United States Patent 10,858,403 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 2

SEQ ID NO: 1124 - DNA, 1361 bp, Ambrosia trifida
aacacaaatttcttaccctgaaatcatccattgccattggctttccattgtcctccaaccaattctcaaatatccatattgcactcacaatcatccttcttcttcactcatagtatatcttcagtttctcataactctcttcacattttattcaatccatcaccatggctgcttctgtaagtgctgtggtctctctaccatcttccaagtccaccattgtttcaaccagaacatcactaatctctcaagaaagagtctcctttaccaaggtaccacattacaaaaatgtgtcaacaagtggtagattgttatcaattagagcccagatcacaacagaggctgagactgaggcacctgctaaagtagagaaaatatcaaagaaacaagaggaaggtgtggttacaaacaaatacagaccaaaggaaccatttgttggtaggtgtcttctcaacaccaagatcactggtgatgatgctcctggtgaaacttggcacatggttttcagcactgaaggtgagatcccgtatagagagggacaatccatcggtgtaattccagacgggattgacccgaaaaacggaaagccacacaaactcagattgtactccattgctagcagtgctattggtgactttggagactccaaaactgtctctttatgtgtgaaaagacttgtctacacaaatgaccaaggcgaagaagttaaaggagtttgctcaaacttcttgtgtgacttaaagcctggatccgaggtgcaaataactggtccagtaggaaaagaaatgcttatgccaaaggatcctaatgctaccattataatgcttgcaacaggaaccggaattgctcctttccgctcatttttgtggaaaatgttcttcgagaagcacgaagactatgaattcaatgggttggcatggcttttcttgggtgttcctacaggcagttccttgttatacaaagaggaatttgagaaaatgaaggagatgaagccagataactttagacttgactttgcagtgagcagagagcaaactaatgacaagggcgaaaagatgtacattcaaaccagaatggcgcagtatgacagagagctatgggaattactcaagaaagacaacacatttgtgtatatgtgtgggcttaagggcatggagaagggtattgatgacattatggtcacattggctgctgaagatggcattgattgggtaacatacaagaagcagttgaagagagaagggcaatggaatgtggaggtttactaagttggctattttcttgtacaaatgcaagcctctctttgtagataggtaacttttttttcattttcttctctttaatttcatcataaaccaagtcta

SEQ ID NO: 1125 - DNA, 1600 bp, Ambrosia trifida
accattcatgatcatatttctatatcttttcctcttcttcttcttcatattattccatcaccatggctgctgctgtaagtgtcgctgtgacgtccctcccttcttccaaatccactgttatttcaactagaacatcacttgtctctcaagatcgtctctctttcaccaaggtaccatattacaaaaatctgtcaacaaatagcaaaccactatcaattagagcccaagtcacaacagaggctgaagctgaagcacctgctaaagtagagaaagtttcaaagaaacaagaagaaggtgtggttacaaacaaataccgcccaaaggaaccatatatcggtaggtgtctactcaacaccaagatcacaggtgatgacgctcctggtgaaacgtggcacatggttttcagcacagaaggtgagatcccatataaagaagggcaatcgatcggtgtaattccggatggaattgaccccaagaatgggaaaccgcacaaactgagattgtattccattgctagcagcgctcttggtgattttggagactccaaaactgtatctttatgcgtgaaaagacttgtctacacgaatgacaaaggcgaagaagttaaaggagtttgctctaacttcttgtgtgacttaaagcctggagctgaggtgcaaataaccggtccagtaggaaaagaaatgctcatgccaaaagatcctaatgctactataataatgcttgcaacaggaactgggattgctccattccgctcatttatgtggaaaatgttctttgagaagcatgaagactatcagttcaatgggttggcatggctctttttgggtgttcccacaagtagttccttgttatataaagaggaattcgagaaaatgaaggagatgaaaccagacaacctaagagtcgactttgctgtgagccgagaacaaaccaacgagaagggtgaaaagatgtacattcaaaccagaatggctcaatatgacagagaattatgggagttactcaagaaagacaacacctttgtgtatatgtgtgggcttaagggtatggagaagggtatagatgacattatgggcacattggctgctgaagatggcattgattgggtaacatacaagaagcagttgaagagagaagggcaatggaatgtggaggtttactaaatggctttgtttcttcatgtacaaatgcagccttctctttgtagataggataaaaggacatgttacgcgcgcacacttaaagggatgtggaatttataacgaggctgtgttagaacgcttcaccaactagacgaatgtaataagtcatggattttgctttcatgtattgagcttttatatgggttcttgtacaaggcattttatgacattagtatgcattcggtttcgatagttatggtggataatgtattgaaacgactagtgaaccgagtcttcaatgaacaatagttcatactatagatctaagtcaattcttgtttgggtgtatacaagcaaaactttaattttgattcagttgtggtagggtctaaatgagaatcaagccaaatataagaaaggaaaaattacatatttcatacttttataaaaaagaa

SEQ ID NO: 1126 - DNA, 1190 bp, Flaveria ramosissima
acactatgtcatccatttcactcacctctcttcactcttcatttcactcaatcaccatggcctctgcagtaagcgctgtggtctcccttccatcttcaaaatccaccaaaatttccaccagaacatcactaatctctcaacaacgagtctccttcaccaaggtgccgtattacaagaatgtgtcttctcgtggtagattgttgtcggttagagctcaagttacaacagaggctgaggcgcctgagaaagtgtcgaagaagcaagaggagggtgtggttacaaacaagtataggccgaaggaaccgtatattggtaggtgtcttctcaacaccaagatcacaggtgatgatgctcctggtgaaacttggcatatggtcttcagcactgagggtgagatcccatataaagaaggacaatccattggtgtaattccagacggaattgaccccaaaaacggaaagccacacaaactaagattgtattctattgctagtagcgctattggtgactttggagactccaaaactgtctctttatgtgtgaaaagacttgtctatacgaatgaccaaggcgaagaagttaaaggagtttgctcaaacttcttgtgtgacttaaagcctggagctgaggtccaaataactggtccagtaggaaaagaaatgcttatgccaaaggatcctaatgctacaattataatgcttgcaacaggaactgggattgctcctttccgttcgtttatgtggaaaatgttcttcgagaagcacgaagactataaattcaatgggttggcatggctctttttgggtgttcccacaagtagttccttgttatataaagaggagtttgagaaaatgaaggagatgaagccagataacctaagagttgactttgcagtgagtagagagcaaactaatgataagggtgaaaagatgtacattcaaaccagaatggctcagtatgacagagagctatgggaattactcaagaaagacaacacttttgtgtatatgtgtgggcttaaaggcatggagaagggtattgatgacatcatgactacattggctgctgaagaaggcattgattgggtacaatacaagaagcaattgaagaaagaaggacaatggaatgtggaggtttactaagtggtttttttcttgtacaaatgcagccctctgtagataggtaacctt

SEQ ID NO: 1127 - DNA, 1377 bp, Flaveria ramosissima
aacctactatgtcatccatttcactcacctctcttcactcttcatttcactcaatcaccatggcctctgcagtaagcgctgtggtctcccttccatcttcaaaatccaccaaaatttccaccagaacatcactaatctctcaacaacgagtctccttcaccaaggtgccgtattacaagaatgtgtcttctcgtggtagattgttgtcggttagagctcaagttacaacagaggctgaggcgcctgagaaagtgtcgaagaagcaagaggagggtgtggttacaaacaagtataggccgaaggaaccgtatattggtaggtgtcttctcaacaccaagatcacaggtgatgatgctcctggtgaaacttggcatatggtcttcagcactgagggtgagatcccatataaagaaggacaatccattggtgtaattccagacggaattgaccccaaaaacggaaagccacacaaactaagattgtattctattgctagtagcgctattggtgactttggagactccaaaactgtctctttatgtgtgaaaagacttgtctatacgaatgaccaaggcgaagaagttaaaggagtttgctcaaacttcttgtgtgacttaaagcctggagctgaggtccaaataactggtccagtaggaaaagaaatgcttatgccaaaggatcctaatgctacaattataatgcttgcaacaggaactgggattgctcctttccgttcgtttatgtggaaaatgttcttcgagaagcacgaagactataaattcaatgggttggcatggctctttttgggtgttcccacaagtagttccttgttatataaagaggagtttgagaaaatgaaggagatgaagccagataacctaagagttgactttgcagtgagtagagagcaaactaatgataagggtgaaaagatgtacattcaaaccagaatggctcagtatgacagagagctatgggaattactcaagaaagacaacacttttgtgtatatgtgtgggcttaaaggcatggagaagggtattgatgacatcatgactacattggctgctgaagaaggcattgattgggtacaatacaagaagcaattgaagaaagaaggacaatggaatgtggaggtttactaagtggtttttttcttgtacaaatgcagccctctgtagataggtaaccttctatttttttttgtaatttgtacttttttttcttttaatttctattataaaccaactctattgttattgggtatccctaaattttagttttctttttccttactttgagggtcattgattatgaaagtatactacaattatggtaaataagattctaccttgaaaagttattttttagactatg

SEQ ID NO: 1128 - DNA, 1419 bp, Arachis hypogaea
aaaaataacacaacataacaacctttcaagtttaaactaccttcacttgacaccaccacttcttttctacattgctctctctcactcttttctgctcaaaaaatggctgccgccgttacggcctcagtctccttcccatctaccaagtctgcctctctctcgagccgcacctccatcgtcgctccggagagagtcgtattcaaaaaggcttcattgcaatggagagatgtttcggtttcaataagagctcaagttacaaccacggagacagagacgacacagacaccaacaaaggtggagaaggagcacaagaagcaggaagaaggtgtggttgtgaacaagttcaagcctaagaacccatacattggaaggtgcttgctcaacactaagatcactggtgatgatgctcctggtgaaacttggcacatggtcttcagcactgagggagaggttccatacagagaagggcaatcaattggggtaattcctgagggagttgacaagaatgggaagcctcataaactcagattgtattccattgccagcagtgcccttggtgactttggagactccaaaactgtttcactatgtgtgaagaggcttgtttacacaaatgaaaatggagagattgtcaaaggagtttgctcaaatttcttgtgtgatttgaagcctggagctgaagtaacaattacaggacctgttgggaaagaaatgcttatgccaaaagatcctaatgccaccatcgtcatgttggcaactggaactggaattgccccattccgctcatttttatggaaaatgttcttcgaaaagcacgacgattacaagttcaatggtttggcatggctcttcttgggtgttcccacaagcagctcactgctttacaaggaggaatttgagaagatgaaggagaaagcacctgagaacttcaggcttgactttgctgtgagcagagagcaaacaaatgagaaaggagagaagatgtacatccaaaccagaatggctgagtatgcagaagagctttgggagttgctcaagaaagataacacttttgtttacatgtgtggacttaaaggaatggagaaaggaattgatgacattatggtctctttggctgctagagatggaattgactggattgagtacaagagacaattgaagaaagcagagcaatggaatgtggaagtgtactaagttcagttgattagatatatcaactcatgctttatgatgaaacaaaatagtcactaccctttctctgcattctgtagataaattaccaacttgtaatttttctttcatgatttgtttttaccatgtttatgtaacaacttcgttggaaaaaaggccttaatttttgagggatgatgcagtatagacaaaattcacaccttaaaaaaaaagaaaaaaacaaaagta

SEQ ID NO: 1129 - DNA, 1290 bp, Platanus occidentalis
ttctctctccagcagagcctctattacctcctctgaaagaatcagcttcaacaagagttgtttgtactccaggaatgtctctattggtgggaaggtagttcctatcagagcccaggtcacgactgaagctcctgctaaagtagtgaagatctccaagaaggatgacgagggtgtgattgttaacaagtataagcccaagaacccttacattggcagatgccttctcaacaccaagatcactggtgacgacgctcccggagagacctggcatatggtcttcagcactgagggggagatcccgtacagagaagggcagtctattggggttattgcagatggtgttgacaagaatgggaagccccacaagctgaggttgtactccattgccagcagtgctcttggggactttggagactccaagactgtttctctgtgtgtgaagcggctagtttacaccaatgataaaggggaaatagttaagggagtctgctcaaatttcctttgtgatttgaaacctgggactgaagtgcaactcacaggacctgtcgggaaagaaatgcttatgcccaaagatcctaatgccaccgtcgtaatgcttgcaactggaactggaattgctccattccgctcattcttgtggaagatgttctttgagaagcacgaagactacaagttcaatggtttggcatggctcttcttgggtgttcccacgagtagttctttgctttacaaggaggaatttgagaagatgaaggagaaatcacccgacaacttcagggttgacttcgccgtaagcagagagcaaacaaatgaaaagggtgagaagatgtacatccaaactcgaatggcccagtatgcagaggaattatgggagttactgaagaaagacaacacctttgtctatatgtgtgggctgaagggaatggagaagggaattgatgacataatggtgtctttggccgctaaagatggcattgattggattgagtacaagaggcagttgaagaaggcggaacagtggaacgtggaagtttattgatatttgctcctctatacaagcatctcctgatccaagaagccatccttatatagtttcctctttgctttgtagataggtaaccttgttttgtaatttgtgtttattttctgataaggtagctgtattattatggcctctgcaaaagttttaccaaagagggattatggatcatacaatgatagtgtggaccaatttcagcctcttgtaagcattctcaacgtcatttgttgatattaatcccatttttcaat

SEQ ID NO: 1130 - DNA, 1371 bp, Helianthus annuus
cgggatagtatatcttcaattcttctgagcactcttcacattttattattcaatcaccatggctgcttcagttagtgctgtggtctcccttccttcttcaaaatccaccattgtttcaaccagaacatcatcattaatctctccagaaagactcaccttcaccaaggtgccacattacaaaaatgtgtcaacaagtggtagattgctatcaattagagcccagatcacaacagaggctgagactgaagcacctgctaaagtagagaagatttcaaagaaacaagaggagggtgtggttacaaacaaatacaaaccaaaggaaccatatgttggtaggtgtcttctcaacaccaagatcacaggtgatgatgctcctggtgaaacctggcacatggttttcagcactgagggtgagatcccgtataaggaaggacaatccatcggtgtagttccagacgggattgacccgaaaaacggaaagccacacaaactgagattgtattccattgctagcagtgctattggtgactttggagactccaaaactgtctccttatgtgtgaaaagacttgtctacacaaatgaccaaggggtagaagttaaaggagtttgctctaacttcttgtgtgacttaaagcctggagctgaggtgcagataaccggtccggtaggaaaagaaatgcttatgccaaaggatcctaatgctacagttatcatgcttggaacaggaaccgggattgctcctttccgctcatttttgtggaaaatgttcttcgagaagcacgaagactatgaattcaatgggttggcatggctcttcttgggtgttcccacaagcagttccttgttatacaaagaggaatttgagaaaatgaaggagttgaagccggataactttagacttgactttgcagtgagcagagagcaaactaatgacaagggtgaaaagatgtacattcaaacccgaatggcgcagtatgacagagagctatgggaattactcaagaaagacaacacctttgtgtatatgtgtgggcttaagggcatggagaagggtattgatgacatcatggctacattggcagctgaagatggcattgaatgggcaacatacaagaagcaattgaagaaagaagggcaatggaatgtggaagtttactaagtggtttattcttgtacaaatgcagccctctctttgtagataggtaaccttttttttttactttttttttgtaatttgacccttttttttttgttttcttccctttaatttatcataaacaaagtctattgttatgggtatccccaaattttagtatttttttttccactttggaggggcattgattatgaaagtatactacaattatg

SEQ ID NO: 1131 - DNA, 1652 bp, Chrysanthemum coronarium
atcgaaagtgtaaaaaagacaacacagatttcttatcctcacatctgcctttgccattggcttttaaatttcctccatccaatttacaaaatatccattcaattcacaatcacatttctagcttcactcatactatatcttcaattttccttagctcacttcattcttcattttattcaccatggcttcctctgttagcgctgttgtctccctttcatcttcaaagaccactgctatttctactagatcatccttcatttctcaagatagagtctcttttgccaaggggccttcttacaaaaatgtgtcaagtggtaaattgttatctattagagcccaagttgcaacagacactgacacacctcctgctaaagtagagaaaatttcaaagaaacaagaggaaggtgtagttgtaaataaattcaggccaaaggagccatatattggtcgatgccttctcaacaccaagatcaccggtgatgatgcacctggtgaaacctggcacatggtcttcagcaccgagggtgaggtcccatacaaggaggggcaatccattggtgtcattccagatggaattgatcccaagaacggcaagccacacaaattgagattgtattccattgctagtagtgcacttggtgattttggagactctaaaactgtctctttatgtgtgaaaagacttgtctacactaatgaccaaggcgtagaagttaaaggagtttgctctaacttcttgtgtgacctaaagcctggtgctgacgtgcaaataactggtccagtaggaaaagagatgcttatgccaaaggaccccaatgcaactgttattatgcttgcaacaggaactggaattgctcctttccgctcatttatgtggaaaatgttctttgagaagcacgaagactatcagttcaatggtttggcatggctctttttgggagttcccacaagtagttccttgttatataaagaggaattcgagaaaatgaaggagataaaacctgataacctacgagttgactttgctgtgagcagagagcaaactaacgagaagggtgaaaagatgtacattcaaactagaatggcacaatacgacagagagctatgggaattactaaagaaggacaacacctttgtgtacatgtgtgggcttaagggtatggagaagggtattgatgacattatggtttcattggctgccgaagatggcattgattgggtaacatacaagaagcagttgaagaaagaaggacaatggaatgtggaagtctactaagtggctttgtttcttctttgtacaaatgcaagccctctctttgtagatagctccggatgaatgtttcgactgcccattcaaaagatataggacgtgtaacgacactaagtgaaagagcttcaccaagaaaatgaatgttataatggtaacatattgttcttcatttctcacaaattataggctatgttgtacttgtctttgatttttatggacccgagatcacaatgttatgttatattgatgacacggtcactgagcagagctatatacgggtggagcttatatgtgacatgttatgccattagtatgcatttgttttagtaacgatcatctcttaaatttgtcagaattacgtcttgaaacagtgtgaaaccat

SEQ ID NO: 1132 - DNA, 1276 bp, Cichorium intybus
ccattggctttccaatttcctccatccaattcacaaatatccattcacttcaccatcgcatttcttcttcactcatagtatatcttccctttctcttagctctcttcactcttcattttgttcgatcaccatggcttctgcagtaagtgccgtagtctcccttccatcttccaaatccgccgtcgtttcaacaagaacatccctcatcactcaagaacgagtctctttcaccaaggtgccatattacaaaaatgcgtcatcgagtgttaaatctttatcgattagagcccaagtcactacagaagctgaggctccccccgctaaagtagagaaaatttcaaagaaacaagaagatggtgttgttacaaataaataccgcccaaaggaaccgtatgttggtaggtgtcttctcaacaccaagatcaccggcgatgatgcccccggtgaaacttggcacatggtcttcaccaccgaaggtgagatcccatatagagaaggacaatccattggtgtgattcctgacggaattgatcccaaaaatggaaagccacacaaactgagattgtactccattgctagcagtgctatcggtgactttggggactccaaaaccgtttcattgtgtgtgaaaagacttgtctacaccaatgacgcaggggaagaagttaaaggagtttgctctaacttcttatgtgacttgaagcctggagcagaggtgcaaataacgggtccagtaggaaaagaaatgcttatgccaaaggatcctaatgcaactattataatgcttgcaacaggaactggtattgctccgtttcgctcatttatgtggaaaatgttctttgagaagcatgaagactataagttcaacggtttggcatggctctttttgggagttcccacaagtagttcgttgctatacaaagaggaatttgagaaaatgaaagagatgaaaccagataatctacgagttgactttgctgtgagcagagagcaaactaacgaaaagggtgaaaagatgtacattcaaactagaatggctcaatatgacagagagctatgggaattactcaagaaagacaacacctttgtgtatatgtgtgggcttaagggcatggagaagggtattgatgacattatgggcacattggctgctgaagatgggattgattgggtaacatacaagaagcagttgaagaaggaagggcaatggaatgtggaggtttactaaatggttttcttcctttttgtacaaatacagccctctctttgtagatag

SEQ ID NO: 1133 - DNA, 1334 bp, Flaveria ramosissima
actcacactatatcacccatttctctcacctctcttcactcttcattttattaaatcaccatggctgctgcagtaagcgctgtggtctcccttccatcttcaaaatccaccacaatttccaccagaacatcactaatctctcaagaacgagtctccttcaccaaggtgccgtgttacaagaatgtgtctactagtggtagattgttgtcggttagagctcaagttacaacagaggctgaggcgcctgcgaaagtagagaaagtgtcgaagaaacaagaggagggtgtggttacaaataagtataggccgaaggaaccgtatactggtaggtgtcttctcaacaccaagatcacaggtgatgatgctcctggtgaaacttggcatatggttttcagcactgaaggtgagatcccatataaagaaggacaatccattggtgtaataccagacgggattgaccccaaaagcggaaagccacacaaactaagattgtattccattgctagcagtgctattggtgacttcggagactccaaaactgtctctttatgtgtgaaaagacttgtctacacgaatgaccaaggcgaagaagttaaaggagtttgctcgaactttctgtgtgacttaaagcctggagctgaggtgcaaataaccggtccagtgggaaaagaaatgcttatgccaaaggatcctaatgctacaattataatgcttgcaacaggaactgggattgctcctttccgctcatttatgtggaaaatgttcttcgagaagcacgaagactataaattcaatgggttggcatggctctttttgggtgttcccacaagtagttccttgttatataaagaggaatttgagaaaatgaaggagatgaagccagataacctaagagttgactttgcagtgagtagagagcaaactaatgataagggtgaaaagatgtacattcaaaccagaatggctcagtatgacagagagctgtgggaattactcaagaaagacaacacttttgtgtatatgtgtgggcttaaaggcatggagaagggtattgatgacatcatgactacattggctgctgaagaaggcattgattgggtacaatacaagaagcaattgaagaaagaaggacaatggaatgtggaggtttactaagtggtttttttcttgtacaaatgcagccctctctttgtagataggtaaccttctattttttgtaatttgtatttttttttttttttaatttcattataaaccaactctattgttattgggtatccccaaattttattcttttccttactttgagggcattgattatgaaagtatactac

SEQ ID NO: 1134 - DNA, 1240 bp, Flaveria ramosissima
tcacactatatcatcgatttctctcagctctctccactcttcattttattcaatcaccatggcctctgcagtaagcgctgtggtctcccttccatcttcaaaatccaccacaatttccaccagaacatcactaatctctcaagaacgagtttctttcaccaaggtgccgtattacaagaatgtgtcaacgagtggtagattgttgtcgattagagctcaagttacaacagaggccgaggcacctgcgaaagtagagaaagtgtcgaagaaacaagaggagggtgtggttacaaataagtataggccgaaggaaccttatattggtaggtgtcttctcaacaccaagatcacaggcgatgatgctcctggtgaaacttggcatatggttttcagcactgagggtgagatcccatataaagaaggacaatccattggtgtaattccagacgggattgaccccaaaaccggaaagccacacaaactaagattgtattccattgctagcagtgctattggtgactttggggattccaaaactgtctcattatgtgtgaaaagacttgtctacacgaatgaccaaggcgaagaagttaaaggagtttgctcgaacttcttatgtgacttaaagcctggagctgaggtgcaaataaccggtccagtgggaaaagaaatgcttatgccaaaggatcctaatgctacaattataatgcttgcaacaggaactgggattgctcctttccgctcatttatgtggaaaatgttcttcgagaagcacgaagactataaattcaatgggttggcatggctctttttgggtgttcccacaagtagttccttgttatataaagaggaatttgagaaaatgaaggatatgaagccagataaccttagagttgactttgcagtgagtagagagcaaactaatgataagggtgaaaagatgtacattcaaaccaggatggctcagtatgacagagagctatgggaattactcaagaaagagaacacttttgtgtatatgtgtgggcttaaagggatggagaagggtattgatgacatcatgactacattggctgctgaagaaggcattgactgggtacaatacaagaagcaattgaagaaagaaggacaatggaatgtggaggtttactaagtggcttttttcttgtacaaatgcagccctctctttgtagataggtaaccttctatttttgtaattttgactcttgttttttttttt

SEQ ID NO: 1135 - DNA, 1421 bp, Manihot esculenta
aatccgctaaatcattttctcccttccttttcctttcatgtttcgtcctttgttttctcattttccttcatagcctcacactcaataaccctcccccctttctctgaaccttgaccatggctgccactgtaaatgctgcagtttcgctccccacaaccaagtcatcttctcttccaagcagaatcgccaacattaacccagaaaaagtcagtttcagcaagggtttcctttactccagaaacgtctatgtggttgggagaaaggttactattagagctcaagtcacaacacaggctcctgctaaagtagaaaaggtgtcaaagaagaatgaggagggcatagttgtcaacaagttcaagcccaagaatccatacactgggacatgtcttctcaacaccaaaattactggagatgatgcccctggagaaacctggcacatggtcttcagtactgagggggaagtgccatatagagaaggccaatccattggtgtcattccagatggtattgacaagaatgggaaaccccacaagctacgtttatattccattgccagtagcgctctgggagactttggcaactctaaaaccgtttctttgtgtgtcaaaaggcttgtctacaccaatgagcaaggagagattgtgaaaggagtctgctcgaatttcttgtgtgacctgaaacctggggctgaagttaaaatcacaggacctgtaggaaaagaaatgcttatgccaaaagatccaaatgccacaatcattatgcttggaactggaactggaattgctcctttccgctcattcttgtggaagatgttctttgagaaacacgaagactacaagttcaatgggttggcttggctcttcttgggtgtcccaaccagcagctcattgctttacaaagaggcaatttgagaagatgaaggagaaggccccagataacttcagagttgattatgctgtgagcagagaacaaacaaatgagcagggtgagaagatgtacattcaaacccgaatggcacaatatgcagaggagttatgggaactactcaaaaaggacaacaccttcgtatatatgtgtgggctcaagggaatggagaaggggattgatgacattatggtgtctttggcagctaaagatggcattgattggattgaatacaagagatcactgaagaagagtgagcaatggaacgttgaagtctattgatttttagcaggcactagccatcaagttgctgaagatcccattattttactgatttcttctcataacatagatatataaattttccctgcattcttttttttttttgttataatctccacttattttcttcttcctcaccgtgaagcaaatgtatcagtatattcaatgccagggtctcgcgcattaaaaagcaaattgaaaattcctcctttctc

SEQ ID NO: 1136 - DNA, 1171 bp, Centaurea maculosa
cggggatcaccaattcaccatggctgcttcactgagtgctgttgtctccctttcatcttccaaatccactgcaatctcaaccagatcaccatctttggtctcccaagaacgagtctccttcgctaaggtgccatattacaagaatgtgtcatcaagtggtaaattgttttcaattagagctcaagtcacaaccgatgttgaggctccgcctgctaaagtagagaaaatttcaaagaaacaagaagagggtgtcgttacaaataaataccgcccaaaggaaccctatgtcggtaggtgccttctcaacaccaagatcaccggtgatgatgcccccggtgagacttggcacatggtcttcagcaccgagggtgagatcccatatagagaggggcaatccattggtgtaattccggacggaattgatcccaagaacggaaagccacacaaactgagattgtattccatcgctagcagtgctattggtgacttcggggactccaaaaccgtctctttatgtgtgaaaagactcgtctacaccaacgaccaaggcgtagaagttaaaggagtttgctccaacttcctttgtgacttaaagccgggagccgaagtggcaatgacgggtccagtaggaaaagaaatgctcatgccaaaggatcctaatgcaactgttataatgcttgcaacagggactgggattgcgccgtttcgctcatttatgtggaaaatgttcttcgagaagcatgaagactatcagtttaacggtttggcatggctctttttgggagttcccacaagcagttccttgttatataaagaggaattcgagaaaatgaaggagatgaaaccggacaacctaagagttgactttgccgtgagtagagagcaaactaacgataagggcgagaagatgtacattcaaacgagaatggcccaatacgacaaagagctatgggaattgctcaagaaagacaacacctttgtgtatatgtgtgggcttaagggcatggagaagggtattgatgacattatggtttcattggctgctgaagatggaattgattggctacaatacaagaagcaattgaagaaagaagggcaatggaatgtggaagtgtactaagtggctttatttcatcttgtacaaaaaatgcagccctctctttgtagatag

SEQ ID NO: 1137 - DNA, 1454 bp, Cirsium arvense
tttcactcatactatatcttccatttctctttgcactcttcacccttcattcaccaattcaccaccatggctgcttctgtgagtgctgttgtctccctttcatcttccaaatccactgctgcaatctcaaccagatcatcatccttggtctcccaagaacgagtctccttcgctaaggtgccatattacaaaaatgtgtcatcaagtggtaaattgttttcaattagagctcaagtcacaaccgatgttgaggctccgcctgctaaagtagagaaaatttcaaagaaacaagaagagggtgtcgttacaaataaataccgcccaaaggaaccctatgtcggtaggtgccttctcaacaccaagatcaccggtgatgatgcccccggtgaaacttggcacatggtcttcagcaccgagggtgagatcccatatagagaggggcaatccattggtgtaattccggacggaattgatcccaagaacggaaagccacacaaactgagattgtattccatcgctagcagtgctatcggtgacttcggggactccaaaaccgtctctttatgtgtgaaaagactcgtctacaccaacgaccaaggcgtagaagttaaaggagtttgctccaacttcctttgtgacttaaagccgggagccgaagtggcaatgacgggtccagtaggaaaagaaatgctcatgccaaaggatcctaatgcaactgttataatgcttgcaacaggaactgggattgccccgtttcgctcatttatgtggaaaatgttcttcgagaagcacgaagactatcagtttaacggtttggcatggctctttttgggagttcccacaagcagttccttgttatataaagaggaattcgagaaaatgaaggagatgaaaccggacaacctaagagttgactttgccgtgagcagagagcaaactaacgataagggcgagaagatgtacattcaaacgagaatggcccaatacgacaaagagctatgggaattgctcaagaaagacaacacctttgtgtatatgtgtgggcttaagggcatggagaagggtattgatgacattatggtttcattggctgctgaagatggaattgattggctacaatacaagaagcaattgaagaaagaagggcaatggaatgtggaagtgtactaagtggctttatttcttcttgtacaaaaaatgcagccctctctttgtagatagctttggatgcttatttcgagcgcccggaaagcaacaagttcataaggaaatggagctcgtacgacattatgtgagagaacttcaccaacaaaacgagcaataataatgttaaagaattgttctgtgtttcacatgatttaacaaattgtggtatatgtatctttgatttcatatatgtattagggtcattctttacattatattaaagaaagggctcaaggggtcgagttgac

SEQ ID NO: 1138 - DNA, 1249 bp, Flaveria ramosissima
tatatcttccatttctcttcactcaccattttattcaatcaccatggctgctgcagtaagcgttgttgtctcccttccatcttccaaatcttctgcaatttcatcaagaacttcacttatccctcaggatcgcgtctcattcaccaaggtgccatattacaaaagtgtatcaacaaatggtaaattgctatcaattagagctcaaatcacaacagaggctgaaaccgaggcacctgctaaagtagagaaagtttcgaagaaacaagaggaaggtgtggttgtaaataaataccgcccaaaggagccgtatatcggtaggtgtcttctcaacaccaagatcactggtgatgatgcccctggtgaaacttggcacatggttttcagcacagaaggtgagatcccatataaagaaggacaatccattggtgtaattccagatgggattgaccccaagagtggaaaaccacacaaactgagattgtattcaattgctagcagtgctcttggtgattttggggactccaaaactgtatctttatgtgtgaaaagacttgtctacacgaatgacaaaggcgaggaagtcaaaggagtttgttctaacttcttgtgtgacttaaagcctggagctgaggtgcaaataactggtccagtaggaaaagaaatgctcatgccaaaggatcctaatgctactatcataatgcttgcaacaggaactgggattgctcccttccgctcattcatgtggaaaatgttcttcgagaagcatgaagactatcagttcaatgggttagcatggctctttttgggtgttcccacaagtagttccttgttatataaagaggaatttgagaaaatgaaggagatgaaaccggataacctaagagttgacttcgcggtgagcagagaacaaaccaatgagaagggtgaaaagatgtacattcaaaccagaatggctcaatatgacagagaattatgggaattactcaagaaagacaacacatttgtgtatatgtgtgggcttaagggtatggagaagggtattgatgacattatgaccacattggctgctgaagagggcattgattggatacaatacaagaagcagttgaagaaggaaggtcaatggaatgtggaggtttactaaatggatttgcttcttcttgtacaaatgcagcctgctctttgtagataggtaaccttcataaacctactatattgttatgggatttcccccaaattttagttttta

SEQ ID NO: 1139 - DNA, 1444 bp, Helianthus annuus
tgcattggctttccattgtcctccaaccaattttcaaatatccatattcacccttgttcttcactcatagtatatcttcaattcttctgagcactcttcacattttattattcaatcaccatggctgcttcagtaagtgctgtggtctcccttccttcttcaaaatccaccattgtttcaaccagaacatcatcattaatctctccagaaagactcaccttcaccaaggtgccacattacaaaaatgtgtcaacaagtggtagattgttatcaattagagctcagatcacaacagaggctgagactgaggcacctgctaaagtagagaagatttcaaagaaacaagaggagggtgtggttacaaacaaatacaaaccaaaggaaccatatgttggtaggtgtcttctcaacaccaagatcacaggtgatgatgctcctggtgaaacttggcacatggttttcagcactgagggtgagatcccgtataaggaaggacaatccatcggtgtagttccagacgggattgacccaaaaaacggaaagccacacaaactgagattgtattccattgctagcagtgctattggtgactttggagactccaaaactgtctctttatgtgtgaaaagacttgtctacacaaatgaccaaggggtagaagttaaaggagtttgctctaacttcttgtgtgacttaaagcctggagctgaggtgcagataaccggtccggtaggaaaagaaatgcttatgccaaaggatcctaatgctacagttatcatgcttggaacaggaactgggattgctcctttccgctcatttttgtggaaaatgttcttcgagaagcacgatgactatgaattcaatgggttggcatggctcttcttgggtgttcctacaagcagttccttgttatacaaagaggaatttgagaaaatgaaggagttgaagccggataactttagacttgactttgcagtgagcagagagcaaactaatgacaagggtgaaaagatgtacattcaaacccgaatggcgcagtatgacagagagctatgggaattactcaagaaagacaacacctttgtgtatatgtgtgggcttaagggcatggagaagggtattgatgacatcatggctacattggctgctgaggatggcattgaatgggcaacatacaagaagcaattgaagaaagaagggcaatggaatgtggaagtttactaagtggttttttacttgtacaaatgcagccctctctttgtagataggtaaccttttttttgtaatttgacctttttttattttcttccctttaatttatcataaacaaagtctattgttatgggtatccccaaattttagttttttttttccactttggaggggcattgattatgaaagtatactacaattatggaaataagatttccttgatatatgtttc

SEQ ID NO: 1140 - DNA, 3266 bp, Cocos nucifera
gggctccccttcggctcccatctcgtttcgcatatatcgccgccttcaatcggcgttctagggtttcttcctcccgcgcttggggtttcgattcctctagcgttccctttgtccccattctagggttgcggttcctctcctcctccttcttcctcctccgaagcttctccagtggcatggtgattcccctgcccaagctgtaaatggcggtcgcgggcttcggggccgtctccaggacccccttctcctaccgcgctcccctcgtactcactttccgccgtgacccccgccggaacttggccaccgccctcgacacggtggccgagcccgactgtctctccaacgacgaacatcctccccccgccttcgctcggccttcttccccgcctccttctcctaatcaaagaggttgcgagggcgtgaaagggccggcgtggaagaaaatgagttccaaggagctcggaattaagacttcgatgatagcaaagccgaccagattggttctgaatgcgcttagaaaggaagggtatgatgtatacctggtgggaggttgtgtgagggatctcattatgaagagaactccaaaggattttgacattataacatcagcggagcttaaagaggttcagaaaacattttcaagatgcaacatagttggaaaacggtttcccatctgccatgtgtattgcagcaactccattgtggaggtttcaagttttagcacccttcaaaaaagccaaacaatgatctgacttattcttccggaagatcagactgtgataagcaagattatattcggtggagaaactgtcttggacgagatttcactataaacgggttgatgtttaatccattctcaaattttgtttatgactacttgggtggcatggaagacctaaaaaagctaaagttcgaactgtaattcctgctcacacttccttccaagaggattgtgctcgcattttacgtgcaattagaattgcagctcgtttagggtttcgtttttcaaaagaaacagcatattctgtgagggatcttgctagctcagtattgggacttgacaagggaagaattctaatggaaatgaattatatgcttgcatatggttcagctgaagcttctttaaggttgctttggagatttgggctcttggaacttctattaccaattcaggcagcatatttcgtttcacaaggatttcgaaggcgagataaacgatctaatatgttactgactttgttcttcaacttggataaacttcttgcgcctaacaggccatgccataacagcttatgggttgggttgttagcatttcatcaagcactggtacgtcaacctcgagatcctttggttgtagccacgttcacccttgctcttcataatggaggagatttggcagaagctgtggaaatagcaagggcaatcacctacccgcatgatgttagctttccagaactgttgcagccacaaagatgggatatggttgacgaattagttaaagaggttgtggatcttgcttctgcggtcaatgctgcactaagttcaatgacagatgattattttgtttcaaaagcaatggcaaaatacccacgagccccatgctccgatatggtatttatccctctgcaagtatatttgagggtttgccggatcgtggagtgtgtcggacatggagacaaggacgaaagcttcattccaaagcagggtggcaagataaactatcatgctttggcccaaggtggactgccagaggttcggcatgtttttgctagggttgtttttgatgccgtctacccctccccctcttccctttaactcttcttccttttacattgtctctcttcctccccctgaattcagaggagaaagtagacaatggcttctgctgcagtaaccgctgcagtgtccctcccatcctccaagtcctcatcccttgccctgcccaccagtagaacctccatctccactactgagaggctcagtctccacaagacatgcttgcacccaagaagtgtgtccacagctgggaagctggtctcagtaagagcccaggtgacaacagagacgcctgccaaggtacagaaggtctccaagaagaacgacgagggtgtcgtcgtcaacaagtataagccgaaggacccatacattgggaggtgcctccttaacaccaaaatcaccggcgatgacgcacccggagaaacgtggcacatggtcttcagcaccgagggcgaggttccatacagagagggacagtccattggtgtgatccctgatggagttgataagaatggaaaaccacacaagctcaggttgtactcaatcgccagcagcgctattggagattttggtgactccaagacagtttctctctgtgtaaagcggcttgtttatactaatgagcaaggggaaatagtgaaaggagtctgctcaaatttcttatgcgacatcaagcctggggctgaagttaagattacagggcctgtagggaaagaaatgctcatgcctaaggatcccaatgcaaccatcataatgcttgccacaggaactgggatagcacctttccgctccttcttgtggaaaatgttctttgagaagcatgatgactacaagttcaatggacttgcgtggctcttcttgggagttcctacaagcagctcattgctctataaggaggaatttgagaagatgaaagagaaggcaccaaataatttcagggtcgactttgctgtaagcagagagcaaacaaatgaaaagggagaaaagatgtacatacagactcgtatggcgcagtacgctgaggaactgtgggatctactcaagaaggacaatacctatgtatatatgtgtggactaaaaggaatggagaagggtattgatgatatcatggtatctttggctgctaaggatggtattgactggctggattacagaaggaacctgaagaggtcagagcagtggaatgtggaagtgtattagcttgcatttttgtgcatgctgtgtaaggagctcatccttctatgatatactctttactctagtcctatgtggataggtaatgttctcttttgtgttttatattagtttcttgtgaggcaactgtattattctggcctcgtgaatttgattcaagagggattttaacattgtaattctagccgaattggataccttgtaatgaacctcagctataattatagtttttgtactacgttcctgcacagagcagtataagtaatttagctttacatgaaagtagaaacatcaaa

SEQ ID NO: 1141 - DNA, 1452 bp, Cleome spinosa
ttagccttctccaccgtagaggcctctcttctgagttcccgcattgtcaagagtgaaggaaaagggccctttggcattctccttctccttctccttctccttcttctgaaaacataatataatacatcaaggcgaacatggcgtctgccataagtactgctgtctctttcccttcctccaactccacttctctctccgccaaggcctcctttctctcccccgatagaattttcctcaggaagggtactctttgttacagagacgcttgtgttgggggcagagtggtgtcagtgagggcgcaggtgacaacagaggtgacagaagcgcctgtgaaggttgagaaggaatcgaagaagcaggaagaagggattgtcgtgaacaagttcaagcccaagaacccttacactggtcgatgcctcttgaacgtcagactcaccggcgacgatgctcccggtgaaacttggcacattgtcttcagcaccgaaggtgaggttccgtacagagaagggcaatcgattggtgtaattccagatgggatagacaagaacgggaagcctcacaagctgaggttatactcaattgccagcagcgccattggtgattttggagactccaagactgtttctctctgcgttaaaagacttgtttacaccaacgagaatggggagctggtcaagggggtctgttcaaatttcttgtgtgacctgaaaccgggcgctgaagccaagatcacaggacctgttgggaaggaaatgcttatgccaaaagatccaaatgccaccgtcatcatgcttgcaacaggaactggaatcgctccattcagatcgttcttgtggaaaaagttctttgaggagcacgaggactacaagttcaatggtctggcatggttgttcttgggggtcccgacaagtagctcactgctctacaaagaggagtttgagaggatgaaggagaaaaacccagaaaacttcaggctggactttgcagtaagcagagagcaaacgaacgaaaagggagagaaaatgtacatacagacgcgtatggctcagtacgcagatgagctctgggagttactgaagaaggacaacacctttgtctacatgtgtgggctcaagggaatggagaagggtattgatgacataatggtctcgcttgctgcccgagacgggatcgattggttggattacaagaagcagttgaagaagaacgagcagtggaacgttgaagtctactgaggtagctttggacacacgtactgtcttgacgaattctcgacgtctttgtgtagataaagccgatgttttgaggggtttccctctttctgcttctcgcttcatcgcttgttcttgaaggattcatatatatgccacttgtgtagcttcttaagttcgagagttcattcatagtctcaacgatcactcgagagcttaataaacttgtgccgttttccca

SEQ ID NO: 1142 - DNA, 1202 bp, Flaveria ramosissima
atgggggactcacactatatcacccatttctctcagctctctccactcttcattttattcaatcaccatggcctctgcagtaagcgctgtggtctccgttccatcttcaaaatccaccacaatttccaccagagcatcactaatctctcaagaacgagtctccttcaccaaggtgccgtgttacaagaatgtgtctactagtggtagattgtcgttgattagagctcaagttacaacagaggctgaggcgcctgcgaaagtagagaaagtgtcgaagaaacaagaggagggtgtggttacaaataagtataggccgaaggaaccgtatattggtaggtgtcttctcaacaccaagatcacaggtgatgatgctcctggtgaaacttggcatatggttttcagcactgagggtgagatcccatataaagaaggacaatccattggtgtaattccagacggaattgaccccaaaaacggaaagccacacaaactaagattgtattccattgctagtagcgctattggtgactttggagactccaaaactgtctctttatgtgtgaaaagacttgtctacacgaatgaccaaggcgaagaagttaaaggagtttgctcgaacttcttgtgtgacttaaagcctggagctgaggtccaaataactggtccagtaggaaaagaaatgcttatgccaaaggatcctaatgctacaattataatgcttgcaacaggaactgggattgctcctttccgctcatttatgtggaaaatgttcttcgagaagcacgaagactataaattcaatgggttggcatggctctttttgggtgttcccacaagtagttccttgttatataaagaggaatttgagaaaatgaaggagatgagccagataacctaagagttgactttgcagtgagtagagagcaaactaatgataagggtgaaaagatgtacattcaaaccagaatggctcagtatgacagagagctgtgggaattactcaagaaagacaacacttttgtgtatatgtgtggacttaaaggcatggagaagggtattgatgacatcatgactacattggctgctgaagaaggcattgattgggtacaatacaagaagcaattgaagaaagaaggacaatggaatgtggaggttactaagtggatttttctgtacaaatgcagccctctctttgtagatag

SEQ ID NO: 1143 - DNA, 1298 bp, Salvia sclarea
ctactagaccttggctgtcactcaaccactttcgctttcccttgctatacttaataataatatcatcacttcaattctctctctctctctcttgatttcttacttcataaccaaaaaatggctgctgctgtaagtgctgcagtctctctccccaccaacaagtctacttctctttcagctagaacctccattgtttctccagaaaggatcaattttaacaaggcatccttgcactaccggaatgtgtcgtctaaggttgctccgattagagctgaggtgagcacagaggcggcacctgcacctgccaagaaggagaagcactccaagaaacaggaagaaggagtagtcgtcaacaagttcaggcctaaggagccctacattggcaaatgcctcttgaacaccaagatcaccggagatgacgcccccggtgaaacctggcacatgctcttcagcactgagggagaggtgccttacagagaaggacagtcaattgggataatccccgatgggatagacaagaacgggaagcctcacaagctgaggttgtactcgattgccagcagcgccctcggtgatctaggagactccaagactgtctctttgtgtgttaagaggctcgtctacaccaatgatcaaggggaagttgtcaaaggagtttgctcaaactttttgtgtgacttgacaccgggtgctgaggttaaaataactggacctgtagggaaagagatgcttctgcctaaagacccgaatgctaccattataatgcttgccaccggaactgggattgctcctttccgctcgtttttgtggaagatgttctttgagaagcatgatgactacaagttcaacggcttagcatggctattcttgggcgttcccacgagcagctcgttgctctacaaagatgaattctcgaaaatgaagagtaaaaatccggacaacttccgggtggactatgccgtgagcagggaagagacgaacgcgaagggagaagatgtacatccagacacggatggccgagtacgcggaggagctgtgggagctgctcaagaaggacaacacctacatttacatgtgtgggctcaagggcatggagaagggcatcgacgacatcatgggctcgttagctgctagagatggtatcgactgggtagagtacaagaggcagttgaagaaaggagagcaatggaatgtggaagtctactaattcttgttgtataaatgtatcagccagcattgtgatttttctctgctgctgtagataggtaacctctttcttttcttttcttcttttgcta

SEQ ID NO: 1144 - DNA, 1616 bp, Trifolium pratense
caacaacaacaacatggctgctgctgtaacagccgccgtctctttcccatactccaacacaacttctctcccgatcaggacatctattgttgccccagatagacttgtctttaagaaggtttcattgaataatgtttctataagtggaagggtaggtaccatcagagcccaagttacaacagaagctgaagcacctgctaaggtagtaaagatatcaaagaaacaggatgaagatattgttgtgaacaagttcaaacccaaggatccatacactgggatgtgtcttctcaacacaaagatcactggtgatgatgcacctggtgaaacttggcacatggttttcaccactgagggagaggttccttacagagaaggacaatccattggaataattccagacggtattgacaagaatggcaaacctcacaagctgagattgtattcaattgctagcagtgctcttggtgattttggagactccaaaactgtttctctatgcgtgaaacgtcttgtgtacacaaatgatgccggagaagttgttaagggagtctgctcaaatttcttgtgcgatttgaagcctggaaatgaagtaaagattactggaccagttggtaaagaaatgcttatgccaaaagatcctaacgccaccgtcatcatgttgggaactggtactggaatcgccccattccgctcattcttatggaaaatgttcttcgagaagcatgatgattacaagttcaatggtttggcatggctcttcctaggtgtccccactagcagctctctgctttataaggaggaatttgaattgatgaaggagaaagcacctgaaaacttcaggcttgactttgctgtgagcagagagcaagtaaacgacaaaggagagaaaatgtacatccaaaccagaatggctcaatatgcagaagagttgtgggaattacttaagaaagacaacacatttgtttacatgtgtggactgaaaggaatggaaaagggaattgatgacatcatggtgtcactcgctgccaaagacggcatcgattggatcgagtacaagagacagttgaagaagtcagagcaatggaacgttgaagtgtattaatttattttcacttgcacagataacaagttccactttgtgcagcaggatatctatataccctcctgcattttgtagatagattacaacccttgtaattttggtatgacaaaaaattataccttgcttgtgaacaatattgtttgtagaatcgttgcaagaaataattttgaggatcatgcaatatagatgaaaccaacttcatcaattttaatgttagttggaggtattgagagaaagggtttgggtgacctgggaagggaagggggatcaaacttgatttggattgtgtgtaatatgattgcacacgtcagccacatcaagatttgacgatttagattacaatgtagattttacatctaaaatacaaagcttaaaatttgaatggtttactcttgaccaaacagtctagatgtggctgactgcctacaaaaacgaggtagaggtcttgatcgcacgcaacctagatccggtcaaaccgatgcatgagctatcaacttatgcacgggtgagatta

SEQ ID NO: 1145 - DNA, 1231 bp, Flaveria ramosissima
tgatcgtatatcttaccatttctcttcactttccattttattcaatcaccatgggccgctgcagtaagcgttgttgtctcccttccatcttccaaatcttctgcaatttcatcaagacatcacttttctctcaggatcgcgtctcattcaccaaggtgccatattacaaaagtgtatcaacaaatggtaaattgctatcaattagagctcaaatcacaacagaggctgaagcagaagcacctgctaaagtagagaaagtttcaaagaaacaagaggagggtgttgttgttaataaataccgcccaaaggagccgtatatcggtaggtgtcttctcaacaccaagatcactggtgatgatgcccctggtgaaacttggcatatggttttcagcacagaaggtgagatcccatataaggaaggacaatccattggtgtgattccagatgggattgaccccaagaatggaaaaccacacaaactgagattgtattcaattgctagcagtgctattggtgatttcggagactccaaaactgtgtctttgtgtgtgaaaagacttgtctacacgaatgacaaaggcgaagaggttaaaggagtttgttctaacttcttgtgtgacttaaagcctggagctgaggtgcaaataactggtccagtaggaaaagaaatgctcatgccaaaggatcctaatgctactatcataatgcttgcaacaggaactgggattgctccattccgctcattcatgtggaaaatgttcttcgagaagcatgaagactatcagttcaatgggttggcatggctatttttgggtgttcccacaagtagttccttgttatataaagaggaatttgagaaaatgaaggagatgaaaccggataacctaagagtcgacttcgcagtgagcagagaacaaaccaatgagaagggtgaaaagatgtacattcaaaccagaatggctcaatatgacagagaattatgggagttactcaagaaagacaacacctttgtgtatatgtgtgggcttaagggtatggagaagggtattgatgacattatgaccacattggctgctgaagagggcattgattgggtacaatacaagaaacagttgaagaaagaaggtcaatggaatgtggaggtttactaaatggctttgtttcatcttgtacaaatgcagcctgctctttgtagataggtaaccttcataaaccaactttattgttatgg

SEQ ID NO: 1146 - DNA, 1271 bp, Centaurea maculosa
tctttcattcaccaattcaccaccatggctgcttcagtgagtgctgttgtctccctttcatcttccaaaagcactgcaatctcaaccagaacttcatctttggtctcccaagaacgagtctccttcgctaaggtgccatattacaagaatgtgtcatcaagtggtaaactattttcagttagagctcaagtcacagctgatgtcgaggctcctcctgctaaagtagagaaaatttcaaagaaacaagaagagggcgtcgttacaaataaataccgcccaaaggaaccctatgtcggtaggtgccttctcaacaccaaaatcaccggcgatgatgcccccggtgaaacttggcacatggtcttcagcaccgagggtgagatcccatacagagaagggcaatctattggtgttattccggacggaattgatcccaagaacggaaagccacacaaactgagattgtattccatcgctagcagtgctatcggtgacttcggagactctaaaaccgtctctttatgtgtgaaaagactcgtctacaccaacgaccaaggcgtagaagttaaaggagtttgctctaacttcctctgtgacttaaagccgggagccgaagtgcaaatgactggtccagttggaaaagaaatgcttatgccaaaggatcctaatgcaactgttataatgcttgcaacaggaactgggattgccccatttcgctcatttatgtggaaaatgttctttgagaagcacgaagactatcagtttaatggtttggcatggctctttttgggagttcccacaagcagttccttgttatataaagaggaattcgagaaaatgaaggagatgaaaccggacaacctaagagttgactttgcggtgagcagagagcaaactaacgataagggcgagaagatgtacattcaaacgagaatggcccaatacgacaaagagctatgggaattgctcaagaaagacaacacctttgtgtatatgtgtgggcttaagggcatggagaagggtattgatgacattatggtttcattggctgctgaagatggcattgattggatacaatacaagaagcaattgaagaaagaagggcaatggaatgtggaggtgtactaagtggctttatttcttcttgtacaaaaaatgcagccctctctttgtagataggtaaccttctatttttgtaagttgcatatttgacgacttctttttatttttcaattttcttctctttaatttcatcaaaaccaagtctatgttat

SEQ ID NO: 1147 - DNA, 1419 bp, Flaveria ramosissima
tgatcgtatatctttcatttctcttcactttccattttattcaatcgccatggctgctgcagtaagcgttgttgtctcccttccatcttccaaatcttctgcaatttcatcaagaacatcacttttctctcaggatcgcgtctcaatcaccaaggttccatattacaaaagtgtatcaacaaatggtaaattgctatcaattagagcccaaatcacaacagaggctgaagcagaagcacctgctaaagtagagaaagtttcaaagaaacaagaggagggtgttgttgttaataaataccgcccaaaggagccgtatatcggtaggtgtcttctcaacaccaagatcactggtgatgatgcccctggtgaaacttggcacatggttttcagcacagagggtgagatcccatataaagaaggacaatccattggtgtgattcctgatgggattgaccccaagaatggaaaaccacacaaactgagattgtattcaattgctagcagtgctattggtgatttcggagactccaaaactgtatctttgtgtgtgaaaagacttgtctacacgaatgacaaaggcgaagaggttaaaggagtttgttctaacttcttgtgtgacttaaagcctggagctgaggtgcaaataactggtccagtaggaaaagaaatgctcatgccaaaggatcctaatgctactatcataatgcttgcaacaggaactgggattgctccattccgctcattcatgtggaaaatgttcttcgagaagcatgaagactatcagttcaatgggttggcatggctatttttgggtgttcccacaagtagttccttgttatataaagaggaatttgagaaaatgaaggagatgaaaccggataacctaagagtcgacttcgcagtgagcagagaacaaaccaatgagaagggtgaaaagatgtacattcaaaccagaatggctcaatatgacagagaactatgggaattactcaagaaagacaacacctttgtgtatatgtgtgggcttaagggtatggagaagggtattgatgacattatgaccacattggctgctgaagagggcattgattgggtacaatacaagaaacagttgaagaaagaaggtcaatggaatgtggaggtttactaaatggctttgtttcttcttgtacaaatgcagcctgctctttgtagataggattaaatgttctgagtgcacgttcaaagggatatggattcgagaatgacactatgtgagcgagcttcaccaactagatgaatgtaataaggtaagttggtagcatattgtttcttgtttctcacttgctataacatatggctttttgtttcatgtgtcgagcttttgtgtgggttcttgtacaaaggattttatgatgttagtatgcattcggttttggt

SEQ ID NO: 1148 - DNA, 1228 bp, Flaveria ramosissima
atcgtatatcttccatttctcttcactttccattttattcaatcaccatggctgctgcagtaagcgttgttgtctcccttccatcttccaaatcttctgcaatttcatcaagaacatcacttttctctcaggatcgcgtctcactcaccaaggtgccatattacaaaagtgtatccacaaatggtaaattgctatcaattagagcccaaatcacaacagaggctgaaacagaagcacctgctaaagtagagaaagtttcaaagaaacaagaggagggtgttgttgttaataaataccgcccaaaggaaccgtatatcggtaggtgtcttctcaacaccaagatcactggtgatgatgcccctggtgaaacttggcacatggttttcagcacagagggtgagatcccatataaagaaggacaatccattggtgtgattcctgatgggattgaccccaagaatggaaaaccacacaaactgagattgtattcaattgctagcagtgctattggtgatttcggagactccaaaactgtgtctttatgtgtgaaaagacttgtctacacgaatgacaaaggcgaagaagttaaaggagtttgttctaacttcttgtgtgacttaaagcctggagctgaggtgcaaataactggtccagtaggaaaagaaatgctcatgccaaaggatcctaatgctacaatcataatgcttgcaacaggaactgggattgctcccttccgctcattcatgtggaaaatgttcttcgagaagcatgaagactatcagttcaatgggttggcatggctatttttgggtgttcccacaagtagttccttgttatataaagaggaatttgagaaaatgaaggagatgaaaccggataacctaagagtcgacttcgcagtgagcagagaacaaaccaatgagaagggtgaaaagatgtacattcaaaccagaatggctcaatatgacagagaactatgggaattactcaagaaagacaacacctttgtgtatatgtgtgggcttaagggtatggagaagggtattgatgacattatgaccacattggctgctgaagagggcattgattgggtacaatacaagaaacagttgaagaaagaaggtcaatggaatgtggaggtttactaaatggctttgtttcttcttgtacaaatgcagcctgctctttgtagataggtaaccttcataaaccaactttattgttatgg

SEQ ID NO: 1149 - DNA, 1209 bp, Flaveria ramosissima
actgatcgtatatcttccatttctcttcactttccattttattcaatcaccatggctgctgcagtaagcgttgttgtctcccttccatcttccaaatcttctgcaatttcatcaagaacatcacttttctctcaggatcgcttctcattcaccaaggtgccatattacaaaagtgtatcaacaaatggtaaattgctatcaattaaagcccaaattacaacagaggctgaagcagaagcacctgctaaagtagagaaagtttcaaagaaacaagaggagggtgtcgttgttaataaataccgcccaaaggagccgtatatcggtaggtgtcttctcaacaccaagatcactggtgatgatgcccctggtgaaacttggcacatggttttcagcacagagggtgagatcccatataaagaaggacaatccattggtgtgattcctgatgggattgaccccaagaatggaaaaccacacaaactgagattgtattcaattgctagcagtgctataggtgatttcggagactccaaaactgtatctttgtgtgtgaaaagacttgtctacacgaatgacaaaggcgaagaagttaaaggagtttgttctaacttcttgtgtgacttaaagcctggagctgaggtgcaaataactggtccagtaggaaaagaaatgctcatgccaaaggatcctaatgctactatcataatgcttgcaacaggaactgggattgctcccttccgctcattcatgtggaaaatgttcttcgagaagcatgaagactatcagttcaatgggttggcatggctatttttgggtgttcccacaagtagttccttgttatataaagaggagtttgagaaaatgaaggagatgaaaccggataacctaagagtcgacttcgcagtgagcagagaacaaaccaatgagaagggtgagaagatgtacattcaaaccagaatggctcaatatgacagagaattatgggagttactcaagaaagacaacacatttgtgtatatgtgtgggcttaagggtatggagaagggtattgatgacattatgaccacattggctgctgaagagggcattgattgggtacaatacaagaaacagttgaagaaagaaggtcaatggaatgtggaggtttactaaatggttttgtttcatcttgtacaaatgcagcctgctctttgtagataggtaaccttc

SEQ ID NO: 1150 - DNA, 1513 bp, Flaveria ramosissima
aatcacaacacaaatttcttatcctcacatcttcctcttccaatttcctccatccaatccacaaatatccacacaattcacaatcatacttcttcttcactgatcgtatatcttccatttctcttcactctccattttgttcaatcaccatggctgctgcagtaagcgttgttgtctcccttccatcttccaaatctactgcaatttcatcaagaacatcacttttctctcaggatcgcgtctcattcaccaaggtgccatattacaaaagtgtatcaacaaatggtaaattgctatcaattagagctcaaatcacaacagaggctgaagcagaggcacctgttaaagtagagaaagtttcgaagaaacaagaggaaggtgtggttgtaaataaataccgcccaaaggagccgtatatcggtaggtgtcttctcaacaccaagatcacaggtgatgatgcccctggtgaaacttggcacatggttttcagcactgagggtgagatcccatataaagaaggacaatccattggtgtgattccagatgggattgaccccaagagtggaaaacctcacaaactgagattgtattcaattgctagcagtgctattggtgatttcggagactccaaaactgtatctttgtgtgtaaaaagacttgtctacacgaacgataaaggcgaagaagttaaaggagtttgttctaacttcttgtgtgacttgaagcctggagctgaggtgcaaataactggtccagtaggaaaagaaatgctcatgccaaaggatcctaatgctacaattataatgcttgcaacaggaactgggattgctccattccgctcgtttatgtggaaaatgttctttgagaagcatgaagactatcagttcaatgggttggcatggctctttttgggtgttcccacaagtagttccttgttgtataaagaggaatttgagaaaatgaaggagatgaaaccagataacctaagagttgactttgcggttagcagagaacaaaccaatgagaagggtgaaaagatgtacattcaaaccagaatggctcaatatgacagagaactatggaaattactcaagaaagacaatacatttgtgtatatgtgtgggcttaagggtatggagaagggtattgatgacattatgaccacactggctgctgaagagggcattgattgggtacaatacaagaaacagttgaagaaagaaggtcaatggaatgtggaggtttactaaatggctttgtttcttcttgtacaaatgcagccttctctttgtagataggataaaaagacaaatgttccgagtgcacgttcaaagggatatggaatcgagaatgacattatgtgagcgagcttcaccgactagatgaatgtaataaggtaagttgataacatattgttccttgtttctcacttgttataacatatggctttttgtttcatgtatcgagcttttgtgtgggttcttgtacaaagtattttatgacattagtatgc

SEQ ID NO: 1151 - DNA, 1324 bp, Flaveria ramosissima
tgatcgtatatctttcatttctcttcactttccattttattcaatcgccatggctgctgcagtaagcgttgttgtctcccttccatcttccaaatcttctgcaatttcatcaagaacatcacttttctctcaggatcgcgtctcattcaccaaggttccatataacaaaagtgtatcaacaaatggtaaattgctatcaattagagcccaaatcacaacagaggctgaagcagaagcacctgctaaagtagagaaagtttcaaagaaacaagaggagggtgttgttgttaataaataccgcccgaaggagccgtatatcggtagatgtcttctcaacaccaagatcactggtgatgatgcccctggtgaaacttggcacatggttttcagcacagagggtgagatcccatataaagaaggacaatccattggtgtgattcctgatgggattgaccccaagaatggaaaaccacacaaactgagattgtattcaattgctagcagtgctattggtgatttcggagactccaaaactgtgtctttatgtgtgaaaagacttgtctacacgaatgacaaaggcgaagaagttaaaggagtttgttctaacttcttgtgtgacttaaagcctggagctgaggtgcaaataactggtccagtaggaaaagaaatgctcatgccaaaggatcctaatgctactatcataatgcttgcaacaggaactgggattgctcccttccgctcattcatgtggaaaatgttcttcgagaagcatgaagactatcagttcaatgggttggcatggctatttttgggtgttcccacaagtagttccttgttatataaagaggaatttgagaaaatgaaggagatgaaaccggataacctaagagtcgacttcgcagtgagcagagaacaaaccaatgagaagggtgaaaagatgtacattcaaaccagaatggctcaatatgacagagaactatgggaattactcaagaaagacaacacctttgtgtatatgtgtgggcttaagggtatggagaagggtattgatgacattatgaccacattggctgctgaagagggcattgattgggtacaatacaagaaacagttgaagaaagaaggtcaatggaatgtggaggtttactaaatggctttgtttcatcttgtacaaatgcagcctgctctttgtagataggtaaccttcataaacctaacttattgttatggtattccctaaactttatttaatttttattatatttttgtaggtatggtaatatagaagtaatataactaattaacaataataagatagcttacg

SEQ ID NO: 1152 - DNA, 1223 bp, Flaveria ramosissima
atcgtatatcttccatttctcttcactttccattttattcaatcaccatggctgctgcagtaagcgttgttgtctcccttccatcttccaaatcttctgcaatttcatcaagaacatcacttttctctcaggatcgcttctcattcaccaaggttccatataacaaaagtgtatcaacaaatggtaaattgctatcaattagagcccaaatcacaacagaggctgaagcagaagcacctgctaaagtagagaaagtttcaaagaaacaagaggagggtgttgttgttaataaataccgcccgaaggagccgtatatcggtagatgtcttctcaacaccaagatcactggtgatgatgcccctggtgaaacttggcacatggttttcagcacagagggtgagatcccatataaagaaggacaatccattggtgtgattcctgatgggattgaccccaagaatggaaaaccacacaaactgagattgtattcaattgctagcagtgctattggtgatttcggagactccaaaactgtgtctttatgtgtgaaaagacttgtctacacgaatgacaaaggcgaagaagttaaaggagtttgttctaacttcttgtgtgacttaaagcctggagctgaggtgcaaataactggtccagtaggaaaagaaatgctcatgccaaaggatcctaacgctactatcataatgcttgcaacaggaactgggattgctcccttccgctcattcatgtggaaaatgttcttcgagaagcatgaagactatcagttcaatgggttggcatggctatttttgggtgttcccacaagtagttccttgttatataaagaggaatttgagaaaatgaaggagatgaaaccggataacctaagagtcgacttcgcagtgagcagagaacaaaccaatgagaagggtgagaagatgtacattcaaaccagaatggctcaatatgacagagaattatgggagttactcaagaaagacaacacctttgtgtatatgtgtgggcttaagggtatggagaagggtattgatgacattatgaccacattggctgctgaagagggcattgattgggtacaatacaagaaacagttgaagaaagaaggtcaatggaatgtggaggtttactaaatggctttgtttcatcttgtacaaatgcagcctgctctttgtagataggtaaccttcataaaccaactttattgt

SEQ ID NO: 1153 - DNA, 1186 bp, Flaveria ramosissima
aatcaccatggctgctgcagtaagcgttgttgtctcccttccatcttccaaatcttctgcaatttcatcaagaacatcacttttctctcaggatcgcttctcattcaccaaggttccatataacaaaagtgtatcaacaaatggtaaattgctatcaattagagcccaaatcacaacagaggctgaagcagaagcacctgctaaagtagagaaagtttcaaagaaacaagaggagggtgttgttgttaataaataccgcccgaaggagccgtatatcggtagatgtcttctcaacaccaagatcactggtgatgatgcccctggtgaaacttggcacatggttttcagcacagagggtgagatcccatataaagaaggacaatccattggtgtgattcctgatgggattgaccccaagaatggaaaaccacacaaactgagattgtattcaattgctagcagtgctattggtgatttcggagactccaaaactgtatctttgtgtgtgaaaagacttgtctacacgaatgacaaaggcgaagaggttaaaggagtttgttctaacttcttgtgtgacttaaagcctggagctgaggtgcaaataactggtccagtaggaaaagaaatgctcatgccaaaggatcctaatgctactatcataatgcttgcaacaggaactgggattgctcccttccgctcattcatgtggaaaatgttcttcgagaagcatgaagactatcagttcaatgggttggcatggctatttttgggtgttcccacaagtagttccttgttatataaagaggaatttgagaaaatgaaggagatgaaaccggataacctaagagtcgacttcgcagtgagcagagaacaaaccaatgagaagggtgagaagatgtacattcaaaccagaatggctcaatatgacagagaattatgggagttactcaagaaagacaacacctttgtgtatatgtgtgggcttaagggtatggagaagggtattgatgacattatgaccacattggctgctgaagagggcattgattggatacaatacaagaagcagttgaagaaggaaggtcaatggaatgttgaggtttactaaatggctttgtttcatcttgtacaaatgcagcctgctctttgtagataggtaaccttcataaaccaactttattgttat

SEQ ID NO: 1154 - DNA, 1780 bp, Fragaria vesca
ggcactgttgtgaatcaaaaatcaaaaccaaggtgcggtgagactgtgagagtcatacattacaaaaagacttatcctcacatctgccactgcattggcctcaaatctctaccaccaatctatgatccagtacccataaaaaaaaaatcccaatttttctctcatactaacaccattcacaaccccataaaacatcacacattgcttctatctgtctcttcttcttcttcttctcctcttaacacaaagccatggctgcagctgtaactgctgctgtttcattcccatcatccaagtcttccactctccccaccagaacctcccttatctgccctgaaagaatcacccttaagaaggtttatagagaagcttctgctagtgggagagtggtatctgtcagagcccaggtcaccaccactgaggctgctccacctgccaaggctgtgaagcattccaagaagcaagaggaaggtgtggttgtgaacaagtacaaacctaagaacccttacactggcagagtcctcctcaacactaagatcactggtgatgatgcacccggtgaaacctggcacatggtcttcagcactgatggagagatgccctacagagaaggccagtctattggagtgattccagatggtattgaccctaagaatgggaagcctcacaagctcaggctctactcaattgccagcagtgcccttggtgacttcggtgactccaaaactgtttctctctgtgtgaaaaggcttgtgtacaccaatgaggcaggcgaaactgttaaaggggtgtgctcaaactttttgtgtgacttgaagccagggggtgaagtgaccatgacaggaccagttggtaaagaaatgcttatgccaaaagatcctaatgcaaccatcgtcatgcttgcaactggtactggaattgctccattcagatcattcttgtggaaaatgttctttgagaagcacgaagactacaagtttgaaggtttggcttggctcttcttgggtgttcccacaagtagctcactgctttacaaggaggaatttgagaagatgaaagagaaggcccccgataacttcagacttgacttcgctgtcagcagagagcaaaccaacgagaagggcgagaagatgtacattcaaaccagaatggctcagtatgcagaagagctatgggagttgctcaagaaggacaacacctacatctacatgtgtggtctcaagggaatggagaagggtattgatgacatcatggtgtcattggctgccaaagatggcattgactggctagactacaagaagcagttgaagaaagcagagcaatggaatgtggaagtctactaatttctggtcactttgtacaaatatctctccttttactataaacaagccattcttgaatgattcccactgcagtatgtagataggtaaagtaattgcaattttcctgctatatctttttttttttccttttgatgaagcagctgtattatcttgcctcgacatgaatttcatttctgaggatcacgaatcatacactctaatagaaagcttgtttcctcttgttcatacgttttttgttcaagggtagttcttcaacagccaagtatcatatgattgctgtggcatttgatcatagctagaaaaagactcatgccaattgccttgtatgtatttgcgtcttgttctattatttggcaccagaaaattaagtaattatgggggactgaattataaattactgtactacgaatgtcttaatttggtgttcacaaaatcag

SEQ ID NO: 1155 - DNA, 1143 bp, Nicotiana tabacum
gcccaggtgacaacagaggctcctgctaaagttgagaagatttcaaagaaacaagatgagggtgtagttgtaaacaaattcaggccaaaggaaccttacgttggtagatgtctactcaacactaagatcactggtgatgatgctcctggtgaaacttggcacatggtctttagcactgagggagagatcccatacagagaaggacaatccattggtgtgattgctgatggtgttgatgccaatgggaagcctcacaagcttagattgtactccattgctagcagtgcccttggtgacttcggcgactccaaaaccgtttctctgtgcgtcaaaaggcttgtctacaccaatgacaaaggggaagaagttaaaggagtttgctctaacttcttatgtgacttgaaacctggagctgaggtcaacattactggacctgttgggaaagaaatgctcatgcctaaagatccaaatgccaccgttgttatgcttgcaactggaactggaattgctcctttccgttcattcttgtggaaaatgttctttgagaaacatgaggattacaagttcaacggtttggcatggcttttcttgggtgttcccaccagcagctcactactttacaaggaggaattcgagaaaatgaaggagaaggccccggaaaactttagactggactttgcagtgagcagagaacaaacaaacgaaaaaggcgaaaagatgtacatccaaaccagaatggctcagtatgcagaagaactatggggtctgctacagaaagacaacaccttcgtttacatgtgtggactcaagggcatggagtccggaattgatgacattatgacttcacttgctgctagagatggtattgtatgggcggactacaagaagcaattgaagaaggcagagcaatggaatgtggaagtctactaaatatttttggttttctttgtataaatatgagccaactttatgcttctctacccttcatccatgtagataggtaaatttttccttttaaattaattttcatttttttggattttccttttcttgtaatttcatcactaaatgaatcagtgtattggcattggccctctaaaagttgaattgatggcatggatcaataacatatagctgaatcaa

SEQ ID NO: 1156 - DNA, 1477 bp, Gossypium hirsutum
gggatctacttttttcatgccactcttattccctttttcattaggttctacttgacttaagttcttcctccacttgaaggcctcaattcagtcttctctttttttctgtgcgtgtaaacaatggcgatgactgtaaatgcagcagtatctctcccatcttccaagtcatctaccctgtcatttaaaaactcagtcactgtccctgaaagaatcaacttcaacaagagtgttttgtacccaaaaaatgtcagccttggtggaaatgtggtttccattagagctcaggtcactacagaagctcctgcaaaagcaccaaaaatttccaagaaagatgatgagggtattgttgtgaacaagttcaaaccaaaggaaccctacattggaaagtgcctcctcaacaccaaaattaccggagatgatgctccaggagagacttggcacatggtttttagtaccgaaggggaagtaccatacagagaaggacaatccattggtgtcatcccagatggtattgacaagaacggaaaaccccacaaacttagattgtactctattgctagcagtgctttgggagattttggcaattctcaaactgtttccttgtgtgtgaaaaggcttgtctacaccaacgaacaaggagagatagtgaaaggagtttgctccaatttcctgtgtgacttgaagcctggtgctgaagtgaagatcacagggcctgttgggaaagagatgctcttgccaaaagatccaaatgccaccatcataatgctcgcaactggaactggaattgctcctttccgttcattcttgtggaagatgttcttcgaaaagcacgacgactacaagttcaacggattggcttggctcttcttgggtgttcccaccagtagctcactgctctacccagaggaatttgagaagatgaaggagaaggcaccaaataacctcagggtggattatgcgattagtagagaacaaacaaatgagcagggtgagaagatgtatattcaaacccgaatggcccaatatgctgaagaactttgggaattgcttaagaaagataacacctatgtctacatgtgcgggctgaagggaatggaaaagggaatcgacgatatcatgacttctttggctgccaaagatggtattgattggattgaatacaagagacaaatgaagaaaggagaacaatggaacgttgaagtctactgatctaggtgggattttgctattcagtcatttccttgcttctctctgcaccatctctttttgaacttgtttgatgctgtagaagttgaattatcaactcaactcataaattcttgcctcagaacaggttgtatagtgcaaatttgaaggagataacttcgtatcctgtaatatcctcctttttttttctttttggtctaattattgtatttgtccttttacaattttaacatttattttctccacataattttatctccaaattgataca

SEQ ID NO: 1157 - DNA, 1383 bp, Gossypium hirsutum
ctacttgactcaagttcttcctccacttgaaggccacaattcatcctctttttttccttgtgcttgtaaacaatggctatgactgtaaatgcagcagtatctcttccatcttccaagtcatctaccctgtcatttaaaaactcagtcactgtccctgaaagaatcaacttcaacaagagtgttttgtacccaaaaaatgtcagccttggtggaaatgtggtttccattagagctcaggtcactacagaagctcctgcaaaagcaccaaaaatttccaagaaagatgacgagggtattgttgtgaacaagttcaaaccaaaggaaccctacattggaaagtgcctcctcaacaccaaaattaccggagatgatgctccaggagagacttggcacatggtttttagtaccgaaggggaagtaccatacagagaaggacaatccattggtgtcatcccagatggtattgacaagaacggaaaaccccacaaacttagattgtactctattgctagcagtgctttgggagattttggcaattctcaaactgtttccttgtgtgtgaaaaggcttgtctacaccaacgaacaaggagagatagtgaaaggagtttgctccaatttcctgtgtgacttgaagcctggtgctgaagtgaagatcacagggcctgttgggaaagagatgctcttgccaaaagatccaaatgccaccatcataatgctcgctactggaactggaattgctcctttccgttcattcttgtggaagatgttcttcgaaaagcacgacgactacaagttcaacggattggcttggctcttcttgggtgttcccaccagtagctcactgctctacccagaggaatttgagaagatgaaggagaaggcaccaaataacctcagggtggattatgcgattagtagagaacagacaaatgagcagggtgagaagatgtatattcaaacccgaatggcccaatatgctgaagaactttgggaattgcttaagaaagataacacctatgtctacatgtgcgggctgaagggaatggaaaagggaatcgacgatatcatgacttctttggctgccaaagatggtattgattggattgaatacaagagacaaatgaagaaaggagaacaatggaacgttgaagtctactgatctaggtgggattttgccattcagtcatttccttgcttctctctgcaccatctctttttgaacttgtttgatgctgtagaagttgaattatcaactcaactcataaattcttgcctcagaacaggttgtatagtgcaaatttgaaggagataagttcgtatcctgtaatatcctttcttttttcttttggtctaattattgtttttgtccttggacaatttt

SEQ ID NO: 1158 - DNA, 1583 bp, Gossypium raimondii
caaatgcatctcccaagaatctaaaccgagaatactttccaaccatagatactaaactgccactgaatttgtcctcctctctcatccaaccaatctgtaatcctttcccatactttttttttgtcttttttatttcctttttcaatttggttctacttgacttaagttcttcctccacttgaaggcctcaattcagtcttctctttttttctgtgcgtgtaaacaatggcgatgactgtaaatgcagcagtatctctcccatcttccaagtcatctaccctgtcatttaaaaactcagtcactgtccctgaaagaatcaacttcaacaagagtgttttgtacccaaaaaatgtcagccttggtggaaatgtggtttccattagagctcaggtcactacagaagctcctgcaaaagcaccaaaaatttccaagaaagatgatgagggtattgttgtgaacaagttcaaaccaaaggaaccctacattggaaagtgcctcctcaacaccaaaattaccggagatgatgctccaggagagacttggcacatggtttttagtaccgaaggggaagtaccatacagagaaggacaatccattggtgtcatcccagatggtattgacaagaacggaaaaccccacaaacttagattgtactctattgctagcagtgctttgggagattttggcaattctcaaactgtttccttgtgtgtgaaaaggcttgtctacaccaacgaacaaggagagatagtgaaaggagtttgctccaatttcctgtgtgacttgaagcctggtgctgaagtgaagatcacagggcctgttgggaaagagatgctcttgccaaaagatccaaatgccaccatcataatgctcgcaactggaactggaattgctcctttccgttcattcttgtggaagatgttcttcgaaaagcacgacgactacaagttcaacggattggcttggctcttcttgggtgttcccaccagtagctcactgctctacccagaggaatttgagaagatgaaggagaaggcaccaaataacctcagggtggattatgcgattagtagagaacaaacaaatgagcagggtgagaagatgtatattcaaacccgaatggcccaatatgctgaagaactttgggaattgcttaagaaagataacacctatgtctacatgtgcgggctgaagggaatggaaaagggaatcgacgatatcatgacttctttggctgccaaagatggtattgattggattgaatacaagagacaaatgaagaaaggagaacaatggaacgttgaagtctactgatctaggtgggattttgctattcagtcatttccttgcttctctctgcaccatctctttttgaacttgtttgatgctgtagaagttgaattatcaactcaactcataaattcttgcctcagaacaggttgtatagtgcaaatttgaaggagataagttcgtatcctgtaatatccttcttcttttttcttttggtctaattattgtttttgtccttttacaattttaacatttgttttttccacgtaatttgatctccaaattgatacatt

SEQ ID NO: 1159 - DNA, 1489 bp, Eutrema halophilum
gatctttttgcttattatcataattttttattttttttgtttttgcccagaagaaagacagaggcccatctctagttcttccattgtgatcaaacatggctgctgctataagcgctgcagtctctttcccttcctctaagtcctctactctccccaccaaaacatccttcgtctcccatcaaaggattttcctcaacaagagcacactgtgttacagagacgcctgtattgggggcagagtagtttcagtgaaggctcaggtgacaacagaggcgccagtgaaagtagagaaggagtcaaagaaacaggaagaaggaattgttgtcaacaaattcaaacctaagaacccttacaccggtcgatgcctcttgaacaccaggatcaccggcgatgacgctcccggtgaaacctggcacattgtcttcagcaccgatggtgaggttccgtatagagaagggcaatcgataggagtgattccagaggggattgacaagaacggcaaaccccacaagctgaggctatactcaatcgccagcagtgccattggtgacttcggagactccaaaaccgtttctctctgtgtcaagagactggtttacacaaacgataatggagagcttgtcaagggagtctgctccaacttcttgtgtgacttgaagccgggtgatgaagcaaagatcactggacctgttggaaaggaaatgcttatgccaaaagacccaaatgccaccgtcatcatgcttggaaccggaactggaatagctccgttcagatcatttttgtggaaaatgttctttgaggagcatgaggactacaagttcaacggtttggcatggctcttcttgggtgtaccaacaagcagctcgctgctctacaaggaggagtttgagaagatgaaggagaagaatccagaaaacttcaggctggactttgcggtgagcagagagcagacgaacgacaagggagagaaaatgtacattcagacaagaatggcagagtatgcagaagagctgtgggagttactgaagaaagacaacacctttgtttacatgtgtggtcttaagggtatggagaagggaatcgatgagattatggtctcacttgctgctaaagatgggatcgattggttggagtacaagaagcaattgaagaggagtgagcagtggaatgttgaagtctattaaggaagcttgtgaggggtttattattattatgaattatgtagataaagctgatgcattgtcaattcgtcaaatcctgctactttcttcttccttcacttgttcttgatggaagaatttcatcataagaaagcatcattacccaccaaactactctttcttgaaacaatacattgtattttgatgatatcagacttttcagagataataataataatatatataaatagagagagagagatggattagaggagcaataagtgtactaagactaaggagacgtgttctatataagagataattgtgga

SEQ ID NO: 1160 - DNA, 1340 bp, Eutrema parvulum
attttctttgatccttttttgccagaagaaagacagaggcccatctctagttcttccattgtgatcaaacatggctgctgctataagcgctgcagtctctttcccttcctctaagtcctctactctccccaccaaaacatccttcgtctcccatcaaaggattttcctcaacaagagcacactgtgttacagagacgcctgtattgggggcagagtagtttcagtgaaggctcaggtgacaacagaggcgccagtgaaagtagagaaggagtcaaagaaacaggaagaaggaattgttgtcaacaaattcaaacctaagaacccttacaccggtcgatgcctcttgaacaccaggatcaccggcgatgacgctcccggtgaaacctggcacattgtcttcagcaccgatggtgaggttccgtatagagaagggcaatcgataggagtgattccagagggaattgacaagaacggcaaaccccacaagctgaggctatactcaatcgccagcagtgccattggtgacttcggagactccaaaaccgtttctctctgtgtcaagagactggtttacacaaacgataatggagagcttgtcaagggagtctgctccaacttcttgtgtgacttgaagccgggtgatgaagcaaagatcactggacctgttggaaaggaaatgcttatgccaaaagacccaaatgccaccgtcatcatgcttggaaccggaactggaatagctccgttcagatcatttttgtggaaaatgttctttgaggagcatgaggactacaagttcaacggtttggcatggctcttcttgggtgtaccaacaagcagctcgctgctctacaaggaggagtttgagaagatgaaggagaagaatccagaaaacttcaggctggactttgcggtgagcagagagcagacgaacgacaagggagagaaaatgtacattcagacaagaatggcagagtatgcagaagagctgtgggagttactgaagaaagacaacacctttgtttacatgtgtggtcttaagggtatggagaagggaatcgatgagattatggtctcacttgctgctaaagatgggatcgattggttggagtacaagaagcaattgaagaggagtgagcagtggaatgttgaagtctattaaggaagcttgtgaggggtttattattattatgaattatgtagataaagctgatgcattgtcaattcgtcaaatcctgctactttcttcttccttcacttgttcttgatggaagaatttcatcataagaaagcatcattacccaccaaattactctttctcacttcctattcatcttatattt

SEQ ID NO: 1161 - DNA, 1356 bp, Amaranthus tuberculatus
gcagttcctttccctacaaccaagtcatcaaatctctccactagaacttcttctatcatctcaactgacaagatcagctacaaaaaggttcctttgtaccacagaaatgcatgtggtgtgggtaaagtgggggccattagagcccaagtgacctcagatgtggcagctcctcctgcaaaagttgagaagcattctaagaaaatggaggaaggagttgttttaaacaagtataagcctaaagaaccttacgttggaaggtgtctccttaacactaaaattactggggatgatgctcctggggagacttggcacatggttttttcccatgaaggagaggttccttacagagaggggcagtctattggagtcattgccgatggtgttgacaagaatggaaagcctcataagttgagattgtactcaattgccagcagtgcccttggtgattttggtgattctaaaactgtttcgttgtgtgtaaaacgacttgtctacaccaatgaggctggagaaatagtcaagggagtctgctcgaactacttatgtgacttgaaacccggtgctgaagtgaagataacagggccagttggaaaggagatgctgatgcctaaagaccccaatgcaactattatcatgcttgcaactggaactggaattgctcctttccgttcgttcttgtggaagatgtttttcgaaaagcatgatgattacaagtttaacggcttggcttggctgtttttgggtgtacccacaagcagttctctgctctacaaagaggaatttgaaaagatgaaagagaaggctccagaaaacttcaggctagattttgctgtgagccgtgagcagactaacgagaaaggagagaagatgtacatccaaactcgtatggcacaatacgacaaggagctatgggaattgctcaagaaagataatacttacgtctacatgtgtggactcaagggaatggagaaaggaatcgatgatatcatggttccattggctgctgctgaggggatcgattggattgaatacaagaggcaattgaagaaggcagagcagtggaacgttgaagtctactgaaaacccatgtaaaataatcccagtttctcactgcaccttgtagttaggtcagttttttctcaatactattatcatcatcatagcataaaacttgtgttcggaagcccagtgtttgagctaatatagtgaaactcattttaagcatttgtacttggagaatattcattttcaacaattgtgtttaagctagattaaggctttcggattgttgtatgctttgcaaatatgaacaaacctaataacgttgagctttatcgattgtttaggatattcttt

SEQ ID NO: 1162 - DNA, 1385 bp, Ambrosia trifida
ctcatagtatatcttcagtttctcataactctctacacattttattcaatccatcaccatggctgcttcagtaagtgctgtggtctctctaccatcttccaaagccaccattgtttcaaccaggacatcattaatctctcaagaaagagtctccttcaccaaggtaccacattacaaaaatgtgtcaacaagtggtagatttttatcaattagagcccagatcacaacagaggctgaggcacctgctaaagtagagaaaatatcaaagaaacaagaggagggtgtggttacaaacaaatacagaccaaaggaaccatatgttggtaggtgtcttctcaacaccaagatcacaggtgatgatgctcctggtgaaacttggcacatggttttcagcactgagggtgagattccgtataaagaaggacaatccatcggtgtaattccagacgggattgacccgaaaaacggaaagccacacaaactcagattgtactccattgctagcagtgctattggtgactttggagactccaaaactgtatctttatgtgtgaaaagacttatctacacaaatgaccaaggtgtagaagttaaaggagtttgctcaaacttcttgtgtgacttaaagcctggatccgaggtgcaaataaccggtccagtaggaaaagaaatgcttatgccaaaggatcctaatgctaccattataatgcttgcaacaggaaccggaattgctcctttccgctcatttttgtggaaaatgttcttcgagaagcacgaagactatgaattcaatgggttggcatggcttttcttgggtgttcctacaggcagttccttgttatacaaagaggaatttgagaaaatgaaggacatgaagccagacaactttagacttgactttgcagtgagcagagagcaaactaatgagaagggcgaaaagatgtacattcaaactagaatggcgcagtacgacagagagctatgggaattactcaagaaagacaacacatatgtgtatatgtgtgggcttaagggcatggagaagggtattgatgacattatggtcacattggctgctgaagatggcattgattgggtaacatacaagaagcagttgaagagagaagggcaatggaatgtggaggtttactaagttggctattttcttgtacaaatgcaagcctctctttgtagataggtaacctttttttttttcattttcttctctttaatttcatcataaaccaagtctattgttatgggtatccccaaattgattatgaaagtatactacaattatggaaataagattcttcctgaaatatgttttattggcatgtttatgtaccatagcatattactttattctaagtgacaaaaaagaa

SEQ ID NO: 1163 - DNA, 1388 bp, Vicia sativa
ttctctttctccttcttctagattcttccatcaacaacaatcatggctgctgcagttacagccgcagtctccttgccatactccaactccacttctcttccgatcaggacatctattgttgcaccagagagacttgtcttcaaaaaggtttcattgaacaatgtttctataagtggaagggtaggtaccatcagagctcagattactactactactactgagactgtggcacctgttacgaaggtagtaaagcattcaaagaaacaagatgaaggtatcgttgtgaacaagttcaaacccaaggaaccatacgttgggaggtgtcttctcaacacaaagatcactggtgatgatgcacctggtgaaacttggcacatggttttcaccactgagggagcggttccttacagagaaggacaatcaattgggatagttccagatggtattgacaagaatggcaagcctcacaagctgagattgtattcaattgctagcagtgccattggtgattttggagactccaaaactgtttctctatgtgtgaaacgtctcgtgtacacaaatgatgccggagaggttgttaagggagtttgctcaaatttcttgtgtgatttgaagcccggatcagaagtaaagattactggaccagttggtaaagaaatgcttatgcccaaagatcctaatgccactgtcatcatgttgggaactggaactggaatcgccccatttcgctcatttttatggaaaatgttctttgagaagcatgaagattacaagttcaatggtttggcatggctcttccttggtgtccctacaagcagctcactgctctataaggaggaatttgaaaagatgaaggagaaagcacctgagaacttcaggcttgactttgcagtgagcagagaacaagttaacgataaaggagagaaaatgtacatccaaaccagaatggctcaatatgcagaagagttatgggagttactgaagaaagacaacacttttgtttacatgtgtggactgaaaggaatggaaaagggaattgatgacataatggtgtcactcgctgccaaagacggtatcgattggatcgagtacaagagaacgttgaagaaggcggaacaatggaatgtcgaagtctattaatttcttttcacttgcattgataacaagttccactttgtgcagcatcttatctatatcaccctcttgtattctgtagataggttacattacaaccctgtaattttggtatgacaaaaaattataccttgcttgtgaacaatattgtttacggaatcgttgcaagaaataattttgaggatcatgcagtatagatgaaaccgactttatcgatttcctgaaatttaaatgtgaatattcagtatcta

SEQ ID NO: 1164 - DNA, 1381 bp, Chenopodium quinoa
cttcactactaataaaactactcaaattttctcattttcctttcatttcttcttcttcttcctccaattcccattttactccgccatggctgccgccgtcaccgccgccgtatctttcccttccaccaccaaatcatcctctctctcctccagaacttcctccatcatttcccctgacaaaatcagctacaaaaaggttcctctgtattacagaaatgtatctgcaacagggaaagtgggacccattagggcccagatcacatctgacgtggaggcaccacctcctgctaaggttgagaagcattcaaagaaaatggaggaaggtattgtagtgaacaagtacaagcctaagaacccttacattggaagatgtcttcttaacactaaaattactggggatgatgcacctggagagacctggcatatggttttttcccatgagggagagatcccttatagagaagggcaatctgttggggtcattccagatggtgaagacaagaatggaaagccccataagttgaggttgtactcgattgccagcagtgctcttggtgactttggtgatgctaaaactgtttcgttgtgtgtaaaacgacttatctacaccaatgatgctggagaaactgtcaagggagtctgctcgaacttcttgtgtgacttgaagcctggtgctgaagtgaagttaacagggccggttggaaaggagatgttgatgcccaaagaccctaatgccacaattatcatgcttggaactggaactggaattgctcctttccgttcattcttgtggaagatgttcttcgaaaagcacgatgattacaagtttaacggcttggcttggctcttcttgggtgtacccactagcagttctctgctctacaaagaggaatttgagaagatgaaggagaaggctccagacaacttcagactagattttgctgtcagcagagagcagacaaatgagaacggagagaagatgtacattcaaacccgtatggcacaatatgccaacgaactgtgggaaatgttgaagaaagataacacttacgtctacatgtgtgggcttaagggaatggaaaagggaatcgatgacattatgggttcattggctgctgccgaaggcatcgattggcttgaatacaagaggacactgaagaaggcagaacaatggaatgtggaagtctactgataactcttgtacaaacatctcttattcctttttgtgaagcagctatatttattacctatttttcactgcaccttgtagataggtcagtttttttccttatattgtattgacgataagccattgcattttagcgccatagcataaaactcttgtcagaagactagcattcagctaatataatgaaaatca

SEQ ID NO: 1165 - DNA, 1467 bp, Fagopyrum esculentum
tacataatccatttaatgtaaaaattcctaactatttttcctacctttgtcagtttatttttatgattttatctcaagggaatcacatccattgtctcttttcatcatttcattcgtcatcttcttcttctagatccatctctgaagaagtcatggctgccgccgtgacagccgccgtgtctttcccttgcaccaccaaatccaccaatctctcatccagaccgtccatctcaccagacaaaatttcctacaactacaagaagatctcattacaatacaacaggggaaatggatcagttggattcatcagagcacaaatcaccacagatgcaccaccaccaccagtcaaggttgagaaggtgtcaaagaagatggaagaaggggttgtcaccaacaagttcaggcccaaggagccttacactggaaggtgccttcttaacaccaagatcactggtgatgatgcacctggtgaaacctggcacatggtcttcagcactgagggggagctcccttacagagaagggcagtcagttggagtaatcccagatggtattgataagaatggtaagcctcataaggtcaggctgtattcaattgctagcagtgcccttggagactttggtgactctaagactgtttcgttatgtgtgaaaaggcttgtctacaccaatgaccaaggggaagtggttaagggagtctgctcaaactttctctgtgatcttaagcctggttcagaagtgaagctaactggacctgttggaaaagaaatgctgatgccgatagaccagaatgcaacgattataatgcttgcaactggtactgggattgctccttttcggtcattcttatggaaaatgttctttgaaaagcatgaggattacaagttcaatggtcttgcatggctcttcttaggtgttccaacaagtagctcattactctacaaggaggagtttgagttgatgaaagaaaagtcaccagagaactttaggttggatttcgctgtaagcagagagcaaacaaacgaaaagggtgaaaagatgtacatccaaacacgtatggctcagtacgctaacgaactttgggaactactcaagaaggacaacaccttcgtatacatgtgcggattgaagggaatggagaaaggtattgatgagatcatggcgcctttggctgctgcagaaggtattgagtggatagatttcaagaagcaattgaagaagcaagagcaatggaatgtggaagtttactagctgcatatgtatacaaagggccaccattttttttgcttccattgtaggaatcaaatcagctatgtgttatatactatggtggctttctgtactctttgtagatatctaagagtatttttttcactggagttgatttcacctcgagagatacactccttatgtctttatgaggtgtatatcatctaaagtacagtctaaataacataattcatatcat

SEQ ID NO: 1166 - DNA, 1315 bp, Flaveria ramosissima
acacaaatttcttatccacacatcttcactttccaatttcctccatccaattcacaaatatccacagaattctcaatcatacttgttcttcactgatcgtatatcttccatttctcttcactctccattttgttcaatcaccatggctgctgcagtaggcgttgttgtctcccttccatcttccaaatcttctgcattttcatcaagaacatcacttttctctcaggatcgcgtctctttcaccaaggtgccatattacaaaagtctatcaacaaatggtaaattgctatcaattagagcccaaatcacaacagaggctgcaacagaagcacctgctaaattagagaaagtttcaaagaaacaagaggagggtgttgttgttaataaataccgcccgaaggagccgtatatcggtaggtgtcttctcaacaccaagatcactggtgatgatgcccctggtgaaacttggcacatggttttcagcacagagggtaagatcccatataaagaaggacaatccattggtgtgattccagatgggattgaccccaagagtggaaaaccacacaaactgagattgtattcaattgctagcagcgctattggtgatttcggagactccaaaactgtatctttgtgtgtgaaaagacttgtctacacgaacgataaaggcgaagaagttaaaggatttgttctaacttcttgtgtgacttgaagcctggagctgaggtgcaaataactggtccagtaggaaaagaaatgcttatgccaaaggatcctaatgctacaattataatgcttgcaacaggaactgggattgctcccttccgctcattcatgtggaaaatgttctttgagaagcatgaagactatcagttcaatgggttggcatggctatttttgggtgttcccacaagtagttccttgttgtataaagaggaatttgagaaaatgaaggagatgaaaccagataacctaagagttgacttcgcggtgagtagagaacaaaccaatgagaagggtgaaaagatgtacattcaaaccagaatggctcaatatgacaaagaattatgggaattactcaagaaagacaacacctttgtgtatatgtgtgggcttaagggtatggagcagggtattgatgacattatgaccacattggctgctgaagagggcattgattggacacaatacaagaagcagttgaagaaggaaggtcaatggaatgtggaggtttactaaatggctttgtttcttcttgtacaaatgcagcctgctctttgtagataggtaaccttcataaaccaactttatt

SEQ ID NO: 1167 - DNA, 1486 bp, Flaveria ramosissima
aaacatctaacaatttaaaaacacaacacaaatttcttatcctcacatcttcaccttccaatttcctccatccaattgacaaatatccacagaattctaaatcatacttgttcttcactgatcgtatatcatccatttctcttcactctccattttattcaatcaccatggctgctgcagtaggcgttgttgtctcccttccatcttccaaatcttctgcaatttcatcaagaacatcacttttctctcaggatcgcgtctctttcaccaaggtgccatattacaaaagtctatcaacaaatggtaaattgctatcaattagagcccaaatcacaacagaggctgaaacagaagcacctgctaaattagagaaactttcaaagaaacaagaggagggtgttgttgttaataaataccgcccgaaggagccgtataccggtaggtgtcttctcaacaccaagatcactggtgatgatgcccctggtgaaacttggcacatggttttcagcacagagggtaagatcccatataaagaaggacaatccattggtgtgattccagatgggattgaccccaagagtggaaaaccacacaaactgagactgtattcaattgctagcagcgctattggtgatttcggagactccaaaactgtatctttgtgtgtgaaaagacttgtctacacgaacgataaaggcgaagaagttaaaggagtttgttctaacttcttgtgtgacttgaagcctggagctgaggtgcaaataactggtccagtaggaaaagaaatgcttatgccaaaggatcctaatgctacaattataatgcttgcaacaggaactgggattgctcccttccgctcattcatgtggaaaatgttctttgagaagcatgaagactatcagttcaatgggttggcatggctatttttgggtgttcccacaagtagttccttgttgtataaagaggaatttgagaaaatgaaggagatgaaaccagataacctaagagttgacttcgcggtgagtagagaacaaaccaatgagaagggtgaaaagatgtacattcaaaccagaatggctcaatatgacaaagaattatgggaattactcaagaaagacaacacctttgtgtatatgtgtgggcttaagggtatggagcagggtattgatgacattatgaccacattggctgctgaagagggcattgattggacacaatacaagaagcagttgaagaaggaaggtcaatggaatgtggaggtttactaaatggctttgtttcttcttgtacaaatgcagcctgctctttgtagataggattaaatgttctgagtgcacgttcaaagggatatggaatcgagaatgacactatgtgagcgagcttcaccaactagatgaatgtaataaggtaagttggtagcatattgtttcttgtttctcacttgctataacatatggctttttgtttcatgtgtcgagcttttgtg

SEQ ID NO: 1168 - DNA, 1384 bp, Musa acuminata
cccacttctgctgcctttcctgccttcaattctctcgcccggaggatcaccaagtcaagcaatggcttctgccgcagtcactgctgcagtttccctcccttcctccaagccatccctctcccctgcctccctcgagcgaatcagcttccacaagacatgcttgcacccacgaagcaccgctgcagctaaagcaggcaggttggtcacggtcagagcacaggtcacgaccgaggctcctgccaaggtagccaaggtgtcgaagaaggacgacgagggcgtcgtcaccaacaagtacaaacccaaggagccatacatcgggaggtgcctcatcaacactaagatcaccggagacgacgcacccggagagaccaaccacatagtcttcagcaccgagggggagattccctacagagaaggtcaatcgataggcgtgatcgctgatgggatcgacaagaacgggaagccacacaagctgaggctctactcgatcgccagtagcgctattggggattttggagactccaagaccgtttccctctgtgtgaagaggcttgtttatacaaatgaacaaggagagatagtgaaaggagtctgctccaacttcctatgtgacctcaagcctggtgctgcagttaagattaccggaccggttgggaaggagatgcttatgcctaaagatcccaatgcaactgtcgtaatgcttgcaacagggactggtattgctcctttcagagcattcctgtggaaaatgttctttgagaagcatgaaaactacaagttcaatggacttgcatggctctttttgggagttcctacaagcagctctttgctctacaaggaggaatttgagaagatgaaagagttggcacccgaaaatttccgtctagattttgctgtcagcagagaacaaacaaatgaaaagggagagaagatgtacatccagactcgtatggcacaatatgcaagtgagctgtgggagctactgaagaaggacaacacctttgtttacatgtgtggattgaaaggaatggagaagggtattgatgatatcatggtttccttggctgccaaagatggcattgattggctgacctacaagagggaactgaagaaggcagaacaatggaatgtggaggtctattgatgcattttgttgcaagctatctctcttcaaaaaccaaccttcatcatatgctatacttgatgtagataacaagttgtcttgtgttctgtgttatgtccttgtagtttttaactattttagttgccctcctattctgtgaaaagaaaccacaatttaatttctgtggaattcttgtaaccaatcaacttcactcttgtgttggtcatattttttgaggagagatatatatgatctttttgc

SEQ ID NO: 1169 - DNA, 1430 bp, Allium cepa
tagttacgggggatttaaaagggaatcaccacttcattttcttcaccaatatcctccactcaatttaatcttcttccaaccacttctccatattatcatcatcatcttctcttcatttctcctacatataatttcctactcttaactgctcagcttttaattttaattttatagcaatcatggcttcctctgctgcagttacaactgcagtttccttgccaaattccaagtcatcttctcttgttctctcttcaagaacgtccatcgcttccgggatcaatttcaacaagacagctttgtattcaagaaatgtaaccacaaacaacaagtcatcgagtatacgagcacaagtgacaacagaaactccaactaaagctgtgaaagtatcaaaaaagaacgatgaaggagtgatcacaaacacatataagcctaaagatccatacgtcggtagatgcttacttaacactaaaatcactggagatgatgcacctggtgaaacctggcatatggtcttcagtactgaaggaaaagtacagtacagggaaggtcaatctattggtgttatagctgatggagttgagaagaatggaaagcctcataaactcaggctgtattcaattgccagcagtgctattggtgattttggagattcaaagactgtatcactgtgtgtgaagaggttggtttacaccaatgatcaaggagaaattgtaaaaggggtgtgctctaatttcttatgtgacttgcagcctgggtctgaagtgaaaatcaccggaccagttggaaaagaaatgctcatgcccaaagatccaaatgcaactatcatcatgcttggtactggaactggaatagctcctttccgaagtttcctatggaaaatgttctttgagaaacatgatgattacaagttcaatggactggcatggctctttctaggagtaccaacaagtagttcactgctctacaaagaggaatttgagaagatgaaggagataggaaaagacaacttcaggttagattttgcagtcagtagagaacaaacaaacgagaaaggcgagaaaatgtacattcaaactcgaatggcgcaatacgcagaagagttatgggagttgcttaagaaagataacacatatgtgtatatgtgtggattgaaaggaatggaaaagggtattgatgacattatgctttctctggctgctaaagatggtattgattggcttgcttacaagaaggaattgaagaaggcagaacaatggaacgttgaagtatattgatgaagtttgtattccattgtatactttttcattcatattataattcaacgataaagtatagtctttgcgtttctgttcctgtactttatcacaacaatatagtagtgtcttgcattacaaaatttaaactttttgcttggagattaaaacacacac

SEQ ID NO: 1170 - DNA, 1199 bp, Vinca minor
gaacatccataatttttccagaaagagtcaactttaacaaggttcctttgtattatcggagtgtttctgctggtgggaaagtagtttccatcagagcccaggtgactacagaggctcctgctactgctaaggttgagaaagtttccaagaaaaatgaagaaggtgtggtagtgaacaagtacaagccaaaggacccatatattggcagatgtctacttaacactaagatcactggcgatgatgcaccaggagaaacttggcatatggttttcagcactgagggtgaagtcccatatagagaaggtcagtcaattggggttattcctgatggaattgatcccaagaatggaaagcctcacaagctgagattgtactccattgctagcagtgccattggtgactttggagattccaaaactgtttctctgtgtgttaaaaggcttgtctatacaaatgataagggagaacttgttaaaggagtttgttcaaacttcttgtgtgatctgaaacctggagctgaggcgaaaattactggacctattggtaaagaaatgctcatgcctaaggatcccaatgccaccattatcatgcttgccactggaactggaattgctcctttccgtggtttcttgtggaaaatgttctttgagaagcacgatgactaccagttcaatggtttgggatggcttttcttgggtgttccaacaagcagttccctgctttacaaagaggaatttgagaaaatgaaggagaaatatccggagaatttcagactcgactttgctgtcagcagagagcaaaccaacgagcaaggtgagaagatgtacatccaaaccaggatggctcaatatgcggaagagctatggcaactactcaagaaagacaacacttttgtgtacatgtgtggactgaagggtatggagaagggtattgatgacattatgggatcattggctgctagagatggtattgattggttggattacaaaagacagttgaagaaggctgagcaatggaatgtggaagtctactaagtctgcttccttgtacaaatataagtcactattacataattttctctgctttcatgtagatataggtattattcctgctgctaatttgtttctttttccttttccttaaactactttttagtgtctgtcttcgccttctccgtaaaactttttgaagggcatgga

SEQ ID NO: 1171 - DNA, 1197 bp, Papaver somniferum
acccattaattaacctagtcatggcagctgcactcactgctgctgtatctattccagcatccaattcatcgtctctccaaaccagaacttctatttcttcctcggaacgaatcagcttcaacaagagctgtttgtattctaggaatggctgtgccagcagaagggtgttttctatcaaagccgaggttactacggacactactccacctgccaaagtagagaagatttcaaagaagtatgaagaaggtgttgttgttaacaagttcaaacccaagaaccctttcactggcaaagtccttctcaacaccaagatcacagctgatgacgctccaggagaaacctggcacatggtcttccatacagacggtgaggttccatacagagaaggacaatctattggtattattccggagggtattgacaaaaacggaaagccacacaagctgagattatactcaattgccagtagtgctcttggggatcttggagactccaaaactgtttctctttgtgtcaaaaggctggtgtacaccaacgaccaaggcgaagaagtcaagggagtctgctctaatttcctatgtgatctgcaaccagggagtgaggtgaagattactggacctgttggaaaagaaatgcttatgcccaaagaccccaatgccaccattattatgcttgcaacaggtacaggtatagctcctttccgttcattcttgtggaaaatgttcttcgagaagcacgaagactacaagttcaatggactagcttggctcttcttgggtgttcccacaagcagttctctactttaccagcaggaatttcagaagatggtggaaaaggccccagaaaatttcaggctggactatgcagtgagcagagagcaaacaaatgagaagggagagaagatgtacattcagaccagaatggcacagtacgctgaggagctatgggagttactcaagaaggataacaccttcatttacatgtgcgggctgaagggaatggagaagggtattgatgatataatggattcgttggctgctagagatggtattgtctggaccgacttcaaaaagtcattgaagaaggctgggcaatggaatgttgaagtgtattgattgaatatcccagcatctcttcacaagaacctccttgcatcgatccctctataactttgtatgttttatgtagataggtagt

SEQ ID NO: 1172 - DNA, 1326 bp, Castanea mollissima
tatggcttctgcagtaaatgcatcggtctctttaccatcttccacttcatcctctctaaccaccagaacttctacagtatattcagaaagagttagcttcagtaagaatatcttctattctagaaatgtctacgttggtaagaaaatggttcagattagagcccaagtcaccacagagactccagccaaagtacaaaaagtttccaagaaagatgacgagggtgtgattgtaaacaagttcaagcctaaggagccttacattggtaagtgccttctcaactccaaaattacagcagacgatgctccgggagagacttggcacatggtgttcactactgagggggaagttccttatagagaaggacaatccattggtattattgcagatggcattgacaagaatgggaaaccccacaagcttagattgtattctattgccagtagtgctcttggagactttgggaattccaaaactgtttctctgtgtgtcaagaggcttgtctacaccaatgataaaggagagatagttaaaggagtttgctcaaatttcttgtgtgacctgaagcctggggctgatgtgaaaatcacaggacctgtaggaaaagaaatgcttatgccaaaagatccaaatgccacagttataatgcttgcaaccggaactggaattgctcctttccgttcattcttgtggaagatggtttttgagaagcatgagaattataagttcaatggattggcttggcttttttgggtgttccaacaactagctcattgctctacaaggaggagtttgcgaagatgaaagagaaggcaccagaaaacttcagagttgattatgcagtgagcagagaacaaacaaatgacaagggtgagaagatgtatattcaaacccgaatggcacagtatgcagaggagctatgggagttactcaaaaaagacaacacctatgtatatatgtgtggactcaagggaatggagaaggggattgatgacataatggtctctttggctgctaaagatggcatcgactggcttgaatacaggagacaattgaagaaggcagagcaatggaatgttgaagtctattgattctattggtgttacacatatacactgaagaatcccttattatttcttgtgtgtgaaggagataggtcatcttatatgtaatttgttagaacataatctacttattttgtatagtgagtttaaaatcgcattaactactggatttagggatatcatggatgatttcatggtagaatgaattccactacttggaagttttcataatttgtagaatactaattccattgtttttccact

SEQ ID NO: 1173 - DNA, 1586 bp, Chrysanthemum coronarium
tcctcacatctgccactgccattggcttttaaatttcctccatccaatttactccaaaatatccacaatcatatttcttgcttcactcatactatatcttctatttttgttagctcacttcattcttcattttattcaccatggcttcctctgtttctgctgttgtctctctttcatcttcaaaaaccactgctatttcaactagatcatctttcatttctcaagaaagagtctcttttgccaaggtgccatcttacaaaaatgtgtcaagtggtaaattgttatctattagagcccaagtcacaaccgacactgagacacctcctgctaaagtagagaaaatttcaaagaaacaagaggaaggtgttgttacaaatacatacaagccaaaggagccatatgttggtcgatgtcttctcaacaccaagatcaccggtgatgatgcacctggtgaaacctggcacatggtcttcaccacagagggtctgattaaatacaaagagggacaatccattggtgttattccagacggaattgatcccaagaacggaaagccacataaattgagattgtattcaattgctagtagtgcaattggtgactttggagactctcaaactgtctctctatgtgtgaagagactagtctacacaaatgaccaaggagaagaagttaaaggagtttgctccaacttcttgtgtgacctaaagcctggttgtgaagtgcaaataactgggccagtaggaaaagagatgcttatgccaaaggaccccaatgcaactgttattatgcttgcaacaggaactggaattgctcctttccgctcatttatgtggaaaatgttctttgagaagcatgaagactataagttcaacggtttggcatggctctttttgggagttcctacaagtagttccttgttatataaagaggaatttgagaaaatgaaggagatgaaacctgataacctacgtgttgactttgcggtgagcagagagcaaactaacgagaagggtgaaaagatgtacattcaaaccagaatggctcagtacgacagagagctatgggaattactaaagaaagacaacacctttgtgtacatgtgtgggcttaagggtatggagaagggtattgatgacattatggtttcattggctgccgaagatggcattgattggataacatacaagaagcagttgaagaaagaagggcaatggaatgtggaagtctattaagtggctttgtttcttctttgtacaaatgcaagccctctctttgtagatagctctggaggtttcaactgcccagtcaaaagatatgtgcccgggtaacaacactaagtgaaagagcttcgccaagaaaatgaatcttataacagtaacatactgttcttcatttctcacaaataataggatatgatgtactctttgatttgttatggacccaagatcactatgttatgttatgttatattgacgatgtggtcactaatcagagctatatctttatgtatccagccttcgggtgggtcttatactcttatatgtcacatgttatgccattagtacacatttgtttttgttaaa

SEQ ID NO: 1174 - DNA, 1306 bp, Musa acuminata
ctccctttcacctaagctctgctgctgcttccacagaaaacttgggcaatggcctctgctgcagtgactgctgcagtcggctcccttccttcctccaagtcctcatccctcagcaagaccccgtccatctctcctgctactctcgagaggaccagcttccacaaggcatgcttgtactcgagaagcgtctccacagccaatgccaggaagaagctggtcgccgttcgagcccaggtaaccaccgaagctcctgccaaggtagcgaaggtctccaagaagaacgacgagggtgtcgtcaccaacaagtacaagcccaaggagccctacgtcgggacatgcctcctcaacaccaagatcaccggcgacgacgcgcccggcgagacatggcacatggtcttcagcacagagggagaggttccctacagagaggggcaatcgatcggtgtgatcgccgacggcatcgacaagaacgggaagccacacaagctgagactctactccatcgccagcagtgctctcggtgacttcggtgacgccaagaccgtttctctgtgtgtgaagaggctggtttacaccaacgagcaaggggaggtcgtgaaaggagtctgctcaaatttcctgtgtgacctgaagcctggcgctgaagtgaagataacaggaccggtaggaaaagagatgctgatgcccaaagatcccaatgcaaccgtcatcatgctcggcaccggaactggaatcgctcctttccgctcgttcttgtggaagatgttcttcgagaagcacgatgactacgagttcaatggactcgcatggctgttcttgggagttcctacgagtagctcgctgctctacaaggaggagttcgagaagatgaaggagagagcaccggacaatttccgggtggattacgctgtcagcagagagcaggcgaacgagaagggagagaagatgtacatccagactcgcatggcggagtatgcaggtgaactgtgggagctgctcaagaaggacaacaccttcgtctacatgtgtgggttgaaagggatggagaagggtatcgatgatatcatggtctctttggctgctaacgacggcatcgactggttatcttacaaaagggaactgaagagagcagaacagtggaatgtggaagtctactgatatatgtatctctctttttccaaagattacttgcttcaataggatcttctgcagcagatatgttgtacataatctattcgagttctgcatactttttcttctatgactgctataccatatttgagttttagcatatatagatagttat

SEQ ID NO: 1175 - DNA, 1446 bp, Musa acuminata
atgatccactccaaatgtacgcccaccacttcattcccatcaccaatctccaccaaccatttaaatctccctatcctccccccccacccttttcttctcctcttacccacctccctttcacctaaagctctgctgctgcttccacagaaaacttgggcaatggcctctgctgcagtgactgctgcagtcggctcccttccttcctccaagtcctcatccctcagcaagaccccgtccatctctcctgctactctcgagaggaccagcttccacaaggcatgcttgtactcgagaagcgtctccacagccaatgccaggaagaagctggtcgccgttcgagcccaggtaaccaccgaagctcctgccaaggtagcgaaggtctccaagaagaacgacgagggtgtcgtcaccaacaagtacaagcccaaggagccctacgtcgggacatgcctcctcaacaccaagatcaccggcgacgacgcgcccggcgagacatggcacatggtcttcagcacagagggagaggttccctacagagaggggcaatcgatcggtgtgatcgccgacggcatcgacaagaacgggaagccacacaagctgagactctactccatcgccagcagtgctctcggtgacttcggtgacgccaagaccgtttctctgtgtgtgaagaggctggtttacaccaacgagcaaggggaggtcgtgaaaggagtctgctcaaatttcctgtgtgacctgaagcctggcgcggaagtgaagataacaggaccggtaggaaaagagatgctgatgcccaaagatcccaatgcaaccgtcatcatgctcggcaccggaactggaatcgctcctttccgctcgttcctgtggaagatgttcttcgagaagcacgatgactacgagttcaatggactcgcatggctgttcttgggagttcccacgagtagctcgctgctctacaaggaggagttcgagaagatgaaggagagagcaccggacaatttccgggtggattacgctgtcagcagagagcaggcgaacgagaagggagagaagatgtacatccagactcgcatggcggagtatgcaggtgaactgtgggagctgctcaagaaggacaacaccttcgtctacatgtgtgggttgaaagggatggagaagggtatcgatgatatcatggtctctttggctgctaacgacggcatcgactggttatcttacaaaagggaactgaagagagcagaacagtggaatgtggaagtctactgatatgtatctctcttttcccaaagattacttgcttcaataggatcttctgcagcagatatgttgtacataatctattcgagttctgcatactttttcttctatgactgctataccatatttgagttttagcatatatagatagttatcaccaatcctaaccccacgttcatgtctgcc

SEQ ID NO: 1176 - DNA, 1539 bp, Musa acuminata
caattgaccacaaactcatgacatcttgttaatatcttgatgccactccaaatgtacagccaccacttcattgccaccaccaatctcctccacccatttaaacagcccaatcctctctcggttctcttttagctgcctctcttccttcccaccccacttctgctgcctttcctgccttcaattctctcgcccggaggatcaccaagtcaagcaatggcttctgccgcagtcaccgctgcagtttccctcccttcctccaagccatccctctcccctgcctccctcgagcgaatcagcttccacaagacatgcttgcacccacgaagcaccgctgcagctaaagcaggcaggttggtcacggtcagagcacaggtcacgaccgaggctcctgccaaggtagccaaggtgtcgaagaaggacgacgagggcgtcgtcaccaacaagtacaaacccaaggagccgtacatcgggaggtgcctcatcaacactaagatcaccggagacgacgcacccggagagaccaaccacatagtcttcagcaccgagggggagattccctacagagaaggtcaatcgataggcgtgatcgctgatgggatcgacaagaacgggaagccacacaagctgaggctctactcgatcgccagtagcgctattggggattttggagactccaagaccgtttccctctgtgtgaagaggcttgtttatacaaatgaacaaggagagatagtgaaaggagtctgctccaacttcctatgtgacctcaagcctggtgctgcagttaagattaccggaccagttgggaaggagatgcttatgcctaaagatcccaatgcaactgtcgtaatgcttggaacagggactggtattgctcctttcagagcattcctgtggaaaatgttctttgagaagcatgaaaactacaagttcaatggacttgcatggctctttttgggagttcctacaagcagctctttgctctacaaggaggaatttgagaagatgaaagagttggcacccgaaaatttccgtctagattttgctgtcagcagagaacaaacaaatgaaaagggagagaagatgtacatccagactcgtatggcacaatatgcaagtgagctgtgggagctactgaagaaggacaacacctttgtgtacatgtgtggattgaaaggaatggagaagggtattgatgatatcatggtttccttggctgccaaagatggcattgattggctgacctacaagagggaactgaagaaggcagaacaatggaatgtggaggtctattgatgcattttgttgcaacctatctctcttcaaaaaccaaccttcatcatatgctatacttgatgtagataacaagttgtcttgtgttctgtgttatgtccttgtagtttttaactattttagttgccctcctattctgtgaaaagaaaccacaatttaatttctgtggaattcttgtaaccaatcaacttcactcttgtgttggtcatattttttgaggagagatatatatgatctttttgcatg

SEQ ID NO: 1177 - DNA, 1347 bp, Papaver somniferum
ttttctcacgtttcattactaatcttactacattatacctcatagcacacaaaagaaaaagaaaaacacccattaattaagctagtcatggcagctgcactcactgctgctgtatctattccagcatccaattcatcgtctctccaaaccagaacttctatttcttcctcggaacgaatcagcttcaacaagacctgtttgtactctaggaatggctgtgccagcagaagggtgttttctatcaaagccgaggttactacggacactactccacctgccaaagtagagaagatttcaaagaagtatgaagaaggtgttgttgtcaacaagttcaaacccaagaaccctttcactggcaaagtccttctcaacaccaagatcacagctgatgatgctccaggagaaacctggcacatggtcttccatacagacggtgaggttccatacagagaaggacaatctattggtattattccagagggtattgacaaaaatggaaagccacacaagctgagattatactcaattgccagtagtgctcttggggatcttggagactccaaaactgtttctctttgtgtcaaaaggctggtgtacaccaacgaccaaggcgaagaagtcaagggagtctgctctaatttcctatgtgatttgcaaccagggagtgacgtgaagattactggacctgttggaaaagaaatgcttatgcccaaagaccccaatgccaccattattatgcttgcaacaggtacaggtattgctcctttccgttcattcttgtggaaaatgttcttcgagaagcacgaagactacaagttcaatggactagcttggctcttcttgggtgttcccacaagcagttctttactttaccagcaggaatttcagaagatgacagaaaaggccccagaaaatttcaggctcgactatgcagtgagcagagagcaaacaaatgagaagggagagaagatgtacattcagactagaatggcacagtacgctgaggagctatggcagttactcaagaaagataacaccttcatctacatgtgcgggctgaagggaatggagaagggtattgatgatataatggactcgttggccgctagagatggtattgtctggaccgacttcaaaaagtcattgaagaaggctgggcaatggaatgttgaagtgtattgattgaatatcctagcatctcttcacaagaacctccttgcaaggatcgatactttgtatgttttatgtagataggtagtgttttttttgttgttgttgcataatccgtattaaatttcatagagtcagaactgagataacaattctacatgttgcacgaattctcaa

SEQ ID NO: 1178 - DNA, 1450 bp, Quercus alba
atctttgtacgtgtctcctttttttcaagtttcctcacaaccccatttaactctattgtgtgtctgtattttcctctgaaaaaaaaatggcttctgcagtaaatgcatcggtctctttaccatcttcctcttcatcctctctaaccaccagagcttctacaatatattcagaaagagttagcttcagtaagaatatcttctattctagaaatgtctacgttggtaagaaaatggttcagattagagcccaagtcactacagcaactccagccaaagtagaaaaggtttccaagaaagatgatgagggtgtggttgtaaacaagttcaagcctaaggatccttacattggtaagtgccttctcaactccaaaattacagcggacgatgctccgggagagacttggcacatggtgttcactactgagggggaagttccttatagagaaggacaatccattggtgttattccagatggcattgacaagaatgggaaaccccacaagcttagattgtattctattgccagtagtgctcttggagactttgggaattccaaaactgtttctctgtgtgtcaagaggcttgtctacaccaatgataaaggagagatggttaaaggagtttgctcaaatttcttgtgtgacctgaagcctggggctgatgtgaaaatcacaggacctgtaggaaaagaaatgcttatgccaaaagatccaaatgccacagttataatgcttgcaaccggaactggaattgctcctttccgttcattcttgtggaagatgttttttgagaagtatgagaactataagttcaatggattggcttggctctttttgggtgttccaacaactagctcattgctctacaaggaggagtttgcgaagatgaaagagaaggcaccagaaaacttcagagttgattatgcagtgagcagagaacaaacaaatgacaagggtgagaagatgtatattcaaacccgaatggcacagtatgcagaggagctatgggagttactcaaaaaagacaacacctatgtatatatgtgtggactcaagggaatggagaaggggattgatgacataatggtctctttggctgctaaagatggcatcgattggcttgaatacaggagacaattgaagaagtcagagcaatggaatgttgaagtctattgattctactggtgttacacttatacactgaagaatcccttaatatttcttctgtgtgaaggagataggtaatcttatatgtaatttattagaacataatctacttattttgtatagtaattttaaaatcgcattcactactggaattagggatatcatggatgatttcatggtagaatgaattccactacctggaagttttcataatttgtagaatactaattccgttgtttttccactcatattttgtcaagattgaactttaaacaacaacaata

SEQ ID NO: 1179 - DNA, 1361 bp, Raphanus sativus
ggaggaaaatgttgaacagagacgaatgagaagaaaaacagagaggcccatcttcgttgcatagttgataaaacatggctgctgcaataggtgctgcagtctcttatccttcatccaagtcctcttctcttccctccaaaacttccttcgtctcccctcaaaggattttcctcaacaacaagagcagagtgtgctacagagaggcgtgtatttataggggaagagtgaaggctcaggtgtcaacagagacgccagtgaaagtagtcaaggagtcaaagaaacaggaagaagggattgttgtcaacaaattcaaaccaaaggagccttacactggtcgatgcctcttgaacaccaggatcactggcgatgacgctcccggtgaaacctggcacatcgtcttcagcaccgaaggggaggttccatacagagaagggcagtcgataggagtgattccagaaggaattgacaagaacgggaagccccacaagctgaggttatactctatcgccagcagtgccattggtgactttggtgattccaaaaccgtttctctctgtgtcaagagattagtttacactaacgaaagcggagagcttgttaagggagtctgctccaacttcttgtgtgacttgaagcctggtgatgaggcaaagatcactggaccagttggaaaggaaatgcttatgcctaaagatcctaatgccaccatcatcatgcttggaacaggaactggaatagcaccattcagatcatttttgtggaaaatgttctttgaggagcatgaggactacaagttcaacggtttggcatggctcttcttgggtgtacccacaagcagctcattgctctacaaggaggagtttgagaagatgaaggagaagaacccggaaaatttcaggttggactttgcggtgagcagagagcagacaaacgagaagggagagaaaatgtacatacagacaagaatggcagagtatgcagaagagctgtgggagttgctgaagaaagacaacacctttgtttacatgtgtggtctcaagggtatggagaagggtatcgatgagatcatggtctcacttgctgctaaagatgggatcgattggttggagtacaagaagcaattgaagaagagtgagcagtggaatgtggaagtctactaagcaagattgtgagagggtttattaatattattatgtagataaaggagctgatgccattgtcaattcttcatctttcttctgcatgtgatgattttccatcaacaatctaaagagacaatcattacccccaaaatactcttttttttttacttcctattcatatcatatttcgaatataattatatatggtttgcatgttca

SEQ ID NO: 1180 - DNA, 1312 bp, Lippia dulcis
attcaaacaaaatatggctgctgctgtaagtgctgcagtctctcttcctacctccaaatctgcttctctttcagctagaacatccattatttctccagaaagaatcaattttaacaaggcatccttgcactacaggaatgtatcgtctaaggttgctccgataagagctgaggtgagcaccgaggcgcctccgaagaaggagaagcattccaagaaacaggaagaaggagtagttgtcaacaagttcaggcctaaagatccatacattggcaaatgcctcttgaacaccaagatcaccgcagacgatgcccctggtgaaacatggcacatgctcttcagcactgagggagaggtgccttacagagaaggccaatcgattggaataatcccggatggcatagacaagaacgggaagcctcacaagttgaggttgtactcgattgcaagcagcgccatcggtgatctaggagactccaagactgtctctttgtgtgttaagaggcttatctacaccaatgatcaaggggaaatagttaaaggagtttgctcaaactttttgtgtgacttgacacccggtgctgaggtgaaaatactggacctgtaggaaagcgatgcttctgccaaaagaccctaatgctaccattatcatgcttgctaccggaactgggattgctcctttccgctcgtttttgtggaagatattctttgagaagcatgatgactacaagttcaatggcttagcgtggctgtttctgggcgttcccacgagcagttcgttgctctacaaagatgaattctccaaaatgaagagtaaaagtcctgacaacttccgggtggactatgctataagcagagaagagacaaacgcgaatggggagaagatgtacatccagacgcggatggctgagtacgcagaggagctctgggagctgctcaagaaggacaacacctacgtatacatgtgcgggctcaagggcatggagaagggcatcgacgatatcatgggctcgttagctgctagagatggtattgactgggtagagtacaagagacagttgaagaaggcagagcaatggaatgtggaagtctactaattcttcttgtataaatgtatcactctttgctgctgtagataggaaacctcttttttgtcttatttttttttctaatttgcttattttttaatattcttatctgatcctctcattcacccacctgatgatgttgagagtttgaggaactatcatagagtttaattgtgaagcaaattatcaatcattttcactattaattggctactttatttgatata

SEQ ID NO: 1181 - DNA, 1415 bp, Helianthus annuus
ctgtctcccttccatcttccaatccactctaatctcaactagaccatcactcgtctctcaggatcgtgtctccttcaccaaggtgccatattacaaaaatgtgacaacaaacggtaaaccactatcaattagagcccaaatcacaacagaggctcaagctgaagcaactgctaaagtagagaaagtttcaaagaaacaagaagaaggtgtagttacaaacaaatacaaaccaaaggaaccatacatcggtaggtgccttctcaacaccaagatcaccggtgatgacgcccctggtgaaacttggcacatggttttcagcacagagggtgagatcccatatagagaagggcaatctattggcgtaattccagacgggattgaccccaagaacggaaaaccgcacaaactgagattgtattccattgctagcagtgctcttggtgactttggagactctaaaaccgtatctctatgtgtgaaaagacttgtctacacgaatgacaaaggcgaagaagtcaaaggagtttgctctaacttcttgtgtgacttaaagcctggagccggggtgcaaataactggtccggtaggaaaagaaatgctcatgccaaaggatcctaacgctactgtcataatgcttgcaacaggaactgggattgctccattccgctcatttatgtggaaaatgttctttgagaagcatgaagactatcagttcaatgggttggcatggctctttttaggtgttcccacaagtagttccttgttatataaagaggaatttgagaagatgaaggagatgaaaccagataacttaagagttgactttgcggtgagccgagaacaaaccaacgagaagggtgaaaagatgtacattcaaaccagaatggctcaatacgacagggaattatgggagttactcaagaaagacaacaccttcgtgtatatgtgcgggcttaagggtatggagaagggtattgatgacattatgaccacattggctgctgaagatggcattgagtgggcaacatacaagaagcagttgaagaaagaagggcaatggaatgtggaggtttactaaatggcgtttttcgcttcttgtacaaatgcagccctctctttgtagataggataaaaagacatgtttcgcacacgcatttaaagggatgtggagtagataatgaggaggctatgtgagagcgcttcaccaattagacgaatgtaataatggtatgttggtaatatatgtcattgcttttgctttcatgtatcgatgggttcttgtacgacgcagtttgacattggtatgtactcgtttttggtggttatgatggatctctattctctatgttcctaaaacctggctgttaaaggttggtagttaatcaacatcatatatatgaatagtgtattgaaac

SEQ ID NO: 1182 - DNA, 1243 bp, Amaranthus tuberculatus
tccctcctctagaacttcttctatcatctctaatgacaagatcagctacaaaaaggttcctttgtaccacagaaatgtatgtggtgtgggtaaagtgggggccattagagcccaagtgacctcagatgtggcagctcctcctgcaaaagttgagaagcattctaagaaaatggaggaaggagttgttttaaacaagtataagcctaaagaaccttacgttggaaggtgtctccttaacactaaaattactggggatgatgctcctggggagacttggcacatggttttttcccatgaaggagaggttccttacagagaggggcagtctattggagtcattgccgatggtgttgacaagaatggaaagcctcataagttgagattgtactcaattgccagcagtgcccttggtgatttcggtgattctaaaactgtttcgttgtgtgtaaaacgacttgtctacaccaatgaggctggagaaatagtcaagggagtctgctcgaactacttatgtgacttgaaacccggtgctgaagtgaagataacagggccagttggaaaggagatgctgatgcctaaagaccccaatgcaactattatcatgcttgcaactggaactggaattgctcctttccgttcgttcttgtggaagatgttcttcgaaaagcatgatgattacaagtttaacggcttggcttggctgtttttgggtgtaccgacaagcagttctctgctctacaaagaggaatttgaaaagatgaaagagaaggctccagaaaacttcaggctagattttgctgtgagccgtgagcagactaacgagaaaggagagaagatgtacatccaaactcgtatggcacaatacgacaaggagctatgggaattgctcaagaaagataacacttacgtctacatgtgtggactcaagggaatggagaaaggaatcgatgatatcatggttccattggctgctgctgaggggatcgattggattgaatacaagaggcaattgaagaaggcagagcagtggaacgttgaagtctactgataacccatgtatattgtttacttattcaaaataatcccagtttctcactgcaccttgtagttagctcagttttttctcaatactattatcatcatcataccataaaacttgtgttcggaagcccagtgtttgagctaatatagtcaaactcatttgaaaacaattgttgtatgctttacaaatatgaaccaacct

SEQ ID NO: 1183 - DNA, 1145 bp, Ricinus communis
acctctctctcttctttctgaaacttgacgatggctgccactgtaaatgccgcagtttcgcttccaaccaccaaatcatcgtcatcccttcccgccagaatctcaactaccccagaaagaatcagctttaacaagggttttttgtactccagaaatgtctcttttagtgggagaacattaactgtcaaagctcaagtgactacagaagcacctgctaaagtggtaaaggagtcaaagaaaaatgacgaaggtgtaactgtcaacaagttcaagcccaagaatccatatgttggaacatgtcttcttaacaccaaaattactggcgatgatgctcctggagagacctggcacatggttttcagcactgagggggaaataccatacagagaggggcaatccattggtatcattcctgatggtattgacaagaatgggaagccctacaagctcagattatattctattgccagtagtgctcttggagattttggggactctaaaactgtttcattgtgtgtcaaaaggcttgtctacactaatgagcaaggagaaatagtgaaaggagtctgctcaaatttcttgtgcgacttaaaacctggtgctgcagttacgatgacaggacctgtaggaaaagaaatgcttatgccaaaggatccaaatgccacaatcattatgcttgcaactggaactggaattgctccattccgctcattcttgtggaagatgttctttgaaaagcacgaagactacaagtttaatgggttggcttggctcttcctgggtgtcccgaccagtagctcactgctctacccagatgagtttcagaagatgaaggaaaaggccccagagaacttcagggttgattacgctgtgagcagagagcaaacaaatgataagggtgataaaatgtacatccagacaagaatggcacaatatgcagaagagttatgggaattactcaaaaaggataacacttacgtctacatgtgtgggctaaagggaatggagaagggtattgatgatattatggtgaatctagcagctagagatggtatcgattggattgaatacaagagacaactgaagaagagtgagcaatggaacgttgaagtctattaattttttttctttcagcagccattatg

SEQ ID NO: 1184 - DNA, 1293 bp, Brassica juncea
ggatcttcttcttattttttttgtttctgccagaagaaagacagataggcccatcttccttgcatagttatggctgctgctgctataggtgctgcagtctcttatccttcatccaagtcctcttctcttccctccaaaacttccttcgtctcccctcaaaggattttcctcaacaacaagagcacactgtgctacagagaggcgtgtatttataggggaagagtgaaggctcaggtgtcaacagaggcgccagtgaaagtagccaaggagtcaaagaaacaggaagaaggaattactgtcaacaaattcaaaccaaaggaaccttacactggtcgatgcctcttgaacaccaggatcactggcgatgacgctcccggtgaaacctggcacatcgtcttcaccaccgaaggtgaggttccgtacagagaagggcagtcgataggagtgattccagagggaattgacaagaatgggaagccccacaagctgaggttatactctattgccagcagtgccattggtgactttggtgattccaagaccgtttctctttgtgtcaagagattggtttacactaacgaaagcggagagcttgttaagggagtctgctccaacttcttgtgtgacttgaagccgggtgatgaggcaaagattactggaccagttggaaaggaaatgcttatgcctaaagatcctaatgccaccatcatcatgcttggaacaggaactggaatagctccattcagatcgtttttgtggaaaatgttctttgaggagcacgaagactacaagttcaacggtttggcatggctcttcttgggtgtaccaacaagcagctcactgctctacaaggaggagtttgagaagatgaaggagaagaacccggaaaacttcaggttggactttgcggtgagcagggagcagacgaacgagaagggagagaaaatgtacatacagacaagaatggcagagtatgcagaagagctgtgggagttgctgaagaaagacaacacctttgtttacatgtgtggtctcaagggtatggagaagggcatcgatgagatcatggtctcacttgctgctaaagatgggatcgattggttggagtacaagaagcaattgaagaagagtgagcagtggaatgtggaagtctactaagcgaaagaagcttgtgaggggtttattattattaaatattatgtagataaaggagctgatgccattgtcaattcttcatctctcttctgcatttgagaattttccatcaacaatctaaagagcatcattaccatc

SEQ ID NO: 1185 - DNA, 3247 bp, Ricinus communis
atctaacaaaacacgccacgacacagctacacgaatctacaacaaattaacaatggccaccacgttgtctcttgcatctctaagttcctcctccgcctctcctttcataggaccaaagtttccgaccgatagccaccgttctccgccctctcgtgtgagttttcggcagctccgtgtatccgcaaattgcgccacaacagctgatagaacagcagcggcaccgcacatttcatcggcggggtcactctacgaagtccttgggattcagatgggagccacgtgtcaagaaataaaggctgcttataggagattagcgagggttctgcatcctgatgctgcgactgataatggacaaaaggagaataaggcgaatgagtttataaaagtacacgaagcttatgaaactttgtccgatccagagaaacgagctgattatgaccggagtttattctggcgagggaggcaattgagttcggcgtttataacgtcggcaatggcggcttctgcttcgggttctggattctctgggtttcctaggcggagatgggaaactgatcaatgctggtaaaagaaagctattggaattgatagttaattattattattaggagctaaagatctttaggattaattaattgaatggggttttagaagaagacatggtaggatacaagtatcgagtgccccaaaatctgataaattgggggagaattactgcattcttgtaaatagacaagattggttatctaacttttgtattatgaaaactaggcgtatttttaaaagcctgtttttaattatattagttctaaattccctaattcaattcttcataagatcaattttctgttccaaagcttattaaggcctctgtgtgttcggtgtagtcgttttcttctattgatggaatgagtactccttttctgataaacgtggatagagcttttctaataattgtactatcagatttctttggatgtgagaatttgttcttatcctaaatgttctctataagtgaagcagatttcaatgtgacaattaatgacacatgcaacgtggataagcagaaatacatagatttggacctgtaatcagatcggcacatttaatcagcaaataatatctgaaaagaatggtctcctctccacaagaaattcaaaaatttgatagcctcagacctcaggaatgcgaaagggcttttatgaggtgagaggaagtgcagtacagtacagagctgatatggaaaaccacaagattcattttacaaccaaatattttcttttctcagtctgttatttatttcatatggattggagacccaagtcgtaattgggaggatgtatttattaggcccatttctggcctacaggagctggtttaattgggcttctttgtacttgttctgggcctatgctctttgtaggcctaacttttcttacattctctctttgccaaagaaaagagaatataagaaggggaaagaaataagaaattaattcagaacaaaaaaaataaaaaataagaatagatagacagtgttaatgagtggaaagcaaggaaattgatttgggatacatatagaattatcttcatagaatctaaataaactctctaaaaccaccaaactgccacagaatttttccctccaattctcatccactcgctctgtaatcctctcaggctctcgcacattttgtcctcttattttcttttcccctctcctttcatccctcggtccttgattctctttcctactttcacctctctctcttctttctgaaacttgacgatggctgccactgtaaatgccgcagtttcgcttccaaccaccaaatcatcgtcatcccttcccgccagaatctcaactaccccagaaagaatcagctttaacaagggttttttgtactccagaaatgtctcttttagtgggagaacattaactgtcaaagctcaagtgactacagaagcacctgctaaagtggtaaaggagtcaaagaaaaatgacgaaggtgtaactgtcaacaagttcaagcccaagaatccatatgttggaacatgtcttcttaacaccaaaattactggcgatgatgctcctggagagacctggcacatggttttcagcactgagggggaaataccatacagagaggggcaatccattggtatcattcctgatggtattgacaagaatgggaagccctacaagctcagattatattctattgccagtagtgctcttggagattttggggactctaaaactgtttcattgtgtgtcaaaaggcttgtctacactaatgagcaaggagaaatagtgaaaggagtctgctcaaatttcttgtgcgacttaaaacctggtgctgcagttacgatgacaggacctgtaggaaaagaaatgcttatgccaaaggatccaaatgccacaatcattatgcttgcaactggaactggaattgctccattccgctcattcttgtggaagatgttctttgaaaagcacgaagactacaagtttaatgggttggcttggctcttcctgggtgtcccgaccagtagctcactgctctacccagatgagtttcagaagatgaaggaaaaggccccagagaacttcagggttgattacgctgtgagcagagagcaaacaaatgataagggtgataaaatgtacatccagacaagaatggcacaatatgcagaagagttatgggaattactcaaaaaggataacacttacgtctacatgtgtgggctaaagggaatggagaagggtattgatgatattatggtgaatctagcagctagagatggtatcgattggattgaatacaagagacaactgaagaagagtgagcaatggaacgttgaagtctattaattttttttctttcagcagccattatgcatcagctgctgaggaatgaacattctattacttactgatttccttctggacaacgtagatatgtaaaattgtaaacgttttgcatttttttcttgtacttttataattcttttttaccatttcctttctttctcgccatggagcaaatgcaagtgtctcctgtaaacagaaatcacgactcgtcactggtgcattaactaccaaaacaaaatcacactctttgtcaagagtatttgcaacacgttttgttataattagctttaacgagatttggactcaaaatctgtttcttaattcatgttgtcatgccgtactacaatatcagatgaaagagtactgagc

SEQ ID NO: 1186 - DNA, 1445 bp, Papaver somniferum
aaaaacaatggcaacttcactcactgctgcagtttctcttccatcatctaagtcatcatcatcatcaacatctgcactttcatcaagaacatcatctatcttttcagataggatcagcttccccaagaactctgcttacactggtggtatctctatttctaacaatgctgttaccataacatctcaagttactactactgaagctgctcctgtaaaggtagaaaagatctccaagaaggatgatgaaggaattgttgttaacaaattcaaaccaaagaatccttatattggtagatgccttcttaacactaagattactggtgatgatgcccctggagaaacatggcatatggttttcaccactgagggtgaagttccttacagagaaggacaatccattgggattattcctgagggagttgacaagaatgggaagccacataaactcaggttgtactcaattgctagcagtgctattggtgattttggagactccaaaactgtttcactgtgtgtgaagcgactagtttacaccaacgatcaaggtgaagaagttaagggagtttgttcaaatttcctatgtgacttgaaacctggatctgaagtgacgatcacagggccaattggaaaagaaatgcttatgcccaaagatccaaatgccacaatcataatgcttggaactgggactggaattgctcctttccgttccttcttgtggaaaatgttctttgagaaacacgaaaactataagtttaacgggttggcatggctctttttgggtgttcccacgagtagctcattgctgtacaaggaggaatttgagttgatgaaggagaaagcacctgaaaacttcaggctcgacttcgcagtgagcagagaacaaacaaatgacaagggagagaagatgtacatacaaactcgaatggctcaatacgcagaggagctatgggaattactcaagaaagacaacactttcgtttacatgtgcgggttgaaaggaatggagaaaggaattgatgacattatggtttctctagcggctaaagacggtattgattggcttgaatacaaaagaacattgaagaaggcagaacaatggaatgttgaagtttattagttaacaacgatatatattttgcttcttattgtataattggtctcatcttgtctagtcaagaatgtgtaagatgattgtaagtttctcataaggtgcccctcctgtgcaccatgaaaccaaactctagtagcaagtataagtagagttgtaattgttgtgaattagtgtcattgatggctcctggtgtaagaaagcactctccaactcctctttgttggtgtatatcaaattcagttttttcgaacttagcaagtaatagctgcattcatgaaaatttgcttgatacagatctcaccactcagctggaaataaaatgctttgatacaaa

SEQ ID NO: 1187 - DNA, 1105 bp, Flaveria ramosissima
ttcattttattcaatcaccatggcctctgcagtcagcgctgtgtctcccttcatcttacaaatccaccacaatttccaccagaacatcactaatctctacaagacgagtctcctcacgaggtggcgtgtacaagatgtgtctactagtggtagtattgttgtcgattagagctcaagttacaacagaggctgaggcgcctgcgaaagtagagaaagtgtcgaagaaacaagaggagggtgtggttacaaataagtataggccgaaggaaccgtatattggtaggtgtcttctcaacaccaagatcacaggtgatgatgctcctggtgaaacttggcatatggttttcagcactgagggtgagatcccatataaagaaggacaatccattggtgtaattccagatggaattgacccaaaaacggaaagccacacaaactaagattgtattccattgctagtagcgctattggtgactttggagactccaaaactgtctctttatgtgtgaaaagacttgtctacacgaatgaccaaggcgaagaagttaaaggagtttgctcgaacttcttgtgtgacttaaagcctggagctgaggtccaaataactggtccagtggaaaagaaatgcttatgccaaaggatcctaatgctacaattataatgcttgcaacaggaactgggattgcttttccgctcatttatgtggaaaatgttcttcgagaagcacgaagactataaattcaatgggttggcatggctatttttgggtgttcccacaagtagttccttgttatataaagaggaatttgagaaaatgaaggagatgaagccagataacctaagagtcgacttcgcagtgagcagagaacaaaccaatgagaagggtgaaaagatgtacattcaaaccagaatggctcaatatgacagagaactatgggaattactcaagaaagacaacacctttgtgtatatgtgtgggcttaaaggcatggagaagggtattgatgacatcatgactacattggctgctgaagaaggcattgattgggtacaatacaagaagcaattgaagaaagaaggacaatggaatgtggaggtttactaa

SEQ ID NO: 1188 - DNA, 1189 bp, Pteridium aquilinum
ttttccttctaccaacgtccacctctcttcctgctagaatcgcgatcatctctccagaaagactcaccttcaagaaggttcctgtttactacagagatgtttccagtggagggagagtggtttctgtcagagcccaggttacgaccgaggctcctagcaaaaaaagttgtaaaggaatccaagaaaaatgaggagggtgttgtcgtgaacaagttcaagccaaagaacccgtacactggcagatgccttctaaacactaagatcactggtgatgatgctcctggagagacttggcacatggtcttcagcactgagggagaggttccctacagagaagggcaatccattggggttattccagatggcattgacaagaatgggaaacctcacaagctgagattatactctatcgctagcagtgcccttggtgattttggagactccaaaactgtgtccctatgtgtgaaacggctggtctacaccaatgagaatggagaacttgttaaaggagtctgctcaaatttcttgtgtgacatgaaacctgggtcagaggttaaaatcacagggcctgttggaaaggaaatgcttatgccaaaagatccaaatgccacaatcatcatgcttgcaactggaactggaattgctcccttccgatcatttttgtggaaaatgttctttgagaagcatgatgactacaagttcaatggtttggcatggctcttcctgggtgtacccacaggtagctcattgctgtacaaggaggaatttgagaagatgaaggagaagtaccctgacaactttaggctggactttgctgtgagcagagagcaaacgaatgagaaaggtgaaaagatgtacatccagacccgaatggatcaatattcaaaggagctatgggagttactcaagaaagataacacctacgtctacatgtgtgggttgaagggaatggagaagggaattgatgacataatggtctcacttgctgcagaagatggtattgattggactgagtacaaaaggcagttgaagaaatctgagcaatggaatgtggaagtctactaactggttgattacttgtacaaatcccctctctcggttttctcctctctttttggtcagccatcctgtaaggagtccactgcactgtgtaaatagggagtgtctcttttttggagtcctatattaa

SEQ ID NO: 1189 - DNA, 1533 bp, Artemisia annua
atcctcacatctgcctctaccattggcttttaaatttcctccatccaatttgcaaaatatccattcaattcacaatcacatttctagcttcactcatactatatcttctatttttgttagctcacttcattcttcattttattcaccatggcttcctctgttagtgctgttgtctccctttcatctgcaaacaccgctgctatttcaactagatcatccttcatttctcaagaaagagtctcttttgccaaggtgccatcttacaaaaatgtgtcaagtggtaaattgttatctattagagcccaagtcgcaacagacactgacacacctccggctcctgctaaagtagagaaaatctcaaagaaacaagaggaaggtgttattataaatacatacaggccaaaggagccatatgttggtcgatgccttctcaacaccaagatcaccggtgatgatgcacctggtgaaacctggcacatggtcttcaccaccgagggtaagatcaaatacagggagggacaatccgttggtgtcattccagacggaattgatcccaagaacggaaagccacacaaattgagattgtattccattgctagtagtgcacttggtgattttggagactctaaaactgtctctctatgtgtgaaaagacttgtctacactaatgaccaaggcgaagaagttaaaggagtttgctctaacttcttgtgtgacctaaagcctggtgctgaagtgcaaatgactggtccagtaggaaaagagatgcttatgccaaaggaccccaatgcaactgttattatgcttgcaacaggaactggaattgctcctttccgctcatttttgtggaaaatgttctttgagaagcacgaagactatcagttcaatggtttggcatggctctttttgggggttcccacaagtagttccttgttatataaagaggaattcgagtatatgaaggagaggaaacctgataacctacgagttgactttgctgtgagcagagagcaaactaacgagaagggtgaaaagatgtacattcaaactagaatggcacaatacgacagagagctatgggaattactaaagaaggacaacacctttgtgtacatgtgtgggcttaagggtatggagaagggtattgatgacattatggtttcattggctgccgaagatggcattgattgggtaacatacaagaagcagttgaagaaagaaggacaatggaatgtggaagtctactaagtggctttgtttcttctttgtacaaatgcaagccctctctttgtagataggtaaccttctattttttgtaatttgcatatttgacctttttttgttcttattacaaaccaagtctattacattattatggggtttccccaaattttagtttctatttttgagggcatggattatcaaagtatactataattatggtaataagattctctttgaaaaaaaaaaaaaaaaaacaatgtcggatctagaatcccgtcggagtactgcgttgaacacccgttcggagta

SEQ ID NO: 1190 - DNA, 1089 bp, Musa acuminata
attccatcatggcgaccgctgctgtgactgccgcagtctccctcccttcctccaagtcctccgccctcaacaggaccccatccgtctctcctgcggcacgcttgcagtcaagaaaagtaccggcggccgatgccaggaagttggtctcagtacgagcccaggtcacgaccgaagctccggccaaggtcgcgaaggtctcgaagaaggacgacgaaggcgttgtcaccaacaagttcaagcccaaggatccctacaccgggacatgcctcctgaacaccaagatcaccggcgacgatgcgcccggcgagacttggcacatggtcttcagcacagagggagaaatcccctacagagagggacaatccatcggtgtcatccctgacggggtcgacaagaacgggaagccgcacaagctcaggctgtactccatcgccagcagtgctcttggagactttggtgattccaagaccgtgtcgctctgcgtgaagcggcttgtttacaccaacgagcaaggggagatcgtcaaaggagtctgctccaatttcttatgtgacctgaagcctggtgctgatgtcaagattacaggaccagtcgggaaggaaatgctaatgccaaaagatccaaatgcaaccatcatcatgcttgcaactggcactggaatcgctcctttccgctctttcctgtggaagatgttctttgagaagcatcatgattataagttcaatggactagcatggctcttcttgggagttcctacgagtagctcattgctctacaaggaggagtttgagaagatgaaggagaaatcaccagacaatttccgggtcgactatgccgtcagcagagagcaaaccaacgagaagggagagaagatgtacatccagactcgcatggcggagtacgctgaggaactgtggcagctactcaagaaggagaatacctatgtatacatgtgtgggctgaaagggatggagaagggaattgatgacattatggtctctttggctgccaaggatggcattgactggttgacttacaagagggaattgaagagagcagaacaatggaacgtggaagtctactgatgtt

SEQ ID NO: 1191 - DNA, 1351 bp, Sesamum indicum
ctctctctctcattcttgattttcttagttcatgacaaacatggctgctgctgtaagtgctgcagtctcactgccttcctccaagtctacttctcttgcatctagaacctccattatttctccagaaagaatcaatttcaacaaggtgcctttgtacaacaggaatgtctcgttggccggtaacaaggtggtcccaatcagagcccaggtagccacagaggcgcctgctaaggtggagaaggagcacaagaaacaggaagaaggggtagttgtcaacgtattcaagcctaaggacccatacattggcaggtgccttcttaacaccaagattaccggcgatgatgcccctggtgaaacctggcacatggtcttcagtactgaggggaagctcccatacagagaagggcaatcaattggggtgatcgctgatggcgaagacaagaatgggaagcctcacaagctgagactgtactcaattgcaagcagtgccattggtgactttggagactccaagactgtttctttgtgcgttaaaaggcttgtctaccaaaacgaacaaggggagacagttaaaggagtttgctcaaactttttgtgtgacttgaaaccgggtgatccagtgaagataacaggacctgtgggaaaagagatgctcatgccgacagaccctaatgctaccattataatgcttgcaactggaactgggatcgctcctttccgttcattcttgtggaaaatgttctttgagaagcacgatgactacaagttcaatggtttagcatggctattcttgggtgttcccacaagcagctcactactctacaaagaggaattcgagaaaatgaaggagagacatggagatagcttcaatctggactttgccattagcagagaacaaaccaacgcccaaggggacaagatgtacatccagactcggatggctgagtacaaggtcgagctgtgggacctgttcaagaaaccgaacactttcgtctacatgtgtgggctgaagggcatggaaaagggaatcgacgagataatgatccccattgctgctgaagaaggaatcgactggatagagtacaagaagcggatgaagagagatgaaagatggaatgtggaagtttactgattcttgctcaatgttcttgtacaaatatcagccaccatcatcattttctctgtgctgatgtagataggtaactttctcttgtaatatgttttgaaactttgtcttcgttcccatcatctgaaacagtttcctgctactgctcctcccatgttaaaaattttaaggccatggttcagagaaaaaaggttaatagtgaagcaaatttttgtcaagtattcc

SEQ ID NO: 1192 - DNA, 1357 bp, Arabidopsis thaliana
gatctttttttttttgcttattatttttttgactttgatctcccatcagttcatcttcttcttcttcttctgatcaaccatggctgctgctataagtgctgcagtctctttaccttcctccaagtcatcctctctcctcaccaaaatctcctctgtatcccctcaaaggattttcctcaagaagagcacagtgtgttacagaagagttgtgtcagtgaaggctcaggtgacaacagatactaccgaggcaccaccagttaaagtagtcaaggagtctaagaaacaggaagaagggattgttgtcaacaaattcaaacctaagaacccttacactggtcgctgccttttgaacaccaagatcaccggtgatgacgctcccggtgagacttggcacattgtcttcaccaccgaaggtgaggttccgtatagagaaggacaatcgataggagtgattccagagggaatagacaagaacgggaagccgcacaagctcaggctttactctatcgcgagtagtgccattggtgactttggagactccaagaccgtttctctctgtgtcaagagactagtttacacaaatgatggcggagagattgttaagggggtctgctccaacttcttgtgtgacttgaagccgggtgatgaagctaagatcactggacctgttggcaaggaaatgcttatgccaaaagaccccaatgccaccatcatcatgcttggaacaggaactggaatagctccattcagatcatttttgtggaaaatgttctttgaggagcacgaggactacaagttcaatggtttggcgtggcttttcttgggtgtacccacaagcagctcactgctatacaaggaggagtttgagaagatgaaggagaagaacccagacaacttcaggctggactttgcggtgagcagagagcagacgaacgagaagggagagaaaatgtacattcagacaagaatggcagagtatgcagaagagctgtgggagttgctgaagaaagacaacacctttgtttacatgtgtggtcttaagggtatggagaagggtatcgatgacattatggtctcgcttgctgctaaagatgggatcgattggttggagtacaagaagcaattgaagaggagtgaacagtggaatgttgaagtctactaaggaagcttctgagggagtaattatataatgtagataaaaagcttctgatgcattgtgaaatcttcatatctgcttcttttttctttctcaaggattttcaatcaaaacattcaaaagagagcatcaataccaccaaactactctttctcacttgttgttcatgttatatttcttgcaacaatatagtgagttttg

SEQ ID NO: 1193 - DNA, 2352 bp, Raphanus sativus
ttttttttggtcagagttccatccctacttcttcttcttcttccattattgatccaacatggctgctgctataggtgctgcagtctcttttccatcctcaaagtcgtcgtctctccacaccaaaagctccttcgtttcccctcaaaggattttcctcaacaacaagagcacagtgtgctacagagaggcgtgtatttatgggggaagagtgaaggctcaggtgacaactgagacgccagtgaaagtagccaaggagtcgaagaaacaggaagaaggaattgttgtcaacaaattcaaaccaaaggaaccttacactggtcgatgcctcttgaacaccaggatcactggcgatgatgctcccggtgaaacctggcacatcgtcttcagcaccgaaggtgaggttccatacagagaagggcagtcgataggagtgattccagaaggaattgataagaatgggaagccccacaagctgaggttatattcaattgccagcagtgccattggtgactttggagactccaaaaccgtttctctctgtgtcaagagattggtttacactaacgaaagtggagagcttgttaagggagtctgctccaacttcttgtgtgacttgaagccgggtgatgaggcaaagatcactggaccagttgggaaagaaatgcttatgcctaaagacccaaatgccaccatcatcatgcttggaacaggaactggaattgctccatttagatcatttttgtggaaaatgttctttgaggagcacgaggactacaagttcaacggtttggcatggctcttcttgggtgtacccacaagcagctcactgctctacaaggaggagtttgagaagatgaaggagaaaaacccggaaaacttcaggttggactttgcggtgagcagagagcagacaaacgagaaaggagagaaaatgtacatacagacaagaatggcagagtatgcagaagagctgtgggagttgctgaagaaagacaacacttttgtttacatgtgtggtctcaagggtatggagaagggtatcgatgagatcatggtctcacttgctgctaaagatgggatcgattggttggagtacaagaagcaattgaagaagagtgagcagtggaacgtggaagtctactaagcttgctagttgctagtgagaggtttactactatgtacataaaggagcttatgccattgccaattattcattttctgcatttttccttttttttttctctctctctttttcaacaatattatgaaatacatgctctgtatcatagtagagaagaatttgacatttgaaaattagcaagttctagtggacacaaatcagctccagctcacgaattgggatttggcaacttgattgttctaagcaaactactttctattcttcacagttaaaaacttaaaatagagtcatcattcatcacagcacatccttctctgcttctttgggtgccattttcttgattctcgcaacaaagagaccgctggttgctgaggtggaagggtcgaaacgcactgtttttggagtgcgtccgcttctacacggccattccctggccatttcaatctcctgcagctctgcggaggagctttcagcaaggaactgatccaccacatcttcgttttgggcatgtgtcaaactgcaggtgctgtatacaagaatgccaccttgtttcaacaatctgaatccatttctcagtagatttaactgaagagcagtcaagtttgtatcggttctctcagcatccagtacacggcgttccaacgttgtccagccccattgctcaaatttctggatatgcttgattgaaccatcatgtgtgcactctgcgtctacaagaaccttgtcatatccacaatttgcataatcattttggtcaagggatctaaaaagctccttcttttgtagccctattactccagaattctgtccgtagaaaataatttcgggatgcggcaaaacaaagttgctcctggtcttggctaattgtttcctttccttgtaaggtctacgagaagtccactgcttgaacgtctcttcatcacatgaaccacaaggtaggtttggggtaggtggaagtgagaaagtagttccatcagcaaggaagaggcgactcctatcaccgagaccatatttttgaagcatggttctgcaggcagagaggcgatgccttgcaacatcgacaccggttgcagtacccttgtcaccaagtaggtctagcatcatacacagtttagcaccgggagcagcacaaagatccaagacatggtctccaggggagataccaagagctgaaacagcagcacctgaagctgcgtcgattccgtacatct

SEQ ID NO: 1194 - DNA, 1309 bp, Brassica juncea
gccagagaaagacagataaggcccatcttccttgcattagttgatcaaacatggctgctgctgctgctataggtgctgcagtctcttacccttcatcaaagtcctcttctcttccctccaaaacttccttcgtctcccctcaaaggattttcctcaacaacaagagcacgctgtgctacagagaggcgtgtatttatgggggaagagtgaaggctcaggtgacgacagaggcgccagtgaaagtagcgaaggagtcaaagaaacaggaagaaggaatagttgtcaacaaattcaaaccaaaggaaccttacactggtcgatgcctcttgaacaccaggatcactggcgatgacgctcccggtgaaacctggcacatcgtcttcaccaccgaaggtgaggttccgtacagagaagggcaatcgataggaataattccagaaggaattgacaagaacgggaagccacacaagctgaggttatactctatcgccagcagtgccattggtgactttggagactccaaaaccgtttctctctgtgtcaagcgattagtttacacaaacgaaagcggagagctggttaagggagtctgctccaacttcttgtgtgacttgaagccgggtgatgaggcaaagatcactggaccagttggaaaggaaatgcttatgcctaaagacccaaatgccaccatcattatgcttggaacaggaactgggatagctccattcagatcatttttgtggaaaatgttctttgaggagcacgaagactacaagttcaatggtttggcgtggctcttcttgggtgtaccaacaagcagctcactgctctacaaggaggagtttgagaagatgaaggagaagaacccggaaaacttcaggttggactttgcggtgagcagggagcagacaaacgagaagggagagaaaatgtacatacagacaagaatggcagagtatgcagaagagctgtgggagttgctgaagaaagacaacacctttgtttacatgtgtggtctcaagggtatggagaagggtatcgatgagatcatggtctcacttgctgctaaagacgggatcgattggttggagtacaagaagcaactaaagaagagtgagcagtggaatgtggaagtctactaagctaagcttgtgaggggttttattattaatattatgtagataaaggagctgatgccattgtcaattcttcattttcttcttactctggattttccatcaacaatctaaagagagcatcattaccaccaaattactcaatttcacttcctattcaagtcatatttaaa

SEQ ID NO: 1195 - DNA, 1239 bp, Ricinus communis
aacacactaccgacttatcctctcatcaaccactgcattgcctttgaaatctcatccacgcaatcccataatccatattttgaacaaaaaaatctaactttcttcttttctcacttctgcagccattaatacaaaacactttgctctcttttccttttcactcttctcttcttctccatttgtcaatacataatagccatggccgctgcagttactgctgcagtttcctttccttccactaagtccacttctctcccttcaagaacctccatcatagcaccagagaggaccaccttaaagaaggtgcctgtttactatagggatgttgtgtctgctggtaaaagagttgtttccatcagagcccaggttacaacagaggcagaagctcctgtcaaggttaagaaagaatcaaagaaaaatgaggaaggtattgttgttaacaagttcaagcctaagaatccttacactggcaggtgccttttgaacactaagatcactggtgatgatgctcctggtgaaacttggcacatggtctttagcaccgagggagaggtcccctacagagaagggcaatcaattggtgtaattccagatggtattgataagaatgggaagcctcacaagctcagattgtattcaattgccagcagtgctcttggtgactttggagactccaaaactgtttctctttgtgtgaagcggcttgtgtacaccaatgataaaggagaattagttaaaggagtctgctcaaatttcttgtgtgacttgaaacctggagctgaagtacagattactggaccagttggaaaagaaatgcttatgccaaaagatcccaatgccaccatcgttatgcttgggactggaactgggattgctcctttccgatcgttcttgtggaagatgttctttgagaagcatgaagactataaattcaatggtttggcgtggctcttcttgggtgtccccacaagtagctcattgctgtacaaggaggaattcgagaaaatgaaggagatagcccctgataactttaggcttgactttgccgtgagcagagagcaaactaatgaaaagggagaaaagatgtatatccaaactcggatggctcaatatgcagaagaactttgggagttattaaagaaagataacaccttcgtctatatgtgtggactgaaaggaatggagaagggaattgatgacataatggcatcattggcagctaaagaaggcaagaaatag

SEQ ID NO: 1196 - DNA, 1608 bp, Chenopodium quinoa
ataaacttatcttcattactaccactcccatttgctcattcaatttcctccacccaatacataatccactcctccatcacccacttcactactaataaaactactcaaattttcacattttcctttcatttcttcttcttcttcctcctattcccattttcctccgccatggctgccgccgtcaccgccgccgtatctttcccttccaccaccaaatcatcctctctctcctccagaacttcctccatcatttcccctgacaaaatctgctacaaaaaggttcctctgtattacaggaatgtatctgtaacagggaaagtgggacccattagggcccagatcacatctgacgtggaggcaccacctccacctcctgctaaggttgagaagcattcaaagaaaatggaggaaggtattgtagttaacaagtacaagcctaagaacccttacattggaagatgtctccttaacactaaaattactggggatgatgcacctggagagacctggcatatggttttttctcatgagggagagatcccttacagagaagggcaatctgttggggtcattcccgatggtgaagacaagaatggaaagccccataagttgaggttgtactcgattgccagcagtgctcttggtgactttggtgatgctaaaactgtttcgttgtgtgtaaaacgacttatctacaccaatgatgctggagaaactgtcaagggagtctgctcgaacttcttgtgtgacttgaagcctggtgctgaagtgaagttaacagggccggttggaaaggagatgttgatgcccaaagaccctaatgccacaattatcatgcttggaactggaactggaattgctcctttccgttcattcttgtggaagatgttcttcgaaaagcacgatgattacaagtttaacggcttggcttggctcttcttgggtgtacccactagcagttctctgctctacaaagaggaatttgagaagatgaaggagaaggctccagacaacttcagactagattttgctgtcagcagagagcagacaaatgagaacggagagaagatgtacattcaaacccgtatggcagaatatgccaacgaactgtgggaaatgttgaagaaagataacacttacgtctacatgtgtgggcttaagggaatggaaagggaatcgatgacattatggtttcattagctgctgccgaaggcattgattggcttgaatacaagaggacattgaagaaggcagaacaatggaatgtggaagtctactgataactcttgtacaaacatctcttattcctttttgtgaagcagctatatttattacctatttttcactgcaccttgtagataggtcagttttttttttccttatattgtattgacgataagccattgcattttagcgccatagcataaagctcttgtcagaagactagtattcagctaatataatgaaaatcattgtcgacacttgtacacggaggaattcttgagaatgaacttatgctgtaatgtataatctgattatatcttttgtggcatggcatatatgaggctatatgaggcaatttgtcaggttttactgtgttctcaagcc

SEQ ID NO: 1197 - DNA, 1437 bp, Musa acuminata
ttccaatctccctatcctctcccgccttcttcgctctcttagccatcccctcctcacccagcttcccttcttcccctccccagaattccatcatggcgaccgctgctgtgactgctgcagtctccctcccttgctccaagtcctccgccctcaacaggaccccatccgtctctcctgtctctctcgagaggatcagcttccagaaggcggcacgcttgcagtcaagaaaagtaccggcgcccgatgccaggaagttggtctcagtacgagcccaggtcacgacagaagctccggccaaggtagtgaaggtctcgaagaaggacgacgagggcgttgtcaccaacaagttcaagcccaaggatccctacaccgggacatgcctcctgaacaccaagatcaccggcgacgatgcgcccggcgagacttggcacatggtcttcagcacagagggagaaatcccctacagagagggacaatccatcggtgtcatccctgacggggtcgacaagaacgggaagccgcacaagctcaggttgtactccatcgccagcagtgctcttggagactttggtgattccaagaccgtgtcgctctgcgtgaagcggcttgtttacaccaacgagcaaggggagatcgtcaaaggagtctgctccaatttcttatgtgacctgaagcctggtgctgatgtcaagattacaggaccagttgggaaggaaatgctaatgccaaaagatccaaatgcaaccatcatcatgcttgcaactggcactggaatcgctcctttccgctctttcctgtggaagatgttctttgagaagcatcatgattataagttcaatggactagcatggctcttcttgggagttcctacgagtagctcattgctctacaaggaggagtttgagaagatgaaggagaaatcaccagacaatttccgggtcgactatgccgtcagcagagagcaaaccaacgagaagggagagaagatgtacatccagactcgcatggcggagtatgctgaggaactgtggcagctactcaagaaggagaatacctatgtatacatgtgtgggctgaaagggatggagaagggaattgatgacattatggtctctttggccgccaaggatggcatcgactggttgacttacaagagggaattgaagagagcagaacaatggaacgtggaagtctactgatgtttcaagtaaacaggtggccttaaatctgaaacatcccagaatccaactccttccttcttgtcacaacaaaggccaagttgaaatgtggcttctgctcccaagtctttgttatctgtgtcaacaaggaaatctaagccatcatgttcttgggactacttgggaaatctaagcctggctagtgccaatgtatggaaactataattataatagttacaggaaccaacacaacggatgt

SEQ ID NO: 1198 - DNA, 1285 bp, Trifolium pratense
ctccaacaccacttctctcccgatcaggacatccgttgttgccccagatagacttgtctttaagaaggtttcattgaataatgtttctataagtggaagggtaggtaccataagagcacaagttactacacaagctgaagcacctgctaaggtagtaaagatatcaaagaaacaggatgaagatattgttgtgaacaagttcaaacccaaggagccatacattgggaggtgtcttcttaacacaaagatcaccggggatgatgcacctggtgaaacttggcacatggttttcaccactgagggagaggttccttacagagaaggacaatccattggaataattccagacggtattgacaagaatggcaaacctcacaagctgagattgtattcaattgctagcagtgctcttggtgattttggagactccaaaactgtttctctatgcgtgaaacgtcttgtgtacacaaatgatgccggagaagttgttaagggagtctgctcaaatttcttgtgcgatttgaagcctggaagtgaagtaaagattacaggaccaattggtaaagaaatgcttatgccaaaagatcctaacgccaccgtcatcatgttgggaactggtactggaatcgccccattccgctcatttttatggaaaatgttcttcgagaagcatgaagattacaagttcaatggtttggcatggctcttcctaggtgtccccacaagcagctcactgctttataaggaggaatttgaaaaaatgaaggagaaagcacctgaaaacttcaggcttgactttgctgtcagcagagagcaagtaaacgataaaggagagaaaatgtacatccaaaccagaatggctcaatatgccgaagagttgtgggaattactcaagaaagacaacacctttgtttacatgtgtggactgaaaggaatggaaaagggaattgatgacatcatggtctcactcgctgccaaagacggtattgattgggtcgagtacaagagacagttgaagaaatccgagcaatggaacgtcgaagtttattaatttattttcacttgcacagataacaagttccattttgtgcagcagcatatctatataccatcctgcattctgtagatagattacaacccttgtaattttggtatgacaaaaaattataccttgcttgtgaacaatattgtttgtagaatcgttgcaagaaataatttgaggatcatgcaatatagatgaaaccaacttcatcaattttaatgttagttggaggtattgagaaaa

SEQ ID NO: 1199 - DNA, 2234 bp, Brassica juncea
gccagaagaaagacagataaggcccatcttcctttgcattagttgatcaaacatggctgctgctgctgctataggtgctgcagtctcttacccttcatcaaagtcctcttctcttccctccaaaacttccttcgtctcccctcaaaggattttcctcaacaacaacaacaagagcacgctgtgctacagagaggcgtgtatttatgggggaagagtgaaggctcaggtgacgacagaggcgccagtgaaagtagccaaggagtcaaagaaacaggaagaaggaatagttgtcaacaaattcaaaccaaaggaaccttacactggtcgatgcctcttgaacaccaggatcactggtgatgacgctcccggtgaaacctggcacatcgtcttcaccaccgaaggtgaggttccgtacagagaagggcagtcgataggagtgattccagagggaattgacaagaatgggaagccccacaagctgaggttatactctattgccagcagtgccattggtgactttggtgattccaagaccgtttctctttgtgtcaagaggttagtttacactaacgaaagcggagagcttgttaagggagtctgctccaacttcttgtgtgacttgaagcctggtgatgaggcaaagatcactggaccagttggaaaagaaatgcttatgcctaaagatcctaatgccaccatcatcatgcttggaacaggaactggaatagctccattcagatcgtttttgtggaaaatgttctttgaggagcacgaagactacaagttcaatggtttggcatggctcttcttgggtgtaccaacaagcagctcactgctctacaaggaggagtttgagaagatgaaggagaagaaccctgaaaacttcaggctggactttgcggtgagcagggagcagactaacgacaagggagagaaaatgtacatacagacaagaatggctgagtatgcagaagagctgtgggagttgctgaagaaagacaacacatttgtttacatgtgtggcctcaagggtatggagaaaggtatagatgagatcatggtctcacttgctgctaaagatgggatcgattggttcgagtacaagaagcagttgaagaagagtgagcagtggaatgtggaagtttactaagcagagcttgtgaggggttttattatgtagataaaggagctgatgccattggtcaattcttcgtttctgcatctttattcttccttgcgagaatattatatagtggaatacaatcatggcgctacaaccaacaaatcattgtggtaggtttacaacttaaaatcaacctctctagttgaaaagaggcgggactggcaagttctattgtacgacacaaatcagctgcagttcatgaattaggatttggcaaattaataagcaaatccactttctattcctcagacagtcaagaacctaacgacccttttttcaagtgcgattataatagataacatcataacacattcttctctggtgccattttcttgattttggcaacaaagaggccgctggttgctgaggtggaagggtcgaaacgcactgtttttggagtgcgtccacttctacacggccattccttggccatttcaatctcctgcagctctgcagaggagctttcagcaaggaactgatccaccacatcttcgttttgggcatgcgtcaaactgcaggtgctgtatacaagaatgccaccttgtttcaacaatctgaatccatttctcagtagatttaactgaagagcagtcaagtttgtatcggttctctcagcatcaagtacacggcgttccaaggttgtccaaccccattgttcaaatttctggatatgcttgattgaaccatcatgtgtgcactctgcgtctacaagaaccttgtcatacccacgatttgcgcaatcattttggtcaaggggtctaaaaagctccttctttggtagcccaattactccggagttgtgtccgtagaaaacaatttccgggtgagcatgaagcggcaaaacaaagttattcctggtcttggctacttgtttcctttctttgtaaggtctacgagaagtccactgcttgaatgtttcttcatcacatgaaccacaaggtaggtttgtggtaggtggaagtgagaaagtagttccatcagcaaggaaaagacgactcctatcaccgagaccatatttttgaagcatggttctgcaggcagagaggcgatg

SEQ ID NO: 1200 - DNA, 1282 bp, Fagus grandifolia
ggcttctgcagtcaatgctgcagtatcttttccatcatccacgtcatcctctctaccgaccagaacttctacagtatattcagaaagaatcagcttcagtaagaatgttttctattctagaaatgtatacgttggtaggaaattgtttcacattagagcccaagtgacacaggctccagcaaaagtagaaaaagtttcaaagaaagatgatgagggtgtggttgtcaacaagttcaagcctaaggagcctttcattggtaagtgccttctcaactccaagattactgcggatgatgcccctggagagacctggcacatggtgttcactactgagggggaagtcccttatagagaaggacaatccattggtattattccggatggcattgacaagaatgggaaaccccacaagcttagattgtattctattgccagtagtgctcttggagactttgggaactccaaaactgtttctttgtgtgtcaagaggcttgtctacaccaatgaccaaggagaagaagttaaaggagtttgctcaaatttcttgtgtgacctgaagcctggtgctgatgtgaaaatcacaggacctataggaaaagaaatgcttatgccaaaagatccaaatgccacggttataatgcttgcaactggaactggaattgctcctttccgctcattcttgtggaaaatgttttttgagaagcatgagagctataagtttaatggattggcttggctctttttgggtgttccaacaagtagctcattgctctacaaggatgagtttgggaaaatgaaagagaaggcaccagagaacttcagagttgattatgctgtgagcagagaacaaaaaatgacaagggtgagaagatgtacatccaaacccgaatggcacaatatgcagaggagctatgggagttactcaaaaaagataacacctatgtatatatgtgtgggctcaagggaatggagaaggggattgatgacataatggtgtctttggctgctaaagatggcatcgactggcttgaatacaggagacaattgaagaaggcagagcaatggaatgttgaagtatattgattctactggtgttacacatatacactgaagaatcccttatcattatttcttctgtgtaaaggagataggtaatcttatatgtaatttattataacttaacttaatctacttattttgtatagcattgcaatatcgcattaagtactggattaaggatatactatactattttgtagtaaggtctgtaacttctaagaac

SEQ ID NO: 1201 - DNA, 1528 bp, Theobroma cacao
ctcttgttggttctacctgacttcaattcgtcctccacttcaaggcctcaattctgcttagaggcctctgtgattcttttgtgtgagagaaacaatggcactgaccgtcaatgctgctgtatctctcccatcttccaagtcatcttctctttcatttaaaagctctatcactatatctgaaagaatgaacttcaacaagagtgtatggtactccaggaatgtcagcgctggtggaaatgtggtttccattaaagctcaggtcactacggaggctcctgcaaaagtagtgaaagtttccaagaaagatgacgaaggtgttgttgttaacaagttcaagccaaagaatccttacattggaaagtgccttctcaacaccaaaattactggagatgatgctcctggagagacttggcacatggtttttagcactgaaggggaagtgccttacagagaaggacaatccattggtgtcactcctgagggtattgacaagaacggaaaaccccacaaacttagactgtactccatcgccagtagtgctttgggagacttcggcacttctcaaactgtttccttgtgtgtcaaaaggcttgtttacaccaatgaacaaggagagatagtgaaaggagtttgctcaaatttcctgtgtgacttgaagcctggtgctgatgggacgatcactggaacctgttgggaaagagatgcttatgccaaaagatccaaatgccaccatcataaggcttgcaactggaactggaattgctcctttccgttcattcttatggaagatgttctttgagaagcatgatgactacaagtttaatgggttggcttggctcttcttgggtgtacccacaagtagctcactgctctacaaggacaaatttgagaagatgaaggagaaggcaccagataacttcagggtggattacgtcgagagtagagaacaaacaaatgacaagggtgagaagatgtatattcaaacccggatggcccagtatgctgaagagctatgggaattgctcaagaaagataacacctatgtctacatgtgcgggctcgagggtatggagaagggaattgatgaaatcatgacttctttggctgccaaaaatggcattgattggcttgaatacaagagacaattaaagaaagcagaacaatggaacgttgaggtctaccgatcttggctgcattgtatttctacaggggattttgccattctgtcaacacttcctctactcctgcactacttcgcaccatatattttttaacgcatttgatatagaagttgaattttttagctcaactcatgtattctttcctcaagacaggttgtatagtgcaaatttgaaggagataactcctttccactgtatcttgtaatattgcattttctaatcatctgtgttactttagtcgacactttctggtcatcatctgaagtgacgagaagctcattcttctcacattcaatcaaattacctgatggaaaggcaatgttaaggttcattctttagtttagcaa

SEQ ID NO: 1202 - DNA, 1625 bp, Brassica rapa
gtgaacatatttttatttgggtggatagtgttaggacaatgttgaacagagagacaaatgagaagctgtaataacttatccacttacacttggccttgcattttcattcacacaatctacaaacatccaatcacaaacctgatcatatcatatagcttcctctttaacattttttctctgatcttttattttctgttttgtaagaagaaagacagagaggcccatcttccttgcatagttgatcaaacatggctgctgctgctgctataggtgctgcagtctcttatccttcatccaagtcctcttctcttccctccaaaacttccttcgtctcccctcaaaggattttcctcaacaacaagagcacactgtgctacagagaggcgtgtgtatatgggggaagagtgaaggctcaggtgtcaacagaggcgccagtgaaagtagccaaggagtcaaagaaacaagaagaaggaatagttgtcaacaaattcaaaccaaaggaaccttacactggtcgatgcctcttgaacaccaggatcaccggcgatgacgctcccggtgagacctggcacatcgtcttcaccaccgaaggtgaggttccgtacagagaagggcagtcgataggaataattccagaaggaattgacaagaacgggaagcctcacaagctgaggttatactctatcgccagcagtgccattggtgactttggagactccaaaaccgtttctctctgtgtcaagagattagtttacactaacgaaagcggagaggttgttaagggagtctgctccaacttcttgtgtgacttgaagcctggtgatgaggcaaagatcactggaccagttggaaaagaaatgcttatgcctaaagatcctaatgccaccatcatcatgcttggaacaggaactggaatagctccattcagatcatttttgtggaaaatgttctttgaggagcatgaggactacaagttcaacggtttggcatggctcttcttgggtgtacccacaagcagctcactgctctacaaggaggagtttgagaagatgaaggagaagaaccctgaaaacttcaggctggactttgcggtgagcagggagcagactaacgacaagggagagaaaatgtacatacagacaagaatggctgagtatgcagaagagctgtgggagttgctgaagaaagacaacacctttgtttacatgtgtggtctcaagggtatggagaagggcatcgatgagatcatggtctcacttgctgctaaagatggtatcgattggttcgagtacaagaagcagttgaagaagagtgagcagtggaatgtggaagtctactaagcaagattgtgagagggtttattattattattaaatattatgtagataaaggagctgatgccattgtcaattcttcatctttcttctgcatttgagaattttccatcaacaatctaaagagagcatcattaccaccaaaattactcttttaaatttctattcatatcatgtttggaatatgtttacatgttcaatacctcgctctaaaccttgaaacacagcagcagttgaaaagaagaagatgggcggattacataagtcttgtgatccatttcacaagctcag

SEQ ID NO: 1203 - DNA, 1270 bp, Brassica napus
agaagaaagacagagaggcccatcttccttgcatagttgatcaaacatggctgctgctgctataggtgctgcagtctcttatccttcatccaagtcttcttctcttccctccaaaacttccttcgtctcccctcaaaggattttcctcaacaacaagagcacactgtgctacagagaggcgtgtgtatatgggggaagagtgaaggctcaggtatcaacagaggcgccagtgaaagtagccaaggagtcaaagaaacaagaagaaggaatagttgtcaacaaattcaaaccaaaggaaccttacactggtcgatgcctcttgaacaccaggatcactggcgatgacgctcccggtgagacctggcacatcgtcttcaccaccgaaggtgaggttccgtacagagaagggcagtcgataggaataattccagaaggaattgacaagaacgggaagcctcacaagctgaggttatactctatcgccagcagtgccattggtgactttggagactccaaaaccgtttctctctgtgtcaagaggttagtttacactaacgaaagcggagaggttgttaagggagtctgctccaacttcttgtgtgacttgaagcctggtgatgaggcaaagatcactggaccagttggaaaagaaatgcttatgcctaaagatcctaatgccaccatcatcatgcttggaacaggaactggaatagctccattcagatcatttttgtggaaaatgttctttgaggagcatgaggactacaagttcaacggtttggcatggctcttcttgggtgtacccacaagcagctcactgctctacaaggaggagtttgagaagatgaaggagaagaaccctgaaaacttcaggctggactttgcggtgagcagggagcagactaacgacaagggagagaaaatgtacatacagacaagaatggctgagtatgcagaagagctgtgggagttgctgaagaaagacaacacctttgtttacatgtgtggtctcaagggtatggagaagggtatcgatgagatcatggtctcacttgctgctaaagatggtatcgattggttcgagtacaagaagcagttgaagaagagtgagcagtggaatgtggaagtctactaagcaagattgtgagagggtttattattattattaaatattatgtagataaaggagctgatgccattgtcaattcttcatctttcttctgcatttgagaattttccatcaacaatctaaagagagcatcattaccac

SEQ ID NO: 1204 - DNA, 3468 bp, Cajanus cajan
ctcttcgaaattctcaatcttctgcttccaccaacatacccttctactatttctacctctctttcacgtctaacttactacccatgccctccttttcaaagaggatataacaagcaaaaggtagaagagtgtgaaattggtttttgctgtgcagcttgtcatctttgacaagtgtgttgtactgttgttgtttgtacacataaatactcatctacaaaggcaacatgcctgtgaggcagatgaaagatagttccgagcaacaccttgtgatcaaaccccatttgcagaatcctatgaatccggccaagaagacaacgaaagctgctcaaaacggcaaagatccaccaccccaagaaaaccataaccaaactttgtctcacgcaaagaacaagggaagaagaagggggagaggtggcagaaaacctgatcaaggagatgttatgatgaggcctagttgcaggccatgtactgcgccactaacaagtagggcaaatgggaatgttgaaaatggttgcatcactgatactggttttcccacttcaagcaagtccttgaactttgctcgtagacctgggtatggacaagttgggacaaaatgcattgtgaaggctaaccacttctttgcagagttaccagacaaggacttgaaccaatatgatgttactattaccccagaagtgtcttctagaacagtaaacaggtccatcatagcagaacttgtgaggctgtataaagaatctgacttggggatgagacttccagcatatgatggcagaaaaagtctgtacacagcagggcagcttccctttgcttggagagaatttaaaattaagcttgtagatgaagaggatggagttaatggccccaaaagggaacgagagtacagggtagtgatcaagtttgttgctcgggcaaacttgcatcacctgggccagtttctagctggtaagcgtgctgatgcaccacaagaggcacttcaaattcttgacatagtactaagagagctgtcaactaagaggtattgccccattggaaggtccttcttttcacatgatattagaacaccacaacggcttggagagggattacagtcatggtgtggattttaccagagcataaggcctacacaaatgggcctgtccctcaatattgatatggcatctgctgcatttattgagcctcttccagtagtggaatttgttgggcagctattaggaaaagatgtgctttcaagaccattgtcagatgcagatcgcattaagattaagaaagcccttagaggagttaaagttgaagtgacccacagaggaagtgtgagaagaaaatatcgtgtttcggggttgacttctcaaccaacaagagaacttgtgtttcctgttgatgagaactcaactatgaaatcagtggttgaatacttccaagagatgtatggtttcactattcaatacactcaccttccttgccttcaagtaggaaaccaaaagaaggccaactatttacctatggaggcatgcaaaattgttgaggggcaacgttatacaaaaagattgaatgagaagcaaattactgctctgttaaaagttacttgccagagacctcgcgatcgggaaaatgacattttacggaccattcagcataatgcttatgatcaagatccttatgcaaaggaatttggaattaaaatcagtgaaaagctagcttccgttgaagcacgaattcttcctgccccttggcttaaatatcacgaaagtgggaaagaaaagaactgtttaccccaagttggtcagtggaatatgatgaacaagaaaatgattaatggaatgactgttagccggtgggcatgcataaatttttcacggagtgtgcaagatagtgttgctcgcactttttgtaatgagctttctcaaatgtgtcaagtatctggcatggaatttaacccagagcctgttatccccatatacaatgccaagcctgaacaggtgggaaaagctttgaaacatgtttaccatgtttcagcgagcaaaactaaaggaaaggagttggagcttttgttagcaatattgccagacaataatggatctctctatggtgatctcaagcgtatttgtgaaactgaccttggcttaatctcacaatgctgtctgacaaagcatgtcttcaaaatcactaaacagtacttggctaatgtgtctctgaagatcaatgtaaagatgggaggtagaaacactgtacttcttgatgctgtaagctgcagaataccattggttagtgacataccaaccataattttcggagcagatgtaacccaccctgaaaatggagaagactcaagcccctcaatagcagctgtagtagcatcccaggactggcctgaagtgacaaaatatgctggtttagtgtgcgcccaagctcacagacaggaacttatacaggatttgtacaaaacatggcatgaccctgttcgtggcacagtcagtggtggcatgatccgagatttactggtttcctttagaaaggcaacaggacaaaagcctctgcggattatattttacagggatggtgtaagtgaaggacaattttaccaagttttactctatgagttggatgcgattcgaaaggcatgtgcttccttagaaccaaactaccagcctcctgtaactttcatagttgtgcaaaaaagacaccatacccggttattcgcaaacaactacagggacagaagcagtacagataggagtgggaatatattgcctgggactgttgttgattccaaaatctgccatccaacagaatttgatttttatctctgcagtcatgctggcatccagggtaccagtcggccggcacattatcatgttttgtgggatgaaaacaacttcacagcagatggaattcagtctttgacaaacaatctgtgttatacatatgccaggtgtacgcgctcggtatctgtagttcctccagcatattatgcacatttagcagcctttcgagcccggttctatatggaaccagatatgcaagagaatggctctaatggtgatggtaatggtcatagttccaaaggaacacgtgtagctggagattatagtgtcaagccattgccagacttgaaagaaaatgtgaagagagtaatgttttactgttagacttctaggtaggtaagtgaaacgatcatggaattcaatgttcacctcacattactttgtacattagttgtggttcatgcatagcagctaggtttcccgtgatagatgcatgattacagttctttaggcttagttagttttagaatgaattcctacaagtattattaggttttatagatgctgtcaaatttggcattgtaaaaatattctgtcaatcattgtagaaaattttgccataaggcctttacaaatgttgaagagtagaaatttcctacttcatctttgcaaggaggggaagtttttctaattagtctaattt

SEQ ID NO: 1205 - DNA, 3791 bp, Glycine max
gagagtaaaagcaaagaggcagggaaagccttctacacgtgataaagaaagaaccaaaaagcgcattgcatgcgtgtataagatcatcataatcatcatcatcgctctttcttacccaacttgcctttcctttcttcttcctctttcaaaattctcaatcttctgcttccaccaacacacccttctactattcctaccctcccttcattcctttcacttcttacttaccacccatgtttcacaagcccttcttttcaaagaggatataataacaatcaaaggctagaagagtgtgaaattggtttttgctgtgaagcttgtcacctttgacaagtgtgttgtactgttgtcgtttgttcacattctggtgagaggagtaagcactcatcaacaacaacaaagccaacatgccagtgaggcagatgaaagaaagttcggagcaacaccttgtgatcaaaccccatttgcagaatcctatgaatcaagccaagaagacaaccaaagctgcacaaaatggcaaaggtccaccgccacaagaaaaccataatcaaactttgcctaactcaaagaacaagggaagaagaagggggagaggtggcagaaaatctgatcaaggagatgttatgatgaggcctagttgcaggccatgcactgcaccactaacaagtagtgcaaatgggaacgctgaaaatggttgtatctctgatacgggttttcccacttcaagcaagtctttgacctttgctcgtaggcctgggtatggacaagttgggacaaaatgcattgtgaaggctaaccacttctttgcagagttaccagacaaggacttgaaccaatatgatgttactattaccccagaagtgtcttctagaacagtaaacaggtctatcatagcagaacttgtgaggctgtataaagagtctgacttggggatgagacttccagcatatgatggcagaaaaagtctgtacactgcagggcagcttccctttgcttggagagagtttaagattaagcttgtagatgaagaggatggagttaatggccccaaaagggaaagagagtacagggtggtgatcaagtttgttgctcgggcaaatttgtatcacttgggccaatttctagctggtaagcgtgctgatgcaccgcaagaggcacttcaaattcttgacattgtactaagagagctgtcaactaagaggtattgccccattgggaggtccttcttttcacctgatattagaacaccgcaacggcttggagagggattagagtcatggtgtggattttaccagagtataaggcctacacaaatgggcctttcccttaatattgatatggcatctgctgcgtttattgagcctctgccagtagtggaatttgttggtcagctattaggaaaagatgtgctgtcaaggccattgtcagatgctgatcgcattaagattaagaaagcccttagaggagttaaagttgaagtaacacacagaggaagtgtgagaagaaagtatcgtgtttctgggttgacttctcaacctaccagagaacttgtgtttcctgttgatgagaactcaactatgaaatcagtagttgaatacttccaagagatgtatggtttcactattcaatatactcaccttccttgccttcaagtaggaaaccaaaagaaggcgaactatttacctatggaggcctgcaaaattgttgaggggcaacgttatacaaaaagattgaatgagaagcaaattacggctctattgaaagttacttgccagaggcctcgcgatcgggaaaatgacattttacggaccgttcaacataatgcttatgatcaagatccttatgcaaaggaatttggaattaaaatcagtgaaaagctagcttctgttgaagcacgaattcttcctgctccttggcttaaatatcatgaaagtgggaaagaaaagaactgtttaccccaagttggtcagtggaatatgatgaacaagaaaatgattaatggaatgactgttagccggtgggcatgcataaatttttcacggagcgtgcaagatagtgttgctcgtactttttgtaatgagcttgctcaaatgtgtcaagtatctggcatggaatttaatccagagcccgttatccccatctacaatgccaagcctgaacaggtggagaaagctttgaaacatgtttaccatgtggcagggagcaaaactaaagcaaaggaattggagcttttgttagcaatattgccagacaataatgggtctctctatggtgatctcaagcgaatttgtgaaactgaccttggcttaatttcacaatgctgtctgacaaagcatgtcttcaaaatcactaaacagtacctggctaatgtgtctctgaagatcaatgtgaagatgggaggtagaaacactgtacttcttgatgctgtaagctgcagaataccattggttagtgacataccaaccataatttttggagcagatgtaacccacccagaaaatggagaagactcgagcccttcaatagcagctgtagtagcatcccaggactggcccgaagtgacaaaatatgccggtttggtatgcgcccaagctcataggcaggaacttatacaagatttgtacaaaacttggcaagaccctgttcgtggcacagttagtggtggcatgatccgagatttactggtttcctttagaaaggcaacaggacaaaagccactacgaattatattttacagggacggtgtaagtgaagggcaattttaccaagttttactttatgagttggatgcgattcggaaggcatgtgcttccttagaaccaaactaccagcctccagtaacattcatagttgtgcaaaaaagacatcatacccggttatttgcaaacaactacagggacagaagtagtacagataggagtgggaatatattgcctgggactgtcgttgattccaaaatctgccatccaacagaatttgatttttatctctgcagccatgctggcatccagggtactagtcggccagctcattatcatgtcctgtgggatgaaaacaacttcacagcagatggaattcagtctctgacaaacaatctttgttatacatatgccaggtgtacgcgctcagtatcagttgttcctccagcatattatgcacatttagcagcgttccgagcacgtttctatatggagccagatatgcaagacaatggctctgcaggtgatggcaatggttatggtgccaaagcaacacgagcagctggtgattatagtgtcaagccattgccagacttgaaagaaaatgtgaagagggtcatgttttactgttagactgctagtgacttggccttggtggaatgatagatatatagggcaagcatcaacatggtaggtaagtgaaaacaatcatggaatgcaatgttcagctcacattactttgtacattagtcgtgtaggtttcctgtgataaatccatgattacagttcttgaggcatagcttagaatgaattcctacaagtactattagattctatatagatgtcaaatttagcattgtaaaaaatattctatgtcaatctttgtagaaaattttgccataaggcctttacagatgctgaagaagagtagaaatttccttcatctttgcaaggagggaagtttttccaagtattcatgtttattctgcactatagctaaagcataatgggatacaagttagtgtaacgtttcattgctaatttgctatctctccctgtgaataaacaaccgaaaatattgctagaagaaaa

SEQ ID NO: 1206 - DNA, 4054 bp, Glycine max
aagcaactaaaaaaaataatttcttgatataataagattatttaagaaattgatgactttaagtcttttaataaatactcactctttcattcgtaaaaatctaaaattgaattaattaccaaacacatgcttatagttaagagatataattatctaacaaaacaaaacatgttaatttaatactagtctctattatgggcatggtgtatcaccgaggctgcggaaacagataggtgagagtaaaagcaaagagctgggaaagccttttacacgtgataaagaaagaaccaaaaagctcattgcatgcgtgtataagatcatcataatcatcatcaacgctattacttaccctgcttccctttcctctttcaaaattgtcaatcttttgcttccaccaacacacccttctactatttctaccctcctttcattcctttcacttcttacttaccacccatgtttcacaagctctccttttctaagaggatataacaagcaaaggctagaagagtgtgaaattggttttggctgtgaagcttgtcacatttgacaagtgtgttgtactgttgtcgtttgtacactttctggtgtgagaggagtaagccagcacttatcaacaacaaagccaacatgccagtgaggcagatgaaagaaagttcggagcaacaccttgtgatcaaaccacatttgcagaatcctatgaatcaagccaagaagacaaccaaagctgcacaaaatggcaaaggtccaccgccacaagaaaaccataaccaaacttcgccacactcaaagaacaagggaaggagaagagggagaggtggcagaaaacctgatcaaggagatgttatgatgaggcctagttgcaggccatgcactgcaacactaacaagtactgcaaatgagaatgctgaaaatggttgcatctctgatatgggttttcccacttcaagcaagtctttgacctttgctcctaggcctggatatggacaagttgggacaaaatgcattgtgaaggctaaccacttctttgcagagttaccagacaaggacttgaaccaatatgatgttactattaccccagaagtgtcttctagaacagtaaacaggtctatcatagcagaactagtgaggctgtataaagagtctgacttggggatgagacttccagcatatgatggcagaaaaagtttgtacactgcagggcagcttccctttgcttggagagagtttaagattaagcttatagatgaagaggatggagttaatggccctaaaagggaaagagagtacagggtggtgatcaagttcgttgctcgggctaacttgtatcacttgggacagtttctagctggtaggcgtgctgatgcaccgcaagaggcacttcaaattcttgacattgtattaagagagctgtcaactaagaggtattgccctattgggaggtccttcttttcacctgatattagaacaccgcaacggcttggagagggattagaatcatggtgtggattttaccagagtataaggcctacacaaatgggcctttcccttaatattgatatggcgtctgctgcgtttattgagcctcttccagtagtggaatttgttggccagctattagcaaaagatgtgctgtcaaggccattgtcagatgctgatcgcattaagattaagaaagcccttagaggagttaaagttgaagtaacacacagaggaagtgtgagaagaaaatatcgtgtttctggattgacttctcaaccaaccagagaacttgtgtttcctgttgatgagaactcaactatgaaatcagtagttgaatacttccaagagatgtatggtttcactattcaatatactcaccttccttgccttcaagtaggaaaccaaaagaaggctaactatttacctatggaggcctgcaaaattgttgaggggcaacgttatacaaaaagattgaatgagaagcaaattacagctctgttgaaagttacttgccagagacctcgcgatcgggaaaatgacattttacggaccgttcaacataatgcttatgatcaagatccttatgcaaaggaatttggaattaaaatcagtgaaaagctagcttctgttgaagcacgaattcttccggccccttggcttaaatatcacgaaagtgggaaagagaagaactgtttaccccaagttggtcagtggaatatgatgaacaagaaaatgattaatggaatgactgttagccggtgggcatgcataaatttttcaaggagcgtgcaagatagtgttgctcgcactttttgtaatgaacttgctcaaatgtgtcaagtatctggcatggaatttaatccagagtctgttattcccatctacaatgccaaacctgaacaggtggaaaaagctttgaaacatgtttaccatgtgtcagggagcaaaattaaaggaaaggaattggagcttttgttagcaatattgccagacaataacgggtctctctatggtgatctcaagcgaatttgtgaaactgaccttggtttaatttcacaatgctgtctgacaaagcatgtcttcaaaatcactaaacagtacttggctaatgtgtctctgaagatcaatgtgaagatgggaggtagaaacactgtacttcttgatgctgtaagcagcagaataccattggttagtgacatgccaaccataattttcggagcagatgtaacccaccctgaaaatggagaagaattgagcccttcaatagcagctgtagtcgcatcccaggactggcccgaagtgacaaaatatgccggtttagtatgtgctcaagctcataggcaggaacttatacaagatttgtacaaaacttggcaagaccctgttcgtggcacagttagtggtggcatgatccgagatttactggtttccttcagaaaggcaacaggacaaaagccactacgaattatattttacagggatggtgtaagtgaaggacaattttaccaagttttactttatgagttagatgcaattcggaaggcatgtgcttccttagaaccaaactaccagcctccagtaactttcatagttgtgcaaaaaagacatcatacccggttatttgcaaacaactacagggacagaagcagtacagatcggagtgggaatatattgcctgggactgttgttgataccaaaatctgccatccaacagaatttgatttttatctctgcagccatgctggcatccagggtactagtcggccagctcattatcatgtcctgtgggatgaaaacaacttcacacctgatggaattcagtctctgacaaacaacctttgttatacatatgccaggtgtacacgctcagtatcagttgttcctccagcatattatgcacatttagcagcgtttcgagcacgtttctatatggaaccagatatgcaagacaatggctctgcaggtgacggtaatggtcatggtgccaaagcaacacgagcagctggtgattatagtgtcaagccattgccagacttgaaagaaaatgtgaagagagtcatgttttactgttagactgcttagtggcttggccttggtagaatgatagatatatggggcaagcatcaacatgataagcaagttttcaaatcatggagtgcaatgttcacctcacattactttgtacattagtcgtgtaggttttgctgtggtagatccatgattacagttcttgagccatagtttagaatgaatttctacaagcattattaggttttatatagatgccaaatttagcattgtaaaaaatattctctgtcaatctttgtagaaaattttgccataaggcctttacagatgctggagtagaaatttccttcatctttgcaaggaggggaagttttttcctagtattcatgtttatcctgcactatagctaaagcatattgggatacaagttagtgtaccatgtgaataacaaccaaaaatattgctagaagaaagaaaaagagaaaccatactcatacaataaatatatgcatcaataacaatttatacaaataaaagatagaaa

SEQ ID NO: 1207 - DNA, 3775 bp, Lotus japonicus
aatttatgggcatggtacatccccgaggctgcgcaaagcagagagaggaggcaactttaaaagcaaagaggcagggaaagccttttacacgtgataaagaaagaaccaaaagtgctttgcatgcgtgtgtaagatcatcatcatcatcactctttccttcactttcctttcttcttccttcaacgattctgaatcttccaccaccctctctactatttctaccccctcactcactccttcaagctccttcctttgttaaacaagtcaaacaagctgaagcaattggtactgtttggaaggtgtttgaagcaaaagctaaaagagaaattggtgcttttttgcattttacattgattccagtttaagtactcatcaataaaagctaacaacatgccattgaggcagatgaaagaagggtctgagcaacacctagtgatcaaaccccatttgcagaaccagaaccccatgtgtactccagctaagaaggtaccgaaagctactacccaaaatggccaaggtccatcaccacctcaagaaaaccatagccaaacttcacctcacccaaggaacaagggaaggagaaggggcagaggaggcagaaaatgtgatcaaggtgatgttttgatgaggcctagttgcaggccttgcactgcaacaagttcttctgcaaatggaaatgttcaaaatggctacacctctgggaatgtagatatgggttttcctacttcaagcaagtctttaagctttgctcgtagacctggatttggacaagttgggacaaaatgcattgtgaaggctaaccacttctttgcagagttaccagacaaggacttgaaccaatatgatgttactattaccccggaagtgtcttcaagagcagtaaataggtccattatagctgaacttgtgaggctgtataaagagtctgacttagggatgagacttcctgcatatgatggcaggaaaagtctgtacactgcagggcagcttccatttgcttggagagaatttaagattaagcttgtagatgaacaagatagagtaaatgtccccaaaagggaaagagagtacaatgtggtgataaagtttgttgctcgggcaaacttgcatcacttaggtcagtttctagctggtaagcgtgctgatgcaccgcaggaggcacttcaaattcttgacattgttctgagagagctgtcgaataagaggtattgtcccattgggaggtccttcttttcacctgatattagaacaccacaacggcttggagagggattggagtcatggtgtggattttaccagagcataaggcctactcagatgggcctttccctcaatattgatatggcatctgctgcattcattgaacctcttccagtagtagagtttgttggccaactattagcaaaagatgtgttgtcaaggccgttgtcagatgctgatcgcattaagattaagaaagcccttagaggagttaaagttgaagtaacacacagaggaagtgtgagaagaaaatatcgtgtttctgggttgacttctcaaccaacaagagaacttgtgtttcctgttgatgagaactcaactatgaagtcagttgttgaatacttccaagagatgtatggtttcactattcaatatgctcaccttccttgccttcaagtaggaaaccaaaagaaggctaactatttacctatggaggcctgcaaaattgttgaggggcaacgctatacaaagagattgaatgagaagcaaattacttctctgttgaaagttacttgccagagacctcgtgatcgggaaaatgacattttacagaccgttcaacataatgcttatgaccaagatccttatgcaaaggaatttggattgaatatcagtgaaaagctagcttctgtcgaagcacggattcttcctgccccatggcttaaatatcatgaaagtgggaaagagaagaactgtttaccccaagttggtcagtggaatatgatgaacaagaaaatgattaatggaatgactgttaaccggtgggcatgcataaatttttcacggagcgtgcaagatagtgttgctcgcactttctgtaatgagcttgctcaaatgtgtcaagtatctggcatggaatttaacccagagcctgttattcccatctacaatgccaagcctgagcaggtggtgaaagctttgaagcatgtttaccatgtttcgtcaaacaaaactaaaggaaaggaattggagctgttgttagcaatattaccagacaataatgggtctctctatggtgatctcaagcgtatatgtgaaactgacctgggtttaatttcacaatgctgtctgacaaagcatgtctttaaaatcactaaacagtacttggctaatgtgtctctgaagatcaacgttaagatgggaggtagaaacactgttcttcttgatgctttgagctgcaggataccattggttagtgacataccaaccataatttttggagcagatgtcacccaccctgaaaatggagaagactctagcccctcaattgcagctgttgtagcatcccaggactggcctgaagtgacgaaatatgctggtttagtgtgtgctcaagctcatagacaagaacttatacaagatttgtacaaaacttggcaggaccctgttcgcggcacagttagtggtggcatgataagagacttactggtttcctttagaaaggcgacaggacaaaagccactacgaattatattttacagggatggtgtaagcgaggggcaattttaccaagtattactttatgagttggacgcaatccggaaggcatgtgcgtccttggagccaaactatcagcctccggtaactttcatagttgtacaaaaaagacaccatactcggttattcccaaacaaccacaaggacaggagcagtacagataagagtgggaacataatgcctgggactgttgttgattctaaaatctgccatccaacggaatttgatttttatctctgcagtcatgctggcatccagggtactagtcgacctgctcattatcatgttctatgggacgaaaacaacttcacagcagatggaattcagtctttgaccaacaatctttgttatacatatgcgaggtgtacacgctccgtgtccgttgttcctccagcatattatgcacatttagcagcttttcgagcccgtttctatatggaaccagatatgcaagagaatggctcttcaggtgacggtaacactagtaacagctccaaggggacacgagtagctggagagtgtggtgttaagccattgccagccttgaaagaaaatgtgaagagagtgatgttttactgttagacttggaattggtagatgatagagcatcaaatagtagaaaactggaacaatcattgaatgcagtgctcacttcagattagcatgtacattagtcgcggttcatgcatagcggtcaggtttcctgtgatagattcacgtaggtttggtttcatggtgaaatgttgaagaatcacttatagttggaaattaaaaattacaagacttagcttttgaagaaccttggaaaccaatcaccaacttagtttagagttcctagaagtattaggttttatagatattgtaaaagttggcattgtaaagaatgttctatcagtcttcattgtagaaaattttgcctgaagatctttctaacatagaaatttcccacttcatttttcaatgaggggaagtttcatctcattagttttgcaatataattagccaacattcacgttta

SEQ ID NO: 1208 - DNA, 3576 bp, Cicer arietinum
atttgttttagttttgcgtagatcataaataggcataataggtacatgacatccccgagactgcgcaagcaagagagagagagagagagagagaagtttaaaagcaaaagagagagaagcaggggaaaggcttttacacgtgataaagaaagaagcaaaagtgttttgcatgcgtgtataacttcatcatcatcatcttctctttctcttactatattcttacttaaattaaactcacttaccctctttcctttccatttcctttctttcaaaattctcctatatccttctaatacagatactttgcaacccattttttttgtcaacaaagtgttattggagatataataatcaaaagctagaaagaagcaaaagcttttcagcaaacatgccagtgaggcaaatgaaagaaagcttagagcaacacattgtgatcaagccccatttgcagaatccaatgaatacatctaataattcaccaaatgcttctcaaaatttcaaaggtccaccacaacaaccttccctagaaaatcatagtcaaacttcacctcaaccaaggaacaaaggaagaagaaggggaagagggggtagaaaatctgatcaaggtgacattttgatgagaccaagttcaagaccatgcactactacaaatggaaatgttgaaaatggttacatctctagtgaaaaagatgttggttttcctacttcaagcaagtctttgagctttgctcgtagacctggatatggacaagttgggacaaaatgcattgtcaaggctaaccatttctttgcagagttaccagacaaggacttaaaccaatatgatgttactattactccagaagtgtcttcaagaacagtaaacaggtccattatagctgaacttgtgaggttgtataaagagtctgatttaggtacgaggcttccagcttatgatggcagaaaaagtctgtacactgcagggcagttacccttttcctggaaagagtttaagattaagcttgtggatgaagaggatggaattaattgcaccaaaagggtaaaagagtacgtggtggtgatcaagtttgttgctagggcaaacttgcatcatttaggccagtttctagctggtaagcgtgctgacgcaccgcaggaggcgctacaaattcttgatattgtactaagagagctatcaactaagaggtattgctccattgggaggtctttcttttcacctgatataagaagaccacaacggcttggagagggattggagtcatggtgtggattttaccagagcataaggcctactcagatgggcctttccctcaatattgatatggcatcagctgcatttattgagcctcttccagttgttgaatttgttggccagctgctaggcaaagatgttctttcaaggccattatcagacgcagatcgcatcaagattaaaaaaggtcttagaggagttaaagttgaagtgacacacagaggaagtgtaagaagaaaatatcgtgtttcaggcttgacttctcaaccaacaagagaacttgtgtttcctgttgatgagaattcaactatgaagtcagtagttgaatacttccaagagatgtatggtttcactattcaatatactcaccttccttgccttcaagtaggaaaccaaaagaaggctaactacttacctatggaggcctgcaaaattgtcgaagggcaacgttatacgaaaagattaaatgagaagcaaattacttctctactgaaagttacttgtcagagacctcgcgatcgtgaaaatgacattttacagactgttcaacataatgcttatgatcaagatccttatgcaaaggaatttggaattaacatcagtgagaagctagcttctgttgaagcaagaattcttcctgctccttggcttaaatatcatgaaagtggcaaagaaaagaactgtttaccccatgttggtcagtggaacatgatgaataagaaaatgattaatggaatgactgttaaccggtgggcgtgcataaatttctcgcggagtgtgcaagatagtgtcgcacggactttttgtaacgaccttgctcaaatgtgtcaagtatctggcatggaatttaatctggagcctgttatccctatctacaatgcaaagcctgagcaagtggagaaagctttgaagcatgtttaccatgtgtcaacaaacaaaactaaaggaaaggagttggagctcttgttagcaatattgccagacaataatggttctctctatggtgatctcaagcgtatttgtgaaactgaccttggtttaatttcacaatgctgtctaacaaagcatgtcttcaaaataactaaacagtatttggctaatgtgtcgctgaagatcaatgttaagatgggaggtagaaacaccgttcttcttgatgcggtatgctacagaataccattggttagtgacataccaaccataatttttggagcagatgttacacatcctgaaaatggagaagactctagtccctcaatagcagctgtagtagcttctcaagattggcctgaagtgacaaaatatgctggtttagtttgtgctcaagctcatagacaggaacttatacaggatttatataaaacatggcatgatcctgttcgtggcacagttagtggaggcatgataagagatttattgatttcctttagaaaggcgacgggacaaaagccgttacgaattatattttacagggatggtgtaagtgaaggacaattttaccaagttttactttatgagttggatgcaattcgaaaggcatgtgcttccttggaaccaaactatcagccaccagtaactttcatagtcgttcaaaaacgtcatcatactcggttatttccaaataaccatcgggacagaagcagtacagataagagtggaaatatattacctgggacggttgtcgattctaaaatttgccatccgacagaatttgatttttatctctgcagtcatgctggcatccagggtactagtcggccggcacattatcatgttctatgggatgaaaacaatttcacagctgatggaattcaatctctgacaaacaatctttgttatacatatgcaaggtgcacacgatctgtatcggttgttcctccagcatattatgcacacttagcagcgtttcgagcccgtttttatatggaaccagatatgcaagagaatggatctaatggtgatggtaattcaagtcatagttccaagggaacacgaacaactggagaatgtggtgtgaagccattaccagccttgaaagataatgtgaagagagtgatgttttactgttagactgatttagatgtagtcaaagttggcattgtaaagagtattatgtgtcaatcttcattgtaggaaattttgctcatctttgtaaggaggggaagtttttctaattagtctttaacataaacattgagccaacaatcatgtttttcttgcaccatagctgaaggaaagtgagtcatttccgtgtaacatttcattttcatttctctatgtaaataaacaaccaaaaatatgactagataatttaattcgcaaaccat

SEQ ID NO: 1209 - DNA, 4354 bp, Cicer arietinum
acatatcttctagacagtgatttagctacccttttcaatgtttattccttcacttagatgttttgttcttgatttttgttttcttgtggttgttttattctcttcaaacttggcttcacatttttttttttaattccaatgtttatttaagtttttttattttttttatgttgttctgtttgttgatttttcattgtttttggtaggggacaggcctaagaagcttgttttgtcttctgggtatttccatttttctgggttttcccatttttctaatcaaattttatcatcaattattcttctcttcactccacaatacaaaaatgttttttgcttcatgtcagtgtcaataaagccatgattttgagctccaaatttcattgagatttccttgttttctgcttctttgaaacttcaatcaaaagggtagaagcaaatgtcttcaaaatttcactttttgttgtcttctacaacttctatcaccatttttgggtttgcttggtgaaacaaagggtaacttgttggatttttcagttttttttgcaaaggaatagtaacgttttaatgtattcttaaacagttcctttactttacactttcacgccataccatatttatctttatgcattgatacattacattgagcacaacaactcataattgagtctttgcctttttcactttattgcaataataactactactcatttggcctcacctataattttccacctttgtttatgcattctcagctgatgtaattttcactattttgcagttataggcaaaaactaaacgtgaaaaactggttatttgctgaaaaacttgttgtcacatttgactagtgagtgtgtttgtgtgtgcatcttctgtgtatatatagctatatagctatatctatctatttaaggccaacatgccattgaggcaaatgaaagagagctcagaacaacaccttgtgatcaaacccaatttgcaaaatcccatgaatcaagctaagaaagttactagagctgttcaaaatggaaaaggtccaccaccattgacacaagagcctcataatcaaacttcacctcaagcaaggactggtggaagaagaaggagtagagttggtggcagaaaatctgatcaaggggatgttttgatgagaccaagttgtagaccttgtactgttgtgaaaaacactgaaaatggaaacacagtctctagtgatgtagagatgagtttccctacctcaagcaagtctttgagctttgctcctcggccgggctatggacaagttggtacaaaatgcattgttaaagccaaccatttctttgcagaattaccagacaaggatttgaatcagtatgatgtaactattacacccgaagtattgtcaaaagcggtaaatagatccatcatagctgaacttgtgagactgtataaagagtctgaccttggaatgaggcttccagcatatgatggtagaaaaagtctgtacacagcaggggttcttcccttttcttggagagagtttaagattaagcttatagaagaagaagacgcaattaatggccccaaaagggaaagagaatacaaagtggtgatcaagtttgttgctagggccaacttgcatcacttagggcagtttctagctggcaagcgagctgatgcaccacaagaggcaattcaaattcttgacatcgttctaagagagttagcgtccaagaggttttgtcccattgggaggtcctttttttcacccgatattagagcaccacaacggctcggagaaggattggagtcatggtgtggattttaccagagtataagacctactcagatgggcctttccctcaatatcgacatggcttctgcggcattcattgaacctcttccagtggtggaatttgtcggccagctattaggaaaagatgtgctgtcaagacagttatctgatgctgatcgcattaagattaagaaagctcttagaggagttaaagttgaagtaacgcaccgagggagtgttagacgaaagtatcgtgtttcaggtttaacatcacaaccaacaagagaacttgtatttcctgttgatgagaattcaactatgaaatcagtagttgaatacttccaagagatgtacggtttcactattaaacatactcaccttccttgccttcaagttggtggaaatcaaaagaaagcaaactatttaccgatggaggcctgcaaaattgtcgaggggcaacgatataccaaaaggttaaatgaaaagcaaattacgtctctcctcaaagtcacttgccagagaccccgtgatcgagaaaatgacattttgcggactattcagcataatgcatacgatcaagatccttatgcaaaggaatttgggattaaagtcagcgagaagctagctactgttgaagcccgaattcttcctgctccatggcttaaatatcatgagagtggaaaggaaaaaaattgtttaccccaagttggccagtggaatatgatgaacaagaaaatgattaacggaatgaatgttagccgttgggcatgcataaatttttcacgaagcgtgcaggatagtgttgctcgtactttttgtaacgagcttgcgcaaatgtgtcaagtatctggcatggaatttaatctagaccctgtgatccccatctacaatgccaaacctgagcaagtagagaaagctttgaagcatgtttaccatgtttcgtcgaacaaaattaaaggaaaggaattggagcttttgttagcaattttgcccgacaacaatggctctctctatggtgatctcaagcgtatttgtgagactgaccttggtttaatttctcaatgttgtctgacaaagcatgtctttaagatcaccaagcagtacttggccaatgtgtctctgaagatcaacgttaagatgggtggtagaaacaccgttcttgttgatgccgtaagttgcagaataccattagttagtgacataccgacaataatatttggagcagatgttacgcaccctgaaaatggggaagactccagcccctcaatagcagctgtagtagcgtcacaagattggcctgaagttacaaagtatgcaggtttagtttgtgctcaacctcaaaggcaagaacttatacaagatttgtacaaaacatggcacgaccctgttcgtggcgtagttagtggtggcatgatccgagatttgttggtttcctttagaaaggcaacaggacagaagccactaaggattatattttacagggatggtgtaagtgaaggacagttttaccaagttctattatacgagttggatgcaattcggaaggcatgtgcttctttggagccaaactatcaacctccagtaactttcatagttgtacaaaaaagacatcatactcggttatttgcgaacaaccacagggacaggaacagtacagataggagtggaaatatacttcctggaactgttgtagataccaaaatctgtcacccaacagagtttgatttttatctctgcagtcacgcaggcatccagggtacaagtcggccagcacattatcatgttctatgggatgaaaacaacttcacagcagatggtattcaatctttaacaaacaatctctgttatacatacgccagatgtacacgctccgtatctgttgttcctccagcatattatgcacatttagcagcttttcgagcccgtttctacacggagccagacctacaagagaccggctccaatgggggcggtcgaggttccaagacaacgcgtgcagccggagattgtggcgtaaaaccattaccagccttaaaggaaaatgtgaagagagtaatgttttattgttagacaatataaatccgtttgacaatgatagatgtatgagaacatggaaatcaaatggtacatgaagcaaacaccatcatcatcatgcattgcaatatttgacatctcttaaaaagttacttgtacattagtagtgactcttcaacattgtggcaagttttttcataatagatccatgattgtagttctagaggactgactagtttaggattcctagatgtatttggctactagatcttgtgagacattcacccatagtttagactttagagttgctaacttcaggcattgttaattaactaagctctatgtatcaatcttgtagatttttttttcttttttgccttgtagatgttgaagagtataaaaaaaaaaaatcacttcctatatttgcaaggattgtaatttgcaagttattattgctagtcgagtaaatcattttcgtcgtaaatgtgtgatgtggtgtcacagtagtcattgagttttgttagtaatattaatttcatagacttaagc

SEQ ID NO: 1210 - DNA, 3583 bp, Phaseolus vulgaris
tataatcctcagtacctcttttggactcattaccctctttctctctctcttcaactttcaccatttttttaatacctctctctcttcgtagcctctgctgctacaacaacaaggggtgtaatgtaggagagagaagaagaggaagtaagaggaatacaagaagggaaggcagagcctttttttctacacgtgataaagaaaacaccaaaagctcttttgcatgcgtgtataagattcatcaccaccaccatcttctccctttatcttccatctttctaaattctcaatctttccaaactcacccactatagttttcacgtggctactacttgcttagttagtcacagggccttctttgctacccgagagaaagaggcacaaaaggcgaacatgccagtgagacagatgagggagagctcagaacaacaccttgttatcaagccccatttgcagaaccccatgaatggagccaagaaggtttctagagctgtacaaaatggcaaaggtccaccaccaccaccactgccacaagaaccccacaaccaaacttcacctcatgcaaggaacaaggggagaagaaggagcagaggtggcagaaaatgtgatcaaggagatgttttgatgagacctattgtgacaagtggttttggaaatggaagcaccatgtgtggtgaaatagagatgggataccctacatcaagcaagtctttgagctttgctcctaggcctggctatggacaagttggtataaagtgcattgtgaaggctaaccatttctttgctgagttaccggacaaggacctgaaccagtatgatgtcagtatcacccctgaagtctcttccaaagctgtgaacaggtctataatagcagaactcgtgaggctgtataaagagtctgaccttgggatgaggcttccagcatatgatggcagaaaaagtctgtacactgcagggcctcttcccttttcctggagagagtttaagataaaggttgtggatgacgaggctggagttaatggtcccaaaagggaaagagaatatagagtggtgatcaagtttgttgctagggcgaatttgcatcacttgggccagtttctggctggtaaacgtgctgatgctccacaagaggcactccaaattcttgacattgtattaagagagctttcatctaagaggttctgtccaattgggagatccttcttttcaccagatattagaacaccccaacggcttggagaaggtttggagtcttggtgtggattttaccaaagcataaggcctactcagatgggtctttccctcaatattgatatggcttctgctgcgttcattgaacctcttccagttgtggaatatgttggccagctattaggaaaagatatcctatcaaggcaattgtctgacgcggatcgcatcaaaattaagaaagctcttagaggagttaaagttgaagtaacccacagagggagtgttagaagaaagtaccgagtttctggtttgacttctcaaccgaccagagaacttgtgtttcctgttgatgagaactcaactatgaagtcagtagttgaatatttccaagagatgtatggtttcacaattaaatatactcaccttccttgccttcaagtaggaaatcaaaagaaagcaaattatttacctatggaggcctgcaaaattgttgaaggacaacgctatactaaaaggctgaatgagaaacaaatcactgctctcctgaaagttacttgtcaaagacctcgtgatcgagaaaatgatattttgcggaccattcagcacaatgcttatgatcaagacccttatgcaaaggaatttggaatcaaaataagtgagaagttagcttcggtagaggctcgaattcttcctgccccgtggcttaaatatcatgaaagtgggaaagaaaagaattgtttgccccaagttggtcaatggaatatgatgaacaagaaaatgataaatgggatgactgtcagccggtgggcctgcataaatttttcaagaagtgtacaagacactgttgctctcacgttttgtaccgaactagctcaaatgtgccaagtatctggcatggaatttaatccagagcctgttatccccatctacaatgccaaacctgagcatgtggagaaagctttgaaacatgtttaccatgtgtcaacaaacaaaaccaaaggaaaggaattggagcttttattagcagtattgcctgacaacaatggttctctctatggtgatctaaagcgtatttgtgaaactgaccttggtttaatttctcaatgttgtctgacgaagcatgtcttcaagatcactaagcagtacctggctaatgtgtctttgaaaatcaatgtcaagatgggaggtagaaacactgttttggttgatgctgtaagttgtagaataccactggttagtgacataccaactataatatttggagcagatgttacccaccctgaaaatggagaagattccagcccttcaattgcagctgtcgtagcatctcaagactggcctgaagtgacaaaatatgctggtttagtgtgtgctcaggctcataggcaggaacttatacaagacttgtacaaaatgtggcatgaccctgttcgtggcttagttagtggtggcatgatccgagatttgttgatttcctttagaaaggcaacaggacagaagcctctaaggattatattttatagggatggtgtaagtgaagggcaattttaccaagttctactatacgagttggatgcaattcggaaggcatgtgcttctttagaaccaaactatcaacctccggtaactttcatagttgtacaaaaaagacatcatactcggttgtttgcaaataaccacagggacagaaacagcacagataagagtggaaatatattgcctgggactgttgtggattctaaaatctgtcatccaacagaatttgatttttatctctgcagtcatgctggtattcagggtacaagtcgtcctgctcattatcatgttctttgggatgaaaacaactttacagcagatggaatccaatctttgactaacaatctatgctatacatatgccaggtgtacacgctccgtgtctgttgttcctcctgcatattacgcacacttggcagcttttcgggcacggttctacatggaaccggaaatgcaggaaaatggctcctcggggggtggtggtggtggtggttccaaggcaacaagagcaggtggagagtgtggtgtggtgaagccattgccagccttgaaagagaatgtgaagagagtaatgttttactgttagattgtgtagttgtagaagatgcataaaatgaatgttgatccatgataatagttctagaggcttagtttaggattggtacaagtatttgggtggacatgagaggcacatcataggtttagtgttgctaattctgagttccagccatcaccaaaattgtttaaagattaaattaggcatctgaaacaaagttcatgaatcaatctttttacagaaaattttgcctgaaggggcattgtagatgttgaaatagtagaaaattttcaatcccatgcaa

SEQ ID NO: 1211 - DNA, 3479 bp, Cajanus cajan
caattggcactgttttgctgttataagcaaaaactaaacgtcaaaaactggccacctttgacaaagtgtgcttcttcttttgtatatccattggccagcactcagcagaaaggaaaacatgccagtaagacagatgagggagagctcagaacaacatcttgtgatcaaaccccatttgcagaaccccatgaatgcagctaagaaggttccaagagctgttcaaaatgggaaaggtccaccaccactgcccgaggaaccccacaaccaaacttcacctcatgtaaggaacaaggggagaaggaggagtagaggtggccgaaaatgtgaccaagatgttttgatgagacctatggtgacaagtactgttgaaaatggcagcaccatgtgtgctgaaatagaaatgggttaccctacttcaagcaagtctttgagctttgctcctaggcctggctatgggcaagttgggacaaagtgcattgtgaaagctaaccacttcttcgcagagttaccagacaaggacttgaaccagtatgatgtcagcatcacccccgaagtgtcttctaaagcagtgaacaggtccattatagccgaacttgtgaggctgtataaggagtctgaccttgggatgaggcttccagcatatgatggaagaaaaaacctgtacactgcagggccacttcccttttcctggagagagtttaagttaaagattgtggatgatgaggatggagttaatggtcccaaaagggaaagataatatagagtggtgatcaagtttgttgccagggaaaacttgcaccacttgggtcagtttttagctggtaaacgtgctgatgctccacaggaagcactccagattcttgacattgtattgagagagctatcatctaagaggttttgtccaatcgggagatccttcttttcacctgatattagaacacctcaacgacttggagagggtttggagtcatggtgtggattttaccaaagcataaggcctactcagatgggtctttccctcaatattgatatggcttctgctgcattcattgaacctcttccagttgtggaatatgttggccagctattaggaaaagatatcctggcgaggcaattgtctgatgctgatcgcattaaaattaagaaagccctcagaggagttaaatttgaagttacccacagagggagtgttagaagaaagtatcgtgtttctggtttgacttctcagccaaccagagaactcatgtttcctgttgatgagaactcaactatgaagtcagtagttgaatacttccaagagatgtatggtttcacaattaaatatactcaccttccttgccttcaagtaggaaatcaaaagaaagcaaattatttacctatggaggcctgcaaaattgttgagggacaacgatatacaaaaaggttgaatgagaagcagatcactgctctccttaaagttacttgtcaaaggcctcgtgatcgagaaaatgacattttgcggactattcagcataatgcttatgatcaagatccttatgcaaaggaatttggcattaaaataagtgaaaagctagcttctgtagaggcgcgaatactccctgccccatggcttaaatatcatgaaagtgggaaagaaaagaattgtttaccccaagtgggtcagtggaatatgatgaacaagaaaatgattaatggaatgacagtcagctggtgggcatgcataaatttttcacggagtgtgcaagacagtgttgctcgtactttttgtactgaacttgctcagatgtgtcaagtatctggcatggaatttaatccagagcctattatccccatctacaatgccaaacctgagcatgtagagaaagctttgaagcatgtttaccatgtgtcaacaaacaaaaccaaaggaaaggaattggagcttttgttagccatattgcctgacaacaatggttctctgtatggtgatctcaagcgtatttgtgaaactgaccttggtttaatatcacaatgttgtctcacaaagcatgtctttaagatcactaagcaatacttggctaacgtgtctttgaaaatcaatgtcaagatgggaggtagaaacactgttttggttgatgctgtaagctgcagaataccattggttagtgacataccaactataatatttggagcagatgttacccatcctgaaaacggagaagaatccagtccctcaattgcagctgtagtagcatcccaagactggcctgaagtgacaaaatatgctggtttagtgtgcgctcaagctcataggcaggaactcattcaagatttgtacaaaatgtggcatgaccctgttcgtggcttagttagtggtggcatgattcgagatttgctgatttcctttagaaaggcaacaggacagaagcctctaaggattatattttatagggatggtgtcagtgaaggacaattttaccaagttctactttatgagttggatgcaattcggaaggcatgtgcttccttagaaccaaattatcaacctccagtaactttcattgtcgtacaaaaaagacatcatactcggttgttcgcaaacaaccacagggacaggaacagtacagataagagtggaaatatattgcctgggactgttgttgattccaaaatctgtcatccaacagaatttgatttttatctgtgcagtcatgctggcatccagggtacgagtcggccagctcattatcatgttctatgggatgaaaacaactttacagcagatggaattcagtctttgactaacaatctctgttatacatatgccaggtgtacacgctctgtatccgttgttcctccagcatattatgcacatttggctgcttttcgggcgcgattctatatggaaccagacctacaggaaaatggctccacaggtggtggtggttcaaaggcaaagccagcaggtggagaatgtggcgtgaagccattgccagctctgaaagaaaatgtgaagagagtaatgttttattgttagtttgtgtggtagatgatggagcatgcagcaaacactatcatggattgcaatgtttacatccccatcaaattgtacattaatggcaactaagcatagcagcaatgtttcccatggtagatccatgcttatagtcctagaggcttagtttaggattcctacaagtatttggctggacatgggaggcacatcataggtttagtgttgctaactctttggtccagccatcacaaaaattatttaagattaaattaggcatcgtcaagatatttatgaatcaattgttgaatagtagaaaattgcctcaaggccattgtagaaaaaaaattaaaattgttgaatagtagaaaattttcactcatcatgtgcaaggatggatcatggatgctattctgattagtttcgcagaatattaagctatgttgtcatttctagtcaaactatattgagtaaccaaggataacta

SEQ ID NO: 1212 - DNA, 3647 bp, Medicago truncatula
aaataggtacatgacatccccgaggaggctgcgcaagaagaaactgaactgaagagatagaaagagaaagaaagaaagagagacaagtaagtttaaaagcagagaaaggcttttacacgtgataaagaaagtagctacctaaagtgctttgcatgcgtgtataacttcatcatcatcaccatcttcttcattttctcttcccctttcttatagcattcttacttattcacttccattttctctatacccttccattttccaacccattctttttcaaccaagtcatagtagatataataatcaaaagctagaagcaaaagttttaaggccaagatgccagtgatgcaattgaaagaaagctcagagcaacacattgtgatcaaaaccaatttgcagaatcctaagaatacaccaaaggcttcttctcaaaatggaaaagctccaccaccaacttccatacaaaacaataaccaaacttcaccacctcaaccaaggaacaaaggaagaagaaggggaagaggtggtagaaaatctgatcaaggagaaattttgacgagacccagttcaagaccatgtactgaaataacaagtgctataaatggaaatgttgaaaatggttacaactctggtgacattgatgttggttttcctacttcaagcaagtctatgaactttactcgtagacctggatttggacaagttgggacaaaatgtattgtgaaggctaaccacttctttgcagagttaccagacaaggacttaaaccaatatgatgttactattacccctgaggtgtcttcaagaacagtaaacaggtccattatagctgaacttgtaaggttgtataaagagtctgatttagggatgaggctcccagcttatgatggcagaaaaagtctgtatactgcaggacagctacccttttcctggaaagattttacgattaagcttgtagatgaagaggatgcagttaattgccccaaaagggtaaaagagtacagggtggtgatcaagtttgtggccagagcaaacttgcatcatttaggccagttcctagctggtaagcgtgctgatgcgccacaagaggcgcttcaaattcttgatattgtattacgagagctatcaactaagaggtattgccccattgggaggtctttcttttcacctgatataagaagaccacaacggcttggagagggattagagtcatggtgtggattttaccagagcataaggcctactcagatgggcctttccctcaatatagatatggcgtctgctgcattcatcgagcctcttccagttgtagaatttgttggccagcttttagggaaagatgttctgtcaagaccattgtcggatgccgatcgcatcaagattaagaaaggccttagaggagttaaagttgaagtaacacacagaggaagtgtaagaagaaaataccgtgtttcagggttgacttctcaaccaacaagagaacttgtgtttcctgtggatgagaattcaacaatgaagtcagtagtcgaatactttcaagagatgtatggtttcactattcaatacacacaccttccttgccttcaagtaggcaaccaaaagaaggctaactacttacctatggaggcatgcaaaattgtcgaaggccaacgttatacaaaaagattgaatgagaagcaaattacttctctattgaaagttacttgtcagagacctcgtgatcgggaaaatgacattttacagactgttcaacataatgcttatgaccaagatccttacgcaaaggaatttggaattaatatcagtgagaagctagcttctgttgaagcacgaattcttcccaccccttggcttaaatatcacgaaagtgggaaagaaaagaactgtttaccccacgttggtcagtggaacatgatgaataagaaaatgattaatggaatgactgttaaccggtgggcatgcataaatttctcacggagcgtgcaagatagtgttgctcgcactttttgtaatgaccttgctcaaatgtgtcaagtatctggcatggaatttaacctggagcctgttattcctatctacaatgccaagcctgagcaggtggagaaagctttgaagcatgtctaccatgtgtcaacaaacaaaactaaaggaaaggagttggagcttttgttagcaatattaccagacagtaatggttctctctatggtgatctcaagcgtatttgtgaaactgaccttggtattatctcacaatgctgccttacaaagcatgtcttcaaaatcactaaacagtatttggctaacgtgtctctgaagatcaatgttaagatgggagggagaaatactgttcttcttgatgctgcaagctacagaataccattagttagcgacataccaaccataatttttggagcagatgttacacaccctgaaaatggagaagactctagcccctcaatagcagctgttgtagcctcccaagattggcctgaagtgacaaaatatgctggcttagtgtgtgctcaagctcatagacaggaacttatacaagatttatacaaaacttggcatgatcctgctcgcggcacagttagtggtggcatgataagagatttactgatttccttcagaaaggccacgggtcaaaagccactacgaattatattttacagggatggtgtaagtgaaggacaattttaccaagtattactttatgagttggatgcaatccggaaggcttgcgcttccttagaaccaaattatcagcctccagtaactttcatagttgtacaaaagcgacatcatactcggttattcccaaacaaccatagggacaggagcagtaccgataagagcgggaatattttgcctgggaccgttgtcgatactaaaatttgccatccgacagaatttgatttttatctctgcagtcatgctggcatccagggtactagtcggccagctcattatcatgttttatgggatgaaaacaatttcacagcagatggaattcaatctttaacaaacaatctttgttatacatatgctaggtgcactcgatccgtatccattgttcctccagcatattatgcacatttagcggcctttcgagcccgtttctatatggaaccagagatgcaagagaatggttcgacaggtgatggtaattctagtcatagctccaaaggaacaacaagagcagctggagaatgtggtgttaagccgttaccagccttgaaagataatgtgaagagagtgatgttttactgttagattgctttagatgtatgttgttaaagttggaattgtaaagagtattctgtgtcaatcttcattgtagaaaattttgctcatagttctttacagatgttgatgggaagtttttctgattagtctaacaaaaacattaagccaacaatcatgtttatcctgcattatagctgaaggtaaatgagtcaagtcagtgtaacatttcattgtcatttctctgtgtaaataaacaagcaaaaatattactagaaacttaaatctcaattcttgttggtccaacatgtgcttggcattctgtgtaagaaactcatagcactttcatgctataatactcacatgtcttttgcaccaacaaacgagccatgattccaatcctaaca

SEQ ID NO: 1213 - DNA, 4150 bp, Medicago truncatula
aaaatttgaattttgactactatgaaaaaaattgataaaagaaaaaggaaacacaaatagcagaagcctgcaatatagatgactgcaagttcgaattattcttctttcttgtatgattgcttttataatcctcagtacatcttttggactcatctttctctctctctttttctctctctctaacattaatatttttcctttatttttttcttgtttttttcctctgttgcataaatataagagttaaacacagttcacaactaatcaaaaaagcaaagtaaaaaaagacagacacaaagccttttacacgtgataaagaaaacaccaaaacctcttttgcatgcgtgtataagattcatcaccatcatcattttcctttcttcatcttcaccacttttttttactattattttctcctttcagaacacttcaaaaacaacccatttttctttcattgctcattgacccttcttccattttcactctctcattactttgacatgtgttaactactttcctagctagatataagcataaggttataggcaaaaactaaacgtgaaaaactggttattttctgaaacttcttgtcactatagtcacctttgattggtgaatatatataatctatatatctatctattcctgcaagaactcagaaaaaattcaacatgcctttgaggcaaatgaaagagagttcagaacaacaccttgtgatcaaacctcatcagcaaaactctatgagtcaagctaagaaagttactaaagctgttcagaatggtaaaggtccaccattagtgtcacaagaacaacagaaccaaacttcaccacctcaagtaaagagtggtggaagaagaaggagtagaaatggtagaaaatctgatcaagttgatgttttgatgagaccaagttgtaggccttgtactgttgtgaagagcaatgaaaatggccatgttgttgaaaatggaaacacagtctctagtgatgtagaaatgagttttcctacttcaagtaaatctttgagttttgctcaaagaccaggttatggacaagctggtacaaaatgcattgttaaagccaaccacttctttgcagaattaccagacaaggacttgaaccaatatgatgtaactattacaccggaagtgtcttcgaaagccgtaaacaggtctatcatagcagaacttgtgaggctgtataaagaatctgaccttgggatgaggcttccagcatatgatggcaggaaaagtctttacacagcaggagttcttcccttttcttggagagagtttaagattaagcttatcgaagaagaggatggaattaatggccccaaaagggaaagagaatacaaagtggtgatcaagtttgttgcaagggctaacttgcatcacttgggacaatttctagccggaaagcgtgctgatgctccacaggaagcaatacaaattctagacattgtactaagagagctagcgtcaaagaggttttgtcctatcgggaggtcattttattcacctgatattagagcaccacaacgactcggagaaggattggagtcgtggtgtggattttaccaaagcataaggcctactcagatgggcctttcactcaatatcgatatggcttctgctgcgttcattgaacctcttccggtggtagagtttgttggccagctattaggaaaagatgtgctgtcaaggcagttgtctgacgcggaccgcatcaagattaagaaatcccttagaggagttaaagttgaagtaacacacagagggagtgttagaagaaagtatcgtgtttccggcataacttctcaaccaacaagagaacttgtgtttcctgttgatgagaactcgactatgaaatcagtggttgaatacttccaagaaatgtatggtttcactattaaacatacacaccttccttgccttcaagttggtggaaatcagaagaaagcaaactatttaccaatggaggcctgtaaaattgtcgaggggcaacgatatactaaaaggttgaatgaaaagcaaattacttctctcttgaaagtcacatgccagagacctcgtgatcgagaaaatgacattttacggacagttcagcataacgcttatgatcaagatccttatgcaaaggaatttgggattaaagtcagcgagaagttagcttcggtggaagcacgaattctgcccgctccttggcttaaatatcacgagagtggtaaagaaaaaaattgtttaccccaagttggccagtggaacatgatgaacaagaaaatgattaatggaatgactgttagccgctgggcgtgcataaatttttcacgaggtgtgcaagatagtgttgctcgtactttttgtaacgagcttgcacaaatgtgtcaagtctctggcatggaatttaatctggagcctgttatcccgatctacaatgcgaaacccgagcaggtggagaaagctttgaagcatgtttaccatgtgtcgtcaaacaaaaccaaaggaaaggaattggagcttttgttagtgatattacccgacaacaatggctctctctatggtgatctcaagcgcatttgtgagactgaccttggcttaatttctcaatgttgtctaacaaagcatgtctttaagatcactaagcaatacttggccaatgtgtctctgaagatcaacgttaagatggggggtagaaacaccgttcttgttgatgccgtaagctgcagaataccattggttagtgacataccgacaataatatttggagcagatgttactcaccctgaaaatggggaagattccagcccctcaatagcagctgttgtagcatcccaagattggcctgaagttacaaagtacgcaggtttagtttgtgctcaacctcaaagacaagagcttatacaagatttgtacaaaacttggcacgaccctgttcgtggtgtagttagtggtggcatgatacgggatttgttggtttcgtttagaagggcaacaggacagaagccacaaaggattatattctatagggatggtgttagtgaaggacagttttaccaagttctactatacgagttggatgctattcggaaggcatgtgcttctttggagccaaactatcaacctccagtaactttcatagttgtgcaaaaaagacaccatactcggttattcgcaaacaaccacagggacagaaacagtactgatcggagtggaaatatactgcctggaactgttgttgataccaaaatttgtcatccaacagagtttgatttttatctctgcagtcacgctggcatccagggtacaagccgtccagcgcattatcatgttctatgggatgaaaacaacttcacagcggatggaattcagtctttgacaaacaatctctgttacacatatgccaggtgtacacgctccgtatctgttgttcctccagcctattatgcacatctagcagcatttcgagcacgtttctacacggagccagaccttcaggagactggttccacaggtggtcgtggttccaagacaacacgtgcagccggagattgcggtgtcaagccattgccagcactgaaggaaaatgtgaagagagtaatgttttactgttaagactctgaatcagtttgtcaatggtagatgcatggatgggcatggagaaatcatatagcgcatgaagcaagcaccgtcacacattgcaatattttaacatctctctaatagttacttgtacattagtgactcttcaacatagttgcaaggtttctcataatagatcaatgattaaagttctagaggcctagtttaggattcctagatgtatttggctagaatttgcgagacactcgcattaggttttagactttagatgatattgaatcaagcattgtaaacaaagctctatgaaatcaatctttgttgtagaatttatttgcttgtatggtaaatgttgaagagtagaaaattttcacttcctatttgcaaggattgtaatctgtaagtgcttaacattaaggtgtcatttctagttataactcaatctagtgagacaggtgattgaatgatccattggcatcactaagcatttacaatgatacaaaactcatgctttttcttttgtgggtaaaaaaaaagttaccattggatcttgc

SEQ ID NO: 1214 - DNA, 4130 bp, Glycine max
tttttcatattatagttgcattggatatcataaaattattaaaatatgttgttacactttcaataaaaactctatttcatcctaacaacactacttagcataaaaaaacataaataaacattgttgtaataaatagagagagagaaaaaagacacaaagtatacatagcagaagcctgcaagagagaggactgcaagttcgaattattcttcttccttgtatgattgcttttataatcctcagtacctcttttggactcattacccctctctctctctccacctttcaccatttttttatttattaaactctctctctctctccacctttcaccatttttttatattaaactctctctctctaggctgctgctactacaactagaacacaaggggtgtgtaaatgtttcatgtaagagagagaaaacaagtctcttttacacgtgataaagaaaacaccaaaagctcttttgcatgcgtgtataagattcatctcactaccaccatcatcttcttcttctcccctttatcttctcttctcttctcttctaaattctgaatcctccaaaaccaaagtctttcacttcccttcttcgttaaccaagagaaagaggcactcgtcacaaaaggtgaacatgccagtgagacagatgagggagagctcagaacaacaccttgtgatcaaaccccatttgcagaaccccatgaatggagctaagaaggttcctagagctgttcaaaatggcaaaggtccaccaccaccgccactgccacaacaggaactaccccacaaccaaacttcacctcatgtaaggaacaaggggagaagaaggagcagaggtggaggaagaaaatgtgatcaaggagatgttttgatgagacctattgtggcaagtggtgttgaaaatggaagcaccatgtgtggtgaaatagagatgagttgccccacttcaagcaagtctttgagctttgctcctaggcctggctatggacaagttgggacaaagtgcattgtgaaggctaaccacttctttgcagagttaccagacaaggacttgaaccagtatgatgtcagtattacccccgaagtgtcttccaaagcagtgaacaggtccattatagcagaacttgtgaggctgtataaagagtctgaccttgggatgaggcttccagcatatgatggcagaaaaagtctgtacactgcagggccacttcccttttcctggagagagttcaagataaaggttgtggatgatgaggatagagttaatggccccaaaagggaaagagattatagagtggtgatcaagtttgttgccagggccaatttgcaccacttgggccagtttctagcgggtaaatgtgctgaagctccacaagaggcactccaaattcttgacattgtattaagagagctatcatctaagaggttttgcccaattgggaggtccttcttttcacctgatattagaacaccacaacggcttggagagggtttggaatcgtggtgtggattttaccaaagcataaggcctactcagatgggtctttcactcaatattgatatggcttctgctgcgttcattgaacctcttccagttgtggaatatgttggccagctattaggaaaagatattctgtcgaggcaattgtctgatgctgatcgcattaaaattaagaaagcccttagaggagttaaagtcgaagtaacccaccgagggagtgttagaagaaagtatcgagtttctggtttgacttgtcaaccaaccagagaacttgtgtttcctgttgatgagaattcaactatgaagtcagtagttgaatactttcaagagatgtatggtttcacaattaaatatactcaccttccttgccttcaagtaggaaatcaaaagaaggcaaattatttacctatggaggcctgcaaaattgttgagggacaacgatatacaaaaaggttgaatgagaagcaaatcactgctctcctgaaagttacttgtcaaagacctcgtgatcgagaaaatgacattttgcagaccattcagcacaatgcttatggtcaagatccttatgcaaaggaatttgggattaaaattagtgaaaagctagcttctgtagaagcgcgaattctccctgccccatggcttaaatatcatgaaagtgggaaagaaaagaattgtttaccccaagttggtcagtggaatatgatgaacaagaaaatgataaatgggatgactgtcagccagtgggcatgcataaatttttcacgaagtgtacaagacagtgttgctcgcactttttgtaccgagctagctcaaatgtgccaagtatctggcatggaatttaatccagagcctgttatccccatctacaatgccaaacctgagcatgtggagaaagctttgaagcatgtttaccatgcgtcaacaaacaaaaccaaaggaaaggaattggagcttttgttagcaatattgccggacaacaatggttctctctatggtgatctcaagcgtatttgtgaaaccgaccttggtttaatttctcaatgttgtttgacaaagcatgtctttaagatcacaaagcagtatttggctaatgtgtctctgaaaatcaatgtcaagatgggaggtagaaacaccgttcttgttgatgctgtaagctgtagaataccattggttagtgacataccaactataatatttggagcagatgttacccatcctgaaaatggagaagactccagcccttcaatagcagccgttgtagcatctcaagactggcctgaagtgacgaaatatgccggtttagtgtgtgctcaagctcatagacaggaactcatacaagatttgtacaaaatgtggcacgaccctgttcgtggcttagtcagtggtggcatgatccgagacttgttgatttcctttagaaaggcaacagggcagaagcctctaagaattatcttttatagggatggtgtaagtgaagggcagttttaccaagttctactttatgagttggatgcaattcggaaggcatgtgcttctttagaaccaaactatcaacctccagtaactttcatagttgtacaaaaaagacaccatacccggttgtttgcaaataaccacagggacaggaacagtacagataagagtggaaatatattgcctgggactgttgttgattccaaaatctgtcatccaacagaatttgatttttatctgtgcagtcatgctggcatccagggtacgagtcgtccagctcattatcatgttctgtgggatgaaaacaacttcacagcagatggaattcagtctttgacaaacaatctctgttatacatatgccaggtgtacacgctccgtatctgttgttcctccagcgtattatgcacatttggcagcttttcgagcgcggttctatatggagccagacctgcagcaggagaatggctcctcaggtggtggctccaaggcaacaagagcaggtggggtgtgtggtggggtgaagccattgccagcattgaaagaaaatgtgaagagagtcatgttttattgttagattgtgactaggcttgcttgacaatcatggattgcaatgtttacatgacatcaaatgtacattagtggctcctaagcatagcagcaatgtttcccatagtagtagatccatgatattatagttctctagtggcttagtttaggattcctacaagtatttttggctgggcttgagaggcacatcataggtttcgttttgctaactctttgtggtccagtcatcaccaaaatgatttaagattaaattaggcatcggaaagtgtttatggatcaatcttaattgtagaaatttttgccttaaggccattgtaggtattgaattgaaatagtagaaattttccaatcctcatgtgcaaagatggatgatattctgattagtcttacaaaatattaggcaattttatcatttctagtcaaacttaattgagtaacttacgataataggtatgatatgactatggtctgagtacttgagtaggtcatcaatttataattgtgttgtcctaaagttcttttcttacgtttgattagtttgagaaaatgttcttttttattttgtttttattttttctcatgtt

SEQ ID NO: 1215 - DNA, 3594 bp, Citrus clementina
ccctctcattttcttcattcaagctcactgctcagtggagtacttaaaaccttgacttagctcttgcaactgggtttggtttggtttggtttgttggttggtgctggattttgtaagtcttggatagggacaagcctatgaaagtggttcttagttgcaggcattttccagcagaattagtcctcgaaatctttgaagtaaagagtaaagactagaagaaagacgctgggtatttgcgtgtaacatttggtgaaaaacggagaacccatcaccaagtctgtactgctcttgcatttccagttttcagtgaccaaagtaaaaccaaaacgccaaagcatgcctataaggcaaatgaaagatagctctgaacaacatttagtgatcaaaacccatttgcaaaataccatgaatcaatcacagaaacaacccaaaactgctcaaaatggcaagggccctccgcatcaagaactccagaactcaaaacctcataatcaaacttcaccaccaacaaaaaatagagggagaagaagagggagaggtggaagaaaatctgatcaaaatgatgtgtttatgagaccaagttcaaggccttgcactgtggcgcataagccagtgaaccaagtttgtgatcttgttggtagtaatgcaaatggggctgttggaaatggtcgtagtttgtgtgcaacggagatggggttccctacttcaagcaagtctttgagttttgctcctaggcctggttatggtcaagttgggacaaaatgtattgttaaggctaaccatttctttgcagagttaccagacaaggacttgaaccagtatgatgttaccataactcctgaggtggcatcaaggactgtgaacagagctattatggcagagcttgtgaggctgtacaaagaatctgacttaggaatgagactacctgcttatgatggcagaaagagcctgtacacagctggtgaacttccttttgtttggaaggagttcaaaattaagcttgtagatgaactggatggaatcaacggtcccaaaagagtgagagaatacaaagtggtaatcaagtttgcggcaagagccaacatgcatcatttaggccagtttttggctggtaagagggcagatgctccacaagaagctcttcaaattcttgacattgtcttgagggagctctcaacaaagaggtattgtcctattgggagatcctttttttcacctagtattagaacaccgcaacggctcggcgatgggttggagtcatggtgtgggttttaccagagtataagacctacacagatgggcctgtcactgaatattgacatggcttcagctgcatttattgagcctcttcctgtaatagagtttgttgctcagcttcttggaaaagatgttttatctagaacattatctgattctgatcgcgtgaagattaaaaaagcccttagaggagtgaaagttgaagtgacacacagaggtactgtaagaaggaagtatcgtgtttcaggattgacgtctcaacctacaagagaactagtgtttcctgttgatgacaattcaacaatgaagtcagtggttgagtacttccaagagatgtatggcttcaccattcaacatactcatttaccttgccttcaagtgggaaaccagaaaaaggcaaactatttacctatggaggcttgcaaaattgtcgaaggacaacgctatacgaaaaggttgaatgaaaggcaaattactgctctcctaaaagttacatgccaaagacctagggatcgggaaaatgacattttgcagactgttcaacagaatgcttatgatcaagacctatatgcaaaggagtttgggatcaaaatcagtgaaaagctagcatctgttgaggctcgaattcttcctgccccttggctaaaatatcatgaaaatggaaaggaaaaggattgtttgcctcaagttggtcagtggaacatgatgaacaagaaaatgattaatgggatgactgtaagtcgatgggcatgcattaacttttcacgaagtgtgcaagagagtgttgctcgcggtttttgcaatgagcttgctcaaatgtgccaggtatctggcatggaattcaatccagagcctgtcattccaatccacaatgccaggcctgatcaagtagagaaagctttgaagcatgtttatcacttatcaatgagcaaaaccaaaggaaaagaattagagcttctattagctattttgccagacaacaatggttccctatatggcgatctcaagcgaatatgtgaaactgatctcggtataatatcccaatgctgtctgacaaaacatgtcttcaagatcagcaagcaatacttggctaatgtgtcccttaagatcaatgtcaagatgggtggcaggaacactgtccttctggatgctatcagttgccgtataccattagttagtgacataccaaccattatatttggagcagatgtgactcatccagagaatggggaagactccagcccctcaattgctgctgtagtagcctcccaggattggcctgaagtgacaaaatatgctggattagtttgcgctcaagctcatagacaagaactcatacaagacttgtacaaaacatggcacgatcctgttcgtgggacagtgagtggtggcatgatcagggatcttctaatttcctttaggaaggcaactgggcagaagccgttacggattatattttacagggatggagtaagtgaagggcaattttatcaagttctactttatgagttggatgcgattcgaaaggcctgtgcttctcttgagccgaattatcaaccacctgtgactttcataattgtacaaaaacgacaccatactcggttattcgctaataaccacagggataggagcagcacagataggagtgggaacattctgcctggcactgtggttgattctaaaatatgtcatccaacagaatttgatttttacctatgcagccatgctggtattcagggcacaagtcgaccggcacattaccatgtgctatgggatgagaacaattttacagccgacggaatccagtctttgacaaacaatctttgttacacatacgcaagatgcacacgctctgtctctgtggttcctccagcatattatgcacatttagctgctttccgcgcccgtttctacatggaaccagacatgcaggagaatggctcgaccgatggcagtggtcatacctccactaagagcactcgggcggtaggagagtctggtgtccggcctttgccagcattgaaagagaacgtgaagagggtgatgttttattgttaagatgggggataaggagttgatagtagcaggggaagagtagtagcttggggatatcaatgcagcaatcacgttcatttccaaaatttcttctgtaaatgtatgatcatgaagatttggcattgctgctagtttctccaacttagatcagtgattacataattaaatcaaatagttttagcctgtaggccatcaatcatgtgtagaatgtgaacaagcgctatgtaaagtaatgttttatcttattatgaatccatgtctaggaagttttgcctcaatttc

SEQ ID NO: 1216 - DNA, 3592 bp, Citrus sinensis
ccctctcattttcttcattcaagctcactgctcagtggagtacttaaaaccttgacttagctcttgcaactgggtttggtttggtttggtttgttggttggtgctggattttgtaagtcttggatagggacaagcctatgaaagtggttcttagttgcaggcattttccagcagaattagtcctcgaaatctttgaagtaaagagtaaagactagaagaaagacgctgggtatttgcgtgtaacatttggtgaaaaacggagaacccatcaccaagtctgtactgctcttgcatttccagttttcagtgaccaaagtaaaaccaaaacgccaaagcatgcctataaggcaaatgaaagatagctctgaacaacatttagtgatcaaaacccatttgcaaaataccatgaatcaatcacagaaacaacccaaaactgctcaaaatggcaagggccctccgcatcaagaactccagaactcaaaacctcataatcaaacttcaccaccaacaaaaaatagagggagaagaagagggagaggtggaagaaaatctgatcaaaatgatgtgtttatgagaccaagttcaaggccttgcactgtggcgcataagccagtgaaccaagtttgtgatcttgttggtagtaatgcaaatggggctgttggaaatggtcgtagtttgtgtgcaacggagatggggttccctacttcaagcaagtctttgagttttgctcctaggcctggttatggtcaagttgggacaaaatgtattgttaaggctaaccatttctttgcagagttaccagacaaggacttgaaccagtatgatgttaccataactcctgaggtggcatcaaggactgtgaacagagctattatggcagagcttgtgaggctgtacaaagaatctgacttaggaatgagactacctgcttatgatggcagaaagagcctgtacacagctggtgaacttccttttgtttggaaggagttcaaaattaagcttgtagatgaactggatggaatcaacggtcccaaaagagtgagagaatacaaagtggtaatcaagtttgcggcaagagccaacatgcatcatttaggccagtttttggctggtaagagggcagatgctccgcaagaagctcttcaaattcttgacattgtcttgagggagctctcaacaaagaggtattgtcctattgggagatcctttttttcacctagtattagaacaccgcaacggctcggcgatgggttggagtcatggtgtgggttttaccagagtataaggcctacacagatgggcctgtcactgaatattgacatggcttcagctgcatttattgagcctcttcctgtaatagagtttgttgctcagcttcttggaaaagatgttttatctagaacattatctgattctgatcgcgtgaagattaaaaaagcccttagaggagtgaaagttgaagtgacacacagaggtactgtaagaaggaagtatcgtgtttcaggattgacgtctcaacctacaagagaactagtgtttcctgttgatgacaattcaacaatgaagtcagtggttgagtacttccaagagatgtatggcttcaccattcaacatactcatttaccttgccttcaagtgggaaaccagaaaaaggcaaactatttacctatggaggcttgcaaaattgttgaaggacaacgctatacgaaaaggttgaatgaaaggcaaattactgctctcctaaaagttacatgccaaagacctagggatcgggaaaatgacattttgcagactgttcaacagaatgcttatgatcaagacctatatgcaaaggagtttgggatcaaaatcagcgaaaagctagcatctgttgaggctcgaattcttcctgccccttggctaaaatatcatgaaaatggaaaggaaaaggattgtttgcctcaagttggtcagtggaacatgatgaacaagaaaatgattaatgggatgactgtaagtcgatgggcatgcattaacttttcacgaagtgtgcaagagagtgttgctcgcggtttttgcaatgagcttgctcaaatgtgccaggtatctggcatggaattcaatccagagcctgtcattccaatccacaatgccaggcctgatcaagtagagaaagctttgaagcatgtttatcactcatcaatgagcaaaaccaaaggaaaagaattagagcttctattagctattttgccagacaacaatggttccctatatggcgatctcaagcgaatatgtgaaactgatctcggtataatatcccaatgctgtctgacaaaacatgtcttcaagatcagcaagcaatacttggctaatgtgtcccttaagatcaatgtcaagatgggtggcaggaacactgtccttctggatgctatcagttgccgtataccattagttagtgacataccaaccattatatttggagcagatgtgactcatccagagaatggggaagactccagcccctcaattgctgctgtagtagcctcccaggattggcctgaagtgacaaaatatgctggattagtttgcgctcaagctcatagacaagaactcatacaagacttgtacaaaacatggcacgatcctgttcgtgggacagtgagtggtggcatgatcagggatcttctaatttcctttaggaaggcaactgggcagaagccgttacggattatattttacagggatggagtaagtgaagggcaattttatcaagttctactttatgagttggatgcgattcgaaaggcctgtgcttctcttgagccgaattatcaaccacctgtgactttcataattgtacaaaaacgacaccatactcggttattcgctaataaccacagggataggagcagcacagataggagtgggaacattctgcctggcactgtggttgattctaaaatatgtcatccaacagaatttgatttttacctatgcagccatgctggtattcagggcacaagtcgaccggcacattaccatgtgctatgggatgagaacaattttacagccgacggaatccagtctttgacaaacaatctttgttacacatacgcaagatgcacacgctctgtctctgttgttcctccagcatattatgcacatttagctgctttccgcgcccgtttctacatggaaccagacatgcaggagaatggctcgaccgatggcagtggtcatacctccactaagagcactcgggcggtaggagagtctggtgtccggcctttgccagcattgaaagagaacgtgaagagggtgatgttttattgttaagatgggggataaggagttgatagtagcaggggaagagtagtagcttggggatcaatgcagcaatcacgttcatttccaaaatttcttctgtaaatgtatgatcatgaagatttggcattgctgctagtttctccaacttagatcagtgattacataattaaatcaaatagttttagcctgtaggccatcaatcatgtgtagaatgtgaacaagcgctatgtaaagtaatgttttatcttattatgaatccatgtctaggaaattttgcctcaatttc

SEQ ID NO: 1217 - DNA, 3011 bp, Manihot esculenta
gggggggggggaaatccgcaatgcctataaggcaaatgaaagagagctcagagcagcacttagtgattaaaacccacttgcagaacactatgaaccatcctcaaaaacaccctaaaacttcccaaaatggcaagggacctccacctcaggaaacccacaacagcaaaactcagaaccagaccttacctccagcaaaaaacagaggaaggagaagaggcagaggtggtagaaagtctgaccaaggagatgccggtatgagacccagttcaaggccgtgtactttggcacataagcctgtgaatccagcaggtgatctcttggcaagtgctccaaatggttctattggaaatgctggaagtacttgtgaaatagagatgggtttggggttccctacttctagcaagtctttgagttacgctgctaggcctggttatggtcaaatggggacaaagtgtgttgttaaggccaaccatttcttcgcagaattaccagacaaggacttgaaccaatatgatgttaccataactcctgaagtggcatcaagaactacaaacagagctatcatggcagagcttgtgaggctttacaaagaatctgacttaggaatgagacttcctgcttacgatggcagaaagagtctgtacacagctgggcaacttccctttgcttggaaggaattcacgattaagctagttgatgaggaggatggaatcaatggccctaagagagagagagagtacaaagtggtgatcaagtttgtagcaagggccaatatgcatcatttgggtcaatttttagctggtaaacgtgctgatgctccacaggaagctttacaaattcttgacattgtattgagagagctctcaacaaagaggtactgtcccataggaagatccttcttttcaccagatattagagcaccacaacggcttggtgatggcttggagtcttggtgtgggttttaccagagtataaggcctacacaaatgggcctctctttaaatattgatatggcttctgctgcattcatcgagcctctccctgtaattgagtttgttgcccagcttctaggcaaggatgtgttatccagaccattgtctgattctgatagaatcaagattaaaaaggccctcaggggagtgaaagttgaagtaactcatagaggacatgtacggagaaagtatcgtgtctcaggattgacatctcaacctacaagagaacttgtatttcctgttgatgataactccactatgaagtcagtagttgagtacttccaagagatgtatggcttcaccattcagcattctcatctcccttgccttcaagtaggaaaccagaagaaggcaaactatctcccgatggaggcatgcaaaattgtagaaggtcaacgatacactaaaaggttgaatgagagacaaattactgcactgttgaaagttacatgccaaagaccgagggatcgagaaaatgacattttgcagacagttcagcataatgcttatgatcaagatccttatgcaaaggagtttgggatcaaaatcagtgaaaagctagcttctgttgaagctcgaattctacctgctccttggctgaaatatcatgaaacaggaagggaaaaggactgtttgccacaagttgggcaatggaacatgatgaacaagaaaatgatcaatgggatgaccgtaagccgatgggcttgtataaacttttcaaggagtgttcaagaaagtgttgctcgtggattttgcaatgaacttgctcagatgtgccaagtatctggcatggaattcaatccagagcctgttattccaatctacaatgccaggccagatcaagtagagaaagccttgaagcatgtatatcattcttctatgagcaaaaccaaaggaaaagaactagagcttttattagctattctgcccgacaacaacggatccctttatggtgaccttaagcggatatgtgaaactgatcttggtttaatatcacaatgctgtcttacaaaacatgtcttcaagatcagcaagcagtatttggctaatgtgtcactgaagattaatgttaagatgggtggtagaaacactgtccttttagacgccattagctgcaggataccattagttagtgacataccaaccattatatttggagcagatgtgactcacccagagaatggggaggactcaagcccttcaattgcagcagtagtagcttctcaagactggcctgaagtgacaaaatatgctggattagtttgtgctcaagctcacagacaagaactcatacaagacttgtataaaacatggcaagatccagttcgtggaactgttagtgggggcatgatcagagatcttctggtttcctttaggaaggcaacaggacagaagccgctgaggattatattctacagggatggtgttagcgaagggcaattctatcaagttctgctttatgaattagatgcaatccggaaggcttgtgcctctttagaaccaaactatcaaccacctgtgactttcatagttgtacagaaacggcatcatactcgattatttgctaacaaccacagggataggagtagcacggacaaaagtgggaacatattacctggtactgtggttgactctaaaatctgtcaccctacagaatttgatttttatctctgtagccatgctggtattcagggaacaagtcggcctgctcactaccatgttttgtgggatgaaaacaacttcactgctgatggaatccagtcattgacaaacaatctatgctatacatatgcaagatgcactcgctctgtttctgtcgttcctccagcatattatgcacatttggctgcttttcgcgctcgattttacatggagccagaaatgcaggaaaatggttcgtcaggagttggttctgggcatggtagcaagggaacacgggtaggagaatctggagtacggccattgcctgccttgaaggaaaacgtgaagagagtaatgttttattgttgaagagcaagg

SEQ ID NO: 1218 - DNA, 3775 bp, Prunus mume
tttgggtttttccaggggaattagtcttaaatctgtgggagaattttgagtgaaagacaagaagggaaggaagacattgtgttcctgtgccatctggtgaagctttatccttttgaacaagtgcttgtgccaacatgcctataagaaaaatgaaagagagctcagagcaacaccttgtgatcaaaacccatttacagaacccggtgaacccagttcagaagcaacctaagactgcccaaaatggcaaaggtccaccgcctcaagaacctcacaaccccaaaacccataaccaaatttcacctccaacaaaaaacagaggaagaagaaggggtagaggtggtcggaaatctgatcaaggcgatgtttgtatgcgaccgagttcacggcactgcactgtggctcatattcctgcctcaccaagctttgctagtcctcctgtagctagtactccaaatgggtatgtggaaaatggtggcaactcgtgttcgatggagatgggctttcctacttcgagcaagtctttgagttttgctcgtaggcctggttttggacaagttgggataaagtgtattgtaaaggccaaccatttctttgcagaattaccagagaaggacttgaaccattatgatgtttgtataactcccgaagttgcatcaagaagtgtgaacagagccatcatggctgaactggtgagattgtacaaagaatctgacttaggaatgagactgcctgcttatgatggcagaaagagtctgtacactgctggtgagctgccctttgcttggaaggagttcaacattaagcttgttgatgaaccggatggaatcaatggccgaaaaagagaaagagactataaagtggtgattaaatttgttgcacgagcaaacatgcatcatctgggacagtttctggccggtaagtgtgctgatgctccccaggaagcgctccaaattcttgacattgtattaagagagctctcaaataaaaggtactgccccattgggagatccttcttttcacctgatatcagaacaccacaacggcttggtgaggggttggagtcgtggtgcggattttatcaaagtataaggcctactcaaatgggtctttccctcaatattgatatggcttcagctgcatttattgagcctctccctgtaatagagtttgttgcccagcttctaggcaaagatgtattatctaggacattgtctgattccgaccgtgtaaagattaaaaaggctcttagaggagtgaaagttgaagttacacacagagggagtgttcgaagaaagtatcgagtgtcaggattgacatctcaacctacaagagaacttgtgtttcctgttgatgagaacttgaccatgaagtcagtaattgaatacttccaggagatgtatggattcaccattcaacaagggcaccttccttgccttcaagttggaaatcagaagaaggcaaattacttacccatggaggcctgcaaaattgttgaggggcaacgatatacaaaaaggttgaatgagaagcaaattaccgctctgttaaaagttacatgtcaaagacctagggatcgtgaaaatgacatcctgcagactgttcaacacaatgcgtatgaccaagacccttatgcgaaggagtttggaatcaaaatcagtgaaaagctagcttcagttgaggctcgaattcttcctgccccttggctgaaatatcatgaaactgggaaagaaaagaattgtttgcctcaagttggtcagtggaatatgatgaacaagaaaatgattaatggaatgactgtcagccggtgggcttgtattaatttttcacggagtgtgcaagagagtgtcgcgcgtgggttttgtaatgaacttgctcaaatgtgtcaagtatctggaatggaatttaatccagaacctgtaattccaatctacaatgccaggcctgagcaagtagagaaagctttgaagcatgtttatcatgcatccatgaacaaaactaaaggaaaagatttagagctcctactagccattttgcctgacaacaatgggtccctgtatggtgatatcaagcgaatatgcgaaacagatcttggtttaatatcacaatgctgtctcacgaagcatgttttcaagatcagcaaacagtacttggctaatgtgtccctgaagataaatgtgaagatgggcggcagaaatactgttcttttggatgctataagctgcaggatacctttagtcagtgatataccaaccataatctttggagcagatgtgactcaccctgagaatggagaagattccagcccctcaatcgctgccgtagtagcttcccaggactggcctgaagtgaccaaatatgccggattagtttgcgctcaagctcacagacaagaactcatacaagatttgtataaaacatggcaggaccctgttcgtggcacagtcagtggtggcatgatcagggatcttctggtttcgtttaggaaagcaacagggcagaagccattaaggattatattttacagggacggtgtaagtgaagggcaattttatcaagtcctactttatgagctagatgcaatccggaaggcatgtgcttcgctggaaccaaactatcaaccgccagtgactttcattgtggtgcaaaaacggcaccacacacgattatttgctaataaccatagggacagaagcagcatagacaagagtgggaacatattgcctggcaccgtggttgatactaagatttgtcatccgacagagtttgatttttatctctgcagtcacgctggtattcaggggacaagtcgtccggctcactaccatgttctttgggatgagaataattttactgctgatggaatccagtcattgacaaacaacctttgttacacatatgcaaggtgcacacgctccgtctctgttgtacctccagcatattatgcacatttggctgctttccgtgctcgattctatatggagccagatatgcaggagaatggctctactggtcatactgctaagggtacacgggctgcaggagagactggggtccggccattgccagccttgaaggagaatgtaaagagagtaatgttttactgttagaagtagaagaggattgatggtttggttgccgaaacgagctagccataaacgatgttgcaatcataagatcgttcactgttagattcgttcttcgtgtatggaccattcatgcatggttcaaggtcttccagtttaacctagcaggaaagaaggggtatttcaacttagatcagtggttatagcgttagagttctttgatcataggtagcaggtccttgttctcttgcagtgtagacccccattatgggaaagtttatcagttctagcctctgtaaagaaatgttaattaatcaatcaaatttatatgtaggaaaattatgctcaagtcttcaaagatacttcgcaaaactaccagtcttggcagttttgctggagaagtatctcagaatgaatgagaagaattgcaagttattaactgcgattccttctgcaatttaccagttactcggcaataaaatgctatcgcgaccaaacaatctgaactaggaggatttgaaaggcattatggcattaagatttccaaggtttagccaaggcttagctcaggaccccactactcctcgtatttggtttggtattgctacgcacatgacttcgagagtcatgatgatattactgaggaacgcctttatcagaatatttttgcttctcatttcgggcaattggca

SEQ ID NO: 1219 - DNA, 3396 bp, Manihot esculenta
taagaactagcttcctctccatcactgtatatatatatctctgtaggctgcgcgatcagtcaagaaccagacagagaaagagagagctaatttataaaagcagaggaggggaaggaggaaggaggaggggcctcacaagcctttacacgtgataaagaaaacaccaaaagcacttgcatgcgtgtataaagattcatcttcatcatcacctctctctgttctagcgaagaaaatggtctaaaatctcaaatctgctactgcgaggcgaatgtggaaaggatagaagagaaagaaagtatatttctgccatttggtgaacctttactgttttgaacaccagcgtttgtgatttgcgtgtaaggttcagcgagcaaagagcaaaagtagagaggaaaaaagaaataaagaaaaaaatcagcaatgcctataaggcaaatgaaagagagctcagagcagcacttggtgataaaaacccacttgcagaacacaatgaaccaacctcaaaaacaccataaaacccctcaaaatggcaagggaccgccatctcaggaaacccacagcaagagccagacctcacccccaacaaaaaacaggggaagaagaagaaacagaggtggtagaaagtctgatcaaggagatgtctgtatgagacccagttcaaggccatgtactgtggcgcataagcccgtgaatccagcaggtaatcccttggcaagagctccaaatggaaatgctggaaatatttgtgaaatggagatgggtttggggttccctacttctagcaagtctttgagttttgctcctaggcctggttatggtcagctggggacaaagtgtattgttaaggccaaccacttctttgcagagttaccagacaaggacttgaaccactatgatgttaccataactcctgaagtggcatcaagagctaaaaacagagctatcatggcggagctggtgaggctttacaaagaatctgacttgggaaggagacttcctgcttacgatggcagaaagagtctgtatactgctggtgaacttccctttgcttggaaggagttcgtgattaaacttgttgatgaagaagatggaataaatggtcccaagagggaaagagagtacaaagtggtgatcaagtttgtagcaagggccaatatgcatcacttgggtcaatttttagctggtaaacgtgctgatgctccacaggaggctttacaaattcttgacattgtgctgagggagctctcaacaaagaggtactgccccattggaagatccttcttttcaccggatattagagcaccacaacgacttggtgatggcttggagtcctggtgtgggttttaccagagtataaggcctacacaaatgggcctatccttgaatattgatatggcttcagctgcattcattgagcctctcccagtaattgagtttgttgcacagcttctgggcaaggatgtattatcaaggccattatgtgattccgatagaatcaagattaagaaggccctcagaggagtaaaagttgaagtaactcatagagggaatatacggagaaagtatcgtgtctcaggattgacatctcaacctacaagagaacttgtatttcctgttgatgataactcaactatgaagtcagtagttgaatatttccaagagatgtatggattcaccattcaacatacgcatctaccttgccttcaagtaggaaaccagaagaaggcgaactatctacctatggaggcttgcaaaattgtggagggccaacgatatacgaaaaggttgaatgagagacaaattactgccctgttgaaagttacatgccaaaggccaagggatcgagaaaatgacattttgcagacagttcagcataatgcttatgatcatgatccttttgcaaaggagtttgggatcaaaatcagtgaaaagctagcttctgttgaggctcgaattctccctgctccctggctgaaatatcatgaaactggaaaggaaaaggactgcttgccacaagttggccaatggaacatgatgaataagaaaatgattaatggaatgactgtgagccgatggtcatgtatcaacttttcaagaagtgttcaagaaagtgttgctcgggggttttgcaatgagcttgctcagatgtgccaagtatctggcatggaattcaatccagagcctgttattccaatctataatgccaggcctgatcaagtagaaaaagctttgaagcatgtttatcatgcttccatgaacaaaaccaaaggaaaagaattggagcttttattagctattctacctgacaataatggatccctatatggggatcttaagcggatatgtgaaactgatcttggtttaatatcacaatgctgtcttactaaacatgttttcaaaatcagcaagcagtatttggctaatgtatcactgaagattaatgttaagatgggtggtagaaacactgtccttttagatgccattagctgcagaataccattggttagtgacataccaactattatatttggagcagatgtaactcacccagagaatggggaggactcaagcccctccattgcagctgtggtagcttctcaggactggcctgaagtgacaaaatatgctggattggtttgtgctcaagctcacagacaagaactcatacaagacttgtacaaaacatggcaagatccagttcgtggaactgttagtggtggcatgatcagagatcttctagtttcctttcggaaggcaacaggacaaaagccactaaggattatattttacagggatggtgttagtgaagggcaattttatcaagttttgctttatgaattggatgcaatccggaaggcttgtgcttctctagaaccaaactatcaaccacctgtgactttcatagttgtacaaaaacgacaccatactcgattatttgctaacaaccacagggatagaagtagcatagataagagtggaaacatattacccggcactgtggttgattcgaaaatctgccatccaacagagtttgatttttatctctgcagtcatgcaggtattcaggggacaagtcggcctgctcactaccatgttctgtgggatgagaacaacttcactgctgacggaatccagtcattgacgaacaatttatgttacacatatgcaagatgcactcgctctgtttctgttgttcctcctgcatattacgcacatttagctgcttttcgtgcccgattttacacggagccagaaatgcaggaaaatggctccagcggtgggggctcaggatatggcaccaagggagcaagagcaggagaaacaggagtccggccattgcctgccttgaaggaaaatgtgaagagagtaatgttttactgttaaagaccatggagg

SEQ ID NO: 1220 - DNA, 3146 bp, Prunus persica
caacatgcctataagaaaaatgaaagagagctcagagcaacaccttgtgatcaaaacccatttacagaacccagtgaacccagttcagaagcaacctaagactgcccaaaatggcaaaggtccaccgcctcaagaacctcacaaccccaaaacccataaccaaatttcacctccaacaaaaaacagaggaagaagaaggggtagaggtggtcggaaatctgatcaaggggatgtttgtatgcgaccgagttcacggcactgcactgtggctcatattcctgcctcaccaagctttgctagtcctcctgtagctagtactccaaatgggtatgtggaaaatggtggcaactcgtgttcgatggagatgggctttcctacttcgagcaagtctttgagttttgctcgtaggcctggttttggacaagttgggataaagtgtattgtaaaggccaaccatttctttgcagaattaccagagaaggacttgaaccattatgatgtttgtataactcccgaagttgcatcaagaagtgtgaacagagccatcatggctgaactggtgagattgtacagagaatctgacttaggaatgagactgcctgcttatgatggtagaaagagtctgtacactgctggtgagctgccctttgcttggaaggagttcaacattaagcttgttgatgaaccggacggaatcaatggccgaaaaagagaaagagactataaagtggtgattaaatttgttgcacgagcaaacatgcatcatctgggacagtttctggctggtaagtgtgctgatgctccccaggaagcgctccaaattcttgacattgtattaagagagctctcaaataaaaggtactgccccattgggagatccttcttttcacctgatatcagaacaccacaacggcttggtgaggggttggagtcgtggtgcggattttatcaaagtataaggcctactcaaatgggtctttccctcaatattgatatggcttcagctgcatttattgagcctctccctgtaatagagtttgttgcccagcttctaggcaaagatgtattatctaggacattgtctgattctgaccgtgtaaagattaaaaaggctcttagaggagtgaaagttgaagttacgcacagaggaagtgttcgaagaaagtatcgagtgtcaggattgacatctcaacctacaagagaacttgtgtttcctgttgatgagaacttgaccatgaagtcagtaattgaatacttccaggagatgtatggattcaccattcaacaagggcaccttccttgccttcaagttggaaatcagaagaaggcaaattacttacccatggaggcctgcaaaattgttgaggggcaacgatatacaaaaaggttgaatgagaagcaaattaccgctctgttaaaagttacatgtcaaagacctagggatcgtgaaaatgacatcctgcagaccgttcaacacaatgcgtatgaccaagacccttatgcgaaggagtttggaatcaaaatcagtgaaaaactagcttcagttgaggctcgaattcttcctgccccttggctgaaatatcatgaaactgggaaagaaaagaattgtttgcctcaagttggtcagtggaatatgatgaacaagaaaatgattaatggaatgactgtcagtcggtgggcttgtattaatttttcacggagtgtgcaagagagtgttgcacgtgggttttgtaatgaacttgctcaaatgtgtcaagtatctggaatggaatttaatccagaacctgtaattccaatctacaatgccaggcctgagcaagtagagaaagctttgaagcatgtttatcatgcatccatgaacaaaactaaaggaaaagatttagagctcctactagccattttgcctgacaacaacgggtccctgtacggtgatatcaagcgaatatgcgaaacagatcttggtttaatatcacaatgctgtctcacaaagcatgttttcaagatcagcaaacagtacttggctaatgtgtccctgaagataaatgtgaagatgggcggcagaaatactgttcttttggatgctataagctgcaggatacctttagtcagtgatataccaaccataatctttggagcagatgtgactcaccctgagaatggagaagattccagcccctcaattgctgctgtagtagcttcccaggactggcctgaagtgaccaaatatgctggattagtttgcgctcaggctcacagacaagaactcatacaagatttgtataaaacatggcaggaccctgttcgtggcacagtcagtggtggcatgatcagggatcttctggtttcgtttaggaaagcaacagggcagaagccattaaggattatattttacagggacggtgtaagtgaagggcaattttatcaagtcttactttatgagctagatgcaatccggaaggcgtgtgcttcgctggaaccgaactatcaaccgccagtgactttcattgtggtgcaaaaacggcaccacacacgattatttgccaataaccatagggacagaagcagcatagacaagagtgggaacatattgcctggcaccgtggttgacactaagatttgtcatccgacagagtttgatttttatctctgcagtcatgctggtattcaggggacgagtcgtccggctcactaccatgttctttgggatgagaataattttactgctgatggaatccagtcattgacaaacaacctttgttacacatatgcaaggtgcacgcgctctgtctctgttgtacctccggcatattatgcacatttggctgctttccgtgctcgattctatatggagccagatatgcaggagaatggctctactggtcatactgccaagggtacacgggctgcaggagagactggggtccggccattgccagccttgaaggagaacgtaaagagagtaatgttttactgttagatgtagaagaggattgatggtttggtcgccaagacgagcaagccataaatgatgctgcaatcataagatcgttcactgttagattcgttctttgcatatggaccattcatgaatggttcaaggtcttccagtttaacctagcaggagggaagaaaagaaagggtatttc

SEQ ID NO: 1221 - DNA, 3450 bp, Gossypium hirsutum
ctcttttatttctctctatttttaaacccatcttttctatcatcttcctcttgttatctttgcttcaaagttcactgctttttatttttgttttcaagttggtgactgcaaaggtaaaccaagtatgcctataaggcaaatgaaagagagctcagagcaacacctggtgataaaaagccacttgcaaaacactatgaacacagttcaaagaccacccaaaacagcacaaaatggcaaaggtccaccacaagctcatgaacctcacaacaacacaaaacaaccccataaccaagccacatcacctccatcaaagaatagaggaagaagaagaggaaggggtggtaaaaaatctgatcaactagatgtttgtatgagaccaagttcaaggccttgcactgtagcacataaaccagtgaaccaagcttcttgtggaatggaaatggggttccccacttcaagcaagtctttgaattttgcacctagacctggttatggtcaagttgggacaaaatgtattgtgaaggctaaccatttctttgctcagttaccagacaaggacttgaaccagtatgatgttacaataactcccgaagtagcatccagaacggttaaccgagctattattgcagaacttgtgagactgtacaaagaatccgatttgggtacgagattgccggcttatgacggcagaaagagtttgtacacggccggtgagcttccgtttgcgtggaaggagttcgtcgttaagcttgtagacgaggaagatggcatcaatggccccaaaagagaaagagaatataaagtggtaataaagtttgttgcacgagcaaacatgcatcatttaggccagtttttagccggtaagcgagctgatgctccacaagaagcgctccaaatactagacattgtattacgagagttatcgtcaaagaggtactgtcctattgggagatcattcttttcacctgatattagagcaccacaaaggcttggcgacggtttggagtcatggtgtggtttttaccaaagtattaggcctactcagatggggttgtctctgaacatcgatatggcttcagctgcattcatcgagcctctccctgtaatagagtttgttgctcagcttctaggcaaggatgtactgtctaggccattgtcggattccgatcgtgtgaagattaagaaggcgctcagaggagtcaaagtagaggtgacacatagagggaatgtacgaagaaaataccgtgtttcaggattgacttctcagcctactagagaactagtgtttccggttgacgataactctacaatgaagtctgttgttgaatacttccaagaaatgtatagcttcacaattcagcatacgcatctaccttgccttcaagttggaaaccagaagaaggcaaattatttacctatggaggcatgcaaaatcgtggagggacagagatatacgaaaagattgaatgagaggcaaattactgctctcttgaaagtcacatgccaaagaccgagggatcgagaaaatgacattctgcagacggttcaacataatgcttatgatcaagatccttatgcaaaggagtttggaatcaaaattagtgaaaaactcgcttcggtcgaggctcgtatccttcctgccccttggctgaaatatcatgaaactggaaaagaaaaggattgtttgcctcaagtggggcaatggaacatgatgaacaagaaaatgattaacggaatgactgtgagccgatgggcatgtattaacttctcacgaagcgtgcaagagagtgttgctcgagggttttgcaatgaacttgcacaaatgtgccaagtttctggcatggagttcaatcccgagcctgttataccgatctacagtgccaggcccgagcaagtggaaaaagctttgaagcatgtttatcatgcatccatgaaaactaagggaaaagaactagagcttctattagctatattgcctgacaacaacggctcgctttatggtgatctcaagcgaatttgtgaaactgatctaggattaatatcacaatgctgtctgacaaagcatgtctttaagatcagtaaacaatacttggctaatgtggcccttaagatcaatgttaagatgggtggcagaaacactgttcttttggatgctatcagctgccgaataccgttagttagcgatataccgaccataatattcggagcagatgtgactcacccggaaaatggagaagactcgagcccctcaattgcagcagtagtagcttcacaagattggccggaagtgacgaaatacgctggattagtttgtgctcaagctcatagacaagaactcatacaggacttgtacaaaacttggcatgatcctgtacgtggcactgtcagtggtggcatgatcagggatcttctgatatcttttaggaaggccacggggcaaaagccgctgaggataatattttacagggatggtgtgagcgaaggacagttttatcaagttttactgtacgagttagatgcaatccggaaggcctgtgcttctcttgaaccgaactatcaaccactggtgactttcattgtagtgcaaaaaagacaccacactcgtttgtttgctaataatcacagggaccgaagcagcacggacaagagtggaaacattttgcctggcactgtcgttgattcgaaaatctgtcatccatcggaatttgacttctatctttgcagccatgccggtattcagggaacaagtcggcctgcacactaccatgttctttgggacgaaaacaattttactgcagatggaatacagtctctaacaaacaacctttgttacacgtatgcaaggtgcacgcgctcggtctctgttgttcctcctgcctattatgcacatttagctgcattccgagcacggttctacctagaaccagagatgcaagacaataatagctcaacaggcgctggttcaggtcaagcaaaaggtggtggtacaaaggcagcaggagaatccggggtgcggccgttgccggccttgaaagagaatgtgaagagagtgatgttctactgctagaaccgtagcaaaagctaggcggagatgcagcaaccatgaacgacctttcggttcacaatgttgcttgtacagttgctaatgatacttgcatggttgcatgcaaggtcttcgaattaaggtcgtcagcgcagcctttaatgtaaaaatggtcggtgggacagtgaccaaaatgatctttgatggataaaaatgtttaaagtaggtatatgtaaagcaatgcttatttagaatcaaatcttaacgtaggaaattttggctgagaaacttgctataatctcctaccctccgtttcaatatatgacgaagatcattgaattagatagaatgttaaaaggtgttgaaagtttttaatccttttattctagttcatgagcatagcttaa

SEQ ID NO: 1222 - DNA, 4647 bp, Vitis vinifera
attcaccaaccagaaaatagggtcaaacttcacagtcaccggcatcaacggcagaagagggtagatgagtttttggcaatggtagggtggggcgcagaggaagagaccaaaagtccataggaggagaagccagagggggtggacccgtttgaaaagtggggccggtttgtaggtagaatggaccgttacagcttagccaaggaactgggttggggtgggggagtgaggagggagtacacaaaaaatgagaatggggctagagagagaaagtgagtgagagaggcacatatggagaagtctgcagaagagaggactgcaagttcgaattattcttcttctgtgtatgattgcttttaatcctcagtggttcttttggactatacccactttctctctctcaatatctataaatattcaatatatattatactctattgtacgtccccgaggctgcgcgatctgtacagaagagagaagagggaagggagaagcgggggagagagatgaacgaagccatttttatttaaatgaaaaagctaagagaggggggtgtggtgtgtggggggcagggccttggcaagccttttacacgtgataaagaaaacaccaaaagcacttgcatgcgtgtataaagattcatcatcatcatcatcatcatctctctctctctccctctctatacactccttctcagaagtctgaaaactcacccaaaaacacccacatccttttttatctccactttcgactctctttctatctcttcacgttcttttggctgccccagcccatcttttgaacctcctgtatcggtttttgatgattgaagaagagtatagagagactgcctcatctgtttctctccttctcttttcatggtgagactgtttggttggtggttactgattttcaagtcctaaatagcacttaatctttgagagagaaagggctagaaaaggaacagtgtatgtgtggtattggttgaagtttctcccatttggacgagtgcttttgctttggatatcagttcagaggcagcaatccaacatgcctatgaggcagatgaaagagagctcagagcaacacctagtgatcaaaacccacttgcagaactccatgaacccagttcaaaagccccccaaaactgctcaaaatgggaaaggccccccatcccatgaacctcagaacgccaaacctcacagccaaacttcgccttcatcaaaaaacagagggaggagaagaggaagaggtggcagaaaatctgatcaaagcgatgttttcatgcgccccagttcaaggccctgcactgtagcagataagccagttttggcgcaccaggctggacctcttgttactgatattcctcatgggtgtgtcgaaaatgggggcaacatgtgtgaaatggagatgggttttccttcttcaagtaagtctttgacctttgcacctaggcccgggtatggtcaacttggaacaaaatgtattgtgaaggccaaccatttctttactgagttaccagagaaggacttgaatcagtatgatgtgacaattactcctgaagtgtcctcaagaacggttaacagagctatcatgaatgagctggtgaaactgtacaaagaatctgacttgggaatgagattgcctgcttatgatggtagaaagagtctatacactgctggtgagcttccgtttgcttggaaagagttcaaggttaagctagttgatgaagaggatggaatcaatggtcccaaaagagagagggagtataaagtggtcatcaagtttgtagcacgggcaaacttgcatcatttgggccagtttctggctggtaagcgagcagatgctccacaggaagctcttcaaattcttgacattgtattgagagagctctctactagaaggtactgtcctgttgggagatccttcttttctcctgatattagagcacctcaacgtcttggagaaggtttggagtcatggtgtggattctaccagagtataagacctactcagatgggtttgtcactgaatattgatatgtcttcggctgcatttattgaagctctccctgtaatagagtttgttggtcagctattaggcaaagatgtgttatctaggccattgtctgattctgaccgtgtgaagatcaaaaaggcccttagaggagtaaaagttgaagtaacacacagagggaatgtacgaagaaagtatcgtgtatcaggactaacatcccaacctacaagagaactagtttttcctgttgatgataattcaaccatgaagtcagttgtggaatacttccaagaaatgtatggctttacaattcaacatgcacaccttccttgccttcaagtaggaaaccagaagaaggctaactatttacctttggaggcctgcaaaattgtagaggggcagcggtataccaaaaggttgaatgagaggcaaattactgctctattaaaagttacatgccaaagacccagggatcaggaaaatgatattctgcagacggttcaacataatgcttatgatcaagatccatatgcaaaggagtttgggatcaaaatcagtgaaaaattagcttctgttgaggctcggattcttcctgctccttggctgaaatatcatgaaactgggaaggaaaaggattgtttgcctcaagtcggtcagtggaatatgatgaacaaaaaaatgatcaatggaatgactgttagccggtgggcatgtatcaacttctctcggagtgtgcaagagagtgttgctcgtgggttttgtaatgaattggctcaaatgtgtcaagtgtctggcatggaatttaaccccgaacctgttattccaatctacatggccagacctgatcaagtagagaaagctctgaagcatgtgtatcatgcatctatgaacaaactcaaaggaaaagaattggagcttctattagctattttacctgacaacaatgggtctttatatggtgatcttaagagaatatgtgaaaccgaccttggtctaatatcacaatgctgtctcacaaaacatgtcttcaagattagcaagcagtacttagccaatgtgtctctgaagattaatgttaagatgggtggtagaaacactgtccttttggatgctatcagttgcaggataccattagttagtgacataccaaccataatatttggagcagatgtgacgcatccagagaatggagaagactccagcccttcaattgctgctgtagtagcttctcaggactggcctgaagtcacaaaatatgcaggattggtttgtgctcaggctcacagacaggaactgatacaagatttatacaagacatggcatgatcctgttcgtggcacagttagtggtggcatgattcgggatcttttggtttcctttcggaaggcgacagggcagaagccactaaggattatattttacagggatggtgttagtgaagggcaattttatcaagtgctactttatgaactagatgcaatccggaaagcttgtgcttctctagaaccaaactatcaaccaccagttacttttattgtggttcaaaaacgacatcatacccgattgttcgctaacaaccacagggaccggaacagcactgacagaagcgggaatattttgcctggcacagtggttgattctaaaatttgtcatccgactgaatttgatttttatctctgcagccatgctggtattcaggggacaagtaggcctgctcattaccatgttttatgggatgagaacaatttcacagcagatggaattcaatccttgacgaacaatctttgctacacatatgcaaggtgcacacgatcggtgtctgttgttcctccagcatattatgcacatttagcagcatttcgagcccgattctacatggagcctgacatgcaggagaatggttcaaatggaggtggcggtggtggtcatgccgccaaggctacacgagcatccggagagactggtgtccggccattgccagcacttaaagaaaatgtgaaaagagtaatgttttattgttagaagagggaaagaggggtgatgttgattgcagagccatcagtgggaatgcggctatcatgcgctactctttcatctctatagtttcctcattgtatatgtatgataattcatgcctggttgtaagaacatcaaatttagatcagtgattatatagtgcaagagagtttaggtttctttgtaacaactttgacagagcccccatgccttggaaaaatgcatgactaggcaatgtagaaaatgcccaaaatgtaatcattaatcagtttaggaattttgcttcagccttgtgaagaagaatattatcaaagtgtgagatgggcgtctgtcgtttggaaagctaaccaaggcaacttttactttctccaccaacccaacaggaagcatttgtggcaatgcttggttagaacccagtagactcctaggtccagaaaaaataatacaagaacaaagtaaattctaaaaatgaaaatggattctgggccctgggcaaccttctgtgcgcctcgacttatgaaattgtgagggtttaaaacctgggacccccaaatccaactggagggattttctggtttctttggctgccattaagctgttagcaagtatagcctgctg

SEQ ID NO: 1223 - DNA, 4007 bp, Glycine max
acacataacatagcagaagcctgcaagagagaggactgcaagttcgaattattcttcttccttgtttgattgcttttataaccctccgtacctcttttggactcattcattacccttctctctctctccaactttcaccatttttttttattactctctctctccaagctgctgctgctacaactagaacataggggtgtgtaatgtaagagagagagaaaacaaaaacaagctgttttacacgtgataaagaaaaacaccaaaagctattttgcatgcgtctataagattcatctcctcaccaccaccctcatcatcatcttcttctcccctttatcttctcttctcttcttcctctttccaaattctgaatcctccaaaacccaagtctttcacttctcctcacttatttatttccatcttggtttgtttgttcctggctgaagcaattggcactgttttgctgttataagcaaaaactaaacgtcaaaaactggtcctctctttgacaaagtgtgcttattcttctgtgtgtattcattggccagcactcatcacaaaaggtgaacatgccagtgagacagatgagggagggctcagaacagcacattgtgatcaaaccccatttgcagaaccccatgaatggagctaagaaggttcctagagctgttcaaaatggcaaaggttcaccaccgccaccactgtcacaacaggaactaccccacaaccaaacttcacctcatgcaaggaacaaggggagaagaaggagccgaggtggaggaagaaaatgtgatcaaggagatgttttgatgagacctattgtgactagtggtgttgaaaatggaagcaccatgtgtggtgaaaaagagatgagttaccctacttcaagcaagtcgttgagctttgctcctagacctggctatggacaagttggaacaaagtgcattgtgaaggctaatcacttctttgcagagttacctgacaaggacttgaaccagtatgatgtcagtattacccctgaagtgtcttccaaaacagtgaacaggtccattatagcagaacttgtgaggctgtataaggagtctgaccttgggatgaggcttccagcatatgatggcagaaaaagtatgtacactgcagggccacttcccttttcatggagagagtttaagataaaggttgtggatgatgaggatggagttaatggctccaaaagggaaagagaatatagagtggtgatcaagtttgttgccagggcaaatttgcatcacttgggccagtttctggctggtaaacgtgctgatgctccacaagagacactccaaattcttgacattgtattaagagagctatcatctaagaggttttgcccaattgggaggtccttcttttcacctgatattagaacaccacaacggcttggagagggtttggaatcatggtgtggattttaccaaagcataaggcctactcagatgggtctttccctcaatattgatatggcttctgctgcgttcattgaacctcttccagttgtggaatatgttgaccagctattaggaaaagatatcctgtcgaggcaattgtctgacgccgatcgcattaaaattaagaaagcccttagaggtgttaaagttgaagtaacccacagagggagtgttagaagaaagtatcgagtttctggtttgacttctcaaccaaccagagaacttgtgtttcccgttgatgagaattcaactatgaagtccgtagttgaatacttccaagagatgtatggtttcacaattaaatatactcaccttccttgccttcaagtaggaaatcaaaagaaagcaaattatttacctatggaggcctgcaaaattgttgagggacaacgatatacaaaaaggttgaatgagaagcaaatcactgctctcttgaaagttacttgtcaaagacctcgcgatcgagaaaatgacattttgcaggtattttgctggtttttaactgattaatatttattcgaaacagctttacagttaaaaaatagtgaaaagctagcttctgtagaagcacgaattctccctgccccatggcttaaatatcacgaaagtgggaaagaaaagaattgtttaccccaagttggccagtggaatatgatgaacaagaaaatgataaatgggatgactgtcagccggtgggcatgcataaatttttcacgaagcgtacaagacagtatttctcgcactttttgtacagaattagtccaaatgtgccaagtatctggcatggaatttaatccagagcctgttatccccatctacaatgccaaatcagaacatgtggagaaagctttgaagcatgtttaccatgtgtcaacaaacaaaacaaaaggaaaggaattggagcttttgttagcaatattgcccgacaacaatggttctctctatggtgatctcaagcgtatttgtgaaaccgaccttggtttaatttctcaatgttgtttgactaagcatgtctttaagatcactaagcagtatttggctaatgtgtctttgaaaatcaatgtcaagatgggaggtagaaacaccgttctggttgatgctgtaagctgtagaataccattggttagtgaaataccaactataatatttggagcggatgttacccatcctgaaaatggagaagactccagcccttcaatagcagctgtagtagcatctcaagactggcctgaactgacaaaatatgctggtttagtgtgtgctcaagctcatagacaggaactcatacaagatttgtacaaaatgtggcacgaccctgttcgtggcttagtcagtggtggtatggtccgagatttgttgatttcctttagaaaggcaaccggacagaagcctctaaggattatattttatagggatggtgtaagtgaagggcaattttaccaagttctactttatgagttggatgcaattcggaaggcatgcgcttctttagaaccaaactatcaacctccagtaactttcatagttgtacaaaaaagacaccatactcggttgtttgcaaataaccacagggacaggaacagtacagataagagtggaaatatattgcctgggactgtagttgattccaaaatctgtcatccaacagaatttgatttttatctctgtagtcatgctggcatccagggtacgagtcgtccagctcattatcatgttctgtgggatgaaaacaacttcacagcagatggaattcagtctttgacaaacaatctctgttatacatatgccaggtgtacacgctctgtatctgttgttcctccagcgtattacgcacatttagcagcttttcgagcacgtttctatatggagccagacctgcagcaggagaatggctcctcaggtggtggctccagggcaacaagagcaggtggagtcaagccattgccagccttgaaagaaaatgtgaagagagttatgttttattgttagattgtgtagtagtggcttggcataggcatcatcaaatggtacattcagcaaacacaatcatggcttcaaatgtacaatagtgactcctaagcattgcagcaatatttcccatagtagatccatgattatagttctaaaggcttagtttaggattcctgcaagtattttggctggagggacatgagagacacatcacgggtttagtgttgctaactctttgtggtcaagtcatcacaaaaatgattgaatttaagattaaattaggcatcggaaacaaagtttacggatcaatcttaattgtagaaatttttgcctgaaggccattgttggtgttgaattgaaatagtagaaaatttccaatccccttgtgcaaggatggatgatagtctgattagtcttgcaaaatattaggtgatgttatcatttgtagtcggcttaaatatgtttttattacttaaatgatagtctgattagtcttttttttatctataagaattgaagaagacatgttttaaatatttataacaattc

SEQ ID NO: 1224 - DNA, 4396 bp, Ricinus communis
cccttttcttttctctctcttctctctttgttaaagaaaactgatttcttttaaaataaggattttaaataaataaataaataacccaaaactttatctccacttttgcttctcttttaatccaatcacgttctttgccaccacccatctctataaaacctctctgtccgtttctctctcttttccaatctcatggtttttatcagtaactcagtagttttggactttggttatttattgttaagaagttccgagtcatttctatactcttcagatagtgatttcacttcccttttcaaggtttattccttctctttctatataccttcttcttgttcttgtttgccttttgttttcttctatgtgtagttttctagtttcaaaactctcttaaaaactgaaatcttttattttctttctttaatgcgcttcttgtgtttttatctgcttgggtgtattcattttctccgttattatatacatatacatacacacatatatataaatatatatatatatatatatatatatatatatatatatataaacttcagtttttaggtagggacagtttttaagaatattgttttggcacctggttatttctatttcttttgttttccctactagcattttctttttcctggttttcaactcttctttctttattttttttctttgttttttatctatggtctatggtcagtgatttttgcttatagaaccatctaaacgaacaagatattgcggttttgcgttttaatgtggagaaagaaatggtctgaaaccccaaattagaggcaaatgtggaaagactagaagagaaagaacgaagctttactgttctgaacacagtcttttgtgtgtaaagtttttgtaagcaaagagcaaacagaggtggataggaaagcaaaggaaaggaaagaagaaatcagcaatgcctataaggcaaatgaaagagagttcagagcagcacctagtgttaaaaacccacttgcaaaacactatgaaccaacctcagaaacaccataaaattgcccaaaatggcaagggaccaccacaatctcaagaaactcacaacagcaaaccccaaaaccagacctcacctccaacaaaaaatagaggaagaagaagaggaagaggtggtagaaaatctgatcaaggagatgtctttacgagacccagttcaaggccttgtactgtggtgcataagccagtgaatcaagctggtggtctcttggcaaatgctcccaatggaaatagtggaaatatttgtgaaatggagatgggtttgggattccctacttctagcaagtccttaacttatgctcgtaggcctggttatggtcaacttgggacaaaatgcattgttaaggcgaaccacttctttgcagagctgctggacaaggacttaaaccagtatgatgttacgataactcctgaagtggcatcaagaactactaacagagctatcatggcagagcttgtgaggctctacaaagaatctgacttaggaatgagactgcctgcttatgatggcagaaagagtctttatacatctggtgagcttccctttgcttggaaggagttcatcattaagcttgttgatgaagatgatggagtcaatggccccaagagagaaagggagtacaaagtggtaatcaagtttgttgcgagggccaacatgcatcatctgggtcaatttttagctggtaaacgtgctgatgctccacaggaagctttgcaaattcttgacattgtactgagggagctctcaacaaggaggtactgcccagttggtagatccttcttttcaccagatattagagcaccacagcgacttggtgatggcttggagtcatggtgtgggttttaccagagtataagacctacacagatgggcctgtcactgaatattgatatggcttcagctgcattcattgagcctctccctgtaattgagcttgttgcccagcttctaggcaaggatgtgctatcaaggccattatctgatgctgatagaattaagatcaaaaaggctctcagaggagttaaagttgaagtaactcacagaggaaatgtacgaagaaagtatcgtgtctcaggattgacatctcaacctacgagagaacttgtatttcctgttgatgataactcaactatgaagtcagtagtagaatatttccaagaaatgtatggctttaccattcaacatacacatctaccttgccttcaagtaggaaaccagaagaaagccaactatctaccaatggaggcttgcaaaattgtagaggggcaaagatatacaaaaaggctgaatgagaggcaaattactgccctgttgaaagttacatgccaacgacctagggaccgggaaaatgacattttacagacagttcagcataatgcttatgatcaagacccttatgcaaaggaatttggaattaaaatcagcgaaaagctagcttctgttgaggctcgaattctccctgccccttggctgaaatatcatgatactggaaaggaaaaggattgcttgcctcaggttggccaatggaatatgatgaacaagaaaatgatcaatgggatgactgtaagtaggtgggcttgtattaacttttcaaggagtgtgcaagagagtgttgctcgtgggttttgcagtgaacttgctcagatgtgccaagtgtctggcatggaattcaatccagagcctgttatcccaatttacagtgccaggcctgagcaagttgagaaagctttgaagcatgtttatcatgcttccatgaacaaaaccaaaggaaaagagctggagcttttattagctattctacctgacaacaatggcaccctatatggtgatctcaaaaggatctgtgaaacggatcttggtttaatatcacaatgctgtcttacaaaacatgtcttcaagatcagcaagcagtatctggctaatgtgtcccttaagattaacgttaagatgggtggcagaaatactgtccttttggacgccataagctgtagaataccattagttagtgacataccaaccattatattcggagcagacgtgactcacccagagaatggggaggattcaagcccctcaattgcagctgtagtagcttcacaggactggcctgaagtgacaaaatatgctggattagtttgtgctcaggctcacaggcaagaactcatacaggacttgtacaaaacatggcaagatcctgttcgtggtactgttagtggtggcatgatcagagatcttctggtctcgtttcggaaggcaacaggccagaaaccgctaaggattatattttacagggacggtgttagtgaagggcaattttatcaagttctgctttatgaattagatgcaataagaaaggcctgtgcttctctagaaccaaactatcaacctcctgtgactttcattgttgtacaaaaacgccaccatactcgattgtttgctaacaaccatagggataggagtagcacagacaagagtgggaacatattacctggcactgtggttgattctaaaatctgtcatccgacagaattcgatttttacctctgtagccatgctggtattcaggggactagtaggcctgctcactaccatgttctgtgggatgagaacaacttcactgcagatggaatccagtctttgacaaacaatctgtgttacacatatgcaaggtgtactcgctccgtttccgttgtacctccggcatactatgcgcatttagctgcttttcgtgcccggttttacatggagccagaaatgcaggataacggctcaacaggtaccaggggaacacgagcagctggagaaactggagtccggccattgccagccttgaaggaaaatgtgaagagagtaatgttctattgttaaaaagacgaccatgggagcacagcaggaaatccaacacaacagtagagatatttcccttgtatatgtgacataacacatgcatacatgattgcaagatctcttccattgtcggttgctgctgattagaagtgttagacatggttgctggaaagcaaatggaaaatgcgaagtaacaacccaaaacgtaggagatagttgtagtcctgtcaagtaaccattcatcttggatatgtcaatgaaggccttgtaaagaaatgtttatttatgatcagtcttatatatgtaggaaaattttgcctcatcggaagtagtgaattttcatgtctaaaatgttgcacttggataatgtatagtaataataatctttgatttttaactaatatgataacccggctaccattttgttatccaaggaaaataagaataatgcaagtcaatatggctactagcatgagtattttacaaaatgggaagtcattcatgtcgcggagctcatgt

SEQ ID NO: 1225 - DNA, 3655 bp, Ricinus communis
ttccaatctcatggtttttatcagtaactcagtagttttggactttggttatttattgttaagaagttccgagtcatttctatactcttcagatagtgatttcacttcccttttcaagtggagaaagaaatggtctgaaaccccaaattagaggcaaatgtggaaagactagaagagaaagaacgaagctttactgttctgaacacagtcttttgtgtgtaaagtttttgtaagcaaagagcaaacagaggtggataggaaagcaaaggaaaggaaagaagaaatcagcaatgcctataaggcaaatgaaagagagttcagagcagcacctagtgttaaaaacccacttgcaaaacactatgaaccaacctcagaaacaccataaaattgcccaaaatggcaagggaccaccacaatctcaagaaactcacaacagcaaaccccaaaaccagacctcacctccaacaaaaaatagaggaagaagaagaggaagaggtggtagaaaatctgatcaaggagatgtctttacgagacccagttcaaggccttgtactgtggtgcataagccagtgaatcaagctggtggtctcttggcaaatgctcccaatggaaatagtggaaatatttgtgaaatggagatgggtttgggattccctacttctagcaagtccttaacttatgctcgtaggcctggttatggtcaacttgggacaaaatgcattgttaaggcgaaccacttctttgcagagctgctggacaaggacttaaaccagtatgatgttacgataactcctgaagtggcatcaagaactactaacagagctatcatggcagagcttgtgaggctctacaaagaatctgacttaggaatgagactgcctgcttatgatggcagaaagagtctttatacatctggtgagcttccctttgcttggaaggagttcatcattaagcttgttgatgaagatgatggagtcaatggccccaagagagaaagggagtacaaagtggtaatcaagtttgttgcgagggccaacatgcatcatctgggtcaatttttagctggtaaacgtgctgatgctccacaggaagctttgcaaattcttgacattgtactgagggagctctcaacaaggaggtactgcccagttggtagatccttcttttcaccagatattagagcaccacagcgacttggtgatggcttggagtcatggtgtgggttttaccagagtataagacctacacagatgggcctgtcactgaatattgatatggcttcagctgcattcattgagcctctccctgtaattgagcttgttgcccagcttctaggcaaggatgtgctatcaaggccattatctgatgctgatagaattaagatcaaaaaggctctcagaggagttaaagttgaagtaactcacagaggaaatgtacgaagaaagtatcgtgtctcaggattgacatctcaacctacgagagaacttgtatttcctgttgatgataactcaactatgaagtcagtagtagaatatttccaagaaatgtatggctttaccattcaacatacacatctaccttgccttcaagtaggaaaccagaagaaagccaactatctaccaatggaggcttgcaaaattgtagaggggcaaagatatacaaaaaggctgaatgagaggcaaattactgccctgttgaaagttacatgccaacgacctagggaccgggaaaatgacattttacagacagttcagcataatgcttatgatcaagacccttatgcaaaggaatttggaattaaaatcagcgaaaagctagcttctgttgaggctcgaattctccctgccccttggctgaaatatcatgatactggaaaggaaaaggattgcttgcctcaggttggccaatggaatatgatgaacaagaaaatgatcaatgggatgactgtaagtaggtgggcttgtattaacttttcaaggagtgtgcaagagagtgttgctcgtgggttttgcagtgaacttgctcagatgtgccaagtgtctggcatggaattcaatccagagcctgttatcccaatttacagtgccaggcctgagcaagttgagaaagctttgaagcatgtttatcatgcttccatgaacaaaaccaaaggaaaagagctggagcttttattagctattctacctgacaacaatggcaccctatatggtgatctcaaaaggatctgtgaaacggatcttggtttaatatcacaatgctgtcttacaaaacatgtcttcaagatcagcaagcagtatctggctaatgtgtcccttaagattaacgttaagatgggtggcagaaatactgtccttttggacgccataagctgtagaataccattagttagtgacataccaaccattatattcggagcagacgtgactcacccagagaatggggaggattcaagcccctcaattgcagctgtagtagcttcacaggactggcctgaagtgacaaaatatgctggattagtttgtgctcaggctcacaggcaagaactcatacaggacttgtacaaaacatggcaagatcctgttcgtggtactgttagtggtggcatgatcagagatcttctggtctcgtttcggaaggcaacaggccagaaaccgctaaggattatattttacagggacggtgttagtgaagggcaattttatcaagttctgctttatgaattagatgcaataagaaaggcctgtgcttctctagaaccaaactatcaacctcctgtgactttcattgttgtacaaaaacgccaccatactcgattgtttgctaacaaccatagggataggagtagcacagacaagagtgggaacatattacctggcactgtggttgattctaaaatctgtcatccgacagaattcgatttttacctctgtagccatgctggtattcaggggactagtaggcctgctcactaccatgttctgtgggatgagaacaacttcactgcagatggaatccagtctttgacaaacaatctgtgttacacatatgcaaggtgtactcgctccgtttccgttgtacctccggcatactatgcgcatttagctgcttttcgtgcccggttttacatggagccagaaatgcaggataacggctcaacaggtaccaggggaacacgagcagctggagaaactggagtccggccattgccagccttgaaggaaaatgtgaagagagtaatgttctattgttaaaaagacgaccatgggagcacagcaggaaatccaacacaacagtagagatatttcccttgtatatgtgacataacacatgcatacatgattgcaagatctcttccattgtcggttgctgctgattagaagtgttagacatggttgctggaaagcaaatggaaaatgcgaagtaacaacccaaaacgtaggagatagttgtagtcctgtcaagtaaccattcatcttggatatgtcaatgaaggccttgtaaagaaatgtttatttatgatcagtcttatatatgtaggaaaattttgcctcatcggaagtagtgaattttcatgtctaaaatgttgcacttggataatgtatagtaataataatctttgatttttaactaatatgataacccggctaccattttg

SEQ ID NO: 1226 - DNA, 3396 bp, Tripterygium wilfordii
gtaatccctattttgtgaggcgaataaaccaaccataggtgggcttgtgtatgtgccatgcggtgaaaagaaacaactacttgtgaacgctttgcatacgaatttcagtgagaaagatacagtagacaacagacatgcctataaggcagatgaaagagagctcggaccagcatcttgtgatcaaaacccacttgaaaaactccatgaacccaccacagaaaactccaaaaactgctcaaaatgggaaaggtccaccactccaagaacaccagaacactaaaatccagaaccagccctcacctccttcaagaaatagaagaagaaggggaagaggtggtagaaaatctgatcaaggtgatgcctgtctgagaccgagttccaggccttgtactgtggcctgtaaaccggtaaactcagctggtgatcttttggctaccattcctaatgggtctactgaaaatgggggcaatgtttgtgaaatggacatgggtttccctacttcgagcaagtctttgagttttgctcctaggcctggttatggtcaagttgggacaaaatgtatagtcaaggcgaaccacttcttagctgagttaccagaaaaggacttgaaccagtatgatgttaccatcacccctgaagtgtcgtcaagaactgtgaacagagcaattatggcagagcttgtaaggctgtacaaggaatctgacttaggcatgagattgcctgcgtatgatggcagaaagagtctgtacacagctggtgagcttccttttgcttggaaggagtttaccattaagcttgtagatgaagatgatggaacaaacggtcccaaaagagaaagagaatatagagtggtgattaaatttgttgctcgggcgaatttgcatcatttgggccagtttttggctggtaatcgtgctgacgctccccaagaagctctgcaaattcttgacattgtgttaagagagctttcagttaagaggtattgccccatcgggagatcctttttttcttctgatataagagcaccacaacggcttggggatggcttagagtcctggtgtggcttttaccagagtataaggcctacccagatgggcctgtccctgaatattgatatggcttcagctgctttcattgagcctcttcctgttattgaatttgctggtcaacttttagggaaagatgttctatcaaggccattgtccgattctgatcgtgtgaagattaaaaaggcccttagaggagtgaaagttgaagtaactcatagaggtaatgtaagaagaaagtatcgtgtttctggattaacgtctcaaccgacaagagaactagtgtttcccgttgatgagaactcgaccatgaagtctgttgttgaatacttccaagaaatgtatggattcaccattcaacatagtcatctaccttgcctccaagttggaaaccagaagaaagcaaattatttacccatggaggcatgcaaaattgttgagggacaacgatacacaaaaaggttaaatgagaaacaaatcactgctctcctaaaagtcacatgtcaaaggccgagggagcgggaaaatgacattttgcagacggttcaacataatgcttatgatcaagacccttatgcaaatgagtttgggatcaaaatcagtgaaaagctagcttctgttgaggctcgaattctccccgccccttggctaaaatatcatgaaactggaaaagaaaaggattgtttgcctcaagttggtcagtggaatatgatgaataagaaaatgattaatgggatgactgtaaaccggtgggcatgcattaacttctcacgtagtgttcaagagaatgttgctcgtggattttgtagtgagcttgcgcaaatgtgccaagtatctggcatggaatttaacccagatcctgtaattccaatatacactgctcgtcctgagcaagtagaaaaagctttaaagcatgtttatcatgtgtccatgaacaaaaccaaaggaaaagagctggaacttctattggcgattttgcctgataataatggctcactctatggagatctcaagcgaatatgtgaaactgatcttggcttattaacacaatgctgtctcacaaaacatgttttcaaaatcagcaagcagtacttggctaatgtgtcgcttaagatcaatgttaagatgggcggtaggaacactgtacttttggatgccatcagttgcagaatacctttagttagtgacataccaaccattatttttggagccgatgtcactcacccagagaatggggaagactcgagtccatcaatagctgctgtagtagcttctcaggactggcctgaagtgacaaaatatgctggattagtatgtgctcaagctcacagacaggaactcatccaagatttgtacaaaacatggcaagatcctgttcgtggtactgttagtggtggcatgatcagggatcttttaatttcttttaggaaggcaacaggccagaagccactgaggataatattttacagggatggtgtaagtgaagggcagttctatcaagttctactttatgagttagatgccatacggaaggcttgtgcttctctagaaccaaactatcaaccaccagtaacttttattgtagtacaaaaacgacaccacactcggctgtttgctaacaaccacagggacagaagtagcacagataagagtgggaacatattacctggcactgtggttgatactaaaatctgccatccaacagaatttgacttttatctctgcagccatgccggaatacaggggacgagtaggccagctcactaccatgttctctgggatgaaaacaattttacggcagatggaattcagtctttaaccaacaacctctgttacacgtatgcaaggtgcacgcgttctgtctctgttgttcctccagcatattatgcacatttggctgctttccgcgcaagattctacttggaaccagatgtgcaggagaatggctctaatggcagtggccatgctacaaagaccacacgaacaggagatgccggtgtccgaccattgcctgctctaaaagagaatgtgaagagagtaatgttctactgctaagcttggtttggtgcagcagtttgtgggagaccggccatactaaatggtctttcattcctcagattcctttgtacattatcagtgacatgatcgctaggttttcccttctaggaagcggttaaactgaaaaggtttaggggtaatagtcctggaaagttatttaggggtaataatccttgaaagttaattggaatcgtttagagtaggtgagttgtgaaatcccttttagtttttagagggaagaatgtaaaagtagggctcatgtaaagaaacttttcttttttctatgtatgaa

SEQ ID NO: 1227 - DNA, 3713 bp, Theobroma cacao
ctgaatcctccacaaaacccatcttttatctcccacttttgccttgtcatttaatctctcttcacgttctttggcttcaacccatcttttctaacctcgtcctctccctttctattgtggtttttttgcttcaaagttactgcttcatatgttttttcactaagttgaaagggtcatttaatccgtgaagggggagcaaaacaagtataagaatagaggagaaaccactgctttctgcgtgtgccatttcgtgaaaactctcccatcttttttaactcttctggacaaagcttttgttcttgtgttgtgtctttttcagtgcgcaagttaagaaaaactaaaccagtatgcctattaggcaaatgaaagagaactcagagcaacaccttgtgatcaagaatcacttgcaaaacactatgaacccagttcaaagagcacctaaaactgcacaaaacggcaaaggtcctccagcagctcatgaaccacagaacacgaaactgcctcataaccaaacctcacctcccacaaagaataaaggaagaagaagaggaagaggtggtagaaaatctgaccaaggagatgtttgtatgagaccaagttcaaggccctgcactgtagcacataagccagtgaatccagctgctggtgatcttgtggctgcatcttcaaatgggcctattcagaatggtcataatttgcgcggaatggaaatggggtttcctacttctagcaagtcttcgaattttgcccctagacctggttatggtcaagttgggacaaagtgtattgtaaaggctaaccatttctttgcagagctaccggacaaggacttaaaccagtatgatgttacaatatctcctgaagtggcatccagaatggtgaacagagctattatggcagagcttgtaagactgtacaaagaatcagacctaggaatgagattgcctgcttatgatggcagaaagagtctgtacacagctggtgaacttccttttgcatggaaggaattcatcatcaagcttgtagatgaagaggatggcatcaatggccccaaaagagaaagagaatacaaagtggtaataaagtttgttgcacgagcaaacatgcatcatttaggccaatttctagctggtaagcgtgctgatgctccacaagaagctctgcagattcttgacattgtattacgagagctatcaatgaagaggtactgtcctattgggagatccttcttttcacctgatattagagcaccacaaaggcttggtgatggtttggagtcatggtgtggtttttaccagagtattaggcctactcaaatgggcttgtctctgaatattgatatggcgtcagctgcattcatcgagcctctccctgtaatagattttgttgctcagcttctaggcaaggatgtattgtcaaggccatcgtccgattctgatcgtgtgaagattaaaaaggcactcagaggagtgaaagtagaggtaactcatagagggaatgtacgaagaaaatatcgcgtttcaggattgacttctcagcctactagagaactaatgtttcctgttgatgacaactcaaccatgaagtctgttgttgaatacttccaagagatgtatggcttcacaattcagcacacacatctaccttgccttaaagtaggaaaccagaggaaggcaaactatttacctatggaggcttgcaaaattgttgaggggcagcgatacacaaaaagactgaatgagaggcaaattactgctctcttgaaagtcacatgccaaagaccaagagatcgggaaaatgacattttgcagacagttcaacataattcttatgatcaagacccttatgcaaatgagtttggaatcaaaatcagtgaaaaacttgcctcagttgaggcgcgaatccttcctgccccttggctgaaatatcatgaaactggaaaagaaaaggattgtctgcctcaagtcgggcagtggaatatgatgaacaagaaaatgatcaatgggatgactgtaaaccgatgggcatgtattaacttctcacgaagtgtgcaagagagtgttgctcgagggttttgcaatgaacttgctcaaatgtgccaagtctctggcatggaattcaattcagagcctgttattccaatctacagtgccaggcctgagcaagtggaaaaagctttgaagcatgtttatcatgcatccatgaataaaaccaaaggaaaagaactggagcttctattagctatattgcctgacaacaatggatcgctttatggtgatctcaagcgaatatgtgaaactgatctaggcttgatatcacaatgctgtctcacaaaacatgtcttcaagatcagtaaacagtacttggctaatgtggcacttaagatcaatgttaagatgggtggcagaaacactgttcttttggatgctatcagctgtagaataccattagttagtgacataccaaccataatatttggagcagatgtcactcacccagaaaatggagaagactccagcccctcaatagcagctgtagtagcatcacaagactggcctgaagtgacaaaatatgccggactagtttgtgctcaagctcatagacaggaactcatacaagacttgtacaaaacatggcaggatgctgtacgtggcactgttagtggtggcatgatcagggatcttcttgtatcttttaggaaggcaacggggcagaagccgctgagaatcatattttacagggatggtgtaagtgaagggcaattttatcaagttctgctgtatgagctagacgcaatcaggaaggcctgtgcttctctagaaccaaactatcaaccaccggtgactttcattgtcgtacaaaagcgacaccacacccgattgtttgctaataatcacagggaccgaagcagcacagacaagagtggtaacattttgcctggcactgttgttgattctaaaatctgtcatccaacagaatttgatttttatctttgcagccatgctggtattcaggggacaagtcggcctgcacactaccatgttctttgggatgagaacaattttactgcagatggaatacagtctctaacaaacaacctttgttacacatacgcaaggtgcacacgctcagtctctgttgttcctcctgcatattatgctcatttagctgcattccgtgcccggttctacatggaaccagagatgcaagagaatggctcaacagttggaggtgctggtcacacaaaaggtacaagggcagctggagaatccggggtgcggccattgccagccctgaaggagaatgtgaagagagttatgttctactgttagaatggagagatgttgatggtaatcaagtgagggagaacgtcattcaaaatgctggtcatcactgtgtgtacgcccatatcttcaggaatcagaaaagtgaaatgtgtcacttgtccagcggggcactgccaatagttttaaaggagctgtatgacccatataaaattttaagttatcttaacactgcaactgggaactcagatgtccccagatgatttggaagagcaaaatggggtactgacccactgtttgatgtctagtcagtgaaatatttggacagtagggataaagagaatccgattttacttttgtgaaagcttagagggctgagcttgaccctgctgccagcactgacttcctctctcacacatgggagcaggt

SEQ ID NO: 1228 - DNA, 3344 bp, Cucumis sativus
aaacccaccatgccagtacggcaaatgaaagagagctccgagcagcaccttgtaatcaaaacccacttgcagaacactgttcaaaaagctccaaaatcaacccaaaatggcaaaggtccgccgaatctggaacaccagaacatcaaatttcgaaacccctcttcccctccgagtaaaaacaggggtcggagaaggagcagaggtggtcggaaatccgatcagggagatgtgtttatgaggcccagttctcggccctgcacggtggcacgtaaacccgatgaacctgagtttaacgccggagctatggtggcgagtactaatccaaatggtggaatcattagtgggatgcaaatgggttttcgtaattcaagcaagtctttgagttttgccccaagacctggatttggtcaagttggaacaaagtgtattgtaaaagcaaaccatttctttgcagagttaccagacaaagatttgaatcaatatgatgttacaattactcctgaagtggcatcaagaactgtgaacagagccatcatggctgaattggtgagattatacagagaatctgatttgggaaaaagattaccagcttatgatggcagaaagagtctgtatacagctggtgagcttccttttgtatggaaagagtttaccatcaagcttgtggatgaagaagatggagtcagtggtcccaagagggagagggaatataaagtacttattaagttcgttgcacgtgcaaatttacaccatctgggtcagtttctggcgggcaagcgtgctgatgctccacaagaagctcttcagatactggacattgtattgagagagctttcatccaaaaggtactgtcctatagggagatctttcttttctcctgatattagatcacctcagcggctcggtgatgggctagaatcatggtgtggattttatcagagtattagacctactcaaatgggactgtctctgaacatagatatggcttcagctgcgttcattgagcctctccctgtccttgagtttgttgctcagcttctagggaaagatgttttgtcacggccactgtccgactccgatcgagtaaagattaaaaaggctctgagaggggtgaaagttgaagtaacacaccgtggaaatgttaggcggaagtatcgagtttcgggtctgacatcacagcctacaagagaattagtatttcctgttgatgacaactcaaccatgaagtcagttgttgaatacttccaggagatgtatggcttcaccattcagcatgcacatctcccttgccttcaagtaggaaaccagaagaaggcaaattatttgccaatggaggcctgcaaaattgtgggggggcaaagatatacaaagagattgaatgaaaagcaaataacagcacttctaaaagtcacgtgtcaaagacctagggatcgagaaaacgacattttgcagactgtccaacataacgcttatgacaatgatccttatgctaaagagtttgggattaaaatcagtgaaaaattggcttctgttgaagctagaattcttcctcctccatggctaaaatatcatgatactggtaaagagaaggattgtttgcctcaagtgggtcaatggaatatgatgaacaagaaaatgattaatggaatgactgttaaccggtgggcatgtatcaacttctctaggagcgtgcaagagagcgtagctcgtgggttttgttctgaacttgctcagatgtgtcaagtgtctggaatggaattcaatccagaaccagttattccaatatacaatgcaaggccagaacaggtagagaaagctttgaagcatgtgtaccatgcttccatgaacaagactaaaggaaaagagttggagttattattagctattttacctgacaataacgggtcgctttatggtgatcttaagcgaatttgtgaaactgatcttggtttaatatcacaatgctgtcttacaaagcacgtgttcaagataagcaagcaataccttgctaatgtgtcactgaagatcaatgtcaagatgggtggaagaaacaccgttcttctagatgctatcagctgcaggataccacttgtgagtgacataccaacaattatatttggagcagacgtgacccatccagagaatggcgaagattccagcccttcaatagctgctgtagtagcctctcaggattggcctgaagtgacaaaatatgcagggctagtatgtgctcaagctcatagacaagaacttatacaagacttgtacaaaacttggcaggatcctgtccgtggcactgtcagtggtggcatgatcagggatcttctgatttcgtttaggaaagcaacagggcagaagcctctcaggataatattttacagggacggcgtgagcgaaggacaattttatcaagtattactttatgagttggatgcaatcaggaaggcatgtgcttctttagaaccgaattaccaaccacctgtaacattcattgtcgtacaaaagcgacaccacacccgattgtttgccaacaactatagagatagaagtagcacagacaagagtgggaacattttacctggaactgtagtcgactccaaaatatgccacccaacagaatttgatttctatctctgtagtcatgctggaattcagggaacgagtcggccagctcactaccatgttctttgggatgaaaacaatttcactgcagatggaattcagtcgttaacaaacaatctttgctacacgtatgcaagatgtacacgttcagtttctgtcgtccctccagcatactatgcacatttagctgcattccgagctcgattctacatggaaccggagatgcaggagaatggctcagctggtcgttcggccaagagtacacgtgtcaccggagaatgtggggttcgtcctttgccagctctaaaagaaaacgtgaagagagtaatgttttactgttagaaagtagaagcaccaagcaaaggagaggctggtagtcggagcgatgactggaaatgttcaggcatcagaaacttgactccttcctctttcctctgcatttgagtttctttgtaaatgaatcatcatcatcaatgtgggttcaggtaggtgattttagttgggagtaaatgtagagttggttagttagttataggccaccccttaggtgagagttttacatttgctttactactgcactttgtaattgtcaaaatcaagtaacagtgagacgcacacccactcaagccatagatgacagattctattctcacccacatttgtaaagagctgtttttttccataatgaatcggtatagatgtgttggaaatttctctcataa

SEQ ID NO: 1229 - DNA, 3700 bp, Populus trichocarpa
gggaaggaatagtaatgcttatgacgtgcaaaaaagtcgcggccttttatccataccttcttactttgcgtatacaactatgttgaattgcaccgtcatcattattattcctatttctttactgtatctgcaatgtttttgttcacttggttgacatgcattctctcttattattttgtacctttttggttgcagaggacaagtggggcttaaatccaagcctgcaagacatacaagcgaaaggctaaagatacataaagtatatttgtgccatttggtgaatctttactgttttgaagacagagtatcctggtgctatcatataaagtttcagtgagtgaagggaagaaagtataagaaaagaccagcaatgcctgtaaggcaaatgaaagagagctcggagcagcacttagtgataaaaacccacatgcagaactccatgaaccaaccacaaaaacaccacaaaactgctcaaaatggaaaaggaccaccacaaccactccaagaaagttccaacactaaaccccaaaaccaggcctcacctcctgcaaagaacagagggaggagaagaggcagaggtggtagaaagtctgatcaaggagatgtatgtacgaggcctagttcaaggccttgtacagtggcacataaacctgttctgaacccaacaggtgatctcctggcaaatgcttctaatgggcatattgagaatagtaaaaatgtttgtgaaatggagatgggtttggggttccctacctcaagcaagtctttgagtttagctcctaggcctggttatggtcaagttgggactaagtgtattgttaaagccaaccatttccttgcagagttaccagacaaggacttgaaccagtatgatgttaccataactcctgaagtggcatcaagaactatgaacagagatattatggcagagctcgtgaggctttacaaagattctgacttgggaatgagactgcctgcttatgatggcagaaagagcttgtacacggctggtgagcttccttttgcttggaaggagttcataattaagcttattgatgaagaggatggtatcaatggtcccaagagagggagggaatacaaggtggtgatcaagtttgtcgcgagggccaatatgtatcatttaggtcaattcttagctgggaaacgtgctgatgccccgcaggaagctctacagattcttgacattgtactgagagagctatcttcaaagaggtattgccctgtcggaagatccttcttttcacctgatataagagcaccacaacgacttggtgatggcttagagtcctggtgtggattttaccagagtataaggcctactcaaatgggactgtccttaaatattgatatggcctcagctgctttcatcgagcctcttcctgtgatagagttcgttgcccagcttctaggcaaagatatattatcaaggccattgtctgattctgatcgagttaagattaagaagggtctcagaggagtgaaagttgaagttactcacagagggagtgtacgaagaaagtaccgtgtctcaggattgacatctcagcctacaagagaacttgtgtttcctgttgatgataactcgaccatgaagtcagttgttgaatacttccaggagatgtatggctttaccattcaacatacacatctaccttgccttcaggttggaaaccagaagaaagcaaactatctacctatggaggcttgcaaaattgtggaggggcagcgttatacaaaaaggttgaatgagaggcaaattactgccctcttaagagttacatgccaaagacccagggatcgagaaaatgacattttacagacagttcagcataatgcttatgatcaagatccttatgcaaaggaatttggtatcaaaatcagtgaaaagctagcttctgttgaggctcgaattctccctgccccttggctgaaatatcatgaaactggaaaagaaaaggattgcctgcctcaagttgggcaatggaatatgatgaacaagaaaatgattaatggaatgactgtaagccggtgggcatgtattaacttctctaggagtgtgcaagagagtgttgctcgtggcttttgcaatgaacttgcccaaatgtgtcaagtttctggaatggagttcaattcagagcctgtgatccctatttacaatgccaggcctgagcatgtagagaaagctttgaagcatgtgtatcatgcatccacgaacagaaccaaaggaaaagagctagagcttctcttagctattctacctgacaacaatgggtccctctatggtgatctgaagcgaatatgtgaaactgatcttggtttaataactcaatgttgtctctcaaaacacgttttcaagatcagtaagcagtacttggcaaacctgtcgctcaagatcaatgtaaagatgggtggtaggaataccgtccttttagatgctataagctgcagaataccattagttagcgacataccgacaattatttttggagcagatgtgactcacccagagaatggagaggactcaagcccctcgattgctgctgtggtagcttctcaggactggcctgaagtaacaaaatacgctggattggtatgtgctcaagctcacagacaggaactcatacaggacttatacaaaacatggcaagatcctgttcgtggtactgtaagtggtggcatgatcagagatctcctgatttctttcaggaaagcaacggggcaaaagccgctaaggatcatattttatagggatggtgtaagtgaagggcaattttatcaagttctgctttatgagttggatgcaattcggaaggcctgcgcttctttggagccaaattatcagccaccggtgactttcattgttgtacaaaaacgtcaccacacaagattgtttgctaacaaccatagggacaggaatagcacagacaagagtggaaacatattacctggcactgtggttgattctaaaatctgtcatccaacggaatttgacttttatctctgtagccatgctggtattcagggaacaagtagaccagcacactatcatgtgttgtgggatgagaacaatttcacagctgatggaatccagtccttgacaaacaatctctgttacacatacgcaaggtgcacgcggtctgtttcagtggttccacccgcatactatgcacatttagctgcttttcgtgctcgattttacacggagccagtaatgcaggagaatggctcagcaggcagtggtgcttgccatggtgctaagggaacgcggacaggagaatctggtgtccggccacttccagccttgaaagagaatgtaaagagagtaatgttttattgttaggagggaatggaagttggattcaggaataggtagttcgagatgctagaatcgagaattctcatgtacatgtaacaacaaaagaaacatgatagcaggatgtttcattctagctcagtgattagaacccccaaaaagcctatggtcggtggttctctttaaacatgtcgagcgtgagaaacaccccaaaacacaggtgatagcactagtcctccaagtagccatagatgatgggaagaatgtcaaagtaggccttgtaaagaaatgttcatttatgaattaatcacgatgtaggaaattttgccactttgaagagtgcatgtttgttgacttgtgaggttt

SEQ ID NO: 1230 - DNA, 3546 bp, Fagus grandifolia
gcaggaatagtgtttgaatctgtgaaaaaaatgagtgaagactagaagaacaagaagaagaagaaaaggcagactctgttttttgcttttgcgtgccatttggtgaaagcgttatctttttgaataaaaagtggttttgctttgaatatttatatatatatatataaatatatatatatatcagtctcatcagtcagcaaattattagcttaaccagcatgcctataaggcaaatgaaggagagctcagagcaacaccttgtgatacaaaacccacttgcagaattccatgaacccagttcagaaatcacccaaaacagcccaaaatggcaaaggtccaccgctaccatcaccacctcaagatttccacaacacaaaaccccataaccaaacttcaccaccttcaaaaacagaggaagaagaaggggtagaggtggccgaaagtctgatcaaggtgatgtttttatgcgtccaagttctaggcactgcactgtggcacataagcctgtctctgcaaaccgtgcaggagctcttgtagcaagtactcctaatggtactgttgaaaatggtggcaactcgtgtaaactggagatgggttttcccacttcaagcaagtctttgagttttgcacctaggcctggttttggtcaagttgggacaaagtgtattgtaaaggccaaccatttctttgcagagttaccggacaaggacttgaaccagtatgatgttaccataactcctgaagtgtcatcaagaactgtaaacagagctatcatcgcagaactggtgaggttatacaaagaatctgagttaggaacaagactacctgcttatgatggcagaaagagtctatacacagctggggagcttccctttgcttggaaggagttcaaaattaagcttgtagatgaagaagatggaatcagtggtcctaaaaggcagagagaatataaggtggtgattaagtttgttgcacgggcaaacatgcatcatttgggccagtttctagctggaaagcgtgctgatgcgccgcaggaagctcttcaaattcttgacattgtattaagagaactttcaacaaagaggtattgccccgttgggagatccttttttcacgggaggatattagaatgccacaacgactaggtgatggcttggagtcatggtgtggattttatcagagtataaggcctacccagatgggcctgtctttgaacattgacatggctgcagctgcatttattgagcctctcccagtaatagaatttgttgcccagcttctaagcaaagatgttttatcaaggccattgtctgattctgaccgtgtaaagattaagaaggcccttagaggagtgaaagttgaggtaactcacagaggaaatgtacgaagaaagtatcgtgtttcaggattgacatctcaacctacaagagaactagtgtttcctgtcgatgacaattcaaacatgaagtcagttgttgaatacttccaagagatgtatggcttcaccattcaacatacacaccttccttgtcttcaagtaggaaaccaaaagaaggctaactatttacctatggaggcctgcaaaattgttgaggggcaacgatatacaaaaaggctgaatgagaggcaaattacttctttcctaaaagttacttgccaaagacctagagatcgggaaaatgacattttgcagacagttcaacaaaatgcctatgatctagacccttatgcaaaggagtttgggatcaaaatcagtgaaaagctagcttctgttgaggctcgaattcttcctgctccttggttgaagtatcacgaaactggaaaagaaaaggactgtttgccacaagttggtcagtggaacatgatgaacaagaaaatgatcaacgggatgactgtaagtcggtgggcatgtataaatttctcacggagtgtacaagagaacattgctcgtgggttttgtaatgaacttgcccaaatgtgtcaagtatctggcatggaatttaatccagagcctgtcattccaatctacaatgccaggcctgagcaagtggagaaggccttgaagcatatttatcatacagccatgaacaagaccaaaggaaaagatttagagcttctgttagctattttgccagacaacaatgggtcactgtacggtgatatcaagcgaatctgtgaaactgatcttggtttaatatcacaatgctgtctcacaaagtatgttttcaagatcaacaagcagcagtacttggctaatgtgtctctgaagatcaatgttaagatgggtggtagaaacacagttcttctggatgctatcagctgcagaataccattagttagtgacataccaaccattatatttggagctgatgtgactcacccagagaacggagaagactccagtccctcaatagctgctgtagtagcttcccaggactggcccgaagtaacaaaatatgctggattagtttgcgctcaagctcacagacaggaactcatacaggacctgtacaaaacatggcatgatcctgttcgtggcttgattagtggtggcatgatccgggacctcctagtttcttttaggaaggcaacggggcagaagccactgagaattatattttacagggatggtgttagtgaaggacagttttatcaagttctgctttatgagttagatgcaatccggaaggcttgtgcttctcttgaaccaaactatcaaccaccagtgactttcattgtggtacaaaaacgacatcacactcgattatttgctaacaaccatagagataagagcagcatagacaagaagagtgggaacgttttgccaggcactgtggttgattctaaaatctgccatccaacggaatttgatttttatctctgcagccacgctggtattcaggggacaagtcggccagctcactaccatgttctatgggatgagaacaattttaccccagatggaatccagtcattgacgaataatctctgttatacgtatgcacgatgtacacgctccgtctctgttgttcctccagcatattatgcacatttagctgcttttcgtgcccgattctacatggaaccggagatgcaggagaatggttcgtcgggtggtggtggtggtcatggtaacaagggaacacgagcagctggagagtctggtgtcaagccattgccggccttaaaggagaatgtgaaaagagtaatgttttactgttagagaccgtaaagagaggagggttagtggtggagcaatagccgggagatgtggcaatcatgaattgttattttctttttgggtatttcttctttgtacatgtatgatgtgatctaggcgtagtaacaagttcttcccaatttcagatcggtgattatagtgctagagagagcagtaggggcttttagtttatggttcatacgcccatcatagattaacaggtctttatctctgtattgttaacccataatgggaagaatgtaaaactaggccatgtaagaaaatatttatcaatctatatgtagactaaaaacttttcccccaaa

SEQ ID NO: 1231 - DNA, 3807 bp, Populus trichocarpa
aggcatggcagagggcctcactcacaaagccttttacacgtgataaagaaaacaccaaaagcacacttgcatgcgtgtataaagattcatcatcatcatcgtctctctagaattctctcactcttactctcttttatttctaaggccagaagaactgaaaccctccataaaaagccttcactttcctttctccttaaacccatcatttcacgttctttgtctccctcttctctcaaacatttctcttcttgcaacctcaactcttgtatcttggttgttaccgactgagtgagtgagcagaggagaagtggtcttaagtccaagcctgtgaggccaacaagcaaaagactagaagataaataaagtatatttttgccattcggtgaatctttacttttttgaagacaaagtatcttgctgctttcacataaagtttcagtgagtgaagggaataaagtgaaagaaaaaactagctatgcctataaggcaaatgaaagagagctcagagcagcacttagtgataaaaactcacatgcagaactccataaaccaacctcaaaaacaccacaaaactgctcaaaatggcaaaggaccaccacaaccactccaagaaagttccaacactaaaccccaaaaccagacctcacctcctgcaaagaatagagggagaaggagaggcagaggtggtagaaagtctgatcaaggagatgtatgtatgaggccttgttcaaggccttgtaccgtagtacataaacctgttgtgaatccaattggtgatctcctgtcaactacttcaagcgggcctattgagactggtaaaaatgtttgtgaaatggagatgggtccggggttcccaacctcaagcaagtctttgagtttcgcgcgtaggcctggttatggtcaagttggtagtaagtgtattgttaaggccaaccatttctttgcagagttaccagacaaggacttgaaccagtatgatgttactataactcctgaagtggcatcaagaactatgaacagagctattatggcagagctcgtgaggctttacaaagaatctgatttaggaatgcgactgcctgcttatgatggcagaaagagcttgtacacagctggtaagcttccgtttgcttggaaggagttcgctattaagcttgttgatgcacaggatggtatcagtggtcccaagagagagagagaatacaaagtggtgatcaagtttgttgcaagggcaaacatgtatcatttgagtcaattcttagctggaaaacatgctgatgctccgcaggaagctctacagattcttgacattgtactgagagagctctctacaaagaggtattgccctgttggaagatcctttttttcacccgatataagagcaccacagcgactaggtgatggcttggaatcctggtgcggattttaccagagtataagaccgactcaaatgggactgtccttaaacattgatatggcctcggcagcattcattgagcctcttcctgtgatagagtttgtcgctcagcttctaggcaaagatgtattgtcaaggccattgtctgattctgatcgagtgaagattaaaaaaggtctaagaggagtgaaagttgaagtaactcacagagggagtgtacgaagaaagtatcgtgtctcgggcttgacatctcagcctacaagagaacttgtgtttcctgttgatgataactcgacaatgaagtcagtcgttgaatacttccaagagatgtatggcttcaccattcaacatgcacatctaccttgccttcaggttggaaaccagaagaaagcaaattatctacccatggaggcttgcaaaattgtggaggggcaacggtatacaaaacggttgaatgagaggcaaattactgcccttctaaaagttacatgtcaaagaccccgggatcgggaaaatgacattttgcagactgttcagaataatgcttatgatcaagacccctacgcgaaggagtttgggatcaaaatcagtgaaaagcttgcttctgttgaggctcgaattctccctgccccttggctgaaatatcatgaaactggaaaagaaaaggattgcttgcctcaagtggggcaatggaatatgatgaacaagaaaatgattaatggaatgactgtaagccggtgggcatgtattaacttctcaaggagtgtgcaagagagtgttgctcgtggcttttgcaatgaacttgcccaaatgtgtcaagtttctggaatggagttcaattcagagcctgtgatccctatctacaatgccaggcctgagcatgtagagaaagctttgaagcacgtctatcatgcatccacaaacagaaccaaaggaaaagagctagagcttctcttagctattctacctgacaacaatgggtccctatatggtgatctgaagcgaatatgcgaaactgatcttggtttactaactcaatgctgtctctcgaaacatgtgttcaagatcagtaagcagtacttggcaaatgtgtccctcaagatcaatgtaaagatgggtggtagaaatactgtccttttagatgctatcagctgcagaataccattagttagcgacataccaaccattatttttggagcagatgtgactcacccagagaatggagaggactcaagcccctcaatagctgctgtggtggcttctcaggactggcctgaagtaacaaaatatgctggactagtttgtgctcaagctcacagacaggaactcatacaggacttgtacaaaacatggcaagatcctgttcgtggtactgttagcggtggcatgatcagagatcttctgatttctttcaggaaagcaactggacaaaagccgctaaggatcatattttacagggatggtgttagtgaaggacaattttatcaagttctgctttatgagttggatgcgattcggaaggcctgtgcgtctttggagccaaattatcagccaccagtaactttcatagttgtacaaaaacgtcaccacactagattgtttgctaacaaccatagggacaggactagcacagacaagagtggaaacatactgcctggcactgtggttgattctaaaatctgtcatccaacagagtttgacttctatctctgtagccatgctggtattcaggggacaagtaggccagcgcactatcatgttttgtgggatgagaacaacttcacagctgatggaatccagtctttgacgaacaatctctgctacacatatgctaggtgcactcgctccgtttcagtagttcctccggcatactatgcacatttagctgcatttcgtgctcgattttacacggagccagtaatgcaggagactggctcagcaggcagtggtgctggccatggtgctaagggaacacgaactggagaatctggtgtccggccactgccggccttgaaagagaatgtaaagagagtaatgttttattgttaggggggaatggaagttggattcaggtagtggttagctggagatgctagtattgataattctcatgtacatgtaacaacacaagcatgatagcaaaatgtttcattctacctcagtgattagaagcccaaaaagcctttggtcggttgttctcttaaaacatctcaaaacatgagaaacgcccctaaacacaggtgatggcactcgtcttccgaccatccatagatgacgggaagaacaaagtaggccttgtaaagaaatgttcattaatgaatcgatcgctatgtaggaaattttgccccatttaggagtgcatgatctagtaacttgtgaagtttcaaccc

SEQ ID NO: 1232 - DNA, 3076 bp, Trifolium pratense
aggagtagaaatggtagaaaatctgatcaagttgatgttttgatgagaccaagttgtagaccttgtactactgttgtgaaaaataatgataatggtcatgttgaaaatggaagcataatcacttctagtgatgttgagatgagttttcctacttcaagtaagtctttgagttttgctcaaagacctggttatggacaagttggtacaaaatgcattgttaaagctaatcacttctttgcagaattaccagacaaagacttgaatcagtatgatgtaactattacacctgaagtgtcgtccaaagccgttaacagatccattatagcagaacttgtgaggctgtataaagaatctgaccttggcatgagacttccagcgtatgatggacgaaaaagtttgtacacagcgggggttcttcccttttcctggagagagtttaagattaagcttatagaggaagaggatggaattaatggccccaaaagggaaagagaatacaaagttgtgatcaagtttgttgcaagggctaacttgcatcacttggggcaatttctagctggaaagcgtgcggatgctccacaggaggcaatacaaattcttgacattgtactaagagagctagcatcaaagaggttctgtcccattgggaggtccttttattcacctgatattcgaacaccacaacggctcggagaaggattggagtcatggtgtggattttaccaaagcataaggcctactcagatgggcctttccctcaatatcgatatggcttctgctgcgttcattgaacctcttccggtggtggaatttgttggccagctattgggaaaagatgtgctgtcaaggcagttgtctgatgcggatcgcatcaagattaagaaatcccttagaggagttaaagttgaagtaacacacagagggagtgttagacgaaagtatcgtgtttccggtataacgtctcaaccaacaagagaacttgtgtttcctgtcgatgagaactcaacaatgaaatcagtggttgaatacttccaagagatgtacggtttcactattaaacatacacaccttccgtgccttcaagttggtggaaatcaaaagaaagcaaactatttacctatggaggcctgcaaaattgtcgaggggcaacgatatactaaaaggttgaatgaaaagcaaattacttctcttttgaaagtcacgtgccagagacctcgtgatcgagaaaatgacattttgcggacggttcagcacaacgcttatgatcaagatccttacgcaaaggaattcgggattaaaatcagcgagaagttagcttcggtggaagcacgaattcttcccgctccttggcttaagtatcacgagagtgggaaagagaaaaattgtttaccccaagttggccagtggaatatgatgaacaagaaaatgattaatggaatgaccgttagccgctgggcatgcatcaatttttcacgaggcgtgcaggatagtgttgctcgtactttttgtaacgagcttgcgcaaatgtgtcaagtatctggcatggaatttaatctggagcctgttatcccgatctacaatgcaaaacccgagcaggtggagaaagctttgaagcatgtttaccatgtgtcatcgaacaaaaccaaaggaaaggaattggagcttttgttagttatattgccggacaacaatggttctctctatggcgatctcaagcgtatttgcgagactgaccttggtttaatttctcaatgttgtctgacaaagcatgtctttaagatcactaagcagtacttagccaatgtgtctctgaagatcaacgttaagatgggtggtagaaacaccgttcttgttgatgcggtaagctgcagaataccattggttagtgacataccaacaataatatttggagcagatgttacccaccctgaaaacggggaagactccagcccctcaatagcagcggtagtagcgtcgcaagattggcctgaagttacaaagtatgcaggtttagtatgtgctcaacctcaaagacaagaacttatacaagatttgtacaaaacttggcacgaccctgttcgtggtgtagttagtggtggcatgatccgagatttgttggtttcgtttagaagggcaaccggacagaagccacaaaggattatattttacagggatggtgtaagtgaagggcagttttaccaagttttactatacgagttggatgcaattcggaaggcgtgtgcttctttggagccaaactatcaaccaccagtaactttcatagttgtacaaaaacgacatcatactcggttattcgcaaacaaccacagggacagaaacagcaccgataggagtggaaatatcctgcctggaactgttgttgataccaaaatctgtcatccaacggagtttgatttttatctctgcagtcacgctggcatccagggtacaagtcgtccagcgcattatcatgttctatgggatgaaaataacttcacagcagacgggattcagtctttgacaaacaatctatgttatacatatgccaggtgtacacgctccgtatctgttgttcctccagcatattatgcacatttagcagcttttcgagcccgcttctacacagagccagacctacaggagactggctccaccggtggtcgtggttcgaaaacaacacgtgcagccggtgattgcggtgtcaagccattgccagcgttgaaggaaaatgtgaagagagttatgttttattgttagtctatgaaccagttaggaaatggtggatgcatggaggatggtagcatggagaaatcaaacggtagatgcagcaagcaccatcatgcattgcaatatttaacagttacttgtacattagttctagtggcctagtttaggatttttctagaagtatttggctagaactttggggagactcaccataggtttagactttagatggtattgtatcaggcattgtaaacaaagctctatgaatcaatctttattgtagaatgtttttcctgtgaagatccttgttgatgttgaagagtaaaacatatttcactttatttgctag

SEQ ID NO: 1233 - DNA, 3511 bp, Sesamum indicum
caaagaaaagattccgtctttcatggttcagtgttcattgttgagttcaaagatggaatctttgagccctttagttgtagtgtaagcactcgtgtttgtgttgtgagatgtcattttctatgcagcagcgaaatttgggttgagatgttgatttcccatgcatggagtcattgatctttgaaggactataaccaagaaggacaagaaactgttttatctagtaggaatatttgctgtgaaaaggtccctctgctttcttacatagtaggtttgagtgatcaaattcagtcttcatcataatcatgcctatgaggcagatgaaagaaaattcagaacaacactttgttatcaaatcccagttgcaaaatcccatgaactcagctcagaagaacccaaagactgcccaaaatggcaaaggcccaccaaatcaagaatcacagaatgccaaagctcaaaaccagtgttctcctccatcaagaaacagaggaaggagaaggggaaggggtggccggaaatctgaccaaggcgacgtctttatgcgaccgagttcaaggccatgcactgccgcagataagcctgttatgcgagaaacttcccaagccattgtaccggcattatctaatggatcggttgggaatggaggcagcttatgtcaatcagaaatgggttttccttcttcaagcaagtctttgacttttccaactagacctggatttgggcagctcgggacaaaatgtattgtgaaggccaaccatttcttcgctgagttaccagacaaggacttgaaccaatatgatgtaactattacccctgaagtgtcatcgagagcggtaaatagagctatcatggcagaacttgtgaaaatgtataaagaatctgacttggggatgagattgcctgcctatgatggcagaaagagtctgtacaccgctggcgaacttccttttgcttggaaggagttcacaattaagcttattgatgaagaggacaatgtcaatggtcccaagagagaaagggaatataaagtagtaatcaagtttgtcgcacgggcgaacttacatcatttaggccaatttcttgctggtaagcgtgcagatggcccaaaggaggcacttcaaattctggacattgtcctgcgagaactctcaatgaaaaggttctgccctgtcgggaggtcgttcttttctcctgatatccggagaccacaaaggcttggagatggtttagaagcatggtgtggtttttaccaaagtataagacctacccagatgggcctttcacttaacattgatatggcatcagctgcatttatcgaggctcttccagtgattgaatttgtcgcccaactgttggggaaagatgtgttgtcaaggccattatctgattccgaccgtattaaggttaagaaggcccttagaggagtaaaagttgaagtgactcacaggggagatgtacgtagaaaatatcgagtttctggcattacatcccaaccaactcgagagctagtgtttcctgtcgacgacaactcaatgaaatcagttgttgaatactttcaagaaatgtatggtttcacaattcaatacactcatcttccttgccttcaagtaggtaaccaaaagaaggccaactatttaccaatggaggcctgtaaaattgttgaggggcaacgatatactaaaaggttgagcgagaaacaaattactgctcttctaaaggttacatgccaaaggccaagggatcgggaaaatgatattctgcagactgttcaacacaatgcttatgagcaagatccttatgcaaaagagtttggaattagaatcagtgaaaaactggcttctgttgaggcaagagttctccctgctccctggctgaaatatcacgagaccgggaaggaaaaagattgtttgccgcaagtaggccaatggaatatgatgaacaagaaaatgatcaatggcatgactgttagccgttgggcatgtattaacttctcgcggagtgttcaagatagtgttgctcgtggattttgtaatgagctggctcaaatgtgtcaagtatctggcatggagtttaatccagaaccagtgataccaatctatgcagccaggcctgatcaagtagagaaagctttaaagcatgtttatcatgcatgcatgaacaaattaaaaggaaaagaattggagcttttattagctattttgccagacaacaacggttccctatatggtgatctgaagcggatatgtgagaccgatcttggtttgatatcccagtgctgtcttacaaaacatgtcttcaagattaacaagcaatatttggccaatgtatccttaaaaataaatgttaagatgggtggccggaacactgttctcttggatgctataagctgcagaatcccattggtcagtgacataccgacaattatctttggagctgacgtaacgcatcctgagaatggagaggagtccagtccatcaattgcagctgttgtagcatctcaagactggccagaggtcacaaaatatgcaggattggtttgcgctcaagctcatagacaggaattgatacaagatttgtacaaaacctggcatgatcctgttcgtggtacagtgagtggcggcatgatcagggatcttttggtctcttttaggaaagcaactggacagaagccacagaggataatattttatagggacggtgtgagtgaaggccagttttaccaagtgctgttgtttgagttggatgctattcggaaggcctgtgcttcgttggagccaaactaccaaccacctgtgacatttatcgtagttcaaaaacgacatcataccagacttttcgctaacaatcacagggacaagagcagcaccgacaagagtggaaacatcttaccaggcacagtggttgattctaaaatctgtcatccaacagaattcgacttttatctctgcagccatgctggaattcagggaactagtcggcctgctcattaccatgtgctctgggacgagaacaatttcactgcagatgggattcagtcattgacgaacaatctctgttacacatacgcaaggtgcacacgttctgtctcagtggttcctccagcttactacgcacatttggctgcattccgggctagattctatatggaacctgatgggcaggagggtggctgtgccggtggtcaaggtggcggcaagggcacacgagtagctggagaatcaggtgtgcgtcctttgccagccctcaaagaaaatgtaaaaagagtaatgttttattgttgaaaggccgcgtagccggaacaacgactagctagctagggttagtggtagggtttgttgctgcatggcagagccttttctttgtatatgtttgatgatgataaaatgcagcttcgcatggttttgaactttgatgaatgatgtaaaaatggctagcattagtttctttaattctgctctaaatgtgttgttgctcagttttcctctgagatacataatgataagtaaacctaggc

SEQ ID NO: 1234 - DNA, 3008 bp, Trifolium pratense
aggagtagaaatggtagaaaatctgatcaagttgatgttttgatgagaccaagttgtagaccttgtactactgttgtgaaaaataatgataatggtcatgttgaaaatggaagcataatcacttctagtgatgttgagatgagttttcctacttcaagtaagtctttgagttttgctcaaagacctggttatggacaagttggtacaaaatgcattgttaaagctaatcacttctttgcagaattaccagacaaagacttgaatcagtatgatgtaactattacacctgaagtgtcgtccaaagccgttaacagatccattatagcagaacttgtgaggttgtataaagaatctgaccttggcatgagacttccagcgtatgatggacgaaaaagtttgtacacagcgggggttcttcccttttcctggagagagtttaagattaagcttatagaggaagaggatggaattaatggccccaaaagggaaagagaatacaaagttgtgatcaagtttgttgcaagggctaacttgcatcacttggggcaatttctagctggaaagcgtgcggatgctccacaggaggcaatacaaattcttgacattgtactaagagagctagcatcaaagaggttctgtcccattgggaggtccttttattcacctgatattcgaacaccacaacggctcggagaaggattggagtcatggtgtggattttaccaaagcataaggcctactcagatgggtctttccctcaatatcgatatggcttctgctgcgttcattgaacctcttccggtggtggaatttgttggccagctattgggaaaagatgtgctgtcaaggcagttgtctgatgcggatcgcatcaagattaagaaatcccttagaggagttaaagttgaagtaacacacagagggagtgttagacgaaagtatcgtgtttccggtataacgtctcaaccaacaagagaacttgtgtttcctgttgatgagaattcaactatgaagtcggtagttgaatactttcaagagatgtatggtttcactattcaatatacgcaccttccttgccttcaagtaggcaaccaaaagaaggctaattacttacctatggaggcgtgcaaaattgttgaagggcaacgttatacgaaaagattgaatgagaagcaaattacttctctattgaaagttacttgtcagagaccccgcgatcgggaaaatgacattttacaaaccattcaacataatgcttatgaccaagatccttatgcaaaggaatttggaattaacatcagcgagaagctagcttctgtcgaagctcgaattcttcctgctccttggcctaaatatcacgaaagtgggaaagaaaagaactgtttaccccatgttggtcagtggaatatgatgaataagaaaatgattaatggaatggctgttaaccggtgggcatgcataaatttctcaaagagcgtgcaagatagtgttgctcgcactttttgtaatgacctcgctctaatgtgtcaagtatctggcatggaatttaatttggagcctgttatccctatctacaatgcgaagcctgagcaagtggagaaagcattgaagcatgtttaccatgtgtcatcaaacaaaactaaaggaaaggaattggaacttttgctagcaatattgccagacaataatggttctctatatggtgatctcaagcgaatctgtgaaactgaccttggtttaatttcacaatgctgtcttacaaagcatgtcttcaaaatcactaaacagtatttagctaacgtgtctctgaagatcaatgttaagatgggaggtagaaacactgttcttcttgatgctgtaagctacagaataccattggttagcgacataccaaccataatttttggagcagatgttactcaccctgaaaatggagaagacactagcccctcaatagcagccgtagtagcgtcccaagattggcctgaagtaacaaaatatgccggtttagtatgtgctcaagctcatagacaagaacttatacaagatttatacaaaacttggcatgatcctgttcgtggcacggttagtggtggcatgataagagatttactgatttcctatagaaaagcaacgggacaaaagccgctacgaattatattttacagggatggtgtaagtgaaggacaattttaccaagttttactttatgagttggacgcaatccggaaggcatgtgcatccttagaaccaaactatcagcctccagtaactttcatcattgtacaaaaaagacatcatactcggttattcccaaacaaccatagagacaggagtagcacagataagagtggaaatatattgcctgggactgttgtcgatactaaaatttgccatccaacggaatttgatttttatctctgcagtcatgctggcatccagggtactagtcggccagctcactatcatgttctatgggacgaaaacaatttcacagcagatggaatccaatctttaacaaacaatctttgttatacatatgctaggtgcacacgatccgtatccgttgttcctccagcatattatgcacatttagcagcctttcgagctcgattctatatggaaccagatatccaacaagagaatggttcttcaggtgatggtaattctagtcataatagttccaagggaacaacaagagcagctggagaatgtggtgttaagccattaccagctttgaaagataatgttaagagagtgatgttttactgttaaaactactttagttggcattgtaaagagtattctgtgtcaatcttcattgtaggaaattttgcttaaaggcttttacagatgttaaggggaagtttttctaattagtcttacagaaacattaagccaagaaatcatgtttattctgcaccatagctgaaggaaaatgagtcaagtcagtgtaacatttcttttacagttctctatgtaaatactcaaccaaaaatattactagg

SEQ ID NO: 1235 - DNA, 3905 bp, Gossypium raimondii
agagagagagagaggctaatgctaaggtaaggccaaagccatgtttttttaaaagccatccacagagagagaaatagagagagaggggcggcttacaaaggcttttacacgtgataaagaaaacaccaaaagcactttgcatgcgtgtataaagattcatcatcatcatcatcatcatctctctttcactcccccccttcgctactttttttttttaatttttctttgctcttatttttctcccttgtctctccatcattcctagaaaaaaaccatcttttatctcccttttctgctttctctttcaatcgctctttcaccttccttggcttcaacccatcttttctaacctcttcctctttctcttctttgttttgcttcaaagttaactgctttgcatattggtttccacttggttggcagaaagtgtaattattacttgtaggtgagggaaagtagtacaagaatagaagagaaaccagtactttatgcgtgtgccgatccctgaaagaacttcacactttgtttctcttttggacaagccttttgttcttgtcttgcatcagtttcgccgagtaagttcagagaaagcttaccagtatgcctattaggcaaatgaaagataactcagagcaacaccttgtgataaagaatcacttgcaaaacactatgaacccgattcaaagaacgccaaagactgcacaaaatggaaaaggtccaccagcaggtcatgaaccacacaacacaaaacaatcccataaccacacctcacctccaacgaagaacaaaggaagaagaagaggaagaggtggtagaaaatctgatcaaggcgatgtttgtatgagaccgagttcgaggcactgcacggtagcacagaagccagtgaatcctggttctgctgatattttggctgctacttcaaatgggtctattcagaatgatcataacttgtctggaatggaaatgggatttcctacttcaagcaagtctttgaattttgcatctaggcctggttttggtcaagttggaaccaagtgtatcgtaaaggctaaccatttctttgctgagttaccagacaaggacttaaaccagtatgatgttactataactcctgaagtgacatcccgaacgatgaacagagctataatggcagagcttgtgaaattgtacaaaggatcagtgctaggaatgagattacctgcttatgatggccgaaagagtctgtacacagctggtgaatttccattttcgtggaaggagtttagtgtcaagcttgtagatgaagacgatggcatcaatggccccaagagagaaagagaatataaagtggtagttaagtttgttgcacgagcaaacatgcatcatttaggccaatttctagctggtaagcgcgctgatgctccacaagaagcactgcagatacttgacattgtgttacgagagttatcaacaaagaggtattgtcctattgggagatccttcttttcacctgatattagagcaccgcaaaggcttggtgacggtttggagtcatggtgcggtttttaccagagtattaggccaactcagatgggcttgtctctgaatattgatatggcttcggctgcattcattgagccactacctgttatagagtttgttgctcagctactaggcaaggatttattgtcaaggccattgtctgattctgatcgtgtgaagattaaaaaggcactcagaggagtgaaagtcgaggtaacccatagagggaatgtacgtagaaaataccgtgtttcaggattgacttctcagcctactagagagttagtgtttcctgttgatgataattcaaccatgaagtctattgttgaatacttccaagagatgtatggctttacaattcagcatacacatctaccttgtcttcaagtaggaaaccaaagaaaggcaaactatttacctatggaggcttgcaaaattgttgagggacagcgatacacaaaaagattgaatgaaaggcaaattactgctctcttgaaagtcacatgccaaagaccaagggatcgggagcatgacattttgcagacggttcaacataatgcttacaaccaagatccttacgcaaaggagtttggggtcaaaatcagtgaaaagcttgcttcagtcgaggcgcgaatccttcctgccccttggctgaaatatcatgaaactggaaaagaaaaggattgtctgcctcaagttgggcagtggaatatgatgaacaagaaaatgatcaatgggatgactgttagccgatgggcatgtattaacttctcacgaagtgtgcaagagagtgttgctcgtgggttttgcattgaacttgctcaaatgtgccaagtttctggcatggagttcaatccagagcctgttattccaatctatagtgccaggcctgagctagtggaaaaagccttgaagcatgtttataatgcaaccatgaataaaaccaagggaaaagaattagagcttctattagctatattacctgacaacaatggatcactttatggtgatctgaagcgaatttgtgaaactgatctaggcttgatatcacaatgctgtctcacaaaacatgtcttcaagatcagtaaacagtacttggctaatgttgccctgaagatcaatgttaagacgggtggcagaaacaccgttcttttggatgctatcagctgcagaataccactagttagtgatataccaacgataatatttggtgcagatgtgacgcaccccgaaaatggagaagactccagcccctcaatagcagctgtagtagcttcacaagactggcctgaagtgacaaaatatgctggactagtatgtgctcaagctcatagacaggaacttatacaggacttgtacaaaacatggcaggaccctgtacgtggcacagttagtggtggcatgatcagggatcttctggtatcctttaggaaggcaacagggcagaagccactgaggattatattttacagggatggtgtcagtgaagggcaattttatcaagttctgctttatgaactagatgcaatccggaaggcgtgtgcttctctagaaccgaactatcaaccaccggtgactttcattgttgtacaaaaacgacaccacactcgcctctttgctaatagtcacagggaccgaagcagcacagataagagtggaaacattttaccaggcactgttgttgattcgaaaatctgtcatccaacggaatttgatttttacctttgcagtcatgctggtattcagggaacaagccggccagcgcactaccatgttctttgggatgaaaacaattttacagcagacggaatacagtctctaacaaacaacctttgttacacatatgcaaggtgtacgcgctcagtctcagttgttcctcctgcatattatgcacatttagctgcattccgtgcacggttctacatggaaccagagatgcaagagaatgggtcgaacagctgcagtaatggtcaagcgaaaggtacaagggcagtgggagaatcgggggtgcggccattgccagccttgaaggagaatgtgaagagagtgatgttctactgttagaatggatgagtggagtgggagatttgcaaccatgaatagactagcttttttcagattattaaaatttccttgtacagtttaaatgaatcattgcaaagtcttccaaagtttagtttaagataaaaatgtgaaacgtgggaggaatgatccacagatgtcagaatgttaaaactaggttattatctttatgtaaagaaatgttaatttagaatccttaatcatcttattctcaatttaatcttgtctgaatgttaatactatgctattacaaacaacagtctgatttataatggaatgtatttggatctaagcagaataaa

SEQ ID NO: 1236 - DNA, 4221 bp, Eucalyptus grandis
aattacgttggtgtttttatctgcttggtctcactcgatgttttcccagcacagatttttcggtttttggtaggggacaggattcgatcctagttttgtcttctgggtattttccgtttactaggttctattgagaaaaccgggctgggtatttttccgtttatcgtgttcgattaaagaaaaccagaaattctttcgtattccaccttttctcttggcctctctttgccttgtgattctcgtcttaaaacgattcatgatcattggtttaccgaatagaagaagaagaatctaaaacaaagttttattagtctcggggttgactgtcagctttgtcttcgcgttcatgaattttgtgctctttgcacgttttctgtttcttcctttcgtgctgattctgttgctgggtttttgaagtttttctgtggtgatagcaccgggggcgaaaggaggaaaatttgtgctcgatgttagttgggccggtggcattaatttatcctcacttctgctcgaaattttttctttctttttggggtggtctgcgtgctgaaacagaggtgaaaaattgactgtgcgttttcaatcttgcgaggaaatggtaatgcttgcaatctgcggcaaagggtggtctttgttccacctctcttcttttgatctattgcgtgcccgaagctgaacccatgatttcgcacacactcattgacgagattttccgttcagtcactgttctgcaattgtagccatttctctgacatgcaagatttcaccctttattctcacttctctcttcaactttgtttctctctcagctgaagtagttttgtatcctcttgaaacaagccaaagcccgagaggggggtcggtgtactatttgggacatcggttgggagtttcagttatcccagcagatgcctacgaggcaaatgaaagagagcgcagagcagaaccaccagcaccttgtcatcaagaccgcccgcttgcagaatcccatgaataatcaacctcagaagtccccgaagaccacgcagaatggcaagggcccgccgaccccgtcacctccctcgaagagcagaggaaggaggaggagagggagaggcgagcggaagtccgaccaaagtgacgtctgcgcgaggccgagctctaggccgtgcaccggggagattgtcgtgccgagggctcctccgaacgggtgcgcccagaatggtggtgggaaccgggcagatttcccggcctcgagccggtccttgagcttggctcgccggcccgggtatgggcaagttgggacccgctgcattgtgaaggccaaccatttttttgcagtgttaccagagaaagacttgaatcagtatgacgtcagcattacaccagaagtggcatcaaggaccgtaaacagagccatcatggcagagttgctaaggctgtatagagaatctgacctaggaatgagattgcctgcttatgatgggaggaagagtctttacactgctggtgagcttcccttttcttggaaggagttcaacattaagctcttagatgaagaggatggaattaatggacccaagagagtaagagaatataaggtggttattaagtttgttgcacgggcaaatatgcaccacttaagccaattcctagctggtaagcgtaccgacgcacctcaggaggctctgcaggtacttgatatcgttttgagggagctttccacgaaaaggttttgccccattggtcgatcatttttctcacccaatttaagaacaccccaacagctaggtgacggcttagaatcatggtgcggtttttaccagagcattaggcctactcagatgggcttatccctgaatattgatatggcttcggctgcattcatagagcctcttccggtgatagagttcgtggcccagcttctaggcaaagatgtcctgtcgaggcaattatctgattctgatcgtatcaagatcaaaaaggcccttcggggggtaaaagttgaagtaacgcacagagggagtgtacgaagaaaataccgtgtttcagggttgacatctcagccaacgagagagctagtatttcctgttgatgacaatctgaacatgaagtctgttgtggaatactttcaagagatgtatggctttacaatactgcatacacatcttccttgcctccaagtaggaaatcaaaagaaggcaaactatttacccatggaggcatgcaaaattgttgaagggcaacgatatacaaaaaggttgaacgagaagcaaattactgccctgctaaaagttacatgccaaagacctagggatcgtgaaaatgatattctccggactgttcaacaaaatgcctatgatcaagacccttatgccaaggaatttgggatcaagatcagtgaaaagctggcatctgtcgaagctcgtatccttccagccccttggttgaaatatcacgaaactggaaaagagaaggattgtttgcctcaagttggtcagtggaatatgatgaacaagaaaatgataaatggcatgactgtgaatcggtgggcatgtatcaacttctctaggagtgtgcaggaaagtgttgcgaaggggttctgcagtgaactcgctcaaatgtgtcaagtttctggaatggaatttaatactcagccggtcattcccatctatattgcaaagccagagcaagtagagaaagctttgaagcatgtataccatgcatgcataaataaaaccaaaggaaaagaactagagcttttattggcaattttgcccgacaataatggctccctatatggggacctcaaaagaatatgcgagactgatcttggtataatatcacaatgttgtctcacaaagcatgttttcaagatcaccaagcagtatttggcaaatgtatccttgaagatcaatgttaagatgggtggcagaaatactgttcttttggatgcaattagctgcagaattccgttagtcagtgacataccaactataatattcggagcagatgtgacccacccagagaatggggaagactctagcccttcaatagctgctgtagtagcatctcaggactggccagaagttacaaaatacgcaggactggtttgtgctcaagctcacagacaggaacttattcaagacttgtacaaaacatggaatgatccagttcgtggaactgttagtgggggcatgatcagggatcttttggtgtcctttagaaaagcaacagggcaaaagccactgaggataatattttacagggatggcgtgagtgaagggcaattctatcaagttctcctgtatgaattggatgcgatcagaaaggcttgtgcttcactagaaccaaactatcaaccgccggtaactttcattgtggtgcaaaaacgacaccatacacgcttgtttgctaacaatcatagagacaaaagcagcaccgataaaagtggcaatattatgcccggtaccgtggtcgatacaaagatctgccatcccacagaatttgatttttacctttgtagtcatgctgggattcagggaacaagtcggccagctcattatcacgttctatgggatgagaataattttacagccgatggaatccagtcgttgacgaacaatctctgttacacatatgcaagatgcacgcgttcagtctcagttgtgcctccggcttattacgcacatttggctgctttccgagcccgcttctacatggaaccggaggcgcaagagaacggatcgatggggagcggcggcggcaacggagatcacaaaaccaaaggcgcgcgcataaccggagagtcgggcgtgaggccattgccggctttgaaggagaacgtgaagagagtgatgttctactgctagaatggggggccgaggacgtgcggcatccactaactttgatcgtagagtctcaaatctttagtggtagatgtgtacatgctgtgtttataaagatgtagacggttgcccctagaatagagtagggaaagatggtggttgttctaggctcttttgaagctgaggatgagagtttagattgcaaataggcaaaaatagtcagaatcagataggaggtgaagatgatagagagggtagttctcatcctttgatgtaaccatcggttctaggaggaagggggggaatttggtggatcacactaggcttctttgtaaaggatttttcttttttttttaatcccagtgaagtcaaaaccaatcttaaagtcagcaaa

SEQ ID NO: 1237 - DNA, 3157 bp, Euphorbia peplus
agcagaaaaaaagagtccaaattttgcagaagatagaagagaaagaacgtttttttgtgccatttggtgaattttgtactgcaaaaaagcagcaatgcctacaaggcaaatgaaagatgggtctgagcagcacttggtgataaaaacccacttgcagaacaccatgaaccagcctcagaagcacctcaaaactagccaaaatggtaagggaccaccatcaccatctcaagctgaagctcagacacaaacctcaccttcaacaacaaagaatagaggaagaagaagagggagaggtgggagaaaatctgatcaaggtgaggcctttatgagacccagttcaagaccatgtgtgaatcaaaatccaagttcaccttgtgatgtgttggtgaaatctccaaatgggtgtggcggaaatgtaagtgagatgcagatgggtttaggattccctaattctagcaagtctttgagttatgctcacagacctggttatggtcaacttgggacaaagtgtattgttaaagccaaccacttctttgctgagttaccagacaaggacttgaatcactatgatgttaccataactccagaagtggcatcaagagctatcaacagagctataattgcagaacttgtgaggctccataaagaatccgatttaggaatgagacttcctgcttatgatggcagaaaaagcctgtacactgctggggagcttccctttgctttcaaggagttcacaattcaacttgttgatgaagatgatggcaccaatgctcccaagagggtgaaagagtataaggtggtaatcaagtttgttgcaagggccaatttgcatcatttgggacaatttttagccggcaaacgtgccgatgctccacaagaagctctgcaaattcttgatattgtacttagagaactctcaaataagaggtactgctccattgggagatctttcttttcaccagatattagaaggccgcaacgacttggcgagggtttggagtcatggtgcggattttaccagagtatcaggcctacacagatgggcctgtccttgaatattgacatggcttcagctgcattcattgagcctcttccagttattgagtttgttgcccagcttttaggcaaagacgtgttgtcaaggccattgtctgatgccgatagaatcaagattaaaaagggtcttagaggtgtaaaagttgaagtaactcacagaggaaatgtaaggagaaagtatcgtgtctctggattgacatctcagcctacgagggaactcgtattcccgattgatgataattcaactatgaagtcggtggtggagtacttccaagagatatatggtttcaccattgtacatactcatcttccctgccttcaagtaggaaaccagaagaaggcaaattatctacctatggaggcttgcaagattgtagagggacaaagatatactaaaaggctgaatgagagacaaatcactgctttgttgaaagtaacatgccaaagacctagggatagggagaatgacattttgaagacagttcaacataattcttatgaccaagacccttatgctaaggagtttgggatcaaaatcagtgaaaagctagcttctgttgaggctcgaattctgcctgccccatggctaaaatatcatgaaactggaaaggagaaggattgtttacctcaggttggccaatggaatatgatgaataagaaaatgattaatggaatgactgtaagccggtgggcatgtattaatttctcaaggaatgttcaagagagtgttgtccgtgggttctgcaacgaacttggtcagatgtgtcaagtatctggcatggaattcaatccggagcctgtcattcctatatacaatgctaggcctgaccaagtggagaaagctttgaaacatgtttatcatgcttccgcaaacaaaaccaaaggaaaagaacttgagcttctgttagcaattctccctgacaacaatggaaccttatatggcgatctcaagcggatatgtgaaactgaccttggattgatatcgcaatgctgcctcacaaaacatgtcatcaagattagcaagcagtatttggctaacgtgtccctaaagatcaatgtcaagatgggtggtagaaatactgttcttttggatgccatcagctgcagaataccgttagtaagcgatataccgaccattatatttggagcagatgtaactcatccggaaaatggggaagactcgagcccctcaattgcagctgtagtagcttctcaagattggcctgaagtgacaaagtatgctggactggtttgtgctcaagcgcaccggcaagaacttatacaggacttgtacaagacctggcaagatcctgttcgtggctctgttagtggcggtatgatcagagatcttctggtttcctttagaaaagcaacaggacaaaagccgttaagaataatattttacagagatggtgtaagcgaagggcaattttatcaagttctgctttacgaactagacgcaatccgaaaggcttgtgcttctttagaaccaaactatcagccgcctgttactttcatcattgtacaaaaaagacaccatactcgattatttgcaaacaaccataaggataggagcagcactgacaagagtggaaacatattacctggcactgtggttgatacaaagatctgccatccaacggaatttgatttttatctttgtagccatgccggtattcaggggacgagtcggcctgctcattaccatgttctctgggatgagaacaacttcactgccgatggaatccaatctttgacaaacaacctctgctatacttatgcaagatgcactcggtccgtttccgttgttcctccagcgtattatgcgcacttagcagcgtttcgggcacgattttacatggaacccgaactgcaagaaaatggatcatcaggaggaagtggaaatcatggtatgaaagtaacaagatcaggagaaagcggagtgaggccattgccggccttgaaggagaatgtgaaaagagtaatgttttattgttagagcgtggaaggagaagggtagtggtagtaaagtagcaggagaaagatgggagcagttaaaaatttccattgtaaatgtaagctgatagattgcagatgt

SEQ ID NO: 1238 - DNA, 3563 bp, Fragaria vesca
gttttgtctcctgggttcctccattttcccagtttctattccttttttaattgttactgtctggaaaattcatgctcattgggctttgcttatagaagcatctgaagaaccactttgggttttggagtaggtagtattgaatctggtggagaattgagtaaagactaaaacggaagaaggatactctgttagtgtgcaatctggtgaagctggtctcttttagaacaaaggcttgtgctttgttgtagttcagttaccaaacatgcctatcaggaaaatgaaggagagctcagagcaacaccttgtgatcaaaacccatatacagaactcagcaaacccagttcagaaggcacccaaaactgcccaaaatggcaaaggcccaccaaccccagaacctcaaaaccccaaaactcagaaccaaacttcacctccaactaagaacagaggaaggagaaggggtagaggtggtcgaaagtccgatcaaggcgatgtttttatgaggcctagttcacgacactgcacagtggctcatattccagccttaccaaacctggctggaggaggtcctattgttactactacaaatggctcattggaaaatggtgggaattcatgtgccatggagatgggtttccccacttccagcaagtctttgagctttgcacctcggcctggttatggacaagctggaataaagtgtgttgtaaaggccaaccatttctttgcagagttaccagacaaggacttgaaccattatgatgttagcataactcccgaagttacttctagagttgtgaacagagctatcatggcggaactggtgagactgtacagagaatctgacctaggaatgagactgcctgcttatgatggtagaaagagtctgtacactgctggtgagctaccctttgtttggaaggagtttaacatcaagcttagtgatgaagaagagcgaattgatggccgaaaaagagaaagggaatataaagtggtgattaaatttgttgctcgagcaaacatgtatcatttgagccagtttctggccggtaaatgtgctgatgctccccaggaggctctccaaattcttgacattgttttaagagagctctcagcaaaaaggtactgtcccattggaagatcttttttttcacctaatatccgaacaccacaacggcttggtgaggggttggagtcatggtgtgggttttaccaaagtataaggcctacccaaatgggtctctccctcaatgttgatatggcttcagctgcatttattgagcctctccctgtaatagagtttgtggcccagcttctgggaaaagatgttctatctaggacattgtctgatgctgaccgtgtaaagattaagaaggctcttagaggggtgaaagttgaagttacccacagaggaagtgttcgaagaaagtatcgagtgtcaggactgacatctcaacctacaagagagctagtgtttcctgttgatgagaactcgacgatgaaatctgtaattgaatacttccaggagatgtatggctttacaattcaacatggacatcttccttgccttcaagttggcggaaatcagaagaaggcaaattatttaccaatggaggcctgtaaaattgttgaggggcaacgatatacaaaaaggttgaatgagaaacaaattactgctcttttaaaagttacatgtcaaaggcctagggatcgtgaaaatgatatcctccagaccgttcaacagaatgcttatgaccaagacccttatgctaatgagtttgggatcaaaatcagtgaaaagctcgcttcagttgaggctcgaattcttccagccccttggctgaagtatcatgaaacaggaaaagaaaagaattgtttgcctcaagtaggtcagtggaatatgatgaacaagaaaatgatcaatgggatgccagttagccggtgggcttgtattaacttctcacggagtgtgcaagagagtgttgctcgtggattttgtagtgaacttggtcagatgtgtcaagtatctggcatggaatttaatccagaacctgtaattccaatctacaatgccaggcctgagcaagtagagaaagctctaaagcatgtatatcatgcatccatgaacaaaacaaaaggaaaagaactagagctcttattggctattttgcctgacaacaatgggtccctgtatggtgatatcaagcgaatatgtgaaacagatcttggattaatctcgcaatgctgtcttacaaagcacgttttcaagattagcaaacagtatttggctaatgtgtccctgaagataaatgttaagatgggtggcagaaacactgtacttttggatgccatcagctgcaggatacctttagtcagtgatataccaaccataattttcggagcagatgtgactcacccggagaatggagaagacaccagtccctctattgctgcggtagtggcttcccaggattggccggaagtgaccaaatatgctgggttagtttgtgctcaacctcacagacaggaactgatacaagatttgtacaagacatggcaggaccctgttcgtggcacagtcagtggcggcatgattcgggatcttttggtttcctttaggaaagcgacagggcagaagcctctcaggattatattttacagggatggcgtaagtgaagggcaattttatcaagtcttactttatgagcttgatgcgattaggaaggcatgtgcttctctggaacccaactatcaaccgccagtgactttcattatagtacaaaagcggcaccacacacgattatttgccaataaccatagggacaggagcagtgtagataagagcggcaacatactgcctggcactgtggttgataccaagatatgccatcctacagaatttgatttctatctctgcagccatgctggtatacaggggacaagccggccggctcactaccatgttctctgggatgagaataattttactcctgatggaatccagtcgttgacaaacaatctttgctacacatatgcaaggtgcacccgctccgtgtctgttgtacctccggtatattatgcacatttggctgctttccgtgctcgattttatatggggccagatctgcaggaaaatggctctattggtcatgctggtaagggcacacggactgcaggagagtctggagtccggccattgccagctttaaaggagaatgtaaagagagtaatgttttattgttagaagttgaagaggttggttaggattgctgagaaagatgctgcaattcggaaatgctcgttcgtcatggtcaaaattccttcttgttagacaaaccatgtatgcatggctcaaggtcttccagtttaaagtatagcaggagggaagaaaaggaaaagctatattcccagtttaggtcagtgatgatagtgctagagttcattgatcataggtaacaacaggtccttagtctgcagtgtagatcacccattatgggatgtttgtcagttctatgctctctgtaaagtaaaggttaattaatgaatcaagttttatagttctgtag

SEQ ID NO: 1239 - DNA, 3764 bp, Gossypium raimondii
gttttttttttatttttattgtttctttaaacatcaatgagccatggtgtacgtccccgaggctgctgctcccatcagttcaaagcaataacacacagagaaagagaaaaaagaaaagcttaaaagcttaagctaagtgctaattaaaaaaccccaaagccattttcattaaaaatggcagcaaagaatgagtgagtgagagaagaagaaggcttacaacaataaaaggctttaacacgtgataaagaaaacaccaaaaagctcttttgcatgcgtgtataaaagattcatcaccaccatcgcctacacaccaccatcatcatctccctctctctttttttcttctttgaatcctcttcaaaaatcccatctttttgaatctccttttttgggccctgctcttttatttctctctatttttaaacccatcttttctatcatcttcctcttgttatctttgcttcaaagttcactgcttttttatttttgttttcaagttggtgactgcaaaggtaaaccaagtatgcctataaggcaaatgaaagagagctcagagcaacacctggtgataaaaagccacttgcaaaacactatgaacacagttcaaagaccacccaaaacagcacaaaatggcaaaggtccaccacaagctcatgaacctcacaacaacacaaaacaaccccataaccaagccacatcacctccatcaaagaatagaggaagaagaagaggaaggggtggtaaaaaatctgatcaactagatgtttgtatgagaccaagttcaaggccttgcactgtagcacataaaccagtgaaccaagcttcttgtggaatggaaatggcgttccccacttcaagcaagtctttgaattttgcacctagacctggttatggtcaagttgggacaaaatgtattgtgaaggctaaccatttctttgctcagttaccagacaaggacttgaaccagtatgatgttacaataactcccgaagtagcatccagaacggttaaccgagctattattgcagaacttgtgagactgtacaaagaatccgatttgggtacgagattgccggcttatgacggcagaaagagtttgtacacggccggtgagcttccgtttgcgtggaaggagttcgtcgttaagcttgtagacgaggaagatggcatcaatggccccaaaagagaaagagaatataaagtggtaataaagtttgttgcacgagcaaacatgcatcatttaggccagtttttagccggtaagcgagctgatgctccacaagaagcgctccaaatactagacattgtattacgagagttatcgtcaaagaggtactgtcctattgggagatcattcttttcacctgatattagagcaccacaaaggcttggcgacggtttggagtcatggtgtggtttttaccaaagtattaggcctactcagatggggttgtctctgaacatcgatatggcttcagctgcattcatcgagcctctccctgtaatagagtttgttgctcagcttctaggcaaggatgtactgtctaggccattgtcggattccgatcgtgtgaagattaagaaggcgctcagaggagtcaaagtagaggtgacacatagagggaatgtacgaagaaaataccgtgtttcaggattgacttctcagcctactagagaactagtgtttccggttgacgataactctacaatgaagtctgttgttgaatacttccaagaaatgtatagcttcacaattcagcatacgcatctaccttgccttcaagttggaaaccagaagaaggcaaattatttacctatggaggcatgcaaaatcgtggagggacagagatatacgaaaagattgaatgagaggcaaattactgctctcttgaaagtcacatgccaaagaccgagggatcgagaaaatgacattctgcagacggttcaacataatgcttatgatcaagatccttatgcaaaggagtttggaatcaaaattagtgaaaaactcgcttcggtcgaggctcgtatccttcctgccccttggctgaaatatcatgaaactggaaaagaaaaggattgtttgcctcaagtggggcaatggaacatgatgaacaagaaaatgattaacggaatgactgtgagccgatgggcatgtattaacttctcacgaagcgtgcaagagagtgttgctcgagggttttgcaatgaacttgctcaaatgtgccaagtttctggcatggagttcaatcccgagcctgttataccgatctacagtgctaagctctcatctatattgcctgacaacaacggctcgctttatggtgatctcaagcgaatttgtgaaactgatctaggattaatatcacaatgctgtctgacaaagcatgtctttaagatcagtaaacaatacttggctaatgtggcccttaagatcaatgttaagatgggtggcagaaacactgttcttttggatgctatcagctgccgaataccgttagttagcgatataccgaccataatattcggagcagatgtgactcacccggaaaatggagaagactcgagcccctcaatagcagcagtagtagcttcacaagattggccggaagtgacgaaatacgctggattagtttgtgctcaagctcatagacaagaactcatacaggacttgtacaaaacttggcatgatcctgtacgtggcactgtcagtggtggcatgatcagggatcttctgatatcttttaggaaggccacggggcaaaagccgctgaggataatattttacagggatggtgtgagcgaaggacagttttatcaagttttactgtacgagttagatgcaatccggaaggcctgtgcttctcttgaaccgaactatcaaccactggtgactttcattgtagtgcaaaaaagacatcacactcgtttgtttgctaataatcacagggaccgaagcagcacggacaagagtggaaatattttgcctggcactgtcgttgattcgaaaatctgtcatccatcggaatttgacttctatctttgcagccatgccggtattcagggaacaagtcggcctgcacactaccatgttctttgggacgaaaacaattttactgcagatggaatacagtctctaacaaacaacctttgttacacgtatgcaaggtgcacgcgctcggtctctgttgttcctcctgcctattatgcacatttagctgcattccgagcacggttctacctagaaccagagatgcaagacaataatagctcaacaggcgctggttcaggtcaagcaaaaggtggtggtacaaaggcagcaggagaatccggggtgcggccgttgccggccttgaaagagaatgtgaagagagtgatgttctactgctagaaccgtagcaaaagcgaggcggagatgcagcaaccatgaacgacctttcggttcacaatgttgcttgtacagttgctaatgatacttgcatggttgcatgcaaggtcttcgaattaaggtcgtcagcgcagcctttaatgtaaaaatggtcggtgggacagtgaccaaaatgatctttgatggataaaaatgtttaaagtaggtatatgtaaagcaatgcttatttagaatcaaatcttaacgtaggaaattttggctgagaaacttgctataatctcctaccctccgtttcaatatatgacgaagatctttgaattagatagaatgttaaaaggtgttgaaatttttttaatccttttattctggttcatga

SEQ ID NO: 1240 - DNA, 3686 bp, Malus domestica
ttaaaactttcaaacccccagttttttatttattttttgttttcaatccaaagatcactgctttatttgtttctcgagtgactctgtgagttaattgcttgctactgctcctgctgctgctgctcagtgagtttaaatggctggttggctgttgtggaattagtgtttaaatcttttggaaattgagtgaaaaaaactagaagggaagtaaagcattgtgtttctgtgcaatctggcgaaagcttcatcgttttgaacgagtgcttctgcaaacatgcctataagaaagaaagagagctcggagcaacaccttgtgatcaaaccccacttgcagaacccagtgaacccagttcagaaggcaccgaaaactgcccaaaatggcaaaggtccaccaccccaggaatcccaaaaagccaaaaccccataaccaaacttcacccccaacaaaaaacagaggaagaagaaggggcagaggtggtcggaagtctgatcaaggcgatgtttgtatgaggcctagttcgcggcactgcgcggtggctcatctgcctacctcaccaagcttgggtggtgctgcttctgtagcgaatgctccaaatgggtatggcggcaacttagtttccatggatatggggtttccgacttcaagcaagtcattgagctttgctcctcggcctggttatggacaagttgggatcaagtgtgttgtgaaggccaaccatttctttgcagagttaccagagaaggacttgaaccattatgatgttagaataactcccgaagttgcatcgacagctgtgaacagagctatcatggcagaactggtgaggttgtacaaggaatctgacttaggaatgagactgcctgcttatgatggtaggaagagtctgtacactgctggtgagctgccctttgcttggaaggagttcaatattaagcttgttgaggaacaggatggaatcgttggccgaacaagagaaagagtatataatgtggtgattaaatttgttgcacgagcaaacatgcatcatctgggtcagtttctggccggtaagtgtgctgatgctccacaagaagccctccaaattcttgacattgtattacgagagctctcgaacaagaggtattgccccatcgggagatcattcttttcacctgatatcagaacaccacaacggcttggtgaagggttggaatcatggtgcggcttttatcaaagtataagacctacccaaatgggtctttccctcaatattgatatggcttcagctgcatttattgagcctctccctgtaatagagtttgtagcgcagcttctaggcaaagatgtattgtctaggacattgtctgatgctgaccgtgtaaagattaaaaaggctcttagaggtgtgaaagttgaagttacacacagagggagtgttcgtagaaagtatcgagtttcaggattgacatctcaacctacaagagaactagtgtttcctgttgatgaaaacttgaccatgaagtccgtaattgaatacttccaggagatgtatgggttcaccattcaacacgggcatcttccttgccttcaagttggtaaccagaagaaggcaaactatttacccatggaggcctgcaaaattgttgaggggcaacggtatacaaaaaggttgaatgagaagcaaattactgctctcttaaaggttacatgtcaaagacctagggatcgtgaaaatgacatcctacagactgttcaacacaatgcttatgaccaagatccttacgcgaaggagtttggaatcaaaatcagtgaaaaactagcttcggtcgaagctcgaattcttcctgcgccttggctgaagtatcatgaaactggaaaagaaaagaattgtttgcctcaagttggtcagtggaatatgatgaacaagaagatgattaatggaatgaccgtcagccggtgggcttgtattaatttttcacggggtgtgcaagagagtgttgcacgtgggttttgcagtgaacttgctcaaatgtgtcaagtatctggcatggaatttaatccagaacctgtaattccaatccacaatgctaggcctgagcaagtagagaaagctttgaagcatgtttatcatgcatccatgaacaagaccaaaggaaaagatttagagctcttgttagccattttgcctgacaacaacgggtccctgtatggtgatatcaagcgaatatgtgaaacagatctcggtttaatatcacaatgctgtctcacaaagtatgttttcaagatcagcaaacagtacttggctaatgtctccctaaagataaatgttaagatgggtggcagaaacactgttcttttggatgctatcagctgcaggatacctttggtcagtgatattccaaccataatcttcggagctgatgtgactcaccctgaaaatggagaagattccagtccctcaattgctgctgtcgtagcttcccaggactggcccgaagtgaccaagtatgctggattagtttgtgctcaagctcacagacaagaactcatacaagatttgtataaaacatggcaagaccctgttcgtggcacggtcagtggcggcatgatccgggatcttctggtttcctttaggaaagcaacaggacagaagccactaaggattatattttacagggatggcgtaagtgaaggtcaattttatcaagtcttactatacgagctcgatgcaatccggaaggcatgcgcttctctggaaccaaactatcaaccaccagtgactttcattgtagttcaaaaacggcatcacacacgaatatttgctaataaccatagggacaggagcagcgtagacaagagtgggaacatattacctggcaccgtggttgatactaagatttgtcatccaaccgaacatgatttttatctctgcagtcatgctggtattcaggggacaagtcgcccagctcactaccatgttctctgggatgagaataactttactgctgatggaatccagtcattgacaaacaacctttgttacacatatgcaaggtgcacgcgctctgtctctgttgtacctccggcatattatgcacatttggctgctttccgtgctcgattctatctggagccagatatgcaagagaatggttctactggtcacactgctaagggtacacgcgctactggagagtctggagtccgaccattaccagccttgaaggagaatgtaaagagagtaatgttttattgttagaagtggaagagggtccatggtttggtcactgaaacgagattagccagaaaagacgctgcaaccaaaagatgattgttcgcggttaattttccttcctcgcatacaaaccgttcatccatggttcgaggtcttccggttcaactagcggcgggaggaaagaatagaaagggtatttctcagtttagatcagtcctttatcatagatagcactctagaaggtccttgttctctgcagtgtagacccacttagagggagtttatcagctgtaggctttgtaaagaaatgttagttattgaatctaattcacatctaggaaatttttgagtcaggcttcaaaaatgctttctcaaaactaccagtggcagttttcttggcaagtaatctctcagcatgaatgggaagaattgcaagatattactacctgcaattgcttctgcaagtcacca

SEQ ID NO: 1241 - DNA, 3445 bp, Solanum phureja
agtctttgctcccattagtacttaagtctgtaatattcttggaatcaagcaaaacttggtctttcatggtttcattcatttggtgattgatttttctagacaccctttaaagatttcattttacaataatcttcaaatcttgaggccatttggagtgttgagaactatattggactgtgccatctagtgaaggacataattacttctgaacagttttcttgtgcttatcaagaaaagcagaaaaagataaaatagcatcatcatgcctataaggcagatgaaagaaagttcagaacaacacattgtgatcaaaccccatttgcaaaacaccatgaatccagttcagaaaacccccaagactcctcaaaatggcaaagggccaccaaatcaagaaccccaaaacaacaaaatccataaccagacttcacccccttcaagaaatagaggtagaagaaggggaagaggaggcagaaagtcagatcaaggtgagacctttatgaggcctagttcaaggccttgtacagcagcaagcaagccagttatagcagcttctgttgaagcaacaaatgtgtcaggagttgagaataatggaagtagctcagggtttccttcttcaagcaagtctttgtgttttgccccaagaccaggttatgggcaacttgggacgaaatgcattgtaaaagcaaaccattttttggctgatttaccagacaaagagttgaaccagtatgatgttactgtaatccctgaagtgtcatcaagaactgtaaacagagctatcatggcagagctggtgaaactgtacaaagaatcccacctagggatgagattaccagcttatgatggcaggaagagtctttacactgctggtgaacttccttttaagtggaaggagtttaccattaagcttattgatgaagatgatgtgatcaatggtccaaagagagagagagaatataaagtggttattaagtttgttgcaagagcgaatctacatcatctgagtgaatttctagctggtaagcgtgctgatggtccaaaagaagctcttcaaattctggacattgttttgagagagctttcgatcaagaggtattgtcctgttggaagatctttcttttcgcctgatatccgcaaacctcagcctcttggtgatggtttagaagcatggtgtggattctaccagagcattagaccgacccaaatgggcttgtcgcttaacattgatatggcttcagctgcatttattgaagctctaccagtgatggaatttgtagcccagcttcttggaaaagatgtgtcgtcaagacccttatctgactcggatcgtgtaaagattaagaaggctcttagaggagtgaaagttgaagtgacacacaggggcaatgtccggagaaagtatagagtttcaggactaacaactcagcccacgagagaactagtatttcctgttgatgacaatttaaccatgaagtcggtagtagaatactttcaagaaatgtatggctttacaataaagaatacacatcttccatgccttcaagtaggaaaccaaaagaaagccaactatttacctatggaggcgtgtaaaattgttgagggacaacgatacaccaaaaggttgagtgagaagcaaattacttctcttttgaaggtcacatgccaaagaccaagagatcgtgagaactcgattttgcagactgttcaacataatgattataatgaagacccatatgcaaaggagtttggaatcaaaatcagtgaaaaacaagcatcggtggaagcccgcgtgctgcctgctccttggctaaaatatcatgagacagggaaggagaaggattgtttacctcaagttgggcagtggaatatgatgaacaagaaaatgataaacgggatgaccgtcaaccgttgggcatgcatcaacttttcacgaagtgtccaagagagtgttgctcgtggcttttgtaacgaactggctcagatgtgtcaagtatctggaatggagttcaatccggaaccaattattccaatatacatggccaggccagatcaagtagagaaagccttgaagcatgtatatcattcatgcgtaaacaagctaaaaggaaaagaacttgagcttctattggtcattctaccagataacaatgggtccctctatggtgacataaagcggatatgtgagactgatcttggtttaataacccaatgctgtctgacaaagcatgtattcaagatcagcaaacaatatttggcaaatgtatccttgaagatcaatgtcaagatgggtggtcgaaacactgtcctgttggatgctattagctgtagaataccattagtaagtgatatacctaccatcatatttggagcagatgtgacccaccctgaaaatggagaagactctagcccttcaattgcagctgtagtagcttctcaagattggcctgaggtgacgaaatacgctggtcttgtttgcgctcaagctcatagacaagaacttatacaagatttgtataagacatggcatgatcctgcacgtggaacagttagtggtggcatgataagggatctccttatatccttcagaaaggccacaggccaaaagccacaaaggataatcttttatcggcaaggatggagtgagtgaagggcaattttaccaagtactgcttttcgagttagatgcaattaggaaggcttgtgcatctctagagccaaattaccaaccgccagtaacttttattgtggtacagaaacggcatcacacccgactatttgctaataatcacaaggacaggagcagcattgataggagtggaaacatattgcctggtactgtggttgatacaaaaatctgtcatccaacagaattcgacttctatctttgtagccacgctggcattcagggtacaagccggcctgcacattaccatgttctgtgggatgaaaacaatttcacagcagacggaatccagtccttgactaacaatctctgctatacatatgcaaggtgcacgcgttctgtctctgtggttcctccagcatattatgcacatttagctgcatttcgagccagattctatatggaaccagacatgccggaaaataattcaggcagccctcatcaaggcagcagcaaggctatacgagagacgggtgttaggccgttgcccgcacttaaagaaaatgtgaagagagtgatgttttattgttagtaagaagaataaacaagggagagtagcaaatgtaacaaatagtaggggttcagatcacatgcatctttgtttgtatatgtatgtatgttgatcatcctaggttaattttcatgttagttttaatgatgtaaagcggctttgttttcaattaatggtaattagtttagcaatgtagccagattaatccaatgtttaatcaaatccaagtagaaataactcttcctaatcct

SEQ ID NO: 1242 - DNA, 3290 bp, Eutrema halophilum
aaatttgttttctttcttcctcatgattttgcaggtagaataaagccaagaagggttcagttttgtttcattctttttgtagtgaaatcggaagaaaaaaaaatgccgattaggcaaatgaaagaaacctcagagactcacttagtaatcaaaccaaatcttcaacctttaaagcaacataatcccaaaaccgtgcaaaccggtaaaatccctcctccgcttcctcctccggcggcttcttcaccttcgccgccgtcgaagaatcgtggccggaggagaaaccgcggtggtagaaaatccgatcaaggagatgtctgtatgagacctagctctcgtcctcgtaaaccgccggttcaaacaacctccaccgccgtctccggcggggagatcgtcgccgccgtgaatcatcagatgcagatgggtgttagcaaaaactcgaactttgcgccgagacctggatttggacagcttggaactaaatgtatcgttaaagctaaccatttcctcgccgacttaccaaccaaagatttgaatcaatatgatgttacaataactcctgaagtgtcatcaaaaagtgtaaatagagctataattgctgagttagttagactatacaaagagtctgatctcgggacaagacttccggcttacgatggccggaaaagcctttacaccgccggagagcttccattcaagtggaaagagttcactgttaagatcgttgatgaagacgacggtatcatcaatggccctaaaagggagagatcatataaggtagctatcaagtttgttgctcgggctaatatgcatcacttaggcgagtttctagctggtaaacgagcagatggaccgcaagaggccttgcagattcttgacattgtgctcagggaactgtcggtgaagaggttttgtcccgttggaagatctttcttctcgcctgatattcgaactccgcagcgactcggtgaaggtttagagtcatggtgtgggttttaccagagtataagacctacacaaatgggtttatcactaaatattgatatggcttcagctgcgtttatcgagcctcttccggtaatagagtttgtagcacagcttcttggaaaagatgtcttgtcgaagccattgtctgattctgatcgtgttaagattaagaagggtctcaggggagtgaaagtagaggttactcacagagcaaacgtaagaaggaaataccgtgttgcgggtttaacaactcaaccaacaagagagcttatgtttccagttgatgagaactctacgatgaagtctgttattgagtatttccaagagatgtatggattcacaatccagcacacgcatttgccgtgtcttcaagttggaaaccaaaagaaggcaagctatttgccaatggaggcatgcaaaattgttgaaggacaacggtacactaaaaggttgaacgagaagcagattactgctttattgaaagttacatgccaaagaccaagagacagagaaaatgatattttgcggaccgttcaacacaatgcgtatgatcaagatccatatgctaaggagtttggtgtcaagataagcgagaagttagcttctgttgaggctcggattcttccagctccatggcttaagtatcacgagaacgggaaagaaaaggattgtcttccgcaagttggtcagtggaatatgatgaacaagaaaatgatcaacgggatgacggttagcagatgggcctgtgttaacttctcacgcagcgtccaagaaaacgttgctcgtggattttgcaatgaacttggtcagatgtgtgaagtctctggcatggagtttaatccggaacctgtgataccaatatatagcgcaaggcctgatcaagtagagaaagctctaaagcatgtttatcacactgctatgaacaaaaccaaaggcaaagaactagagcttctcttggcgattttacctgataacaacggttcactttacggggatcttaagagaatctgcgaaaccgagcttggtttgatatctcaatgttgtctcacaaaacatgtgttcaagattagcaaacagtatcttgcaaatgtatcccttaaaatcaatgtcaagatgggaggaaggaacacagttctattagacgccataagctgtagaatcccactggttagcgatataccgacgatcatatttggagcagacgtgactcatccagagaacggagaagaatcaagcccttcaatcgcagctgttgttgcttctcaagactggcctgaagtcacaaaatatgctggtttggtttgtgctcaagctcacaggcaagaactcatacaagatttgtataaaacatggcaagatcctgtacgcggcactgtcagtggcggtatgatcagggatcttctgatttcattcaggaaagcaacagggcagaaaccacttcgaatcatcttttaccgtgatggagtaagtgaagggcaattctatcaagttttactctacgagttggatgcaattcgtaaggcttgtgcgtcgcttgaaccgaattatcagccaccagtgacattcatcgttgtacagaagcgtcatcacactcgtttgtttgctaataatcaccgagacaaaagcagtactgatcgtagcggaaacatcttaccaggtactgtagttgacaccaaaatatgtcatccaactgaatttgacttctacctttgtagccacgcgggtattcagggaacaagcaggcctgctcattaccatgttctttgggacgagaacaatttcaccgcagatggtattcaatctctgactaataatctctgttatacctatgcgcgatgcaccagatcggtctctgtagttcctccggcgtattatgctcatcttgcagcatttcgagcacgtttctacatggaaccggagataatgcaagacaacggttcaccgggaaaaaagagcgcaaaaacaacgaccttaggagattctggtggtggtcgcggcggtgtgaagccgttaccggctttgaaggaaaatgtgaagagagtaatgttctactgctaaaaaaaatcctacaagaaaagtttgaataagtagttttcgttgttttgtttgtaattcggctttagatatgcattgtcttgtaaatttgttggtttggtgtttaggaatttagggttattttctagcgttgtgttttagctttggtagatgcaatggctttggtagatgcctccggttctacggtggtttctccatcgttgcaatggtgtaagcttttatcttttagccttaagaaaaataacttagca

SEQ ID NO: 1243 - DNA, 3089 bp, Malus domestica
aacatgcctataagaaagaaggagagctcggagcaacaccttgtgatcaaaccccacttgcagaacccagtgaacccagttcaaaaggcaccgaaaactgcccaaaatggcaaaggtccaccaccccaggaaccccaaaaccccaaactccataaccaaacatcacctccagcaaaaaacagaggaagaagaaggggcagaggcggtcggaagtccgatcaaggtgatgtttgtatgcggccgagctcgcggcactgcgctgtggctcatctacctgcctcaccaagcttgggtggtgctgctcctctagctactagtccaaatggttatgtggaaaatggtggcaactcggtttccatggagatggggtttccgacttcgagcaagtcgttgagttttgctcctcggcctggttatggacaagttgggatcaagtgtattgtgaaggccaaccatttctttgcagagttaccagagaaggacttgaaccattatgatgttagcataactcctgaagttgcatcgagagctttgaacagagctatcatggcagaactggtgaggttgtacaaggaatctgacttaggaatgagactgcctgcttatgatggtagaaagagtttgtacactgctggtgagctgccctttgcttggaaggagttcaatattaagcttgttgatgaaccggatggaatcagttggccgaaatttctggctggtaagtgtgctgatgctccacaggaagcgctccaaattcttgacattgtattaagagagctctcaaacaagaggtactgccccattgggagatccttcttttcacccaatatcagaacaccacaacggcttggtgaggggttggaatcatggtgcgggttttaccaaagtataagacctacccaaatggggctttccctcaacattgatatggcttcagctgcgtttattgagcctctccctgtaatagagtttgtagcccagcttctaggcaaagatgtattgtctagaacattgtctgatgctgaccgtgtaaagattaaaaaggctcttagaggtgtgaaagttgaagttacacacagagggagtgttcgaagaaagtatcgagtttcaggattgacatctcaacctacaagagaactagtgtttcctgttgatgagaacttgaccatgaagtccgtaattgaatacttccaagagatgtatggattcaccattcaacacgggcatcttccttgccttcaagcctgcaaaattgttgaggggcaacggtatacaaagaggttgaatgagaagcaaattactgctctcttaaaggttacatgtcaaagacctagggatcgtgaaaatgacatcctgcagcagactgttcaacacaacgcatatgaccaagatccttatgcgaaggagtttggaatcaaaatcagtgaaaaactagcttcagtcgaagctcgaattcttcctgctccttggctgaagtatcatgaaactggaaaagaaaagaattgtttgcctcaagttggtcagtggaatatgatgaacaagaaaatgattaatggaatgactgtcagtcggtgggcttgtattaatttttcaaggggagtgcaagagagtgtcgcacgtggattttgcagtgaacttgctcaaatgtgtcaagtatctggcatggaatttaattcagaacctgtaattccaatctacaatgcgaggcctgaacaagtagagaaagctttgaagcatgtttatcatgcgtccatgaacaagaccaaaggaaaagatttagagctcctattggccattttgcctgacaacaacgggtccctgtatggtgatatcaagcgaatatgtgaaacagatctcggtttaatatcacaatgctgtctcacaaagtatgttttcaagatcagcaaacagtacttggctaatgtctccctaaagataaatgttaagatgggtggcagaaacactgttctcttggatgctatcagctgcaggatacctttggtcagtgatataccaaccataatctttggagcagatgtgactcaccctgagaatggagaagattccagcccctcaattgctgctgtggtagcttcccaggactggcccgaagtgaccaaatatgctggattagtttgtgctcaagctcacagacaggaactcatacaggatttgtataaaacatggcaagaccctgttcgtggcacagtcagtggtggcatgatccgggatcttctagtttcgtttaggaaggcaacaggacagaagcccctaaggattatattttacagggatggtgtaagtgaaggtcaattttaccaagtcttactttacgagcttgatgcaatccggaaggcatgcgcttctctggaacccaactatcaaccaccagtgactttcattgtggttcaaaaacggcaccacacacgattatttgctaataaccatagggacaggagcagcatagacaagagtgggaacatattacctggtactgtggttgatactaagatttgccatccaaccgaacatgatttctatctctgcagtcatgctggtattcaggggacaagtcgcccagctcactaccatgttatttgggatgagaataattttactgctgatggaatccaatcattgacaaataacctgtgttacacatatgcaaggtgcacgcgctctgtctctgttgtacctccggcatactatgcgcatttggctgctttccgtgctcgattctatctggagccagatatgcaagagaatggctctactggtcacactgctaagggtacacgcgctgctggcgagtctggagtgcgaccattaccagccttgaaggagaatgtaaagagagtaatgttttattgttagaagtggaagagggtcgatggtttggtcactgaaacgagattagccagaaaagacgctgcaatcacaagatgattgttcactgttaattttccttcctcacatacaaaccttttatgcgggttcaaggtcttccggtttaactagcggcggagggaagaacagaaggtgtttctgagtttagatcagtatttatagtgttgaaagagttgttcctt

SEQ ID NO: 1244 - DNA, 3315 bp, Nicotiana benthamiana
tgcaataatcttgaattcttgagtgtgaagaactctattggactgtgccatctagtgaaggacaattacttttgagcagttttcttgtgctcatcacattacctgtgacatgcccataaggcagatgaaagaaggttcagaacaacacatggtgatcaaatctcagttgcaaaacaccatgaatccacttcagaaaaaccccaagactgctcaaaatgggaaagggccaccaatcacagaaccccaaaccaacaaaatccataacacaacatcatcacccccatcaaggaacagaggaagaagaaggggaagaggagggagaaagtcagatcaaggtgaggcctttatgaggccaagttcaaggccttgcacagcagcaagcaagccagttatagtagcagcagaaaatgtgataaatgtatcagtcagcagtagctcatgtcaattagtggctgctggttcaggatttccttcttcaagcaagtctttgtgttttaccccaagaccaggttatggccaactggggacaaaatgcattgtaaaagcaaaccattttttggctgaattaccagacaaggacttaaaccagtatgatgttactgtaacccctgaagtgtcatcaagaagtgtaaacagagcaatcttagcagaactggtgaaactgtacaaagaatcagacctagggatgagattaccagcttatgatggcaggaaatctctctacactgctggtgaacttccttttaagtggaaggagttcaccattaagcttattgatgaagatgatgtgatcaatggtccaaagagagaaagagaatataaagtggtgattaagtttgtcgcaagagcgaatttacatcatttgagccaatttctagctggtaagtgcgccgatggtccacaagaagctcttcaaattctggacattgttttgagagagctttcaatcaagaggtattgtcctgttggaagatctttcttttcccctgatatccggaaacctcagcctcttggagatggtttagaagcatggtgtggattctaccagagcatcagacctacccaaatgggcctgtcccttaatattgatatggcttcagctgcatttattgaagcactaccagtgatagagtttgtagcccagcttcttggaaaagatgtgtcgtcaagacctttatctgactctgatcgtgtaaagattaagaaggctcttagaggagtgaaagtagaagtgacacataggggcaatgtccggagaaagtatcgagtttcaggactaacatcccagcccacaagagaactagtttttcctgttgatgataattcaacgatgaagtcagtagtggaatacttccaagaaatgtatggctttactatcaagtatactcatcttccatgccttcaagtagggaaccaaaagaaagccaactatttacctatggaggcatgtaaaattgttgagggacaacgatacactaaaaggttgagtgaaaagcaaattactgctctgttgaaggtcacgtgccaaagaccaagagatcgtgagaactcgattttgcagactgttcaacacaacgattatagtgaagacccatatgcaaaggagtttgggatcaaaatcagtgaaaagcaagcatcagtggaagctcgcgtgctgcctgctccatggctaaaatatcatgagactgggaaagagaaagattgcctgcctcaagttgggcagtggaatatgatgaataagaaaatgatcaatggaatgaccgttagccgttgggcttgcatcaatttttcacgaagtgtccaagagagtgttgctcgtggcttttgtaacgaactggctcagatgtgtcaagtgtctggaatggagttcaatccggaaccagtaattccaatatacatggccaggccagatcaagtagagaaagccttgaagcatgtttatcatgcctatgtaaacaagctaaaaggaaaagaacttgagcttctattggtcattcttccagataacaacggacccctgtatggtgacataaagcggatatgtgagactgatcttggtttaatatcccaatgctgtctgacaaagcatgtgttcaagatcagcaaacaatatttggcaaatgtctccttgaagatcaatgtcaagatgggtggtcgaaatactgtcctgttggatgctattagctgtagaataccattagtaagtgatattcccaccatcatatttggagcagatgtgacccacccagaaaatggagaagactctagcccttcaattgctgcagtagtagcttctcaggattggcctgaggtgacaaaatatgctggccttgtttgcgctcaagctcatagacaggaactcatacaagatttgtacaagacatggcatgatcctgcacgtggaacagttagcggtggcatgataagggatctccttatatccttcagaaaggctactggccaaaagccacaaagaattatcttttatcggcaatatcttgtgtacagggatggagtgagcgaagggcaattttatcaagtacttctttttgagttagatgcaattaggaaggcttgtgcatctttagagccaaattaccaaccaccagtaacttttatcgtggtacagaaacggcatcacactcgtctattcgctaacaatcacaaggataggagtagcacggataggagtggaaacatattgcctggtactgtggttgataccaaaatctgtcatccaacagagtttgacttttatctttgtagccatgccggcattcagggtacaagtcgaccggctcattaccatgttctgtgggatgagaacaatttcacagcagatggaatccaatccttgactaacaatctctgctatacatatgcaaggtgcacacgttctgtctctgtggttcctccagcatattatgcacatttagctgcatttcgagctagattctacatggaaccagagatggcagaaaatggtggcagtcctcataaaggcggcaagggtataagagaaggtggagagagtggtgttcggccattgcctgcgctaaaagaaaacgtgaagagagtaatgttttattgttaggaagagaaacatggagggagtagcaaataggtaatgggagtagtaggtgttaacagaccacatgcagctatctttctttgtatatgtgtgttgatcgtcatcctaggttaattttcatgtcagttttaatgatgtacagcagctctattttcatttaatggtattaagctaatggcagcagtaacagaataatccaatgtccttatcaatccaaagttacg

SEQ ID NO: 1245 - DNA, 3391 bp, Petroselinum crispum
cttcactctccctctaactcatcatcttgggaatttcagccataaatttgttgagtgtaatgagtaaatgcaagaaagttcaagattttgaatgctgaatctgggaaggatctttgctttacattgctttatgttacttgtatctatcagttgttaagaaatatatagttattatcatccagcatcatgcctattaggcagcttaaagaaggttcagagcagcaccttgtgatcaaacctcacttgaataactcagtgaatcaagttcagaagcaacttaaaacagctcgaaatggcaaaagcccacctgggcaagaaaaccagaatgcaaaagcccataaccaatcttcacctccctcaaaaagtagaggaaggagaagaggaagaggtggtcggaaatcggatcaaggtgacgcttgtatgcgtcccagcacgcgaccgtgcacagctgagtattccccggtggctcaggtttcagcccggtctggtgccgctgttgaagtgcataatagtaatttaggcacattgtgtgaagtagggaggaattttccttcttcaagcaagtctttgagttttgctcaaagacctgggtatgggcagcttgggacaaaatgtgttgttaaggcaaaccatttctttgcagagttaccagagaaggacttgaatcactatgatgttagtattacccctgaggtgtcatcaaggaatatgaacagagctataatggcagaactggtgaagctgtataaagaatctgacttggggatgaggttgcctgcttatgatggcagaaagagtctgtacactgctggtgagcttccatttgcatggaaggagttcgatatcaaacttacagatgaagatgatggagttaatggtcccaaaagggtgcgggagtacaaagtggtgattaaatttgttgcaagggcaaatttgcatcatctgggccaatttttggctggcaagcgtgcagatgctccacaagaagctcttcaaatactcgacatcgtactaagagaactatcaaataagaggtattgccccgtgggaagatccttcttttctcctaacatacggaaaccacaacggcttggtgagggcttagagtcatggtgtggattttatcaaagtataaggcctacccaaatgggcttgtccttaaatattgatatggcatcagctgcttttattgaggctctccccgtgatagagtttgtcgcacagcttcttggaaaagatgtgctaacgaaaacattatctgattctgatcgtgtgaagattaaaaaggccctaagaggcttgaaagttgaagtaacacataggggtcatatacgaagaaagtatcgggtttcaggaataacatctcaacccactagagaactagtgtttcctgttgatgacaactcgaatatgaagtcagttgttgagtactttcaagagatgtatggcttcacgattcagcatactcatcttccctgtcttcaagtcggtaaccagaggaaagcaaattatttgccattggaggcttgcaagatagtggagggtcaaagatacacaaaaagattgaatgagaagcaaattactgctcttctgaaagtaacatgccaaaggccaagagatcgagagcatgacattttgcagacggttcaacacaatgcttatgatcaagatccgtatgcaaaggaattcggcatgaatattagtgaaaagcttgcttctgttgaggctcgagttctccctgccccatggctaaaatatcatgaaaatggcaaggagaaggattgtttgccacaagttggtcagtggaatatgatgaacaagaaaatgattaacgggatgactgttagtcggtgggcatgcatcaacttctcaagaagtgtgcaagaaaatgttgctcgtggattttgtagtgaactagctcgtatgtgtcaagtatctggaatggaatttaacccggaacctgtaataccaatctatacagcttggcctgatgatgtagagaaagctttgaagcatgtttaccatgcttgtacgaacaaattaaaggggaaggacttagagcttctgctagtcattcttcctgacaataatgggtcactctatggagatctgaaacgaatctgtgaaactgatcttggtttgatttctcaatgttgtctgacaaagcatgtgtttaagattagcaagcagtacctggcaaatgtgtcactgaagattaatgttaagatgggtggtagaaataccgttcttctggatgcgattagctgcagaataccactagttagtgacataccgacaattatatttggagcagacgtgacccatcccgagaatggagaagattcaagtccttcaatagctgctgtagtagcttcccaggattggcctgaagtcactaaatatgcaggtttagtttgtgctcaagctcatagacaagagcttatacaggacttgtataaaacatggcaagatcctgcacggggtacagtgagtggtggcatgatccgggagcttttggtttccttcaggaaggcaactggccagaaaccattacgcattatattttacagggatggtgtgagtgaaggccagttttatcaagtcctactttatgagttggatgctatacggaaggcctgtgcttcattagaacccaattaccaacctccggtgactttcattgtggtgcaaaaacgacatcacacaaggttattcgcaaacaaccacagggatcgaagcagcactgacaaaagtggaaacgttttgccaggaaccatagttgatacgaagatctgccatccaacagaatttgatttttatctctgcagccatgctggtattcagggcacaagtcggccagcacattaccatgttctttgggatgaaaacaattttacagctgatggaattcagtcgttgacaaacaacctgtgctacacatatgcaaggtgcacgcgctccgtgtctgtggttcctccagcctattatgcacatttagctgcatttcgagccagattctacatggaaccagaactgcaggagaacggatgtggtgttggtcaaggtaccaagaatacacgaggtgttggagagtccggagtgcgtccattaccagccctgaaggagaatgtgaaaagagtaatgttttattgttagactaggaaggtggagcagcagaggggcagctttaggcatataatcaagatcccctttgttctcctatgatgtttgcatgtatcttgttatagttttacagttttagatgaaaggttgtaagcaatagaagatgtggtagatgtaatgttgtttgtaatatatgttgaatggtagctaaagtagattatatacatctggttcatatcagcaactcagaaagcaatttaaatagttt

SEQ ID NO: 1246 - DNA, 3473 bp, Solanum lycopersicum
atatatatatatatgtatgtttgaaagcttgataaaaatcccatcttttttctctctcttgttagtctttgctcacattattactgaagtctgtaatattcttggaatcaaccaaagacttggtctttcatggtttcattcatctgtacaataatcttcaaatcttgaggccatttggagtgttgagaactatattggactgtgccatctagtgaaagacatcattacttttgaacagttttcttcttgtgcttatctagaaaagcaaataaagataaaatagcatcatcatgcctataaggcagatgaaagaaagttcagaacaacacattgtgatcaaaccccatttgcaaaacaccatgaatccagttcagaaaaaccccaagaccactcaaaatggcaaagggccaccaaatcaagaacctccaaacaacaaaatccatatccagacttcacccccttcaagaaatagaggtagaagaagaggaagaggaggcaaaaagtcagatcaaggtgagacctttatgaggcctagttcaaggccttgtacagcagctagcaagccagttatagcagcttctgttgaagcaacaaatgtgtcaggagttgagagtaatggaactagctcagggtttccttcttcaagtaagtctttgtgttttgccccaagaccaggttatgggcaacttgggacaaaatgcattgtaaaagcaaaccattttttggctgattttccagacaaagagttgaatcagtatgatgttactgtaatccctgaagtgtcatcaagaactgtaaacagagctatcatggcagagctggtgaaactgtacaaagaatcccacctagggatgagattaccagcttatgatggcagaaagagtctttacactgctggtgaacttccttttaagtggaaggagtttaccattaagcttattgatgaagatgatgtgatcaatggtccaaagagagagagagaatataaagtggtgattaagtttgttgcaagagcaaatctacatcatctgagtgaatttcttgctggtaagcgcgctgacggtccaaaagaagctcttcaaattctggacattgttttgagagagctttcgatcaagaggtattgtccagttggaagatctttcttttcacctgatatacggaagcctcaacctcttggtgatggtttagaagcatggtgtggattctaccagagcattagaccgacccaaatgggcttgtcgcttaacattgatatggcttcagctgcatttattgaagctctaccagtgatagagtttgtagctcagcttctaggaaaagatgtgtcgtcaagacccttatctgactcggatcgtgtaaagattaagaaggctcttagaggagtgaaagttgaagtgacacacaggggcaatgtccggagaaagtatcgtgtttcaggactaacaactcagcccacgagggaactagtatttcctgttgatgacaatttaaccatgaagtcggttgttgaatactttcaagaaatgtatggctttactataaagaatacacatcttccatgccttcaagtagggaaccaaaagaaagccaactatttacctatggaggcgtgtaaaattgttgagggacaacgatacaccaaaaggttgagtgagaagcaaattacttctcttttgaaggtcacatgccaaagaccaagagatcgtgagaactcaatcttgcagactgttcaacacaatgattataatgaagacccatatgctaaggagtttggaatcaaaatcagtgaaaagcaagcatctgtggaagcccgtgtgttgcctgctccttggctaaaatatcacgagacggggaaggagaaggattgtctacctcaagttgggcagtggaatatgatgaacaagaaaatgataaatgggatgacagtcaaccgttgggcatgcatcaacttttcacgaagtgtccaagagagtgttgctcgtggcttttgtaacgaactcactcagatgtgtcaagtatctggaatggagttcaatccggacccaataattccaatatacatggccaggccagatcaagtagagaaagccttgaagcatgtatatcattcatgcgtaaacaagctaaaaggaaaagaacttgagcttctgttggtcattctaccagataacaatggttccctctatggtgacataaagcggatatgtgagactgatctcggtttaataacccaatgctgtctgacaaagcatgtattcaagatcagcaaacaatatttggcaaatgtatccttgaagatcaacgtcaagatgggtggtcgaaataccgtcctgttggatgctattagctgtagaataccattagtaagtgatatacctaccatcatattcggagcagatgtgacccaccctgaaaacggagaagattctagcccttcaattgcagctgtagtagcttctcaagattggcctgaggtgacaaaatacgccggtcttgtttgcgctcaagctcatagacaagaacttatacaagatttgtacaagacatggcatgatcctgcacgtggaacagttagtggtggcatgataagggatcttcttatatccttcagaaaggccacaggccaaaagccacaaaggataatcttttatcgggatggagtgagtgaaggtcaattttaccaagtactgcttttcgagttagatgcaattaggaaggcttgtgcgtctttagaaccaaattatcaaccgccagtaacttttatcgtggtacagaaacgacatcacacccgactatttgcaaataatcacaaggacaggagcagcattgataggagtggaaacatattgcctggtactgtggttgatacaaaaatctgtcatccaacagaattcgacttctatctttgtagccacgctggcattcagggtacgagccggcctgcacattaccatgttctgtgggatgaaaacaatttcacagcagacggaatccagtccttgactaacaatctctgctatacatatgcaagatgcacacgttctgtctctgtggttcctcctgcatattatgcacatttagctgcatttcgagccagattctacatggaaccagacatgcctgaaactaattcaggcagccctcatcaaggcagcagcaaggctatacgagagacgggtgttaggccattgcccgctcttaaagaaaatgtgaagagagtgatgttttattgttaggaagaagagataacaagtgagtagcaaatgtaacaaatagtaagtagggggttcagttcagaccacatgaatctttgtttgtaaatgtatgttgatcatcctaggttaattgtcatgttagttttaatgatgtaaagcggctttattttcaattaatggtaattagtttagcattatagccaggttaatccaatgtttcatcaaatccagctagaaataactcttcctactact

SEQ ID NO: 1247 - DNA, 3139 bp, Daucus carota
atattcatatattgtcattatgcctattaggcaacttaaagaaggctcagagcaacaccttgtgatcaagcctcaattgcaaaataccatgaatccagttcataagcagctcaaagttgctcagaatgggaaaggctcgaccgggaaagaaactcaaaatgtgaaacttcaaaatcagtcttcgcccccatccaaaagtcggggaaggagaagaggaagaggcggccggaaatctgatcaaggcgaggcctttatgcgcccgagcacacggccttgcactgctgagtatacagtgtctcctcctgtaacaactaggtctgttacagctgttgaagttgataataacaatggaggcaaattgtgtgaaatagttaaggcttttccttcctccagcaagacgctgagttttgcccaaagacctggttatggacagattgggacaagatgtgttgtcaaggcaaaccattttcttgcagaattaccagagaaagaattgaatcactatgatgttactataatgcctgaggtgtcatcgcgtaatgtgaacagagctataatggcagaactggtaaaattatataaagaatctgacttggggatgaggttgcctgcttatgatggcaggaagagtctgtacacggctggtgagcttccatttgcatggagggagttcaatattaagcttactgtggaagatgacggagtcaatggtcccaaaagagtgagggagtacaaagtggtaattaaatttgtggcgagggcaaacttgcatcatctgggacaatttttggctggcaagcatgcagatgctccgcaggaagctcttcaaatacttgatattgtattaagagaactttctaataagaggtactgccccgtaggaagatctttcttttcaccagacattaggaaaccccaacggcttggcgagggattagagtcatggtgtgggttctatcaaagtctaaggcctacccaaatgggcttgtccctgaatatagatatggcatcagctgcatttattgagcctctccccgtgatagagtttgttgcacagcttcttggcaaagatgtggtatcaagaacattgtcagattctgatcgtataaagataaaaaaggccttaagaggcgtgaaagttgaagtaacgcacaggggtagtgtacgaagaaagtatcgggtttcaggattaacatctcaacccactagagagctagtgtttcctgttgatgacgacttgaatatgaagtcagttgttgaatactttcaagagatgtatgacttcacaattcagcatactcatcttccttgtcttcaagtaggaaaccagagaaaagcaaattatttgccattggaggcttgcaagattgttgaaggtcaaagatacacaaaaaggttgaatgacaagcaaattactgctcttttgaaagtaacatgccaaagaccaagagatagagagaatgatattttgcagacggtgaaacacaatgcttatgatcaagatctgtatgctaacgagtttggcatgagaatcagtgaaaagcttgcctctgtggaggctagagttctccctgctccatggctaaagtatcatgaaaatggcaaggagaaggattgtttgccacaaattggtcagtggaatatgatgaacaagaaaatgatcaatggtatgactgttagtcgttgggcatgcattaacttctcaaggagtgtgcaagaaaatgttgctcgtggattctgtagtgaactggctcgtatgtgccaagtatctggaatggaattcaaccctgaacctgtaattccaatctatacagcctggcctgatgatgtagagaaagctttgaagcatgtttatcatgctagtgtgaacaaattaaagggaaaagacttggagcttttgttagccattcttccagacaacaatgggtcattgtacggagatctgaaaagaatatgcgaaactgatctgggtttaatttctcaatgttgtctgacaaagtatgtcttcaagattagcaagcaatacctggcaaatgtgtcattgaagattaatgttaagatgggcggtagaaatactgttcttctggatgcaattagctgcagaatacctctagttagtgacatacccacaataatatttggagcagacgtgacccacccagagaatggagaagattctagcccctccatagcagcggtagtggcttcccaggattggcctgaagtcacaaaatatgcaggtttggtttgtgctcaagctcatagacaagaacttatacaagatttgtacaaaacatggcaagatcctgcacggggtaccattagtggtggcatgatccgggatcttttggtttccttcagaaaggcaactgggcagaagccattacggattatattttacagggatggtgtaagtgaaggccagttttatcaagtcctactttacgagctggatgcaatacggaaggcatgtgcgtcattagaacccaattaccaaccccctgtgactttcattgtggtgcaaaaacgacatcacacaaggttatttgctaacaaccatagggatcgaagcagcaccgacaaaagtggaaatattttgccaggaactgtagtggataccaagatctgtcatccaacagaatttgatttctatctatgtagccatgctggtattcagggtacaagtcggccggcacattaccatgttctttgggatgaaaacaattttacagcagatggaattcaatcattgacaaataacctctgttacacatatgcgaggtgcacccgatcagtgtctgttgttcctccagcatattatgcacatttagctgcatttcgagccagattctatttagaacccgaactgcaggagaacggtcaaggtaataagaacactcgaggcatcggagagtcgggggtgcgtccattaccagccctcaaggagaacgtgaaaagagtaatgttctattgttagtactagtgatgaggtaaagcaggactagctttctgcatatatatgtttgcatgtatacagttttagatggctggcaggttacaggccaaagcagaagcagtagatgtaatgtttgtaaaataatttctagagttgtaaccattctagtatataccatttgct

SEQ ID NO: 1248 - DNA, 3352 bp, Petroselinum crispum
cttcataacacaccccttcacttcactctccctctaactcatcatcttgggaatttcagccataaatttgttgagtgtaatgagtaaatgcaagaaagttcaagattttgaatgctgaatctgggaaggatctttgctttacattgctttatgttacttgtatctatcagttgttaagaaatatatagttattatcatccagcatcatgcctattaggcagcttaaagaaggttcagagcagcaccttgtgatcaaacctcacttgaataactcagtgaatcaagttcagaagcaacttaaaacagctcgaaatggcaaaagcccacctgggcaagaaaaccagaatgcaaaagcccataaccaatcttcacctccctcaaaaagtagaggaaggagaagaggaagaggtggtcggaaatcggatcaaggtgacgcttgtatgcgtcccagcacgcgaccgtgcacagctgagtattccccggtggctcaggtttcagcccggtctggtgccgctgttgaagtgcataatagtaatttaggcacattgtgtgaagtagggaggaattttccttcttcaagcaagtctttgagttttgctcaaagacctgggtatgggcagcttgggacaaaatgtgttgttaaggcaaaccatttctttgcagagttaccagagaaggacttgaatcactatgatgttagtattacccctgaggtgtcatcaaggaatatgaacagagctataatggcagaactggtgaagctgtataaagaatctgacttggggatgaggttgcctgcttatgatggcagaaagagtctgtacactgctggtgagcttccatttgcatggaaggagtttaatattaagcttactgctgaagatgatggagccaatggtcccaaaagagtgcaggagtacaaagtggtaattaagtttgttgcgagggcaaatttgcatcatctgggacagtttttggctggaaagcatgcagacgctccgcaggaagctctccaaatacttgatattgtattaagagaagtttctaataagaggtactgccctgtgggaagatctttcttttcacctgacattaggaaaccccaacggcttggcgagggcttagagtcgtggtgcgggttctatcaaagtttaagacctacccagatgggattgtccctgaatattgatatggcatcggctgcatttattgagcctctccccgtaatagagtttgttgcccagcttcttggcaaagatgtggtatcaagaacattgtcagattctgatcgtgtaaagataaaaaaggccttgagaggcatgaaagttgaagtgacgcacaggggtaatgtacgaagaaagtatcgggtttcaggattaacatctcaacccactagagagctagtgtttccagttgatgacaactcaaatatgaagtcagtagttgaatactttcaagagatgtatgacttcacgattcagcatactcatcttccttgtcttcaagtaggaaaccagagaaaagcaaattatttgccgttggaggcttgcaagattgttgaaggtcaaagatacacaaaaaggttaaatgacaagcaaattactgctcttctaaaagtaacatgccaaagaccaagagaccgagagaatgatattctgcagacagtcaaacacaatgcctatgatcaagatctgtatgcaaaggaatttggcatgaaaatcagtgaaaagcttgcttctgtggaggctcgagttctccctgctccatggctaaaatatcatgaaaatggcaaggagaaggattgtttgccacaagtcggtcagtggaatatgatgaacaagaaaatgatcaatggtatgactgttagtcgttgggcatgcatcaacttctctaggagtgtgcaagaaaatgttgctcgtgggttctgtagtgaactggctcgtatgtgccaggtatctggaatggaatttaaccctgaacctgtaataccgatctatacagcctggcctgacgacgtagagaaagctttgaaacatgtttaccatgcaagtgtgaacaaattaaagggaaaagacctagagcttctgttagccattcttccggacaacaatggttcattgtatggagatctgaaaagaatatgcgaaactgatctgggtttaatttctcaatgttgtctgactaagtatgtcttcaagattagcaagcaatacttggcaaatgtctcactaaagattaatgttaagatgggcggtagaaatactgttcttctggatgcaattagctgcagaatacctttggttagtgacataccaacgattatatttggagcagacgtgacccacccagagaatggagaagattcaagcccctcgatagctgctgtagtggcttcccaggactggcctgaagtcacaaagtatgcaggtttggtttgtgctcaagctcatagacaagaacttatacaggacttgtacaaaacatggcaagatcctgcccggggtactgttagcggcggcatgatccgggatcttttggtttccttcaggaaggcaactgggcagaagcctttacgtattatattttacagggatggtgtgagtgaaggtcaattttatcaagtcctactttttgagttagatgcgatacggaaggcctgtgcatctttagagcccaattaccaacccccagtgactttcattgtggtgcaaaaacggcatcacacaaggttatttgctaacaaccatagaaatcgaagcagcaccgacaaaagtggaaacatcttgccaggaaccgtagttgataccaaaatctgtcatccaacagaattcgacttttatctatgcagccatgctggtattcagggtacaagtcggccagcacattaccatgttctttgggatgaaaacaattttacagcagatggaattcagtcgttgacaaacaacctctgctacacatatgcgaggtgcacaagatcagtttctgttgttcctcctgcgtattatgcgcatttagctgcatttcgagccagattctatttagaacctgaactccaggagaatggatgtggtgttggtcaaggtatgaagaatactcgaggctttggagagtcgggggtgcgtccattaccggccctcaaggagaacgtgaaaagagtaatgttctactgttagtaacctagtgttggtaatgtgggaaagcaggaagagctttcgacatgtatatgtttgcatgtatacagttttacagttttagacagctgatggtttgcaagccaaagcaggagcagtagatgtaatgtctgtaatataattactataatttctcgaacggtgacctttgtagatta

SEQ ID NO: 1249 - DNA, 2920 bp, Trigonella foenum-graecum
atgaactttgctcgtagacctggatttggacaagttgggacaaaatgtattgtgaaggctaatcacttctttgcagagtttaccagacaaggacttaaaccaatatgatgttactattacccctgaagtgtcttcaagaacagtaaacaggtcaattatagctgagcttgtgaggttgtataaagagtctgatttagggatgaggcttccagcttatgatggcagaaaaagtctgtatactgcaggacagctacccttttcctggaaggattttaagattaaacttgtagatgaagaggatgcagttaattgccccaaaagggtaaaagagtacagggtggtgatcaagtttgtggctagagcaaacttgcatcatttaggccagtttctaggtggtaagcgtgctgatgcgccgcaagaggcacttcaaattcttgatattgtactacgagagctatcaactaagaggtattgccctatcgggaggtctttcttttcacctgatataagaagaccacaacggcttggagagggattggagtcatggtgtggattttaccagagcataaggcctactcagatgggcctttcgctcaatatagatatggcatctgctgcgttcattgagcctcttccagttgtagaatttgttgggcagctattagggaaagatgtgctgtcaagaccattgtcggatgctgatcgcattaagattaagaaaggccttagaggagttaaaggttgaagtaacacacagaggaagtgtaagaagaaaataccgtgtttcagggttgacttctcaaccaacaagggaacttgtgtttcctgttgatgagaattcaactatgaaatcagtagtcgaatactttcaagagatgtatggtttcactattcaatacacacaccttccttgcctacaagtaggcaaccaaaagaaggctaactatttacctatggaggcgtgcaaaattgttgaagggcaacgttatacaaaaagattgaatgagaagcaaattacttctctattgaaagttacttgtcagagacctcgcgatcgggaaaatgacattttacagactgttcaacataatgcttatgaccaagatccttatgcaaaggaatttggaattaatatcagtgacaagctaacttctgttgaagcacgaattcttcccgccccttggcttaaatatcacgaaagtgggaaagaaaagaactgtttaccccatgttggccagtggaacatgatgaataagaaaatgattaatggaatgacagttaaccggtgggcatgcataaatttctcacggagcgtgcaagatagtgttgctcgcactttttgtaacgaccttgctcaaatgtgtcaagtatctggcatggaatttaatctggagcctgttattcctatctacaacgccaagcctgagcaggtggagaaagctttgaagcatgtctaccatgtgtcaacaaacaaaactaaaggaaacgagttggagcttttgttagcaatattaccagacagtaatggttctctctatggtgatctcaagcgtatttgtgaaaccgaccttggtataatctcacaatgctgccttacaaagcatgtcttcaaaatcactaaacagtatttggctaacgtgtctctgaagatcaatgttaagatgggagggagaaacactgttcttcttgacgctgcaagctacagaataccattagttagcgacataccaaccataatttttggagcagatgttacacaccctgaaaatggagaagactctagcccctcaatagcagctgttgtagcctcccaagattggcctgaagtgacaaagtatgctggtttagtgtgtgctcaagctcataggcaggaacttatacaagatttatacaaaacatggcatgatcctgttcgcggcacagttagtggtggcatgataagagatttgctgattcctttagaaaggccacaggacaaaagccgctacgaattatattttacagggatggtgtaagtgaaggacaattttaccaagtattgctttatgagttggacgcaatccggaaggcatgcgcttccttagaaccaaattatcagcctccagtaactttcatagttgtacaaaaacgacatcatactcggttattcccaaacaaccatagggacaggagcagtactgataagagtgggaatatattgcctgggactgttgttgatactaaaatttgccatccgacagaatttgacttttatctttgcagtcatgctggcatccagggtactagtcggccagctcattatcatgttctatgggatgaaaacaatttcacagcagatggaattcaatctttaacaaacaatctttgttatacatatgctaggtgcactcgatccgtatccattgttcctccggcatactatgcacatttagcagcctttcgagcccgtttctatatggaaccagtgatgcaagagaatggatcgacaggtgatggtaactctagtcatagctccaagggaacaacaagagcagctggagaatgtggtgttaagccattaccagcgttgaaagataacgtgaagagagtgatgttttactgttaaattgctttagatgtatgttgttaaagttggcattgtaaagagtattctgtgtcaatgtagaaaattttgctcaaaagcctttacagatgttgaggggaagtttttctagttagtctaacaaaaacattaaatcaacaatcatgcttatcctgcattatagctgaaggaaaatgagtcaagtcaatgtaacatttcattgtcacttctctatgtaagtaaacaaccaaaaatattactagaaacttaaatctcaattcttgttggtccaacacgtgtttggcattctgtgtaagaaactcataacatgtaaattgt

SEQ ID NO: 1250 - DNA, 3564 bp, Petroselinum crispum
atcctcaattcatcttcatatcatacacacacatatctttgtatctaatctgaatctcccaaaagaaaccatcttttttatcctcgacttactaacccttctccatcttcatcattaccacccaactcaatcttgtattttcaagaatcatcttcatttcaagctctaaactttcttttccccattttggtactttcagtacgcaactgccataaatctgttggagtgtaatgagtaaaaactagatagttcaagattttgaatgctcaatctggtgaaagatcttttctactacactgctttggatcacctgtaaattttagtggagaggatttctatacataattatgcctattaggcaactcaaagaaggctcagagcaacactttgtgatcaaaccccatttgcagaactccatgaattcagttcctaagcaactcaaaagttctcagaatggtaaagtcttggtggggcaagaatctcaaaatgtgaaaactcaaaatcagtcttcacccccatcaaaaagtcgaggaaggagaagaggaagaggcggccggaaatctgatcaaggtgatgccttaatgcgtccgagcacacggccttgcactgctgagtatacagtgactcatcctgtcacagctcggtgcagtacagctgttgaagttgacaataacaatggaggcaaattgtgtgaaatagtaaaggcttttccttcttccagcaagtcgttgagttttgctcagagacctggttatggacagattgggacaaaatgtgttgtcaaggcaaaccattttcttgcggagttgccggagaaggaattaaatcactatgatgttgctataatgcctgaggtgtcatcacgaaatgttaacagagccataatggcggaactggtaaaactatataaagaatctgacttggggatgaggttgcctgcttatgatggcaggaagagtctgtacactgctggtgagcttccatttgcatggaaggagttcgatatcaaacttacagatgaagatgatggagttaatggtcccaaaagggtgcgggagtacaaagtggtgattaaatttgttgcaagggcaaatttgcatcatctgggccaatttttggctggcaagcgtgcagatgctccacaagaagctcttcaaatactcgacatcgtactaagagaactatcaaataagaggtattgccccgtgggaagatccttcttttctcctaacatacggaaaccacaacggcttggtgagggcttagagtcatggtgtggattttatcaaagtataaggcctacccaaatgggcttgtccttaaatattgatatggcatcagctgcttttattgaggctctccccgtgatagagtttgtcgcacagcttcttggaaaagatgtgctaacgaaaacattatctgattctgatcgtgtgaagattaaaaaggccctaagaggcttgaaagttgaagtaacacataggggtcatatacgaagaaagtatcgggtttcaggaataacatctcaacccactagagaactagtgtttcctgttgatgacaactcgaatatgaagtcagttgttgagtactttcaagagatgtatggcttcacgattcagcatactcatcttccctgtcttcaagtcggtaaccagaggaaagcaaattatttgccattggaggcttgcaagatagtggagggtcaaagatacacaaaaagattgaatgagaagcaaattactgctcttctgaaagtaacatgccaaaggccaagagatcgagagcatgacattttgcagacggttcaacacaatgcttatgatcaagatccgtatgcaaaggaattcggcatgaatattagtgaaaagcttgcttctgttgaggctcgagttctccctgccccatggctaaaatatcatgaaaatggcaaggagaaggattgtttgccacaagttggtcagtggaatatgatgaacaagaaaatgattaacgggatgactgttagtcggtgggcatgcatcaacttctcaagaagtgtgcaagaaaatgttgctcgtggattttgtagtgaactagctcgtatgtgtcaagtatctggaatggaatttaacccggaacctgtaataccaatctatacagcttggcctgatgatgtagagaaagctttgaagcatgtttaccatgcttgtacgaacaaattaaaggggaaggacttagagcttctgctagtcattcttcctgacaataatgggtcactctatggagatctgaaacgaatctgtgaaactgatcttggtttgatttctcaatgttgtctgacaaagcatgtgtttaagattagcaagcagtacctggcaaatgtgtcactgaagattaatgttaagatgggtggtagaaataccgttcttctggatgcgattagctgcagaataccactagttagtgacataccgacaattatatttggagcagacgtgacccatcccgagaatggagaagattcaagtccttcaatagctgctgtagtagcttcccaggattggcctgaagtcactaaatatgcaggtttagtttgtgctcaagctcatagacaagagcttatacaggacttgtataaaacatggcaagatcctgcacggggtacagtgagtggtggcatgatccgggagcttttggtttccttcaggaaggcaactggccagaaaccattacgcattatattttacagggatggtgtgagtgaaggccagttttatcaagtcctactttatgagttggatgctatacggaaggcctgtgcttcattagaacccaattaccaacctccggtgactttcattgtggtgcaaaaacgacatcacacaaggttattcgcaaacaaccacagggatcgaagcagcactgacaaaagtggaaacgttttgccaggaaccatagttgatacgaagatctgccatccaacagaatttgatttttatctctgcagccatgctggtattcagggcacaagtcggccagcacattaccatgttctttgggatgaaaacaattttacagctgatggaattcagtcgttgacaaacaacctgtgctacacatatgcaaggtgcacgcgctccgtgtctgtggttcctccagcctattatgcacatttagctgcatttcgagccagattctacatggaaccagaactgcaggagaacggatgtggtgttggtcaaggtaccaagaatacacgaggtgttggagagtccggagtgcgtccattaccagccctgaaggagaatgtgaaaagagtaatgttttattgttagactagtaaggtggagcagcagaggggcagctttaggcatataatcaagatcccctttgttctcctatgatgtttgcatgtatcttgttatagttttacagttttagatgaaaggttgtaagcaatagaagatgtggtagatgtaatgttgtttgtaatatatgttgaatggtagctaaagtagattatatacatctggttcatatcagcaactcagaaagcaatttaaatagtttctgttaagcaac

SEQ ID NO: 1251 - DNA, 3436 bp, Arabidopsis lyrata
catcatcatcttcttcatcatcatacactctctcttccttatgagattttttctccacattgagaggaaagctatcttctttagcgtcactcttcttcttcattggtcggtagaataaggccaagaagggatcagttttagttttgtttcattctttttgtagtgaagaaaaagagttttcaatatccaaaacaaaaatgccgattaggcaaatgaaagatagctctgagactcatttagtcatcaaaacccaacctttaaagaaccataatcctaaaaccgtccaaaacggcaaaatccctccttctccggtgactactccggcgacggtgactcagagtcaagcttcttcaccttcaccaccgtcaaagaatcgtagccggaggagaaatcgtggtgggagaaaatctgatcaaggagatgtttgtatgagacctagctctcgtcctcgtaaaccaccaccgccgtgtcaaaccacttccgccgtcgtctcagcctccaccgccggtgagattgttgccgtgagtcatcagatgcagatgggtgttcgtaaaaactcaaactttgcgccaagacctggatttggaacacttggaactaaatgcatcgttaaagctaatcatttcctcgctgatttgcctaccaaggatttgaatcaatatgatgttacaataactcctgaagtgtcatcaaagagtgtaaacagagctataattgctgagttagttagactttacaaagagtctgatctcgggaagagacttccggcttacgatggccggaaaagtctttacactgccggagaacttccttttacttggaaggagttcactgttaagattgttgatgaagatgacggtatcatcaatggacctaaaagggagagatcatataaggtggctattaagtttgttgcacgggcaaatatgcatcacttaggcgagtttctagctggtaaacgggcagattgtccgcaagaggcggtgcagattcttgacattgtactcagggaattgtcggttaagaggttttgtccggttggaagatctttcttttcgcctgatattagaacaccgcagcgactcggtgaagggttagagtcatggtgtgggttttaccagagtattagaccaactcaaatgggtttatcactaaatatcgatatggcttcagctgcgttcatcgagcctcttccggtaatagagtttgtagcacagcttcttggaaaggatgtcttgtcgaagccattgtctgattctgatcgggttaagattaagaagggtctcagaggagtgaaagtagaggttactcacagagcgaatgtaaggaggaaataccgtgttgcgggtttaacaactcaacctacaagagagctaatgtttccagttgatgagaactgtacgatgaagtcggttattgagtacttccaagagatgtatggattcacgatccagcacacgcatttgccgtgtctccaagttggaaaccaaaagaaagcaagctatttgccaatggaggcctgcaaaattgttgagggacaacgatacacgaaaaggttgaatgagaagcagattactgctctcttgaaagttacatgtcaaaggccaagggacagagaaaacgatattttgcggacggtccaacacaacgcatatgatcaagatccatatgcgaaggagtttggcatgaacataagcgaaaagttagcttctgttgaagctcggattcttccagctccatggcttaagtatcacgagaacgggaaagaaaaagattgtctcccgcaagtcggtcagtggaatatgatgaacaagaaaatgatcaatgggatgacggtgagcagatgggcctgtgttaacttctcacgcagcgttcaagaaaacgttgctcgtgcattttgtaatgaacttggtcagatgtgtgaagtctcgggcatggagttcaatccagaacccgtgatcccaatatataatgcgaggcccgatcaagtcgagaaagctctaaagcatgtttatcacactgcaatgaacaaaaccaaaggcagagagttagagcttctgttggcaattttacctgataacaacggttcactttatggtgatcttaagagaatctgcgaaaccgagcttggtttgatatctcaatgttgtctcacaaaacatgtgttcaagattagcaaacagtatctggcaaatgtatcccttaaaatcaatgtcaagatgggaggaaggaacacagttcttttagacgccataagctgtagaattccactggttagcgatataccgacaattatatttggcgcagacgtgactcacccagagaacggggaagagtcaagcccttcaatcgctgctgttgttgcttctcaagactggcctgaagtcacaaaatatgcgggtttagtttgtgctcaagctcacaggcaagaacttatacaagatttgtataaaacatggcaagatcctgtacgcggtactgttagtggcggtatgatcagggaccttctgatctcatttaggaaagcaacagggcagaaaccgcttcgaattatcttttaccgtgatggagtaagcgaagggcaattctatcaagttttactctatgagttggatgcaattcgaaaggcttgtgcgtcgcttgaaccgaattatcagccaccggtgacattcattgttgtacagaagcgtcaccacactcgtttgtttgctaataatcaccgagacaaaagcagtactgaccgaagcggaaatatcttacctggtactgtagttgacaccaaaatatgtcatccaactgaattcgacttctacctttgtagccatgcgggtattcagggaacaagcaggcctgcacattaccatgttctttgggacgagaacaatttcacagctgatggtattcaatctttgactaataatctctgttatacctatgcacgatgcactcgatcagtctcgatagttcctccagcgtattatgcgcatcttgcagcatttcgagcacgtttctacatggaaccggagataatgcaagacaacggatcacccggaaaaaagaacacgaaaactacaactgtgggagactcaggtgtgaagcctttaccggctttgaaggagaatgttaagagagtaatgttctactgctaaaagaagaaaaatttaataagtagttttcatcgtttcgttgttcgtagttcggcttttagatttgccaatgttttttcttgttctgtaaattttgttggtttggtattaggaattagggtatcattagggtttttctaaagttgtactttagcttatgataacgttgatgcaaatggctttgttaaaacctcctcttctacagtgtctctttgaaccttaagactggcttagtgtaaaagagaattctcttagagtttcatggcaaaattgcaaatgaaaaaattagc

SEQ ID NO: 1252 - DNA, 3138 bp, Gossypium hirsutum
acctccaacgaagaacaaaggaagaagaagaggaagaggtggtagaaaatctgatcaaggcgatgtttgtatgagaccgagttcgaggcactgcacggtagcacagaagccagtgaatcctggttctgctgatattttggctgctacttcaaatgggtctattcagaatgatcataacttgcctggaatggaaatgggatttcctacttcaagcaagtctttgatttttgcatctaggcctggttttggtcaagttggaaccaagtgtatcgtaaaggctaaccatttctttgctgagttaccagacaaggacttaaaccagtatgatgttactataactcctgaagtgacatcccgaacgatgaacagagctataatggcagagcttgtgaaattgtacaaaggatcagtgctaggaatgagattacctgcttatgatggccgaaagagtctgtacacagctggtgaatttccattttcttggaaggagtttagtgtcaagcttgtagatgaagacgatggcatcaatggccccaagagagaaagagaatataaagtggtagttaagtttgttgcacgagcaaacatgcatcatttaggccaatttctagctggtaagcgcgctgatgctccacaagaagcactgcagatacttgacattgtgttacgagagttatcaacaaagaggtattgtcctattgggagatccttcttttcacctgatattagagcaccgcaaaggcttggtgacggtttggagtcatggtgcggtttttaccagagtattaggccgacacagatgggcttgtctctgaatattgatatggcttcggctgccttcattgagccactccctgttatagagtttgttgctcagctagtaggcaaggatttattgtcaaggccattgtctgattctgatcgtgtgaagattaaaaaggcactcagaggagtgaaagtcgaggtaacccatagagggaatgtacgtagaaaataccgtgtttcaggattgacttctcagcctactagagagttagtgtttcctgttgatgataattcaaccatgaagtctattgttgaatacttccaagagatgtatggctttacaattcagcatacacatctaccttgtcttcaagtaggaaaccaaagaaaggcaaactatttacctatggaggcttgcaaaattgttgagggacagcgatacacaaaaagattgaatgaaaggcaaattactgctctcttgaaagtcacatgccaaagaccaagggatcgggagcatgacattttgcagacggttcaacataatgcttacaaccaagatccttacgcaaaggagtttggggtcaaaatcagtgaaaagcttgcttcagtcgaggcacgaatccttcctgccccttggctgaaatatcatgaaactggaaaagaaaaggattgtctgcctcaagttgggcagtggaatatgatgaacaagaaaatgatcaatgggatgactgttagccgatgggcatgtattaacttctcacgaagtgtgcaagagagtgttgctcgtgggttttgcattgaacttgctcaaatgtgccaagtttctggcatggagttcaatccagagcctgttattccaatctatagtgccaggcctgagctagtggaaaaagccttgaagcatgtttataatgcatccatgaataaaaccaagggaaaagaattagagcttctattagctatattacctgacaacaatggatcactttatggtgatctgaagcgaatttgtgaaactgatctaggcttgatatcacaatgctgtctcacaaaacatgtcttcaagatcagtaaacagtacttggctaatgttgccctgaagatcaatgttaagacgggtggcagaaacactgttcttttggatgctatcagctgcagaataccactagttagtgatataccaacgataatatttggtgcagatgtgacgcaccccgaaaatggagaagactccagcccctcaatagcagctgtagtagcttcacaagactggcctgaagtgacaaaatatgctggactagtatgtgctcaagctcatagacaggaacttatacaggacttgtacaaaacatggcaggaccctgtacgtggcacagttagtggtggcatgatcagggatcttctggtatcctttaggaaggcaacagggcagaagcccctgaggattatattttacagggatggtgtcagtgaagggcaattttatcaagttctgctttatgaactagatgcaatccggaaggcgtgtgcttctctagaaccgaactatcaaccaccggtgactttcattgttgtacaaaaacgacaccacactcgcctctttgctaacagtcacagggaccgaagcagcacagataagagtggaaacattttaccaggaactgttgttgattcgaaaatctgtcatccaacggaatttgatttttacctttgcagtcatgctggtattcagggaacaagccggccagcgcactaccatgttctttgggatgaaaacaattttacagcagacggaatacagtctctaacaaacaacctttgttacacatatgcaaggtgtacgcgctcagtctcagttgttcctcctgcatattatgcacatttagctgcattccgtgcacggttctacatggaaccagagatgcaagagaatgggtcgaacagctgcagtaatggtcaagcgaaaggtacaagggcagtgggagaatcgggggtgcggccattgccagccttgaaggagaatgtgaagagagtgatgttctactgttagaatggatgagtggagtgggagatttgcaaccatgaatagaataacttttttcagcttattaaaatttccttgtacagtttaaatgaatcattgcaaagtcttccaaagtttagtttgagataaaaatgtgaaacgtgggaggaatgatccacagatgccagaatgttaaaactaggttattatctttatgtaaagaaatgctaatttagaatccttaatcatcttattctcaatttaatcttgtctgaatgttaatactatgctattacaaacaacagtctgatttataatggaatgtatttggatttaagcagaaaaaagaa

SEQ ID NO: 1253 - DNA, 3023 bp, Castanea mollissima
agctcttgtagcaagtactgcaaatggtactgttgaaaatggtggcaacttgtgtgaacaagagatgggttttcccacatcaagcaagtctttgagttttgctcctaggcctggatatggtcaagttggggcaaggtgtattgtaaaggccaaccatttctttgcagagttaccagacaaggacttaaaccagtatgatgttaccataactcctgaagtgtcatcaagaactgtaaacagagccatcatggcagaactggtgaggttatacaaagaatctgacttaggaacgagactacctgcttatgatggcagaaagagtctgtacacagctggggagcttccttttgcttggaaggagttcaaaattaagctagtagatcaagaagatggaatcaatggccctaaaagggagagagaatataaagtggtgattaagtttgttgcaagggcaaacatgcatcatttgggccagtttctagctggcaaacgtgccgacgcgccacaggaagctcttcaaattcttgacattgtattaagagaactttcatcaaaaaggtacttacccgttgggagatccttttttcacccaatataagaacgccacaacggcttggtgatggcttggagtcatggtgtggattttatcagagtataaggcctacccagatgggcctgtccttaaacattgacatggcttcagctgcatttattgagcctctcccagttatagagtttgttgcccagcttttaagcaaagatgttttattaaggccattgtctgattctgaccgtgtaaagattaagaaggcccttagaggagtgaaagttgaagtaacacacagaggaaatgtacgaagaaagtatcgcgtttcagggttgacatctcaacctacgagagaactagtgtttcctgttgatgacaattcaaacatgaaatcggttgttgaatacttccaagagatgtatggcttcaccattcaacatacacaccttccttgtcttcaagtaggaaaccaaaagaaggctaactatttacctatggaggcctgcaaaattgttgaggggcaacgatatacaaaaaggctgaatgagaggcaaattactgctctactaaaagttacttgccaaagacctagagataaggaaaatgatattttgcagacagttcaacagaatgcctacaatcaagatccttatgcaaaggagtttgggatcaaaatcagtgaaaagctagcttctgttgaggcacgaattcttcctgctccttggctgaagtatcatgaaaccggaaaagaaaaggactgtttgccacaagttggtcagtggaacatgatgaacaagaaaatgatcaatgggatgactgtaagtcgatgggcatgtataaatttctcacgcagtgtacaagaaagtgttgctcgtgggttttgtaatgaacttgcccaaatgtgtcaagtatctggcatggaatataatccagagcctgtcattccaatctacaatgccaggcctgagcaagtggagaaggccttgaagcatgtttttcattcagccatgaacaagacaaaaggaaaagaattagagctcttgttagctattttgccagacaacaatgggtcactgtatggtgatctcaagcgaatctgtgaaactgatcttggactgatgtcacaatgttgtctcacgaagcatgttttcaagatcagcaagcagtacttggctaacgtatctctgaagatcaatgttaagatgggcggtagaaacactgttcttctggatgctatcagctgcagaatcccattagttagtgacataccaaccattatatttggagctgatgtgactcacccagagaatggagaggactccagtccctcaatagccgctgtagtagcttcccaggactggcctgaagtaacaaaatatgctggattagtttgcgctcaagctcacagacaggaactcatacaggacctgtacaaaacatggcaagatccagttcgtggcttggttagtggtggcatgatccgggatctcctagtttcttttaggaaggcaacggggcagaagccactgagaattatattttacagggatggtgtaagtgaaggacagttttatcaagttctgctttatgagttagatgcaatccggaaggcttgtgcttcactagaaccaaattatcagccaccagtgactttcattgtggtacaaaaacgacatcacactcgattatttgctaacaaccatagggacaagagcagcacggacaagagtgggaacattttgcccggcactgtggttgattctaaaatctgtcatccaacagaatttgatttttatctctgcagccacgctggaattcaggggacaagccggccagctcactaccatgttctttgggatgagaacaattttacaccagatggaatccagtcattgacgaataatctctgttatacatacgcaagatgtacgcgttccgtctctgttgttcctccagcgtattatgcacatttagctgccttccgtgctcgattctacatggagccagagatgcaggagaatggctcgacaggtggtggtgctggtcatggtgccaagggaacacgagcagctggagagtctggtgtccggccattgccagccttaaaggagaatgtgaaaagagtaatgttttactgttagattgtagagagggttagtggcggagcaatagccgggagatatggcaatcgtgaattgctattttcttttcgggtatttcttctttgtacatgtatgacgtgatccaggcgtagttacaagttcttcccaattcagataagtgagattatagtgctagagcaatagagctttagtttatggttcatacttggtagagagctagctagagaagaacatgggaagtacacccttcatagattacaggtctttatctctgcattgtccacccgtaatgggaagaatgtcaaactaggccatgtagaaaatatttatcaatctatatgtagcaaaatttt

SEQ ID NO: 1254 - DNA, 3751 bp, Brassica rapa
tctgtttggggtcatccatattttgctccgggatctcattttccggtttcgaatagagacaaaagcttaaagcttcctccggttttgtcttctgggtactcccaatcttctctttaaagcttcaatcttttgtcttaatggaacagcaataaaaaaaaaatcttctgggtttttgtttcttggtctcttcactggtttcttgtctctctcttgagagaagaactataggccctgtgtctgtgtatgtgcaggttacattttttttacttcttctttcaaactttgtaataatagcatcaaacaacaactgaaacatgtaaactgtgactaaaaagttatatattttttttaatttacttattactgtttatttttttttcaaagttttgattgtaatttttaacctataaaacaccatcatggtttctggatattttctgtatttaatgcaatctgacaaatgggtttttcgatttaaatttgttttctttcttactcatgattttgcaggttggataaagacaagaagagatcagttttttgtttcattcattccttttgtagtggaaaccggaagagagaagaaagaatgccgattaggccaatgaaagaaacctcagagactcatttactcatcaaacccaagcatctccccaaagccgtgcaaaacgctaaagcccctcctactccgacccaagcttcttcaccttctcctccgtccaagaaccgtagccggaggagaaaccgcggtggtcgaaaatcagaccaaggagatgtctgtatgaggcctagctcccgtcctcgcaaaccgccgcctcagaacgctgctcccgtcgccgccgtctccggcaccgagatagtcgccgtgaaccatcagatgcaaatgggtgttcgtgggtcgagtaaaaactcaaactttgcgccgagacctgggttcggacagcttggaactaaatgcatcgtcaaagctaaccatttcctcgctgacttaccgaccaaagatctgagtcactacgatgttacaataactcctgaagtgtcatcaaaaagtgtgaacagagccatcattgctgagttagtgagactatacaaagagtctgaactcgggtcgagacttcctgcttacgacggccggaaaagtctttacaccgccggagagcttcctttcacttggaaagagttcgctgttaagatcttcgatgaagacgatggtatcatcaatggccctagaagggagagatcgtataaggtggctatcaagtttgtggcacgggccaatatgcatcatttaggcgagttcctagctggtaaacgcgcggatggaccgcaagaggcgttgcagattctcgacattgtactcagggagctgtctgttaagaggttctgtcctgtcggaagatcgttcttctcgcctgatattagaacaccgcagcgacttggtgaagggttacagtcatggtgtgggttttaccagagtattcgacctacacaaatgggtttatctcttaacatcgacatggcttcagctgcgtttatcgagcctcttcctgtgatagagtttgtagcacagcttctcgggaaagatgtcttgtcaaagccattatctgactctgatcgtattaagatcaaaaagggtctcaggggagtgaaagtagaggtcactcatagagcaaacgtgagaaggaaataccgtgttgcgggtttaacgactcaaccgacaagggagctcatgtttccagttgatgagaacgctacgatgaagtcggttattgagtattttcaagagatgtatgggttcacgatccagcacacgcatttgccgtgtcttcaagtgggaaaccagaagaaggcgagctatttgccaatggaggcatgcaaaatcgtggagggacaacggtacacaaaaaggttgaacgagaagcagattactgctcttttgaaagttacatgccagaggccaagggacagagaaaacgacattttaaagacggtgcaacacaacgcgtatgatcaagatccatatgctaaggagtttggtatgaatataagtgaaaagctagcttctgttgaagctaggatccttccagctccatggcttaagtatcatgagaatgggaaagaaaaggattgccttccgcaagtgggtcaatggaatatgatgaataagaagatgatcaatgggatgacggtgagtagatgggcctgtgttaacttctcacgcagtgttcaagaaaatgttgctcgtgggttttgtaatgaacttggtcagatgtgtgaagtctctggcatggagtttaatccggagcctgtgataccaatatacagcgcgaggcctgatcaagttgagaaagctctaaagcatgtttatcacactgctatgaacaaaaccaaaggcaaagagttagagcttctcttggccattttacctgataacaacggttcactctacggggatcttaagagaatctgtgaaaccgagcttggtttgatatctcagtgttgtctcacaaaacatgtgttcaagattagcaaacagtatctggctaatgtatcccttaaaatcaatgttaagatgggaggaaggaacacagttctgttagatgctataagctgtaggattccactggttagcgacatacctacaattatatttggcgcagacgtgactcatccagagaacggggaagagtcaagcccttcaatcgctgctgttgttgcttcacaagactggcctgaagtgacaaagtatgctggtttggtttgtgcacaagctcacaggcaagaacttatacaagatttgtataaaacatggcaggatcctgtacgtggcactgttagtggcggcatgatcagggaccttctgatctcattcaggaaagcaacagggcagaaaccgcttcgaatcatcttttaccgtgatggagtaagtgaaggacagttctaccaagttttactctacgagttggatgcaattcgtaaggcatgtgcgtcgcttgaaccgaattatcagccacctgtgacattcatcgtggtacagaagaggcaccacacccgtttgtttgctaataatcaccgagacaaaagcagtactgaccgaagcggaaacatcttacctggtacggtagttgacactaagatatgtcatcctactgaattcgacttctacctttgtagccacgctggtatacagggaacaagcaggcctgctcattaccatgttctttgggatgagaacaatttcacagcggatggtattcaatctctgactaataatctctgttatacctatgcccgatgcactcgatcggtctctgtagttcctccggcgtattatgcacatcttgcagcattccgagcacgtttctacatggaaccggagatcatgcaagataacggatcgccgggtaaaaagaatacgaagacaacaactgtaggagatcatggtgttgttggtggcggtgtgaagccgttacctgctttgaaggagaatgtgaagagagtcatgttttactgctaaatgaaagacaagtagtttcgtttgttatgttcctatcctagttctgctttaggtctgctgctaatgtttgtaaataagttggttcggcttagggttccttatttctagagttgtgtgttttagctcaggtttcgatgataacgtttaatgcattatgttttttcttaaggtctctggttctactaaacagcagttgcaaaagctttatcctttttaagaagactggtttttaaa

SEQ ID NO: 1255 - DNA, 3443 bp, Petroselinum crispum
ctgaatctcccaaaagaaaccatctttttatcctccacttactagcccttctccaccttcatcattacaagcccaactcaatcctgtatttccaagaatcgtcttcatttcaacctctaaactttcttttctccattttggtactttcagtacgcaactgccataaatctgttggagtgtaatgagtaaaaactagatagttcaagattttgaatgctcaatctggtgaaagatcttttctactacactgctttggatcacctgtaaattttagtggagaggatttctatacataattatgcctattaggcaactcaaagaaggctcagagcaacactttgtgatcaaaccccatttgcagaactccatgaattcagttcctaagcaactcaaaagttctcagaatggtaaagtcttggtggggcaagaatctcaaaatgtgaaaactcaaaatcagtcttcacccccatcaaaaagtcgaggaaggagaagaggaagaggcggccggaaatctgatcaaggtgatgccttaatgcgtccgagcacacggccttgcactgctgagtatacagtgactcatcctgtcacagctcggtgcagtacagctgttgaagttgacaataacaatggaggcaaattgtgtgaaatagtaaaggcttttccttcttccagcaagtcgttgagttttgctcagagacctggttatggacagattgggacaaaatgtgttgtcaaggcaaaccattttcttgcggagttgccggagaaggaattaaatcactatgatgttgctataatgcctgaggtgtcatcacgaaatgttaacagagccataatggcggaactggtaaaactatataaagaatctgacttggggatgaggttgcctgcttatgatggcaggaagagtctgtacactgctggtgagcttccatttgcatggaaggagtttaatattaagcttactgctgaagatgatggagccaatggtcccaaaagagtgcgggagtacaaagtggtaattaaatctgttgcgagggcaaattcgcatcatctgggacagtttttggctggaaagcatgcagacgcccgcaagaagctctccaaatacttgatattgtattaagagaagtttctaataagaggtactgccctgtgggaagatctttcttttcacctgacattaggaaaccccaacggcttggcgagggcttagagtcgtggtgcgggttctatcaaagtttaagacctacccagatgggattgtccctgaatattgatatggcatcggctgcatttattgagcctctccccgtaatagagtttgttgcccagcttcttggcaaagatgtggtatcaagaacattgtcagattctgatcgtgtaaagataaaaaaggccttgagaggcatgaaagttgaagtgacgcacaggggtaatgtacgaagaaagtatcgggtttcaggattaacatctcaacccactagagagctagtgtttccagttgatgacaactcaaatatgaagtcagtagttgaatactttcaagagatgtatgacttcacgattcagcatactcatcttccttgtcttcaagtaggaaaccagagaaaagcaaattatttgccgttggaggcttgcaagattgttgaaggtcaaagatacacaaaaaggttaaatgacaagcaaattactgctcttctaaaagtaacatgccaaagaccaagagaccgagagaatgatattctgcagacagtcaaacacaatgcctatgatcaagatctgtatgcaaaggaatttggcatgaaaatcagtgaaaagcttgcttctgtggaggctcgagttctccctgctccatggcttaaatatcatgaaaatggcaaggagaaggattgtttgccacaagtcggtcagtggaatatgatgaacaagaaaatgatcaatggtatgactgttagtcgttgggcatgcatcaacttctctaggagtgtgcaagaaaatgttgctcgtgggttctgtagtgaactggctcgtatgtgccaggtatctggaatggaatttaaccctgaacctgtaataccgatctatacagcctggcctgacgacgtagagaaagctttgaaacatgtttaccatgcaagtgtgaacaaattaaagggaaaagacctagagcttctgttagccattcttccggacaacaatggttcattgtatggagatctgaaaagaatatgcgaaactgatctgggtttaatttctcaatgttgtctgactaagtatgtcttcaagattagcaagcaatacttggcaaatgtctcgctaaagattaatgttaagatgggcggtagaaatactgttcttctggatgcaattagctgcagaatacctttggttagtgacataccaacgattatatttggagcagacgtgacccacccagagaatggagaagattcaagcccctcgatagctgctgtagtggcttcccaggactggcctgaagtcacaaagtatgcaggtttggtttgtgctcaagctcatagacaagaacttatacaggacttgtacaaaacatggcaagatcctgcccggggtactgttagcggcggcatgatccgggatcttttggtttccttcaggaaggcaactgggcagaagcctttacgtattatattttacagggatggtgtgagtgaaggtcaattttatcaagtcctactttttgagttagatgcgatacggaaggcctgtgcatctttagagcccaattaccaacccccagtgactttcattgtggtgcaaaaacggcatcacacaaggttatttgctaacaaccatagaaatcgaagcagcaccgacaaaagtggaaacatcttgccaggaaccgtagttgataccaaaatctgtcatccaacagaattcgacttttatctatgcagccatgctggtattcagggtacaagtcggccagcacattaccatgttctttgggatgaaaacaattttacagcagatggaattcagtcgttgacaaacaacctctgctacacatatgcgaggtgcacaagatcagtttctgttgttcctcctgcgtattatgcgcatttagctgcatttcgagccagattctatttagaacctgaactccaggagaatggatgtggtgttggtcaaggtatgaagaatactcgaggctttggagagtcgggggtgcgtccattaccggccctcaaggagaacgtgaaaagagtaatgttctactgttagtaacctagtgttagtaatgtgggaaagcaggaagagctttcgacatgtatatgtttgcatgtatacagttttacagttttagacagctgatggtttgcaagccaaagcaggagcagtagatgtaatgtctgtaatataattactataatttctcgaacggtgacctttgtagatta

SEQ ID NO: 1256 - DNA, 3179 bp, Aquilegia formosa
tcaactaacatgcctataaggcagatgaaagagaattcagagcaacattttgtgattaaaccccaagtacaaaactccatgactcaagttcaaaagaaccaaaaaaatttacaaaatggaaaaggtcctccaacccaaaatgaatcccaaaatgctaaaatcaatcaacacaattcacctccatcaaagaatagaggtagaagaagaggtaggggaggacggaaatctgatcaaagcgacattcctatgcgcccaagttcgagaccttgtactatagttgagaagtcaatgtctgaatttcctgccatagggaaaccggttgagaatggaagtgtgtctgtagagaatggaggtaatgtgtgtgcaatggatatgggatttccttcttcaagcaaatctttgaggtttgctcctaggcctggttttggtcaagcaggaacaaaatgtatagtaaaagccaaccacttctttgcacaattaccagagaaagatttaaaccaatatgatgttactataactcctgaagttgtttcaagatctttgaacagaagtataatggcagagctggtgaaactatacaaggaatctgacttgggaatgagattacctgcctatgatggccgaaagtgcctatacacagctggggaacttcccttcacttccagggagtttaatatcaaaattgttggtgaagatgatggaatgaatgaaagagaatacaaagtagtgatcaagtttgttgctcgagccaacctgcaccatttaggccagtttctatctggtaaatgtgcagatgccccacaggaagcccttcagattcttgacattgttctgagggagctctcaactaaaaagtattgtgctgtaggaagatccttcttttcccctgatataaggaaaccacagcggcttggggaggggttggagtcatggtgtggattttaccagagtataagacctactcagatgggattgtcactaaatattgatatgtcttcggcagtatttattgagccgctccctgtgattgaatatattgctcaactccttggcaaggacgtgttttcgaggatattatctgattctgatcgtgtgaagataaaaaaggctcttcgaggggtcaaagttgaagttacacatagaggaaatgtccgacggaagtatagagtttcaggcttgacttcacagcctacaagagaacttgtgtttccggttgatgacgactcaaacatgaaatcagttgtagagtattttcaagaaatgtatggttttacgatccaacatacacatcttccatgccttcaagttggaaaccagaagaaagcaaactatttgccgatggaggcttgcaaaattgttgaaggacaacgatatacaaaaaggttgaatgaaaagcaaataacttcccttttgaaagttacatgtcaaaggcccaaggatcgcgaaaatgacattcttcagacagttcgtaaaaatgcttatgatgaagacccttatgcagaggagtttgggatcaaaataagtgagaagctagcttgtgttgaggcgcggattcttccagctccttggctgaaatatcatgatacaggaaaggaaaaagattgtttgcctcaagttggtcaatggaatatgatgaacaagaaaatgatcaatggaagcactgtgagccggtgggcatgtataaacttttcccgcagtgtccaagagagtgtggctcgaggattttgcaatgagttggctcaaatgtgtcaaatctctggcatggaatataatccagagcctgtaattccaatctactcagccaggcctgaacatgtagagaaggctttgaagcatgtttgcaatgcagcttcaaataagctcaaagggaaggagttggagctactcttagttatcttacctgacagtaatggttctctatatggtgatctcaagcggatatgtgaaacagatctgggtttaataacacaatgttgtcttactaagcatgtcttcaagatcaacaaacagtacttagctaatgtggccttgaaaataaatgttaagatgggaggaaggaacactgttcttttggatgctatcagctgcaggataccattggttagtgacataccaacaataatatttggagcagatgtcacccacccggagaatggagaagattcaagcccttcaattgcggctgtagttgcttctcaggactggcctgaggtcacaaaatatgctggtttagtttgtgcccaagctcacagacaggaactcatacaagacttgttcaagacctggcacgatcctgtgcgcggcactgttagtggtgggatgataagggatcttttgatttcatttcgaaaggcaacgggtcaaaaaccgcaaaggattatattctacagggatggtgtaagtgaagggcaattttatcaagtcctactctatgagttagatgcaattaggaaggcttgtgcttctttagaaccaaattaccaaccaccagtgacttttgtcatagtacagaaaagacatcatactagattgtttgctaataaccacaaggaccgcagcagtattgacaagagcgggaatattttacctggaactgtggttgactcaaaaatatgtcatccgactgagtttgatttttatctctgcagccatgctgggatacagggcacaagcagacctgctcattaccatgttttatgggacgaaaaccactttacagctgacggaattcaatccctgacaaacaatttgtgttacacgtatgcaaggtgtacgcgctctgtctcagttgttccacccgcctattatgcacacttagcagcatttcgagctagattttacatggagccagacttacaagaaaacaactcaacgggtggtagccaaccatctgtgcgtgctacacggggagcaggggaggttggtgtgaggccgttacccgcagtgaaggacaatgtgaagagagtaatgttttactgttaaaaatagaacttgtggagttaatgttcctagtaaatcattgtccactatcaattgatgtatctcttgttgtgtatatgctcagtaaatgtatggttaataggtctccaattttagttgttactgtcatgagtcttcttttccttctaaataagcatagatagggaaactaataacatagatggaatattttaatactt

SEQ ID NO: 1257 - DNA, 3697 bp, Arabidopsis thaliana
ctgagatgaggctgagagcctgagtctgcgggtggagagagagagaaagaaagcctctttacacgtgatttttaaaagagaccaaaaccccaaaagcaaacctcttttgcatgcgtccttaaaagacataaatttctctcaaaattttctacatcacaaaatcaatctttttctcttcttcttcgtcttcatcatcatcatcatcatcttcctctttctcttcctactgagatattttctccacattgagaggaaagctatcttctctagcgtcactcttcttcttcattggtcggtagaataaggccaaggaagggatcagttttaagttttgtttcattctttttgtagtggagaaaaagagtttttgaaaatccaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaaaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcgatatggcttcagctgcattcatcgagcctcttccagtgatagagtttgtagcacagcttcttggaaaggatgtcttgtcgaagccattgtcggattctgatcgcgtcaagattaagaagggtcttagaggagtgaaagtagaggttactcacagagcgaatgtaagaaggaaataccgtgttgcgggtttaacaactcaaccaacaagagagctaatgtttccagtagatgagaactgtactatgaagtcagttattgagtatttccaagagatgtatggattcacgatccagcacacgcatttgccatgtctccaagttggaaaccaaaagaaggcaagctatttgccgatggaggcatgcaaaattgtcgagggacaacggtacacgaaaaggttgaatgagaagcagattactgctctcttgaaagttacatgccaaaggccgagggacagagaaaacgatattttgcggactgtccaacacaacgcatatgatcaagatccatatgcaaaggagtttggcatgaacataagcgaaaagttagcttctgttgaagctcgtattcttccagctccatggcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtgatcttaagagaatctgtgaaaccgagcttggtttgatatctcaatgttgtctcacaaaacatgtgttcaagattagcaaacagtatctggcaaatgtatcccttaaaatcaacgtaaagatgggaggaaggaacacagttctagtagacgccataagctgtagaataccactggttagcgatataccgacaatcatttttggcgcagacgtgactcacccagagaacggggaagagtcaagcccttcaatcgctgctgttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcagggaccttcttatctcatttagaaaagcaacagggcaaaaaccgcttcgaattatcttttatcgtgatggagtaagcgaagggcaattctatcaagttttactctatgagttggatgcaattcgaaaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggtactgtagttgacactaaaatatgtcatccaactgaattcgacttctacctttgtagccatgcgggtattcagggaacaagcaggcctgcacattaccatgttctttgggacgagaacaatttcacagcagatggtattcaatctctgactaacaatctctgttatacctatgcgcggtgcactcggtcggtctctatagttcctccagcgtattatgctcatcttgcagcatttcgagcacgtttctacctggaaccggagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgtagttcggctttagatttaccaatgtttttcttatgtaaattttgtcggtttggtttaagcctttaggaattagtgtattagggtttttctaaagttgtactttagctgatgataacgttgatgcagtgactttgttaaaacctcctcttctacagtagtgtttacgtcggttcctcaagctttatttttaaacttacagagtggttagtgtaaatgaaacacttagttctctttgcagtatcgtgggaaaattgtaaatgaaaaacttagccctaaaatttgataaac

SEQ ID NO: 1258 - DNA, 3424 bp, Papaver somniferum
ttagtaaagtaaactaagtaagtagttatctatctagttctatctttctctagctaactagctcattgggttatatttggcgtgtctaaatgaatgaaatcttatgttctactgtcttcaccaactttctatgattctttctatttaatttgtattagataacttggaaaactgttgtgagagagtttaaagagtagagagagaatacagtggttttgcatttgtttcttcttgggtttgttcgtgagttcacatcagtcatcatgcctataaggcagatgaaagagagcttagagcagcatatcgtaatcaaaacacaagttcaaaacaccatgaatcaagttcagaagaactcaaaaactactcaaaatggcaagagctctcaagaaccgcagaatggtaaaatacagcatcaaaattcacctccaacaaagaatagaggaaggagaagaggtagaggaggtagaaaatctgatcaaggagatattctgatgagaccaagttcaagaccttgtactacttcagttcataaacaaccagttaatggttttcttccaccaccagtaaacggaggtcctgtttgtatggagatgggatttccaacttctagcaaaaatataaggtttgcccaaagacctgggtatgggcaactagggacaaaatgtatagtcaaagccaaccatttttttgcagagttaccagacaaagacttgaaccattatgatgtcacaataactcctgaagttgtttcaagaacagtcaacaaggcaataatggctgagctcgtgagactgtacaaggagtctgatttaggaatgagacttcctgcctatgatggtagaaaaagcttatacacagctggggcactaccttttacttacagagagttcaatatcaaagttgctgatgaagatgatggtaccaatgctcccagaagagaaagggactacaaagtggtgatcaagtttgtagctcgagcagatttgcatcatctggggcaatttttaacgggtaagcgcgcggatgctccacaagaagcccttcagattcttgatattgtcctacgggaactcgcgtccaaaaggtactgtcctattgggaggtccttcttttcccctaatataagaaaaccacaccgacttggggagggtttggagtcatggtgtgggttctaccagagtataagacctacgcagatgggattatctttaaacattgacatgtctacggctgcttttattgagcctctccctgtaattgaatatgtggctcaactattgagcaaggatgttttgtcgcggccattatctgatgctgaccgcgtaaagatcaaaaaatctcttagaggagtgaaggttgaagttacacatagaggaggaagtgtgcggcggaagtaccgtgtttcaggaataacctctcaacctacaagggaacttgtttttcctgttgatgatgacttaaacatgaagtcagttgttgagtactttcaagaaatttatgggttcactatacagcatacacatcttccgtgccttcaagttggaaatcagaagaaggctaactatttgccaatggaggcttgcaaaattgttgaaggacaacgttattcaaaaaggttaaatgaaaagcaaattacatctctcctaaaagttacatgccagagacccagggacaaggaaaatgatatattgcagacagttcaccacaatagttatgatcaagacccatatgcaaaggagtttgggttgaacatcagcgaaagtatggcttcggttgaagctcggattcttcctgctccttggttgaaatatcatgatacggggaaggaaaaggattgcttgcccctagttggtcaatggaatatgatgaacaagaaaatgatcaatgggagcactgtaagccgttgggcatgcatcaacttttcaaggagcgttcaagagagcgtggctcgcacgttttgtcatgagctggctcaaatgtgccaagtctctggcatggaattcaaccctgagcctgttattccaatctacacagccagagctgatcaagtagagaaggctttgaagcatgtctgtcatgcatcagttaacaaacttaaagggaaagagctagatctagtcatagccatattacctgacaataacggttctttatatggtgacattaagcggatatgcgaaactgatttgggtctaatatcacaatgctgccttacaaagcatgtctttaagatcaataaacagtacctggccaatgtctccttaaaaattaatgttaagacaggaggaagaaatacagttctaatggatgctttaagttgcagaataccacttgttagtgatataccaacaataatatttggagcagatgttacccacccagagaatggagaggactctagtccctcaattgctgcggtggtagcttctcaagattggccagaagtgacaaaatatgcaggactagtttgtgctcaggctcacagacaggaactcatacaggatttgtacaaaacttggcatgacccagttcgtggcacagttaatggtggaatgattcgggacttgttgatttcattccgtaaggcaacaggacaaaagcctcaaaggattatattctatcgagatggtgtaagtgaagggcaattctaccaagtccttctttatgaattagatgcaatccgtaaggcctgtgcttctttagaaccaaattaccagcctccagtgactttcattattgtccaaaaacgtcatcacacgagattattcgctaacaaccacaaggaccgtagcagtgttgacaagagcgggaacatcttacctggaactgttgttgataccaaaatctgtcatccgacagaatttgatttttatctctgcagtcatgccggaattcagggtacgagccgaccagctcattaccatgtgttgtgggatgagaacaattttacgcctgatggtattcagtccttaacaaacaacctttgttacacgtatgcaaggtgtactcgctctgtctccgtcgttcctccagcatattatgctcacttagcagcctttcgtgctcgcttttacttggaaccaacatcaaatgatgacgacttggctggccaagtgggtcggtctacatggacaggaggatgtggggttcgaccactgccagccctaaaagaaaatgtgaagagagtaatgttttattgttagaaaaggagagaatcttgaggagacagtgacctgtttgtactgaagatgagtagtagtagtagagtagctaccatgttactctttgcactcacttccttctatgtcattgtaattccttcactgtatgtataacccaccactttcttctgataatcaatttagatttgtgaaaattgcaaaaaaaataactaatgtctaatgcgccattctcatttgaacca

SEQ ID NO: 1259 - DNA, 2883 bp, Tabernaemontana elegans
ccccaaaacaggtcaaaatgggaaaagggccaccatctcaagaccctcaaaacaccaagctccataaccagacgtcacctccatcaagaaatagaggaagaagaaggggaagaggtggccggaaatctgatcagagtgatgtatttatgcggccgagttcgaggccttgcactggagcaaataagcccgtggtgggtgaacctgctggagctgttgaagtaactgcaagaaatgggtgtgctgagaatgggaaagacggcttgtctgtggcgagtgtcccatttccttcttcaagcaaggcattgagttttactcctaggccgggttatgggcaacttggtacaagatgtatcgttaaagccaaccacttctttgtggacttgccagacaaggatttgaaccagtatgatgttactattactcctgaggtggcatcaagagctgtgaacagatctattatagcagagcttgtgaaactgtacaaagaatctgacttggggaggagattacctgcttatgatggcagaaagagtctgtataccgctggtgaacttccttttgctttgaaggagtttaccattaagcttattgatgaagaggatggaatcaatggtccaaagcgtgagagggaatacaaagttgtgatcaagtttgttgcccgggcaaacttgcatcagttaggccaattccttgctggtaagcgtgcagatggtccacaagaagctcttcagattcttgacattgtgttacgagaactctctatgaagaggtattgccctgttgggagatcgttcttttctcctgatattaggaggccacaacggcttggtgatggcttggaggcatggtgtggattctaccagagtataagaccaacccagatgggcttgtcccttaatattgatatggcttcagctgcatttattgaggctcttccggtgatagattttgtagcccaacttctagggaaggatgcattatcaagacagttgtccgattctgaccgcgtcaagatcaagaaggcccttagaggagtgaaagtagaagtaacacacaggggtaatgtacgaagaaagtatcgtgtttctgggttaacatctcaacccacaagagaattagtttttccagttgatgacaactcaacgatgaagtcagttgttgaatatttccaagaaatgtatgggttcacaattcagtatactcatcttccttgccttcaagttgggaaccagaaaaggctaactacctaccaatggaggcatgtaaaattgttgagggccaacgctatacaaaaaggttgagtgaaaacaaattactgctcttttgaaggtgacctgccagagacccagggtccgtgaaaatgatattcttcagactgttcaacacaatgcctatgatcaagacccatatgcaaaggaatttgggatcaaaatcagtgaaaacctagcttccgtggaagctcgggttcttccagctccatggctgaaatatcatgagactgggaaggaaaaggattgtttacctcaggttggacaatggaacatgatgaataagaaaatgattaacgggatgactgtttgccggtgggcatgcatcaacttctcaagaagtgtccaagagagtgttgctcgtggattctgtaatgaactggctgaaatgtgtcaagtgtctggaatggaattcaatccagaaccagtcattccaatctacagtgctaggcctgaccaagtagagaaagctttgaagcatgtttaccatgcatgtatgaacaaactaaaagggaaagagttagagcttttgctagccattttacccgacaataatgggccgttgtatggtgatctgaagcgaatatgtgaaacagaacttggtttgatttctcaatgctgtctaacgaaacatgtcttcaagatcagcaagcaatatttggctaacgtgtccttgaagattaatgttaagatgggtggcagaaatactgttcttttggatgctataagctgtagaattccattggttagtgacatacctacaattatatttggagcagatgtgacccatccggagaatggagaggactccagcccctcgatagctgctgtcgtagcttctcaggattggcctgaagtcactaaatatgctggactagtttgtgcgcaagctcatagacaggaacttatacaagatttgtacaagacatggcatgaccctgtccgcggaattgtcagtggcggcatgatccgggatcttctggtttcattcagaaaggcaaccggacaaaagcctcagaggatcatcttttatagggatggtgtaagtgaagggcaattttatcaggtcctactttttgaattagatgcaatccgaaaagcttgcgcctcattagaaccgaactaccagccaccagtaacttttattgtggtacaaaagcgacatcatacccgtctatttgctaacaatcatagagaccggggtagcactgacaagagcggaaatatcttgccaggcactgtggttgattctaaaatctgccacccaacggaatttgacttttatctttgcagccatgctggtattcagggaactagtcgaccagctcattaccatgttctgtgggacgagaacaattttactgctgatggaattcaatcattgacaaataatctttgttatacatatgcaaggtgcacgcgttctgtttctgttgttcctccagcttattatgcccatttagctgcatttcgagctagattctacttggagccagacctacaggagaatggttgtgctgctagccggaaaggcactcgagcaggaggagagtctggtgtacggccactgccagcattgaaagaaaatgtaaaaagagtaatgttttactgttag

SEQ ID NO: 1260 - DNA, 3087 bp, Petroselinum crispum
cttcataacacaccccttcacttcactctccctctaactcatcatcttgggaatttcagccataaatttgttgagtgtaatgagtaaatgcaagaaagttcaagattttgaatgctgaatctgggaaggatctttgctttacattgctttatgttacttgtatctatctgttgttaagaaatatatagttattatcatccagcatcatgcctattaggcagcttaaagaaggttcagagcagcacctagtgatcaaacctcacttgaataactcagtgaatcaagttcagaagcaacttaaaacagctcgaaatggcaaaagcccacctgggcaagaaaaccagaatgcaaaagcccataaccaatcttcacctccctcaaaaagtagaggaaggagaagaggaagaggtggtcggaaatcggatcaaggtgacgcttgtatgcgtcccagcacgcgaccgtgcacagctgagtattccccggtggctcaggtttcagcccggtctggtgccgctgttgaagtgcataatagtaatttaggcacattgtgtgaagtagggaggaattttccttcttcaagcaagtctttgagttttgctcaaagacctgggtatgggcagcttgggacaaaatgtgttgttaaggcaaaccatttctttgcagagttaccagagaaggacttgaatcactatgatgttagtattacccctgaggtgtcatcaaggaatatgaacagagctataatggcagaactggtgaagctgtataaagaatctgacttggggatgaggttgcctgcttatgatggcagaaagagtctgtacactgctggtgagcttccatttgcatggaaggagttcgatatcaaacttacagatgaagatgatggagttaatggtcccaaaagggtgcgggagtacaaagtggtgattaaatttgttgcaagggcaaatttgcatcatctgggccaatttttggctggcaagcgtgcagatgctccacaagaagctcttcaaatactcgacatcgtactaagagaactatcaaataagaggtattgccccgtgggaagatccttcttttctcctaacatacggaaaccacaacggcttggtgagggcttagagtcatggtgtggattttatcaaagtataaggcctacccaaatgggcttgtccttaaatattgatatggcatcagctgcttttattgaggctctccccgtgatagagtttgtcgcacagcttcttggaaaagatgtgctaacgaaaacattatctgattctgatcgtgtgaagattaaaaaggccctaagaggcttgaaagttgaagtaacacataggggtcatatacgaagaaagtatcgggtttcaggaataacatctcaacccactagagaactagtgtttcctgttgatgacaactcgaatatgaagtcagttgttgagtactttcaagagatgtatggcttcacgattcagcatactcatcttccctgtcttcaagtcggtaaccagaggaaagcaaattatttgccattggaggcttgcaagatagtggagggtcaaagatacacaaaaagattgaatgagaagcaaattactgctcttctgaaagtaacatgccaaaggccaagagatcgagagcatgacattttgcagacggttcaacacaatgcttatgatcaagatccgtatgcaaaggaattcggcatgaatattagtgaaaagcttgcttctgttgaggctcgagttctccctgccccatggcttaaatatcatgaaaatggcaaggagaaggattgtttgccacaagtcggtcagtggaatatgatgaacaagaaaatgatcaatggtatgactgttagtcgttgggcatgcatcaacttctctaggagtgtgcaagaaaatgttgctcgtgggttctgtagtgaactggctcgtatgtgccaggtatctggaatggaatttaaccctgaacctgtaataccgatctatacagcctggcctgacgacgtagagaaagctttgaaacatgtttaccatgcaagtgtgaacaaattaaagggaaaagacctagagcttctgttagccattcttccggacaacaatggttcattgtatggagatctgaaaagaatatgcgaaactgatctgggtttaatttctcaatgttgtctgactaagtatgtcttcaagattagcaagcaatacttggcaaatgtctcactaaagattaatgttaagatgggcggtagaaatactgttcttctggatgcaattagctgcagaatacctttggttagtgacataccaacgattatatttggagcagacgtgacccacccagagaatggagaagattcaagcccctcgatagctgctgtagtggcttcccaggactggcctgaagtcacaaagtatgcaggtttggtttgtgctcaagctcatagacaagaacttatacaggacttgtacaaaacatggcaagatcctgcccggggtactgttagcggcggcatgatccgggatcttttggtttccttcaggaaggcaactgggcagaagcctttacgtattatattttacagggatggtgtgagtgaaggtcaattttatcaagtcctactttttgagttagatgcgatacggaaggcctgtgcatctttagagcccaattaccaacccccagtgactttcattgtggtgcaaaaacggcatcacacaaggttatttgctaacaaccatagaaatcgaagcagcaccgacaaaagtggaaacatcttgccaggaaccgtagttgataccaaaatctgtcatccaacagaattcgacttttatctatgcagccatgctggtattcagggtacaagtcggccagcacattaccatgttctttgggatgaaaacaattttacagcagatggaattcagtcgttgacaaacaacctctgctacacatatgcgaggtgcacaagatcagtttctgttgttcctcctgcgtattatgcgcatttagctgcatttcgagccagattctatttagaacctgaactccaggagaatggatgtggtgttggtcaaggta

SEQ ID NO: 1261 - DNA, 3344 bp, Citrullus lanatus
gtaggatgacgtcttgaatccgtgaaggaagagggaaaatgagttcagagtaaacgtgactgtgaagaaacttcatgtacaccatttcgtgaacctttaagctcatttcaaacgagttcgcgtgccattgccagtcgattttccaggcagtaaaagagacccaccatgccagtacggcaaatgaaagagagctccgagcagcaccttgtaatcaaaacccacttacagaactctgttcaaaaacctccaaaatcaacccaaaatggaaaaggccccccgaatctggaacaccaaaacatcaaatctcgaaacccatcttctcctccgagtaaaagcaggggccggagaaggagcagaggcggccggaaatccgatcaaggagaagtgtttatgaggcccagttctcgaccctgcacggttgcacgtaaacccgatgaaccggagtttaacgccggagctctggtggcaagtactaatccaaatggtggaaacattagtgggatgcaaatgggttttcgaaattcaagcaagtctttgagttttgctccaaggcctggattcggacaagttggaacgaagtgtattgttaaagcaaaccatttctttgcagagttaccagacaaagatttgaatcaatatgatgttacaattactcctgaagtggcatcaagaactgtgaacagagccatcatggctgaattggtgagattatacagagaatctgatctgggaaaaagattaccagcttatgatggcagaaagagtctgtatacagctggtgagcttccttttgtttggaaagagtttgatatcaagcttgtggatgaagaagatggagtcagtggtcccaagagggagagggagtataaagtagttattaagttcgttgcacgtgcaaatttacaccatttgggtcagtttctggcgggtaagcgtgctgatgctccacaagaagctcttcaaatactggacattgtattgagagagctgtcatctaaaaggtactgtcctatagggagatccttcttttctcctgatattagatcacctcagcggctcggtgatgggctagaatcatggtgtggtttttaccagagtattagacctactcaaatgggactgtctctgaacattgatatggcttcagctgcattcattgagcctctccctgtccttgagtttgttgctcagcttctagggaaagttgtttggtcacggccattatctgacgctgatagagtaaagattaaaaaggctctgagaggggtgaaagttgaagtaacacaccgtggaaatgtaaggcggaaatatcgagtttcgggtttgacatcacagcctacaagagaattagtatttcctgttgatgacaactcaaccatgaagtcagttgttgaatacttccaggagatgtatggcttcaccattcaacatgcacatctcccttgccttcaagtaggaaaccagaagaaggcaaattatttgccaatggaggcctgcaaaattgtagggggccaaagatatacaaagagattgaatgagaagcaaataactgcacttctaaaagtcacatgtcaaagacctagggatcgggaaaatgacattttgcagactgtccaacataatgcttatgataatgatccttatgctaaggagtttgggattaaaattagtgaaaagctggcttccgttgaagctagaattcttcctcctccatggctgaaatatcatgatactggaaaagagaaggattgcttgcctcaagtgggtcaatggaatatgatgaataagaaaatgattaatggaatgactgttaaccggtgggcatgtatcaacttctctaggagcgtgcaagagagtgttgctcgtgggttttgttctgaacttgctcaaatgtgtcaagtgtctggaatggaatttaatccagaaccagttattccaatatacaacgcaaggccagaacagataagtaagcagtaccttgctaatgtgtcactgaagatcaatgtcaagatgggtggtagaaacactgttcttctagatgctattagctgcaggataccgcttgtgagtgacataccaacaataattttcggtgcagatgtgacccatccagagaacggcgaagattccagcccttcaatagctgctgtagtagcctctcaggattggcctgaagtgacaaagtatgctggactagtatgtgctcaagctcatagacaagaacttatacaagacttgtacaaaacttggcaggatcctgtccgtggcactgtcagcggtggcatgatcagggatcttctggtttcatttaggaaagctacagggcagaagcctctcaggataatattttacagggatggggtgagcgaaggacaattctatcaagtattactttatgagttggatgcaatcaggaaggcatgtgcatctttagaaccgaattaccaaccacctgtgacgttcattgtcgtgcaaaagcgacaccacacccgattgttcgccaacaactatagagatagaagtagcacagacaagagtgggaacattttgcctggcactgtagttgactccaaaatatgccacccaacagaatttgatttctacctctgtagccatgctggaattcaggggacgagtcgcccagctcactaccatgttctttgggatgaaaacaattttactgcagatggaattcagtcattaacgaacaatctttgctacacgtatgcaaggtgtacacgttcggtttctgtcgtccctccagcatactatgcacatttagctgcattccgagctcgattctacatggaaccggagatgcaggagaatggctcagctggtcgttctgccaagagtacacgcactaccggagagtctggggttcgtcctttgccagctctaaaggaaaatgtgaagagagtaatgttttactgttagaaatcagaagcaccaagcaaaggagaggctcgtagttggagcgatgaccggaaatgttcagccatcaggaacttgactcttcctctgcactgcagttgatgagttcctttgtaaatgaatcatcatcatcaatgtgggatcatcaatgtgggttcagatgtgttacaaatgaaggttggtgattttagttgggagtaaatgtagagttggttggttaggtccctttggtgaagagctttacatttgctttactgctgcacttttaagtgtcgaaatcaagaaacagagagacgcacacccacccaaccatagatgacagattctcttctccacccacatttgtaaagagctgtttttttccataatgaatcagtatagatgtgttagaaatttgaatctctcacaaa

SEQ ID NO: 1262 - DNA, 2936 bp, Brassica napus
caccttctccgccgtaccaagaaccgtagccggaggagaaaccgcggtggtcgaaaatcagaccaaggagatgtctgtatgaggcctagctcccgtcctcgcaaaccgccgcctcagaacgctcccgtcgccgccgtctcgggcacagagatagtcgccgtgaaccatcagatgcaaatgggtgttcgtgggtcgagtaaaaactccaactttgcgccgagacctgggttcggacagcttggaactaaatgcatcgtcaaagctaaccatttcctcgctgacttaccgaccaaagatctgagtcactacgatgttacaataactcctgaagtgtcatcaaaaagtgtgaacagagccatcattgctgagttagtgagactatacaaagagtctgaactcgggtcgagacttcctgcttacgacggccggaaaagtctttacaccgccggagagcttcctttcacttggaaagagttcgctgttaagatcttcgatgaagacgatggtatcatcaatggccctagaagggagagatcgtataaggtggctatcaagtttgtggcacgggccaatatgcatcacttaggcgagttcctagctggtaaacgcgcggatggaccgcaagaggcgttgcagattctcgacattgtacttagggagctgtctgttaagaggttctgtcctgtcggaagatcgttcttctcgcctgatattagaacaccgcagcgacttggtgaagggttacagtcatggtgtgggttttaccagagtattcgacctacacaaatgggtttatctcttaacatcgacatggcttcagctgcttttatcgagcctcttcctgtgatagagtttgtagcacagcttctcgggaaagatgtcttgtcaaagccattatctgactctgatcgtattaagatcaaaaagggtctcaggggagtgaaagtagaggtcactcatagagcaaacgtgagaaggaaataccgtgttgcgggtttaacgactcaaccgacaagggagctcatgtttccagttgatgagaacgctacgatgaagtcggttattgagtattttcaagagatgtatgggttcacgatccagcacacgcatttgccgtgtcttcaagtgggaaaccagaagaaggcgagctatttgccaatggaggcatgcaaaatcgtggagggacaacggtacacaaaaaggttgaacgagaagcagattactgctcttttgaaagttacatgccagaggccaagggacagagaaaacgacattttaaagacggtgcaacacaacgcgtatgatcaagatccatatgctaaggagtttggtatgaatataagtgaaaagctagcttctgttgaagctaggatccttccagctccatggcttaagtatcatgagaatgggaaagaaaaggattgccttccgcaagtgggtcaatggaatatgatgaataagaagatgatcaatgggatgacggtgagtagatgggcctgtgttaacttctcacgcagtgttcaagaaaatgttgctcgtgggttttgtaatgaacttggtcagatgtgtgaagtctctggcatggagtttaatccggagcctgtgataccaatatacagcgcgaggcctgatcaagttgagaaagctctaaagcatgtttatcacactgctatgaacaaaaccaaaggcaaagagttagagcttctcttggccattttacctgataacaacggttcactctacggggatcttaaaagaatctgtgaaaccgagcttggtttgatatctcagtgttgtctcacaaaacatgtgttcaagattagcaaacagtatctggctaatgtatcccttaaaatcaatgttaagatgggaggaaggaacacagttctgttagatgccataagctgtaggattccactggttagcgacatacctacaattatatttggcgcagacgtgactcacccagagaacggggaagagtcaagcccttcaatcgctgctgttgttgcttcacaagactggcctgaagtgacaaagtatgctggtttggtttgtgcacaagctcacaggcaagaacttatacaagatttgtataaaacatggcaggatcctgtacgtggcactgttagtggcggcatgatcagggaccttctgatctcattcaggaaagcaacagggcagaaaccgcttcgaatcatcttttaccgtgatggagtaagtgaaggacaattctaccaagttttactctacgagttggatgcaattcgtaaggcatgtgcgtcgcttgaaccgaattatcagccacctgtgacattcatcgtggtacagaagaggcaccacacccgtttgtttgctaataatcaccgagacaaaagcagtactgaccgaagcggaaacatcttacctggtacggtagttgacactaagatatgtcatccaactgaattcgacttctacctttgtagccacgctggtatacagggaacaagcaggcctgctcattaccatgttctttgggatgagaacaatttcacagcggatggtattcaatctctgactaataatctctgttatacctatgctcgatgcactcgatcggtctctgtagttcctccggcgtattatgcacatcttgcagcattccgagcacgtttctacatggaaccggagatcatgcaagataacggatcgccgggtaaaaagaatacgaagacaacaactgtaggagatcatggtgttgttggtggcggtgtgaagccgttacctgctttgaaggagaatgtgaagagagtcatgttttactgctaaatgaaagacaagtagtttcgtttgttatgttcctatcctagttcggctttaggtctgctgctaatgtttgtaaataagttggttcggcttagggttccttatttctagagttgtgtgttttagct

SEQ ID NO: 1263 - DNA, 3404 bp, Mimulus guttatus
accttcttcaatccacacacacacacacacacagacacactaaaaaaacacacacttttctctctcaccaaagaacccatctttttaagttcttgattaaagcccacctctttatttttcaaagggtagattcaaaagtggattttaatcaaatcgttgcattgatctgtggagggctgtaaaccaagaaatcaagaactagaaatcaacaaattcttgattttaattttattttcaacaaaaaaaaaaaatcccatttttgcccacatgataatcatgccaatgaggcagatgaaagaagcttccgaccaccaacactgcgttgtaatgaaaccccagttaccaccgccaccaaacaccgccaccaaaaaccctaaaaccgctcaaaccggcaagggggccgcggcccccccaccaccgttattaccacaagaacctcaaaaccagtcgccgtcacccccatcaagaaacaggggaagaagaagggggcgagggggccgaaaatccgaccaaggtgaagtctttatgcggccaagctcacgcccatgcaccgcagcggataaacccggaaccagagaaacgggtcgggtcatgatcgacccggttccaccaaacgggtcgggtacaagtttcccctgttcaagcaagtctttgactttcccaactaggcctggttttgggcagcttgggacaaaatgtattgtcaaggcaaatcatttctttgctcagttgccagacaaagacttaaaccaatatgatgtaactattacccccgaagtcgcatcgagggcggtaaatcgagctataatagcggaactcgtgaaagtatacaaggaatccgatttagggaagagattacctgcgtatgatgggcgaaagagtctttacaccgcaggggaacttcctttcgctcggaaggagtttattgttaagcttgtagacgaagaagacactatcaacggccctaagagagtgagggaatacaaagtagcaatcaaatttgtcgcacgtgcaaatttacatcatttggagcaatttctagccggtaaacgagcagatggtccaaaggaggcactacaaattctcgacattgtattgagagagctctccgtgaaaagattctgtcctgtcggaagatcgtttttttctccggatataaggaaaccgcaaagactaggtgacggtttggaggcgtggtgtggattctatcagagcatacggcccactcagatgggattgtcacttaacatagatatggcttcggctgcatttattgaggctcttccggttatcgaattcgtcgctcaattattggggaaagatgttttgtcgaggccgttatccgattcggatcgcattaaggttaaaaaagcacttagaggagtaaaagttgaagtgactcatagaagagatgttcgaagaaaatatcgagtttgcggcattacgactcagcccactcgtgagctagtatttccggtggatgacgactcgaacatgaaatccgtggtcgagtatttccaagaaatgtacggtttcacaatacagcacactcatctgccttgcctacaagtagggaatcagaagaaggcaaactatttacccatggaggtcagatgttgttggcttgtaaaaattgtggagggacagagatatactaaaaggcatgtgataactgttcaacacaatgcttatgaagaagatccgtacgcaaatgaattcggaatcaaaatcagcgaaaaaatgacatctgtcgaggcccgagttctccccgctccgtggttgaaatatcatgacacgggaaaagaaaaagattgcttgccccaagttggccaatggaatatgatgaacaagaaaatgataaacggcatgaacgtgaaccgttgggcatgtattaacttctcacggagcgtacaagatagcgttgctcgtggattttgcaatgagctagctcaaatgtgtcaagtatcgggcatggaatttaatccggaacccgttattccaatctacatagctcggccggatcaagtcgaaaaagctttgaagcatgtttatcatgcatgcaccaataaattaaaaggaaaagaattggagcttttattagctattttgcccgacaacaacggctctctatacggtgatttgaagcgaatatgtgaaaccgatcttggtataatatcccaatgttgtctcacgaaacacgttttcaagatcaacaagcaatatcttgctaatgtgtccttaaaaataaatgtcaagatgggtggaagaaatacggttttattggatgcaataagctgtagaataccgctagtgagtgatatacctacgattatattcggagctgatgtaacgcatcccgaaaacggagaggagtcgagtccatctatagctgctgttgtagcttctcaagattggcccgaggtgacaaagtacgcggggttggtttgcgcgcaagcgcatagacaagaattgatacaagatttgtacaagacttggcaagatcctgttcgtgggaccgtgagtggcggcatgatcagggatcttttggtttcgtttagaaaagcaactggacaaaagccacagaggataatattttacagggatggtgtgagtgaagggcaattttaccaagtgctactatttgagttggatgctattcgcaaggcttgcgcctcgttggagccaaactatcaaccaccggtgacttttatcgtagttcaaaaacggcatcacacaagactttttgctaacaatcatagggataaaagcagcaccgacaagagcggaaacgtattacctggtacggtggtcgattcgaaaatctgtcatcctacagaattcgacttttatctttgtagtcatgctggaattcagggaacgagtcgacctgctcactaccatgtactctgggatgagaacaatttcactgccgacggaattcagtcactgacgaacaatctatgttatacatacgccaggtgtacacgctccgtttcagttgttcccccagcttactatgcacatttggctgcattccgggcgagattctatttggaaccggacttgccggaaagtggcagcggcggtggtggcaaggtgggaagagtggcgggagaaacgggtgtgcgtcctttaccggctctcaaagaaaatgtaaaaagagtaatgttttattgttgaaacaaaagggcaaattagggttttcttagcatgagtggaagggcctttgtttgtatatgtttgattataaatgcagcttcctatggtaattttgaattttaatttagataaattaaatgatgtaaaaagtttgcctagctttcattagtttaattttggatctataattgactaggaataatattatagttgcgagaaaaatcgacgaagaaaatttacgcaga

SEQ ID NO: 1264 - DNA, 3058 bp, Cannabis sativa
gagttcaagtaagtctttgagtttcgctcgaagacctgggtttggtcaagttgggaccaagtgcattgtaaaggctaaccatttctttgctcagttaccggacaaggatttgaaccagtatgatgtcaccattactcctgaagttgcatcaagaaatgtgaacagggccatcatggcagaactggtgaggctgtacaaagagactgacttaggaatgagactgcctgcctatgatggcagaaaaagtctgtataccgctggtgagctgccctttacatggaaggagttcaacgttaagcttatagaggaagaagatgcagttcatggtcccaaaagggagagacattacaaagtagtgcttaagtttgtagcaaaggcaaatttgcatcatttgggccagtttttagctggaaagcgtgctgatgcaccccaggaagccctgcaaatacttgacattgtattaagagagctctcaaacaagaggtactgccctgttgggagatccttcttctcacccgatatcagagttccacaacggcttggtgagggcttggagtcttggtgtggattttaccagagcataaggccaacacagatgggcctatctctgaatattgacatggcttcagctgcattcattgaacctttgccggtaattgagtttgttggtcaacttcttgggaaagatgtgctatctaggcccttgtctgatgcagatcgcataaagattaaaaaggcgcttagaggagtgaaggttgaagtcacacacagagcaaatattcgtagaaagtatcgcgtttcaggcttgacatctcaacccacaagagaactagtgtttcctgttgatgagaactcaaccatgaagtcagttgttgaatacttccaggagatgtatggtttcactattcaacatggccatcttccttgccttcaagtgggaaaccagaagaaggcaaactatttacccatggaggcttgcaaaattgttgagggccaaagatattcaaaaaggttaaacgaaaagcaaattactgctctattaaaagtaacatgccaaaggcccaaggatcgtgaacaagacatcctgaagactgttgaacataatgcttacgaccaagatccgtatgcaaaagagttcggaatcaggatcagtgaaaaactagcatctgttgaagctcgaattcttcctgcgccctggttaaagtatcatgacactggaaaggaaaagaattgcttgccgcaagttggtcaatgattgagaatttgagattgaccagaaaatgattaatggaatgactgttagccggtgggcgtgtattaacttctcaagaagtgtgcaagagagtgtagctcgtggattttgcagtgaacttgctcaaatgtgtcaagtatctggcatggaatttaacacagaacctgttattccaatttacaatgctcgacctgagcaagtagagaaggcattgaagcatgtttaccatgcatccatgaacaaaacaaaaggaaaagaattagagcttgtgttagctatcttgcctgacaacaatggctccctatatggtgatctcaaacgaatatgtgagacagatcttggtttactgtcacaatgctgtcttaccaaacatgtcttcaaaattagcaagcagtacctggctaacgtgtccctgaagattaatgtgaagatgggcggtagaaacactgttcttttggatgctattagctgtagaataccattagttagtgatgtgcccaccataatttttggagcagatgtgacacaccccgagaatggagaagactcgagcccttcaatagctgctgtagtagcttctcaggactggcctgaagtgactaaatatgctggattagtttgtgcccaggctcaccgacaggaactaatacaagatctgtataagacatggcaggatccagttcgtggaacagttagtggtggtatgatcagggatcttcttgtttcgtttcggaaggcaacaggacagaagcctctgagaatcatattttatagggatggtgtaagtgaagggcaattttaccaagttctactatatgagcttgatgctatcagaaaggcttgtgcttctttggaacccaactaccaaccgccagtcacttttatagttgtccaaaaacgacatcatactcggctgtttgctaataatcacagagataggagcagcacagacaagagcgggaatatattgcctggcaccgttgttgatactaagatctgccatccaacagagtttgatttttatctttgcagccatgctggtattcagggtacaagtcggccagctcattatcatgttttgtgggatgagaacaattttactgctgatgcaatccagtcattaacaaacaatctctgttatacgtacgctaggtgcactcgatctgtatctgttgttccaccagcatattatgcgcatttggctgcctttcgagctcgattctacctggaaccagagatgcaggaaaatggaagcaatggccacccttctaagggaacgaggacggcaggagacttgggggtccggccattgcctgccttgaaggagaatgtgaagagggtaatgttttattgttagaatgggaagactgatggtgggttggttggttgtagctagaacaagggggcaacaaaaatcatggcaatctttcatagttaaaattcctgtctgtaaatgtatcattgtatgtgactgcatgattgttgcaacttgctattccttcatatctttagtatcccagaaatgaaaaaggagcacaaaacaaagggaagaaaaagaaagacaaaacaagaggattgataaaagaaggtaatatagattcttcccatattttagtttagcatagctttgcaggataggataccctagatgctctgaccaaaaaaaaaaaaaaagttgggaagtagtaggcttattatagttgatgacaggttcctgtctcttgtactttgcagtgtaacccgtttatgtaagatttgtcaaactaggctctttgtaaagaaatgaataatctttatatgtaggtt

SEQ ID NO: 1265 - DNA, 3977 bp, Brassica oleracea
agacaccaaagccccaaaagcaaacctcttttgcatgcgtctttaaagaagagcaaaaataataaaaagagcttctttttcaatttctacatcacaatctcatccttttatcttcctcctctcctccttcatcgacatcatcattcattacacactcccttctccttcgtcttcttctcagaattttttctacacattgataggaaagctataatcttttgcgtcactcaatcttctgaagcagcaatcttttcattggttggtgagtgtttctctgttttatatgtttattttactgtttttgtttttcattaatattagcggacgggtcattttctctccgtagcaattaattcaaagttatgtttttgtttataaaaaaataaaaattctcttgggggagatattgatatttccactgctcttttcgatgtttattccttccctttgttcacttgctctctctctctctctacaattcacagcaacaacaaaaataaaaaaaaaagctacgatttttgtttccctcttggctttgtagttatctgtttggggtcatccatattttgctccgggatctcattttccggtttcgaatagagacaaaagcttaaagcttcctccggttttgtcttctggaactataggccctgtgtctgtgtatgtgcaggttggataaagacaagaagagatcagttttttgtttcattcattccttttgtagtggaaaccggaagagagaagaaagaatgccgattaggccaatgaaagaaacctcagagactcatttactcatcaaacccaagcatctccccaaagccgtgcaaaacgctaaagcccctcctactccggcgacgacgacggcggcagctcagagccaagcttcttcaccttctccgccgtccaagaaccgtagccggaggagaaaccgcggtggtcgaaaatcagaccaaggagatgtctgtatgagacctagctcccgtcctcgtaaaccgccgcctcagaacgctcccgtcgccgccgtctccggcacagagatagtcgccgtgaaccatcagatgcaaatgggtgttcgtgggtcgagtaaaaactcaaactttgcgccgagacctgggttcggacagcttggaactaaatgcatcgtcaaagctaaccatttcctcgctgacttaccgaccaaagatctgagtcactacgatgttacaataactcctgaagtgtcatcaaaaagtgtgaacagagccatcattgctgagttagtgagactatacaaagagtctgaactcgggtcgagacttcctgcttacgacggccggaaaagtctttacaccgccggagagcttcctttcacttggaaagagttcgctgttaagatcttcgatgaagacgatggtatcatcaatggccctagaagggagagatcgtataaggtggctatcaagtttgtggcacgggccaatatgcatcacttaggcgagttcctagctggtaaacgcgcggatggaccgcaagaggcgttgcagattctcgacattgtactcagggagctgtctgttaagaggttctgtcctgtcggaagatcgttcttctcgcctgatattagaacaccgcagcgacttggtgaagggttacagtcatggtgtgggttttaccagagtattagacctacacaaatgggtttatctcttaacatcgacatggcttcagctgcgtttatcgagcctcttcctgtgattgagtttgtagcacagcttcttgggaaagatgtcttgtcaaagccattgtctgactctgatcgtattaagatcaagaagggtctcaggggagtgaaagtagaggtcactcatagagcaaacgtgagaaggaaataccgtgttgccggtttaacaactcaaccaacaagggagcttatgtttcctgttgatgagaacgctacgatgaagtcggttattgagtatttccaagagatgtatgggttcacgatccagcacacgcatttgccgtgtcttcaagttggaaaccagaagaaggcaagctatttgccaatggaggcatgcaaaatagtggagggacaacggtacacaaaaaggttgaacgagaagcagattactgctcttttgaaagttacatgccagaggccaagggacagagaaaacgacattttaaagacggtgcaacacaacgcgtatgatcaagatccatatgctaaggagtttggtatgaatataagcgaaaagctagcttctgttgaagctaggatccttccagctccatggcttaagtatcatgagaatgggaaagaaaaggattgccttccgcaagtgggtcaatggaatatgatgaataagaagatgatcaatggaatgacggtgagcagatgggcctgtgttaacttctcacgcagtgttcaagaaaatgttgctcgtgggttttgtaatgaacttggtcagatgtgtgaagtttctggcatggagtttaatccggaacctgtgataccgatatacagtgcgaggcctgatcaagttgagaaagctctaaagcatgtttatcacactgctatgaacaaaaccaaaggcaaagagttagagcttctcttggccattttacctgataacaacggttcactctacggggatcttaagagaatctgtgaaaccgagcttggtttgatatctcagtgttgtctcacaaaacatgtgttcaagattagcaaacagtatctggctaatgtatcccttaaaatcaatgttaagatgggaggaaggaacacagttctgttagatgccataagctgtaggattccactggttagcgacatacctacaattatatttggcgcagacgtgactcacccagagaacggggaagagtcaagcccttcaatcgctgctgttgttgcttcgcaagactggcctgaagtgacaaagtatgctggtttggtttgtgcacaagctcacaggcaagaacttatacaagatttgtataaaacatggcaggatcctgtacgtggcactgttagtggcggtatgatcagggaccttctgatctcattcaggaaagcaacagggcagaaaccgcttcgaatcatcttttatcgtgatggagtaagcgaaggacagttctaccaagtcttactctacgagttggatgcaattcgtaaggcttgtgcgtcacttgaaccaaattatcagccacctgtgacattcatcgtggtacagaagaggcaccacacccgtttgtttgctaataatcaccgagacaaaagcagtactgaccgaagcggaaacatcttacctggtacggtagttgacactaagatatgtcatccaactgaattcgacttctacctttgtagccacgctggtatacagggaacaagcaggcctgctcattaccatgttctttgggatgagaacaatttcacagcggatggtattcaatctctgactaataatctctgttatacctatgcccgatgcactcgatcggtctctgtagttcctccggcgtattatgcacatcttgcagcattccgagcacgtttctacatggaaccggagatcatgcaagataacggatcgccgggtaaaaagaatacgaagacaacaactgtaggagatcatggtgttgttggtggcggtgtgaagccgttacctgctttgaaggagaatgtgaagagagtcatgttttactgctaaatgaaagacaagtagtttcgtttgttatgttcctagttcggctttaggtttgctgctaatgtttgtaaataagttggttcggcttagggttctttatttctagagttgtgtgtgtttagctcaggtttcgatgataacgtttaatgcaatatgtttttcttaaggtctctctggttctactaacagtagttgcaacgttgtaagctttatcctttttaagaagactggtttttaaaggaagctgctttttagagtcccacatcggttagctaaagatgg

SEQ ID NO: 1266 - DNA, 1176 bp, Arabidopsis lyrata
agattaagacttgttggtcatcttcgagtgtgagtggatgcactaactcaccagagagattagagaatcagatatttacctagtggatcatggcgtcatcatctgatcacacggcgaagataatcgacggaaaggcgattgctcataccatccgatcagagatcgccgaggaagttcgcggtctatctgagaaacacggcaaggtcccaggactagctgtagttattgttgggaaccgaaaggattcacagacctatgtgaatacgaagaggaaagcatgcgctgaggttgggattaagtcatttgatgtgggcctaccagaggaagtttctgaagctgatcttataagcaaagttcatgaactaaattctaatccggatgtccatggcatattagttcaactcccattgccgaaacatattaatgaggagaatgttttgggtgcaatcagcattgataaagatgtcgatggcttccatcctttgaatattggtaagctagccatgaaaggcagagaacccctcttccttccttgcaccccaaagggatgcttggaactcttagccagaagtggggtaaagataaaggggcaacgagcagttgttgtaggtcggagtaatatcgttggtttacctgtttcgcttctattgctcaaggctgatgctactgttacaactgtacattctcacaccaaggatcctgaggctttcatacgggaagctgacatcgttattgctgcttgcggacaagcccacatgattaagggcaactggataaagccaggggctgcggtaatcgatgttggaactaacgcagtcagcgacccaagcaagaaatcaggataccggttggttggagatgtcgattttgcagaagcttctaaagttgcaggtttcataactccggtccctggtggtgtaggcccaatgacagtcgcaatgcttctcaggaacaccgtagacggtgccaagcgtgtctttggcgagtaaaactttctactgtatgtaataaagaaaccagagtttctccattctgtaattgtgtacttggcttgatgattttccactcaaataaattgaaattggcgttccctttggattactttaggtcgttttgcaactagctagaatgattatttccccaaatcagtacaatatgagggtgctatcatgtgac

SEQ ID NO: 1267 - DNA, 1228 bp, Eutrema parvulum
ttaagtcttctcgtcatcttttgagtctttgactgtggatacactactactaagcagacaatcatactttccgatacaggcaacttccgactagctcatggcgtcacaatctgatcaaacggcgaagaaaatcgacggcaaggcaattgctgataccatccgatcagagatcgccgaggaagttcgtgatctatctgaaaaacacggcaaggtcccaggactagcggtagttatagttggggtacggaaagattcacagacttatgtgaatatgaagaggaaagcgtgtgctgaggttgggataaagtcatttgatgtggacctaccagaagatgtttgcgaagctgatcttataagcaaagttcatgaactaaattcggatccggatgtccacggtatattagttcaactcccattgccaaaacatattaatgaggagaatgttttgggtgcaatcagcattgataaagatgtagatggcttccatcctttgaacattggtaagctagccatgaaaggcagagaacccctcttccttccatgcaccccaaaggggtgtttggaactcttagtgagaagcggcataaagataaaggggcaacgagcagttgtagtaggtcggagtaacattgttggtttgcccgtttcacttctattgctcaaggctgatgctactgttacaactgtacattctcacaccaaggatcctgaggctatcataagggaagctgacatcgttattgctgcagccggacaagcctgcatgatcaagggaaactggataaagccaggggctgcagttattgatgttggaactaacgcagtcagcgaccagagcaggaaatctggataccggttggttggagatgtggattttgcagaagcttctaaagttgcaggtttcataactcctgtccctggtggtgtaggcccgatgacagtggcaatgctgctcaggaacaccttagacggtgccaagcgggtcattggccagtaagatgtcctacactatgtaataaaagaaactggagtttatccatttctataattgtgttctcggtttgatgaaattattcctctcaaataaattgaaatttgcattctctttaatctttgtttatatcccgcaaattaaattagtacacagcatgaggcttcgcatcattttaatcaaaaacatctgtattgattcaagataatgtacaatattcattttgaaaaatcttaa

SEQ ID NO: 1268 - DNA, 1271 bp, Eutrema halophilum
gtggagtgttctatttgcggatggattcagatttaagtcttgctcgtcatcattgactgtggatacacactacactaaccagagaaccagatatttcgacacaggcggattccgactagctcatggcgtcaccatctgatcaaacggcgaagattatcgacgggaaggcgattgctcatactatccgatcagagatcgccgaggaagttcgcgatctatctgaaaaacacggcaaggtcccaggactagcggtagttatagttggggtacggaaggattcacagacttatgtgaatatgaagaggaaagcgtgtgctgaggttgggataaagtcatttgatgtggacctaccagaggatgtttgtgaagctgatcttataaacaaagttcatgaactaaattcagatccggaagtccatggtatattagttcaactcccattgccaaaacatattaatgaggagaatgttttgggtgcaatcagtattgataaagatgtagatggcttccatcctttgaatattggtaagctagccatgaaaggcagagaacccctcttccttccatgcaccccaaagggatgtttggaactcttggtgagaagtggcataaagataaaggggcaacgagcagttgtagtaggtcggagtaacattgttggtttgcccgtttcacttctcttgctcaaagctgatgctactgttacaactgtacattctcacaccaaggatcctgagtctatcatacgggaagctgacatcgttattgctgcagccggacaagcctgcatgattaagggcgactggataaagccaggggctgcagtgatcgatgttggaactaacgcagtaagcgacccgagcaggaaatcaggataccggttggtcggagatgttgatttcgcagaggcttcgaaagtcgcaggtttcataactccggtccctggtggtgttggcccaatgacagtggcaatgctgctcaggaacaccttagacggcgccaagcgggtcattggccagtaaacatcccactgtatgtgtatgtaataaaaagactggagtttatcaaattcaatcaataattgtgtgtcttgatgacatttttcctcaaagataatgaaattcgcattccctttgaatgtttatttcccacaaatctgcacaacatgaggttggcatcattttactcaaaggcatgatgctgccattcgtatttttcttggctgcattgattcaagatcatgtaccatattcattgaaaatcttaagcgt

SEQ ID NO: 1269 - DNA, 989 bp, Brassica oleracea
tactgaccagataaagcagatacatggatggcgtcgtcaccatctgatcaaacggcgaagataatcgatggaaaggcggtcgctcacaccatccgatcagagatcgccgaggaagttcgccatttatctgagaaacacggcaaggtcccaggactagcggtggtcatagttgggttacggaaagattcacagacttacgtgaacatgaagaggaaagcgtgcgctgaggttgggatcaagtcattcgatgttgacttacctgaggatgttcctgaagctgatcttataaccaaagttcatgaactaaactcagatcctcaagtccatggtatattagttcaactcccattgcctaaacatatcaacgaggagaatgttttgggtgcaatcagcattgataaagacgtagacggcttccatcctttgaatattggtaagctagctatgaaaggcagagagcccctcttccttccatgcaccccaaagggttgtttggagcttttggtgagaagtggaataaagataaagggccaacgagcagttgtagtaggtcggagtaacattgttggtttgcctgtttcgcttctactgctcaaggctgatgctactgtcacaaccgtacattctcacaccaaagatcctgaggctatcataaaggaagctgacatcgttattgctgcagctggacaagcctgcatgattaagggagactggataaagccaggggctgcagtgatcgacgttggaactaacgcagtcagcgacccgagtaggaaatcaggataccgtttggttggtgatgttgattttgcagaagcttctaaagttgcagggttcattactcctgtccctggtggtgtaggcccaatgacagtggcaatgctgctcagaaacaccttagacggcgccaagcgggtcattggccagtaaaacatccttctgtttgtaatctaagatacatttctataattgtgttctctgcttgatga

SEQ ID NO: 1270 - DNA, 1095 bp, Brassica rapa
atcctattcgcggatagattcgaattcagatttaaaattaaaagtgtgctcgtcgtcatctttcgacagtggatagcgtttggttacatggcgtcgtcaccatctgatcaaacggcgaagataatcgatggaaaggcggttgctcacaccatccgatcagagatcgccgaggaagttcgccatttatctgagaaacacggcaaggtcccaggactagcggtggtcatagtaggaggaaggaaagattcacagacttacgtgaacatgaagaggaaagcgtgcgctgaggttgggatcaagtcattcgatgttgacttacctgaggatgttcctgaagctgatctcataaccaaagttcatgaactaaactcggatcctcaagtccatggtatattagttcaactcccattgcctaaacatatcaacgaggagaatgttttgggtgcaatcagcattgataaagacgtagacggcttccatcctttgaatattggtaagctagctatgaaaggcagagagcccctcttccttccatgcacccctaagggatgtttggagctcttagtgagaagtggaataaagataaagggccaacgagcggttgtggtcggtcggagtaacattgttggtttgcctgtttcgcttctactgctcaaggctgatgctactgtcacaaccgtacattctcacaccaaagatcctgaggctatcataaaggaagctgacatcgttattgctgcagctggacaagcctgcatgattaagggagactggataaagccaggggctgcagtgatcgacgttggaactaacgcagtcagcgatccgagtagaaaatcaggataccgtttggttggagatgttgagtttgcagaagcttctaaagttgcagggttcattactccggtccctggtggtgtaggtccaatgacggtggcaatgctgctcaggaacaccttagacggcgccaagcgggtcattggccagtaaaacatccttctgtttgtaatctaagatacatttctataattgtgttctctgcttgatgacattgtccctctcaaataaaatttaaaatttgcattccatttgaat

SEQ ID NO: 1271 - DNA, 978 bp, Brassica napus
gcgtttggttacatggcgtcgtcaccatctgatcaaacggcgaagataatcgatggaaaggcggttgctcacaccatccgatcagagatcgccgaggaagttcgccatttatctgagaaacacggcaaggtcccaggactagcggtggtcatagtaggagtacggaaagattcacagacttacgtgaacatgaagaggaaagcgtgcgctgaggttgggatcaagtcattcgatgttgacttacctgaggatgttcctgaagctgatctcataaccaaagttcatgaactaaactcggatcctcaagtccatggtatattagttcaactcccattgcctaaacatatcaacgaggagaatgttttgggtgcaatcagcattgataaagacgtagacggcttccatcctttgaatattggtaagctagctatgaaaggcagagagcccctcttccttccatgcacccctaagggatgtttggagctcttagtgagaagtggaataaagataaagggccaacgagcggttgtggtcggtcggagtaacattgttggtttgcctgtttcgcttctactgctcaaggctgatgctactgtcacaaccgtacattctcacaccaaagatcctgaggctatcataaaggaagctgacatcgttattgctgcagctggacaagcctgcatgattaagggagactggataaagccaggggctgcagtgatcgacgttggaactaacgcagtcagcgatccgagtagaaaatcaggataccgtttggttggagatgttgagtttgcagaagcttctaaagttgcagggttcattactccggtccctggtggtgtaggtccaatgacggtggcaatgctgctcaggaacaccttagacggcgccaagcgggtcattggccagtaaaacatccttctgtttgtaatctaagatacatttctataattgtgttctctgcttgatgacatt

SEQ ID NO: 1272 - DNA, 1029 bp, Brassica oleracea
acactgtcacacctaaccagagactcagattttattttttttcccaaacaagcttcatggcttcatctgatcaaacggcgaagataatcgatggaaaggcgattgctcataccatccgatcagagatcgccgaggaagttcgcgatctatctgagaaacacggcaaggtcccaggactagcggtggttatagttggtgcacggaaagattcacaaacttatgtgaatatgaagaggaaagcgtgtgctgaggttgggatcaaatcagttgacgtggacctaccagaggatgtttctgaagctgatcttatcagcaaagttcatcaactcaattcagatcctgatgtccacggtatattagttcaactcccgttgccgaaacatatcaatgaggagaatgttttaagtgcaatcagcattgataaagatgtagatggcttccatcctctgaatattggtaagctagccatgaaaggcagagagcccctcttccttccctgcaccccaaagggatgtttggaactcttaaagagaagtggcgtaaagataaaagggcaacgagcagttgtagtaggtcgcagcaacattgttggattacctgtttcgcttctattgctcaaggctgatgctactgttacaaccgtacattctcacaccaaagatcctgaggctatcatacgcgaagctgacatcgttattgctgcagccggacaagcctgcatgattaagagcgactggattaagccaggtgctgcggtgatcgatgttggaactaatgcagtgagcgacccgagcaggaagtcaggataccggttggttggagatgttgattacgcagaagcttgtaaagttgcaggttgcataactcctgtccctggtggtgtaggtccaatgacagtggcgatgctgctgaggaacaccttagacggtgccaagcgggtcattggccagtaaaataatatcctactgtatttttataaatgaatctgaagtttcatacattttataattacgctctcggtttgatgac

SEQ ID NO: 1273 - DNA, 1077 bp, Brassica oleracea
gggatgatacactgtcacacctaaccagagactcagatttttattttttttccaaacaagctttcatggcttcatctgatcaaacggcgaagataatcgatggaaaggcgattgctcataccatccgatcagagatcgccgaggaagttcgcgatctatctgagaaacacggcaaggtcccaggactagcggtggttatagttggtgtacggaaggattcacaaacttatgtgaatatgaagaggaaagcgtgtgctgaggttgggatcaaatcagttgacgtggacctaccagaggatgtttctgaagctgatcttatcagcaaagttcatcaactcaattcagatcctgatgtccacggtatattagttcaactcccgttgccgaaacatatcaatgaggagaatgttttaagtgcaatcagcattgataaggatgtagatggcttccatcctctgaatattggtaagctagccatgaaaggtagagagcccctcttccttccatgcacacctaagggatgtttggaactcttaaagagaagtggcgtaaagataaaagggcaacgagcagttgtagtaggtcgcagcaacattgttggattacctgtttcgcttctattgctcaaggctgatgctactgttacaaccgtacattctcacaccaaagatcctgaggctatcatacgcgaagctgacatcgttattgctgcagccggacaagcctgcatgattaagagcgactggattaagccaggtgctgcggtgatcgatgttggaactaatgcagtgagcgacccgagcaggaagtcaggataccggttggttggagatgttgattacgcagaagcttgtaaagttgcaggttgcataactcctgtccctggtggtgtaggtccaatgacagtggcgatgctgctgaggaacaccttagacggtgccaagcgggtcattggccagtaaaataatatcctactgtatttttataaatgaatctgaagtttcatacattttataattacgctctcggtttgacgacattgttcctgcaaataaagtgaagcttgcatgtcctttg

SEQ ID NO: 1274 - DNA, 1058 bp, Brassica napus
gccacacctaaccagagactcagatttttttatttttcccaaacaagcttcatggcttcatctgatcaaacggcgaagataatcgatggaaaggcgattgctcataccatccgatcagagatcgccgaggaagttcgcgatctatctgagaaacacggcaaggtcccaggactagcggtggttatagttggtgtacggaaggattcacaaacttatgtgaatatgaagaggaaagcgtgtgctgaggttgggatcaaatcagttgacgtggacctaccagaggatgtttctgaagctgatcttatcagcaaagttcatcaactaaattcagatcctgatgtccacggtatattagttcaactcccgttgccgaaacatatcaatgaggagaatgttttaagtgcaatcagcattgataaagatgtagatggcttccatcctctgaatattggtaagctagccatgaaaggcagagagcccctcttccttccatgcaccccaaagggatgtttggaactcttaaagagaagtggcgtaaagataaaagggcaacgagcagttgtagtaggtcgcagcaacattgttggattacctgtttcgcttctattgctcaaggctgatgctactgttacaaccgtacattctcacaccaaagatcctgaggctatcatacgcgaagctgacatcgttattgctgcagccggacaagcctgcatgattaagagcgactggattaagccaggtgctgcggtgatcgatgttggaactaatgcagtgagcgacccgagcaggaagtcaggataccggttggttggagatgttgattacgcagaagcttgtaaagttgcaggttgcataactcctgtccctggtggtgtaggtccaatgacagtggcgatgctgctgaggaacaccttagacggtgccaagcgggtcattggccagtaaaataatatcctactgtatttttataaatgaatctgaagtttcatacattttataattacgctctcggtttgatgacattgttccttgcaaataaagtgaagcttgcatgt

SEQ ID NO: 1275 - DNA, 1254 bp, Brassica juncea
cacacctaaccagagactcagattcttatttttaccaaaacaagctcatggcatcaccatctgatcaaacggcgaagataatcgatggaaaggcgattgctcataccatccgatcagagatcgccgaggaagttcgcgatctctctgagaaacacggcaaggtcccaggactagcggtagttatagttggggcacggaaagattcacagacttatgtgactatgaagaggaaagcgtgtgctgaggttgggatcaaatcagttgatgtggacctacctgaggatgtttctgaagctgatcttatcagcaaagttcatgagctaaattcagatcctgatgtccatggtatattagttcaactcccattgccgaaacatatcaatgaggagaatgttttaagtgcaatcagcattgataaagatgtagatggcttccatcctcttaatattggtaagctagccatgaaaggcagagagcccctcttccttccctgcaccccaaagggatgtttggaactcttaaagagaagtggcgtaaagataaaagggcaacgagcagttgtagtaggtcggagtaatatcgttggattacctgtttcgcttctattgctcaaggctgatgctactgttacaaccgtacattctcacaccaaagatcctgaggctatcatacgcgaagctgacatcgttattgctgcagccggacaagcctgcatgattaagagggagtggattaagccaggggctgcggtaatcgatgttggaaccaatgcagtgagcgacacgagcaggaagtcaggataccgtttggttggagatgtggattacgcagaagcttgtaaagttgcaggttgcataactccggtccctggtggtgtaggtccaatgacagtggcaatgctgctcaggaacaccttagacggtgccaagcgggtcattggccagtaaaatatcctttctgtatgtaatctaaggtacatttctataattgtgttctcggctttgatggcaaattcctaataccatggatgctacaagccatcctgaacctcccacctaagatgctttaggtctatctaaagtagtttccaagacaacggcagaaacacactcatgctttctgcactgggagatagagtttgaactccggaggaagctcttcatctgagtagagacgttcagcaaaataaatccttctgagacggcagttagcatgaacctgaactcgcaacattccatccctcatccatcttca

SEQ ID NO: 1276 - DNA, 1253 bp, Brassica rapa
atggatttagattcaataaagtctgcttcgttatcatttgactgtggatagtggatgataacactgtcacacctaaccagagactcagattttatttttcccttatggcttcatctgatcaaacggcgaagataatcgatggaaaggcgattgctcataccatccgattagagatcgccgaggaagttcgcgatctatctgagaaacacggcaaggtcccaggactagcggtagttatagttggtgcacggaaagattcgcagacttatgttactatgaagaggaaagcgtgtgctgaggttgggatcaaatcagttgatgtggacctaccagaggatgtttctgaagctgatcttatcagcaaagttcatcaactcaattcagatcctgatgtccatggtatattagttcaactcccattgccgaaacatatcaatgaggagaatgttttaagtgcaatcagcattgataaagatgtagatggcttccatcctcttaatattggtaagctagccatgaaaggcagagagcccctcttccttccctgcaccccaaagggatgtttggaactcttaaagagaagtggcgtaaagataaaagggcaacgagcagttgtagtaggtcggagtaatatcgttggattacctgtttcgcttctattgctcaaggctgatgctactgttacaaccgtacattctcacaccaaagatcctgaggctatcatacgcgaagctgacatcgttattgctgcagccggacaagcctgcatgattaagagcgactggattaagccaggggctgcggtgatcgatgttggaaccaatgcagtgagcgacccgagcaggaagtcaggataccggttggttggagatgtggattacgctgaagcttgtaaagttgctggttgcataactcctgttcctggtggtgtaggtccaatgacagtggcgatgctgctgaggaacaccttagacggtgccaagcgggtcattggccagtaaaataatattctactgtaatatataaatgaatctgaagtttatccattttataacggtttgatgacattgttcctcgcaaataaagtgaagcttgcatgtcctttaaatgtttgcttcccgcaaatttgtacacaacatgaggtttagcatcagtatgatcaaaacctggctttgataccatttacattggtaatttaaacgattttaattttgttatttatcaactttgaaaacgaaattgtaaaaatgtat

SEQ ID NO: 1277 - DNA, 1123 bp, Brassica napus
tcagtttagattcaataaagtctgcttcgttatcatttgactgtggatagtggatgataacactgtcacacctaaccagagactcagattttatttttccctcatggcttcatctgatcaaactgcgaagataatcgatggaaaggcgattgctcataccatccgattagagatcgccgaggaagttcgcgatctatctgagaaacacggcaaggtcccaggactagcggtagttatagttggtgcacggaaagattcgcagacttatgttactatgaagaggaaagcgtgtgctgaggttgggatcaaatcagttgacgtggacctaccagaggatgtttctgaagctgatcttatcagcaaagttcatcaactcaattcagatcctgatgtccacggtatattagttcaactcccattgccgaaacatatcaatgaggagaatgttttaagtgcaatcagcattgataaagatgtagatggcttccatcctctgaatattggtaagctggccatgaaaggcagagagccccttttccttccctgcaccccaaagggatgtttggaactcttaaagagaagtggcgtaaagataaaagggcaacgagcagttgtagtaggtcggagtaatatcgttggattacctgtttcgcttctattgctcaaggctgatgctactgttacaaccgtacattctcacaccaaagatcctgaggctatcatacgcgaagctgacatcgttattgctgcagccggacaagcctgcatgattaagagcgactggattaagccaggggctgcggtgatcgatgttggaaccaatgcagtgagcgacccgagcaggaagtcaggataccggttggttggagatgtggattacgctgaagcttgtaaagttgctggttgcataactcctgttcctggtggtgtaggtccaatgacagtggcgatgctgctgaggaacaccttagacggtgccaagcgggtcattggccagtaaaataatattctactgtaatttataaatgaatctgaagtttatccattttataacggtttgatgacattgttcctcgcaaataaagtgaagcctgcatgtcctttgaatgtttgcttcccgcaa

SEQ ID NO: 1278 - DNA, 1039 bp, Brassica oleracea
ggatatacacacactactgaccagataaagcagatacatggatggcgtcgtcaccatctgatcaaacggcggagataatcgatgggaaggcggtcgctcacaccatccgatcagagatcgccgtggaagttcgccatttatctgagaaacacggcaaggtcccaggactagcggtggtcatagttgggttacggaaagattcacagacttacgtgaacatgaagaggaaagcttgcgctgaggttgggatcaagtcattcgatgttgacttacctgaggatgttcctgaagctgatcttataaccaaagttcatgaactaaactcagatcctcaagtccatggtatattggttcagctcccgttgccgaaacatatcaacgaggagaatgttctgggtgcaatcagcattgataaagacgtagacggcttccatcctttgaatattggtaagctagctatgaaaggtagagagcccctcttccttccatgcaccccaaagggtagtttggagcttttggtgagaagtggaataaagataaaggggcaacgagcagttgtagtaggtcggagtaacattgttggtttgcctgtttcgcttctactgctcaaggctgatgctactgtcacaactgtacattctcacaccaaggatcctgaggctatcataaaagaagctgacatcgttattgctgcagctggacaagcctgcatgattaagggagactggataaagccaggggctgcagtgatcgatgtgggaactaacgcggtcagcgacccgtgtaggaaatcaggataccgtttggttggtgatgttgattttgcagaagcttctaaagtcgcagggttcattactcctgtccctggtggtgtaggcccaatgacagtggctatgctgctcagaaacaccttagacggcgccaagcgggtcattggccagtaaactatcttttctgtatgtaatctatgatacatttctataattgtgttctctgcttgatgacattatccctctcaaataaaatttaaaatttgcat

SEQ ID NO: 1279 - DNA, 1119 bp, Raphanus sativus
gagttgtactgaccagatatagacagcgagattccgcccacatggcctcaacatctgatcaaacggcgaagataatcgatggaaaggcgattgctcataccatccgatcagagatcgccgaggaagttcgccttttatctgagaaacacggcaaggtcccaggactagcggtcgtcatagttggtgtccggaaagattcacagacttatgtgaatatgaagaggaaagcatgtgctgaggttgggatcaagtcatttgatgttgacctacccgacgatgttcctgaagctgaccttatcaccaaagttcatcaactcaattcagatccccaagtccatggtatattagttcaactcccattgccgaaacatatcaatgaggagaacgttctgggtgctatcagcattgataaagacgttgatggattccatcctttgaatattggtaagctagccatgaaaggcagagaacccctcttccttccatgcacccctaagggatgtttggagctcttggtgaggagtggcataaagataaaggggcaacgagcagttgtagtaggtcggagtaacattgttggtttgcccgtttcacttctattgctcaaggctgatgctactgttactactgtacattctcacaccaacgatcccgaggctatcatacccgaagctgacatcgttattgctgcagctggacaggcctgcatgatcaagggagactggataaagccaggggctgcagtgatcgacgttggaactaacgcagtcagcgacccgagcaggaaatctggataccggttggttggagatgttgatttcgccgaagcttctaaagttgcaggcttcataactccggtccctggtggtgtaggcccaatgacagtggcaatgctgctcaagaacaccttagaaggggccaagcgggtcattggccagtaaaacatccctctgtatgttataaaaagatcctgcagtttacccattatctataattgtgtttcggcttgatgtggcattactcctctcaaataaatttgaattcgcattccatttgaattttttttggctgcattgattcaagatcatgtacaatatttattgaaaaattttaagcgta

SEQ ID NO: 1280 - DNA, 1193 bp, Raphanus sativus
ggaataaaagtctgctccttttatcatcatcgaccgtggatagtggatgatacactgtgtcacactcacacctaacaaaagctcatggcttcatctgatcaaacggcgaagataatcgatgggaaggcgattgctcaaaccatccgatcagagatcgccgaggaagttcgcgatctatctgagaaacacggcaaggtcccaggactagcggtagttatagttggggcacggaaagattcacagacatatgtgactatgaagaggaaagcgtgtgctgaggttgggatcaaatcatttgatgtggacctaccagaggatgtttctgaagctgatcttataaccaaagttcatctactcaattcagatcctgatgtccatggtatattagttcaactcccattgccgaaacatattaatgaggagaatgttttaagtgcaatcagcattgataaagatgtagatggcttccatcctctgaatattggtaagcttgccatgaaaggcagagaacccctcttccttccatgcacccctaagggatgtttggaactcttagtaagaagtggcataaagataaaagggcaacgagctgttgtagtaggtcggagtaacatcgttggattgcctgtttcgcttctattgctcaaggctgatgctactgttaccactgtacattcccacaccagagatcctgaggctatcatacgggaagctgacatcgttattgctgcagccggacaaccctgcatgattaagggggactggattaagccaggggctgcggtgatcgatgttggaaccaatgcagtcagcgaccccagcaggaaatcaggataccggttggttggagatgtggattacgcagaggcttgtaaagttgcagggttcataactccggtccctggtggtgtaggtccaatgaccgtggcaatgctgctgaggaacaccttagacggcgccaagcgggtcatcggccaataagatatctatcctactgtatgttaaaaaatgaatctgaagtttatccattatataattacgctctcgctttgattacattattcctctcaaataaattgaagcttgcatgtcttttggaatgtctgtttcccacaaatttgtacacaacatgaggcttagcatcattttaacaaaataaaaaacatctgtattttccttgccaaaaaaaaaaa

SEQ ID NO: 1281 - DNA, 966 bp, Brassica napus
caccatctgatcaaacggcggagataatcgatgggaaggcggtcgctcacaccatccgatcagagatcgccgtggaagttcgccatttatctgagaaacacggcaaggtcccaggactagcggtggtcatagttgggttacggaaagattcacagacttacgtgaacatgaagaggaaagcttgcgctgaggttgggatcaagtcattcgatgttgacttacctgaggatgttcctgaagctgatcttataaccaaagttcatgaactaaactcagatcctcaagtccatggtatattggttcagctcccgttgccgaaacatatcaacgaggagaatgttctgggtgcaatcagcattgataaagacgtagacggcttccatcctttgaatattggtaagctagctatgaaaggtagagagcccctcttccttccatgcaccccaaagggtagtttggagcttttggtgagaagtggaataaagataaaggggcaacgagcagttgtagtaggtcggagtaacattgttggtttgcctgtttcgcttctactgctcaaggctgatgctactgtcacaactgtacattctcacaccaaggatcctgaggctatcataaaagaagctgacatcgttattgctgcagctggacaagcctgcatgattaagggagactggataaagccaggggctgcagtgatcgatgtgggaactaacgcggtcagcgacccgtgtaggaaatcaggataccgtttggttggtgatgttgattttgcagaagcttctaaagtcgcagggttcattactcctgtccctggtggtgtaggcccaatgacagtggctatgctgctcagaaacaccttagacggcgccaagcgggtcattggccagtaaactatcttttctgtatgtaatctatgatacatttctataattgtgttctctgcttgatgacattatccctcac

SEQ ID NO: 1282 - DNA, 938 bp, Brassica napus
catctgatcaaacggcgaagataatcgatggaaaggcggtcgctcacaccatccgatcagagatcgccgacgaagttcgccatttatctgagaaacacggcaaggtcccaggactagcggtggtgatagttgggttacggaaagattcacagacttacgtgaacatgaagaggaaagcgtgtgctgaggttgggatcaagtcattcgatgttgacttacctgaggatgttcctgaagctgatctcataaccaaagttcatgaactaaactcggatcctcaagtccatggtatattagttcaactcccattgcctaaacatatcaacgaggagaatgttttgggtgcaatcagcattgataaagacgtagacggctccatccttgaatatggtaagctagctatgaaaggcagagagcccctcttccttccatgcacccctaagggatgtttggagctcttggtgagaagtggcataaagataaaagggcaaagagcagttgtagtaggtcggagtaacattgttggtttgtcctgtttcgcttctactgctcaaggctgatgctactgtcacaactgtacattctcacaccaaagatcctgaagctatcataaaagaagctgacatcgttattgctgcagctggacaagcctgcatgattaagggagactggataaagccaggggctgcagtgatcgatgtgggaactaacgcggtcagcgacccgtgtaggaaatcaggataccgtttggttggtgatgttgattttgcagaagcttctaaagtcgcagggttcattactcctgtccctggtggtgtaggcccaatgacagtggctatgctgctcagaaacaccttagacggcgccaagcgggtcattggccagtaaactatcttttctgtatgtaatctatgatacatttctataattgtgttctc

SEQ ID NO: 1283 - DNA, 1129 bp, Cleome gynandra
tcggggcaaaagaatcagagtatcatactgtcactggataatttctataggctctcatggcgtcagcgatggatcaaactgcgaagataatcgatgggaaggcgattgctgaggcgattcggttggaaatcgccggcgaagttcgatgtctgtcggagaaacatggcaaggttccaggactggctgtagtcatagtcgggagccggaaggattcacaaagctacgtgagaatgaagaggaaagcatgtgtagaggttgggattaagtcaattgatgtagacctaccggaggaagtatctgaagcagatctcataagcaaagttcacgagttaaattcaaacccagatgtgcatgggatattagttcaactcccattaccaaagcatattaatgaagagaatgttttaggtgcaattgtcattgagaaagatgtagatggtttccacccattgaatattggtaagcttgccatgaaaggcagagaacctctcttccttccttgcaccccaaagggatgtctggaactcttaataagaagcggcataaagataaagggtcaacgagcagttgttgtaggtcggagtaatatagtcggattgcccgtttccctgctactgctcaaggcagatgctactgttacagttgtacactctcacactcaagatagcgagaggattatacgagaagcagatataattattgctgcagcgggtcaagcagccatgattaagggcagctggataaagcccggggctgcagtcattgatgtcggaactaacgcggttgatgacccaagcaagaaagcgggatacaggttggtgggagatgtggattacaaagaagcgtgtaaagtcgcgggttgcataacaccagtgcccggaggtgtaggccccatgacagtggcaatgctgctcaagaacaccttggacggtgccaagcgagtcgtgggtgagtgaaacacggttgtgtaacctctctttctatataataagtggcggatgcagtcaattttctcaaccttatttgtccgtcaatgacattttcttcaagaaattgcttttacctttgaatactctattgaattaaatacttatgtgcacactttgatcaacccttctccaatgaactc

SEQ ID NO: 1284 - DNA, 1234 bp, Citrus clementina
  Sequence also found in Organisms: Citrus sinensis
ccaggtttaaccctgcgacaagcccgcccctcacaacgggcccggatgagataactcgcacagtatgtctgcggctgcgcggttggtaaacgccagcctacgagaagggtgagtgagcaattaattagagttatcaaatctctagttctagaataatggcggcaccgtcagatcagaaggccaccataatcgacggcaaagccgtcgctcagaccatccgatctgaaatcgcagaagaagtccgcctcctttctgaaaaatatggcaaggtgcctggactggcagtagtaatagtgggtggcagaaaagactctcaaagctatgtgagcatgaagagaaaggcttgtgctgaagttgggattaagtcgtttgacatagacctccccgagcaagtctccgaggccgagcttatcagcaaggttcacgagcttaacgtaatgcctgatgtacatggtatattggttcaacttccattgccgaagcatataaatgaagagaaagttttaggtgagataagccttgagaaggatgttgatggctttcatcctttgaacattggcaagctcgcaatgaaaggcagagaccccctcttccttccttgcacgcccaagggatgccttgaacttctgaaacgaagtggtgttactataaagggtaaaagggctgttgtggtgggtcgaagtaacattgttggactcccagtttcattgctgctgctgaaagctgatgccactgtaaccatagtccattcacataccactgatcctgaaagtatcgttcgtgaagctgacattgttattgctgcagccggacaagcaatgatgatcaagggaagttggatcaagcctggtgccgctgttattgatgttggaacaaatgctgtcgatgactcgaccaagaagtcaggctataggttagtgggagatgtggatttccatgaagcgtgtaaagtagctggatgtgtaactcctgttccaggtggtgtgggcccaatgactgttgctatgctactcaggaataccttggatggtgcaaagcgtgtgatcgagctgtaaaaccgccctcgtctttgttcttgacttcattgtaattcatgagacggtactcattctcctttggttttgtttgaaaacatttttatttatcatggttaataatttataatacatgtgaagatggttcatgagtttatcaatgaaaaaaacagttcatcgcatgttgcgccattgcctca

SEQ ID NO: 1285 - DNA, 1223 bp, Tabernaemontana elegans
agagggtagctaattttcgtttcgactacgatggcgtcgccgccggatcacaaagccaccattatcgacggtaaagcaatagcccaaacaatcagatctgagattgcctccgacgtgcgtctactctcccagaaatacggcaaggtacctgggttggctgtagtgattgtaggtaataggaaggactctcaaagctatgtgaatatgaagaggaaggcatgtgctgaagttgggatcaagtcttttgacgtagacctcccagaggaggtgtctgaagctgacttgatccacaaggtccatgagttgaatacaaatcctgatgtccacggtatattggtccagcttccacttccaaaacatataaatgaagagaaagtattgggtgaaattagcttggacaaggatgttgatggatttcaccctttgaacattggaaagcttgcaatgaaaggcagagaacctctattccttccttgcacccccaagggctgtcttgagcttctgtcacggaatggggttaccataaggggcaagaaagcggctgtggtgggcagaagtaacatagttggattaccggtggctctactacttctcaaggaagatgctactgtcactattgtgcattctcgtactaaggaacctgagagtattattcgtgaagctgacattgtaatagctgcggcaggacaagcaatgatgattaagggcagctggatcaaacctggtgctgctgttattgacgtggggacgaatgcagttgatgatccgacaaagaaatctggttacaggctggttggagatgttgatttccatgaagcatgtaaagtagctggatgcataactccagttcctggtggtgttggtccaatgaccgttgcaatgctgctgaagaacacgttagatggcgctaaacgtgtgattgagcagtgatttctatttcagatttttcacataaagccatgtcaatctttgaaattttgaaataaataaaacaacaaagttctcatgtacgtgtcaataaatttttaaggttctacttggtggtggaaatcagaatttatcttcctcttttgaagaggatttgagcgtcacgaggagcattgcctgatgtataggttagtgttgtctgttgtatcctctaggataattacgtaacgctagtttcttcattttgtttcatgattttctggcttctactttcctcttgtttgattttgtttcat

SEQ ID NO: 1286 - DNA, 1298 bp, Eucalyptus grandis
gggcggctctgatctaatctcgtctcggctccagaaaactggcaccacccgcgtcagaagaactccatctcggtgatcctggggagtgaagcagagaatattggaagacagtgatggcatcatcgcttccctctgatcacaaagcccaaatcatcgatggaaaagccattgctcagaccattcgatcagaaattgcctctgaagttagccacctatctcagaagtatggcaaggttcctggacttgctgtggtgatagttggtaccaggaaggattctcaaagctacgtaagtatgaagagaaaggcgtgtgctgaagttggtattacatcattcgatgtagatttgcctgagcaagtatctgaggctgacttgattgacaaggtccacgagttaaatgcaaaccctgatgtacatggtatactggttcagcttcctttgccaaagcatataaatgaagagaaagtcttgggtgcaatcagtatcgagaaagatgttgatggttttcatcctctaaacattggaaagttggccatgaaagggagagaacctttgtttcttccgtgcacacctaagggatgcctcgaactcctctcacgtagtggaattagtacgaagggaaagaaggctgttgtggtcggacgaagtaacatagttgggttaccagtatccttgttgcttctgaaggcagatgctactgttactgtagtccattcgcacactcccaatccagaatctatcattcgtgaagcagacataattattgctgcagcgggacaagcaatgatgatcaagggtagctggatcaaaccaggtgctgcagtcattgatgtaggaactaacgccgttgatgatcccagtaagaaaacgggctacaggttagtaggagatgtgcattttggggaagctagcaaggtagcgggacacataacgcccgtaccaggtggtgtgggcccgatgactgtcgcgatgctattgaagaatactcttgagggcgctaagcgtgaaattgagaaatgaagatccggtgctcaaaattgtatgaccctgggcagagctgtaacttctgtgtaatgctgagtatatttttgtttgttgccacagtaatcatgctgtagtttgtttccttgataacatcataaacccaatcttcatattggtggtccttaaagaattactaacaatgccataaacgtagtttaaatttgcggacagtgtaaagcctattctttaatcaagtagggaggaactgccaggctttttaattttactttcaataagcacatctattgacaccgt

SEQ ID NO: 1287 - DNA, 1296 bp, Theobroma cacao
gcgggcgggtcatcctccagcccgagaggcacaatccaatatgccaagtgtcagcagctgccgcaccttaacccgagcgcctgcgttaaagtgattgcaacgcttctacgaatcgtcgtctccgtgccaatcatacactgctcttctcctccgcaatctatcacccaaatggcctcgccatctgatcacaaagccaccattatcgacggcaaagccatcgctcaaactatcagatccgaaatcgctgacgaggtgcagcacctcttccaaaaatacggcaaggtgccaggcctagccgtggtaattgttgggggcagaaaagattctcaaagctatgtggggatgaaaagaaaagcgtgtgctgaagttgggattaagtcttttgatgtggacctccctgaggaagtacccgaatccgagttgatcagcaaggttcacgagttaaatgcaaatcgggatgtacatggtatattggttcagctccccttaccaaagcatataaacgaagagaaagttttgagtgaaattagccttgcgaaagatgtggatggttttcatcctctgaatattggcaaacttgcaatgaaaggccgagaacccctttttcagccttgtactcccaagggatgccttgaactgctagcacgcagtggtataagcataaagggaaaaaatgctgttgttgtgggtcgaagtaacatagttggattgcctgtttcattgctgctgctgaaggcagatgctactgttaccattgttcattcacgtacgccggatccggaaaggctagttcgtgaagctgacattataattgctgcagcaggacaggctatgatgatcaaaggcagttggatcaaacctggtgctgcagttattgatgttgggactaatgctgttgatgacccaagtaagaagtcaggatataggttagtgggagatgtggatttccacgaagcatgtaaggtggctggatggataactcctgttcctggtggtgtgggcccaatgaccgttgcaatgctgctcaggaatacgttagatggagcaaagcgtgtgattgagcagtgactggtgaggttctctcatctcattgttgtgtacttcataataagatttgctcagttttaacctctgagccagatctctgacttcatagggaaaaaaaaaaaattttgtaagtatagagatatcgttgtctccctcccatactcgaagtgtggtatatttgttattattgccaaattctgaaaacaagttgaactgcaatttcaagtactttacagagcaggtttcata

SEQ ID NO: 1288 - DNA, 1332 bp, Catharanthus roseus
gataaggtggaaaacgtttttcagataatctgtttccttagttttttgacataaaaaacaacgggcggcatccacaagtccgcttcgagttattatccttagttgagaactatggcgtcgccgcccgatcagaaagccaccattatcgacggcaaagcaattgcccaaactataagatctgaaatcgcctccgaagtccggctactctccgagaaatacagcaaggtaccggggctggcagtagtgattgtaggtaataggaaggactctcaaagttatgtgagtatgaagaggaaggcatgcgctgaggttggtattaagtctttcgacatagacctcccagaggaggtgtccgaagctgacctgatccataaggtccatgagttgaatgcaaatcctgatgtacacggtatattggttcagcttccacttccaaagcacataaatgaagagaatgtattgggggaaattagcttggagaaggatgttgatggatttcaccctctgaacattggaaagcttgcaatgaaaggcagagaacccctataccttccttgcacccccaagggttgtcttgagcttcttttccggagtgggattacaataaagggcaagaaggcagttgtggtaggtagaagtaacatagttggtttaccagtttctctactactactcaaggaagatgctactgtcactgtggtgcattcccgaactaaggaccctgagagtatcattcgtgaagcggacattgttattgctgcagcaggccaggcaatgatgataaagggcagttggatcaaacctgatgctgctgttatcgacgtggggacaaatgctgttgatgacccaacgagaaaatcaggttacaggctggtcggagatgttgatttcaaggaagcatgtaaagtagctggatacataactccagtaccaggtggtgttggtccgatgactgttgcaatgctactgaagaacacactggatggagctaggcgtgtgatcgagcagtgatttctatttcagatcataaagcattgtcaattttttgaagttgtgtcgtaactaaaagggttcttatgtatgtgccaataaaatttcaaggttcttcttggcctgggctatctaaacttattttctatctaaacttattttcatcttttcatgatgatttgagcttcaggagtagcattgcctaatgtaggtcatgttttatccgtcctatcctctgggtctaggatgaaattacttgagtggggtctacggtttttcatatttcttggtactaattctgtagtcttagaactaattgagttatgtttctgcgttttttca

SEQ ID NO: 1289 - DNA, 1018 bp, Heritiera littoralis
tgggcgaatcgttgttgcgaaatcatagaccgctcttctccaccgcaaatcggcaatctatcatccgaatggcgtcgccatctgaccacaaagccacgattattgacggcaaagccatcgctcagactgtcagatctgaaattgcggacgaggtgcgccaactctctcagaaatacggcaaggtgccagggttagccgtggtaattgtggggaacaggaaagattctcaaagctatgtgggaatgaagagacaagcgtgtgctgaagttgggattaagtcttttgatgtggacctccctgaggaagtccccgagcctgagctaatcagcaaggttcacgatttaaatgcaaatcctgatgtacatggtatattggttcagctccccttaccaaagcatataaatgaagagaaagttttgagtgcaatcagtcttgagaaagatgtggatggttttcatcctctgaatattggcaaacttgcaatgaaaggccgagaaccccttttccatccttgtactcccaaggggtgccttgaactgctatcacgaagtggtataagcataaaaggaaaaaaggctgttgttgtgggcagaagtaatatagttggattgcctgtttcattgctgctgctgaaggcagatgctactgttagcattgttcattcacatacgccggatcctgaaacattaattcatgaagctgacattgttattgctgcagcaggacaacctatgatgatcaaaggcagttggattaaacctggtgctgcagttattgatgttggaactaatgctgttgatgatccaaccaagaagtcaggatataggttagtgggagatgtggatttccaagaagcatgtaaggttgctggatggataactcctgttcctggtggcgtcggcccaatgaccgttgcaatgctgctcaggaataccgtagacggtgcgaagcgtgtgattgagaagtgaggttctctcattttatcattgtttacatcgtaataagatatcctcacttt

SEQ ID NO: 1290 - DNA, 1098 bp, Euphorbia esula
gagtagttagagagagttcagcgctgcctgcaattcttatcgtctctatctatctagtcgtatctccccaaaccaaataatggcgtcaccgtcagatcacaaggccaccataatcgacggtaaggccatagcccagaccatccgatctgaaatcgccaacgaagtccgtcaactctctcagaaatacggcaaggttccaggattggctgttgtgattgtagggaatagaaaggattctcaaagctatgtaaatatgaaaagaaaggcatgtgcagaggttgggataaaatcacttgatgtagacctccccgaacaaatatctgaagctgaactcattggcaaggtccacgaactaaatgcaaatcccgatgttcatggaatattggttcagcttccattgccaaagcatattaatgaagagaaggttttgagtgctattagtattgaaaaagatgtggatggttttcatccgctgaacattggcaagcttgcaatgaaaggcagagaacctctttttcttccctgcacccctaaggggtgtctggaacttctatcacgaagtggtatagagataaaggggaaaaaggcagttgttgtaggtcgtagcaacatagttggattgccggtatcattgctccttctgaaagcagatgcaactgttaccatagttcattctcgttccgaagatcaagaaagtattattcgtgaagctgacattattattgctgcagcaggccaagctatgatgataaaaggaagctggattaagcctggtgctgcagtaattgatgttggaacaaatgctatagatgacccaagtaagaaggcaggttataggctagttggagatgtagattacaaggaagcatgtaaagtagcaggctggattactcctgttcccggtggtgttggtcctatgactgttgcaatgctactcaataacaccttagatggtgctaagcgtgaatttgaacactaatgcatcatgctcaccaatttttctctccacattctcacccctcgtcctgtttcttttctaatcatgtgcttgcaattttgttgcaatccaataatttattaatgcttagaaactgtctc

SEQ ID NO: 1291 - DNA, 973 bp, Ricinus communis
gagctgcagttggtgctcatctcaactagctgccgcaattatccaaaatggcggcaccgtcggatcacaaggctaccataatcgatggtaaggctatcgcgcagacaatccgatctgaaatcgccgacgaagttcgtcaactctccgagaaatacggcaaggttccaggactggctgttgtgattgtaggcaacagaaaggattctcaaagctatgtaagtatgaaaagaaaggcatgtgctgaagttgggataaagtctttcgacattaacctcccagaacaagtttctgaagccgagctgatcagcaaggtccacgagttaaatgcaaataccgatgttcatggaattttggttcagcttccgttgccaaagcacattaatgaagagaaagtcttgagtgaaatcagtattgagaaggacgtggatggttttcatcctctaaacattggcaagcttgctatgaaaggcagagaacctcttttccttccctgtacccctaagggctgtttagaacttctatcaagaagtggtataagtataaagggaaagaaggcagttgttgtaggccgtagcaacatagttggattgccagtgtcactgctgcttctgaaagcagatgccactgttagcatagtccattctcgtactgaagatccagaaaggatcatttgcgaagccgatatcattattgcagcagcagggcaaccgatgatgatcaagggcagctggatcaaaccaggtgctgcagttattgatgttgggacaaatgctgttgatgacccaagtaagaagtctggttacaggctagtgggagatgtagattacaaggaagcatgtaatgtagctggatggattactcctgttccaggtggtgtaggtcccatgactgttgcaatgctacttaagaacactttggatggtgcgaagcgtgaatttatgcagtaatcccccatatatttttacccttttcc

SEQ ID NO: 1292 - DNA, 1084 bp, Capsicum annuum
ctatcttatatatcttccataatctcccacccacttcaactcaccaactctcattccacagctccaaatattttttccatttttcttacagatccaacaatttcaagatttattttccgtcctgaagttttaggcaagttgtctctcgtttgaagagaaatggcatcgccatcagatcacaaggccgcaatcattgatggtaaagcaatcgctcaaactattcgttctgagattgcttctgaagtcaaacttctttcagaaaagtatggcaaggtcccggggttggccgtagtcattgtaggaaataggaaggattcacaaagttatgtgaatatgaagagaaaatcttgcactgagctttgcataaagtcttttgacgtagatctcccagaggaagttgctgaagctgaattgattagcaaggtccatgagctgaatgctaatcctgatgtacatggtatactggtccagctcccgttaccaaaacatattaatgaagagaaagttctcggtgaaatcagtctggaaaaggatgtagatggctttcatcctctaaatattggcaagcttgcaatgaaaggcaggcaacctttgttcctcccttgcacgcccaagggatgcatcgagcttttagttcgaagtgggattaccataaagggaaagaatgcagttgtggttggtcgaagcaacattgttggattacccgtatctctgcttctcctgaaggaagatgccactgttactatagttcattcacgtaccaaggaaccagagaaaatcattcgtgaagctgacataatcatcgctgctgcagggcaagctatgatgatcaaaggcagctggatcaaacccggtgctgcagtaattgatgttgggacaaatgcagtagatgatccttctaggaagtcgggttataggcttgttggagatgtcgattttcaggaagcatgcaaggtagctggatggataactccagttccgggaggcgttggaccaatgactgttgcgatgcttctgaagaatacattggatggagctaaacgagttatcgacaagtaaacactttacttcctttggctctgta

SEQ ID NO: 1293 - DNA, 1687 bp, Ricinus communis
gtgatgtatcttgtaccacaacctaatacgaaaagtccacgtgcgcaactcttataaatttaactgaagtcggtcagtcaccaagtgatttcgtgtccttgatttgggagttggtgagcttgctactcttagtgtgagctgcagttggtgctcatctcaactagctgccgcaattatccaaaatggcggcaccgtcggatcacaaggctaccataatcgatggtaaggctatcgcgcagacaatccgatctgaaatcgccgacgaagttcgtcaactctccgagaaatacggcaaggttccaggactggctgttgtgattgtaggcaacagaaaggattctcaaagctatgtaagtatgaaaagaaaggcatgtgctgaagttgggataaagtctttcgacattaacctcccagaacaagtttctgaagccgagctgatcagcaaggtccacgagttaaatgcaaataccgatgttcatggaattttggttcagcttccgttgccaaagcacattaatgaagagaaagtcttgagtgaaatcagtattgagaaggacgtggatggttttcatcctctaaacattggcaagcttgctatgaaaggcagagaacctcttttccttccctgtacccctaagggctgtttagaacttctatcaagaagtggtataagtataaagggaaagaaggcagttgttgtaggccgtagcaacatagttggattgccagtgtcactgctgcttctgaaagcagatgccactgttagcatagtccattctcgtactgaagatccagaaaggatcatttgcgaagccgatatcattattgcagcagcagggcaaccgatgatgatcaagggcagctggatcaaaccaggtgctgcagttattgatgttgggacaaatgctgttgatgacccaagtaagaagtctggttacaggctagtgggagatgtagattacaaggaagcatgtaatgtagctggatggattactcctgttccaggtggtgtaggtcccatgactgttgcaatgctacttaagaacactttggatggtgcgaagcgtgaatttatgcagtaatcccccatatatttttacccttttcctcataaagaagccatgtctcctgctatcacttcctaattgggtctttgcacaatctgacccttcatatttggtgttttaagacaacatacgagttaaaatttgttagataatcttgctataataatatttacttctaattttgttgtcagtacagtttcacatgtgcctaaacttttcaattcaacttaatgtgtcaaactgaattgtcaaaggatgacatagatttgaggtgtcacccgaacactgcttgaaatgcggagattttagaaggcctcgagtcgactctgaacttgatgattcaaactgaatttcaaggataatatccggagtttgatgtgatagatatattttgtccatcaatgtatttttgtttattgatcatagctgctgataagcacttgcatgaatgagatagagaatatccaacagcagaaagattattaaacaaacacattcatgggctgctcaactaattcacttttgcagcagcaaatccccgcaagaatatctgtatcattatcttagattatgttgtaattataatatctgtatcaaggtaagaagcaaggtttgtgaaa

SEQ ID NO: 1294 - DNA, 1367 bp, Gossypium hirsutum
acgagtcgttgaagccaaatcttatacagctcatcattcaccgcacaaaatggcgtcgccatctgattgtaaagcgaccattatcgacggcaaagctatcgctcagacgatcagatctgaaattgccgacgaggtccgtcatctctcccagaaatacggcaaggtgccaggcctagctgttgtaattgttgggaacaggaaagattctcaaagctatgtgggaatgaagagaaaagcctgtgctgaagttgggattagatcttttgatgtgaatctccctgaagaagtacctgaatccgatttgatcagcaaagttcacgagctcaatgcaaatcctgatgtacatggcatattggttcagcttcctttaccaaagcacataaatgaagagaaagttttgggtgaaatcagtcttgaaaaagatgtagatggttttcaccctttgaatatcggcaaacttgcgatgaaaggccgagaaccccttttccaaccttgtactcccaaggggtgtcttgaactgctatctcgaagtggtgtaagtgtaaagggaaaaaatgctgttgttgtgggtcgaagtaacatagttgggttgccagtttccttgctgcttctcaaggctgatgctactgttagcattgttcattcacgtacaccggatcccgaaaggctagttcgtgaagctgacattgttatagctgcagcaggacaagctatgatgatcaaaggcagttggatcaaacctggtgctgcggttattgatgttggaaccaatgctgttgatgacccaactaagaaatcaggatacaggttagtgggagacgtggattttgaagcagcatgtagggttgctggatggataacacctgttcctggtggcgttggcccgatgacagttgcaatgctgctccggaataccttagatggtgcgaagcgtgtgattgagcaatgaggtatctcatttccatcactcgtttacttcataataaaatttgcttaagtttaacctctgagttgcatctctgacttcaaacaaaaaaaaaaaggtcgtatcattgcctccctcccatactcaaaaagtgtaatagaaatcaatttcagaaaactttacagagctgttttaggacttgggattttgtctgttgcatgtttaaacatgttcaccttttctttccatgaaggttccaaatatgctgtcagtttctgtatttaagaataagttaattaaattttcttaccttttcgatttaaaatttcaagttaaataatttatattgttaaacatttttcatcaaaacttgtttactgtatttgcttctggagatgatatgattttatggatgcatttatggcaaattgtgaataaaggt

SEQ ID NO: 1295 - DNA, 1348 bp, Capsicum annuum
gcacgaggatcattttagttgcaaaaataagcgactaacgatcctcggaaaaaatcatgaaataaacaaagttatacccataaatatttatttctatcatattttatttatatttctcattctaattttccttttggtgattttaatgatttttatcagattggacataaaaaatactatcttatatatcttccataatctcccacccacttcaaatcaccaactctcattccacagctccaaatattttttccatttttcttacagatccaacaatttcaagatttattttccgtcctgaagttttaggcaagttgtctctcgtttgaagaaaaatggcatcgccatcagatcacaaggccgcaatcattgatggtaaagcaatcgctcaaactattcgttctgagattgcttctgaagtcaaacttctttcagaaaagtatggcaaggtcccggggttggccgtagtcattgtaggaaataggaaggattcacaaagttatgtgaatatgaagagaaaatcttgcactgagctttgcataaagtcttttgacgtagatctcccagaggaagttgctgaagctgaattgattagcaaggtccatgagctgaatgctaatcctgatgtacatggtatactggtccagctcccgttaccaaaacatattaatgaagagaaagttctcggtgaaatcagtctggaaaaggatgtagatggctttcatcctctaaatattggcaagcttgcaatgaaaggcaggcaacctttgttcctcccttgcacgcccaagggatgcatcgagcttttagttcgaagtgggattaccataaagggaaagaatgcagttgtggttggtcgaagcaacattgttggattacccgtatctctgcttctcctgaaggaagatgccactgttactatagttcattcacgtaccaaggaaccagagaaaatcattcgtgaagctgacataatcatcgctgctgcagggcaagctatgatgatcaaaggcagctggatcaaacccggtgctgcagtaattgatgttgggacaaatgcagtagatgatccttctaggaagtcgggttataggctcgttggagatgtcgattttcaggaagcatgcaaggtggctggatggataactccagttccgggaggcgttggaccaatgactgttgcgatgcttctgaagaatacattggatggagctaaacgagttatcgacaagtaaacactttacttcctttggctctgtagactattacaataaagatgtcatggcttcttagcttgttgacaatacatgcatttagaagatgtcaattacattcaagaaaacaacaa

SEQ ID NO: 1296 - DNA, 1176 bp, Amsonia hubrichtii
aggctcaactcccgtagttgcagtagactatactggaaggtgactaatctaataatcttcattttccgggaacgatggcgtcgccgcccgatcacaaagccaccattatcgacggtaaagctatagccaaaacaatcagatctgagatcgccgcggaagtccgactactctcccagaaacacaacaaggtaccaggattggcagtagtgattgtgggtaataggaaggactctcaaagctatgtgagtatgaagaggaaggcatgcgctgaggttgggattaagtcttttgacatagaccttccagaggaggtgtccgaagttgacctgatccacaaggtccatgagttgaatgcaaatcctgatgtacacggtatactggtccagcttccacttccaaaacatataaatgaagagaaagttttgggtgaaattagcttggagaaggatgttgatggatttcaccctctgaacattggaaagcttgcaatgaaaggcagagaacctctgttccttccttgcacccccaagggctgtcttgagcttctgtcacggagtggggttaccataaagggcaagaaagcagctgtggtaggtagaagtaacatagtaggattaccagtggctctactacttctcaaagaagatgctactgtcactgtagtgcattcccgtactgaggaacctgagaatattattcgtgaagctgacattattattgctgcagcaggacaagcaatgatgatcaagggaagctggatcaaacctggtgctgctgttattgatgtggggacaaatgctgttgatgatccgacaaagaaatcaggttacaggctggttggagatgttgatttccatgaagcatgtaaagtagctggatgcataactccagttcctggtggtgttggtccgatgaccgttgcaatgctactgaagaacacattagagggagctaagcgtatcattgagcagtgaatgtctatttcagatttttcacataaaaccatgtcaagctttgaaatgatgaaataaatgaaaaagttcttgtgcacatgtcaataaattcttaaggtttgagctttacaaggagcaatgcctgatgtataggtttctgttgtctgttgtatcctcttaggatgattacttaacacgcatcctttccattgttttactgttg

SEQ ID NO: 1297 - DNA, 1022 bp, Fagus grandifolia
aaagagagagtgttggagtcttaatctactgaacaaacatggcagcaccgttggatcacaaagccagtattatcgacggcaaagccatcgcccaaaccatccgcaatgaaatcgcagctgaagtccataatctttcacagaaacacggcaaggtcccggggctggctgtagtgattgtgggcaccaggaaggattctcaaagctatgtgagtatgaagagaaaggcatgtgccgaagttgggatcaagtcctttgacgtagaccttccagagcaagtttctgaagctgagttggtcgccaaggttcatgaattaaatgcaaatcctgatgtacacggcatattggttcaacttccattgccgaagcatataaatgaagagaaagttctgactgaaatcatcattgagaaggatgtagatggctttcatccgctgaacattggcaagcttgcaatgaaaggcagagaacccttgttccttccttgcacccctaaggggtgtcttgaacttctgtcacgaagtggtataactataaagggaaagaaagcagttgtggtgggtcgaagtaacatagttggattgccagtttcactgctgcttctgaaagcagatgctactgttactgtagtccattcacactctcaagatcctgaacgaatcattcgtgaagcagacatcattattgcagcagcagggcaggcaatgatggtcaaaggtagttggattaaacccggtgctgcagttattgatgttggcacaaatgctatcgatgacccgagcaagaagtcaggttataggctagttggagatgttgatttcaaggaagcaagtaaggtagctggatggataactccagttccaggtggtgtgggtccaatgactgttgcaatgctactgaagaataccttggagggtgctaagcgtgtaattgagcattaaacccatgtcttcattcactttcataataagatgttgcttataagttataacatgcagttttgaaatatgttttatttgtatcat

SEQ ID NO: 1298 - DNA, 1165 bp, Centaurea maculosa
agtcgccggagaactccgccgttaaccgccatcatccaccggccaaaacattctctctatatttcactataaaaaagggttggtgtaatctcgatatccaagtagttatcactatgtcgttgcctgtagatcataaggctaacatcatcgatggaaaagcaatcgcacaaacaatccgttccgaaatagcttcggaagtcagcaacttgatcgagaaatatggcaaggccccaggacttgctgtggttatcgttggacatagaaaagattcacagagctacgtaaatatgaagagaaaagcatgcgcagaggttggaatcaagtctatcgacatagaccttccagaacaagtacccgaagatgagttgatcgcaaaggtccacgagttaaatgaagatcccgatgttcatggcatattggttcaacttcctttaccgaaacacataaatgaagaaaaagttttaactgcaatcagcatcgagaaggatgtagatgggtttcatcctctaaacatcggcaaacttgctatgaagggccgagaaccactctttcttccttgcacaccaaagggatgtattgaacttcttaaacgcagtggtatcaccataaagggaaagcgggctgtcgtggttggtcgaagtaacattgtcggcttaccggtgtcactcctactgctgaaggccgatgccaccgttactacagtccattcgcacacggtggatccggaaaccatcattcgtgaggcggacattgttgttgctgcggccggacaagctatgatgataaaaggtagttggattaagccgggtgcagcagttattgacgtgggaacaaatgcggttgacgatcccagtagaaaatctgggtaccggctcgtgggtgatgtcgattttcaagaagcgtgcgaagtagcaggatgcattacgcccgttccaggtggcgtggggcccatgaccgtagcgatgcttcttaagaacacgttggatggtgctaagcgcgtgatcgggaagtaaaaaacggtatcgaaccgttttcgagttttgttgcaagaaatctgcaaatcatgttgtagttttattgagcatattagctcatgtcattttgactctttgaatgtattaagaatatatcttcttctttcccacaatggattttgattaggact

SEQ ID NO: 1299 - DNA, 1094 bp, Centaurea maculosa
cgtcttttgtgattcagtcgccggagaactccgccgttaaccgccatcatccaccggccaaaacattctctctatatttcactaccaaaaagggttggtgtaatctcgatatccaagtagttatcactatgtcgttgcctgtagatcataaggctaacatcatcgatggaaaagcaatcgcacaaacaatccgttccgaaatagctttggaagtcagcaccttgatcgagaaatatggcaaggcgccaggacttgctgtggttatcgttggacacagaaaagattcacagagctacgtaaatatgaagagaaaagcgtgtgccgaggttggaatcaagtctatcgacatagaccttccagaacaagtacccgaagatgagttgattgcaaaggtccatgagttaaatgaagatcccgatgttcatggcatattggttcaacttcctttgccgaaacacataaatgaagaaaaagttttaactgcaatcagcatcgagaaggatgtagatggctttcatcctctgaacatcggcaaacttgctatgaagggccgagaaccgctctttcttccttgcacaccaaagggatgtattgaacttcttaaacgcagtggtattaccataaagggaaagcgggcagtagtggttggccgaagtaacattgtcggcttaccggtgtcactcctactgctgaaggccgatgccaccgttactacagtccattcgcacacggtggatccggaaaccatcattcgtgaggcggacattgttgttgctgcggccggacaagctatgatgataaaaggtagttggattaagcccggtgcagcggttattgacgtgggaacaaatgcggttgatgatcccagtagaaaatccgggtaccggctcgtgggtgatgtcgattttcaagaagcgtgcgaagtagcaggatgcattacgcccgttccaggtggcgtggggcccatgaccgtagcgatgcttcttaagaacacgttggatggtgctaagcgcgtgatcgggaagtgaaaaacagtatcgaatcgtttccgagttttgttgcaagaaatctgcaaatcatgttgtagttttatt

SEQ ID NO: 1300 - DNA, 1110 bp, Cirsium arvense
cttttgtgattcagtcgccggagaactccgccgttaaccgccatcatccaccggccaaacattctctccatatttcactaccaaaaagggttggtgtaatctcgatatccaagtagttatcactatgtcgttgcctgtagatcataaggctaacatcatcgatggaaaagcaatcgcacaaacaatccgttccgaaatagcttcggaagtcagcaccttgatcgagaaatatggcaaggcgccaggacttgctgtggttattgttggacacagaaaagattcacagagctacgtaaatatgaagagaaaagcatgtgccgaggttggaatcaagtctatcgacatagaccttccggaacaagtacccgaagatgagttgatcgcaaaggtccatgagttaaatgaagatcccgatgttcatggcatattggttcaacttcctttgccgaaacacataaatgaagaaaaagttttaactgcaatcagcatcgagaaggatgtagatggctttcatcctctgaacatcggcaaacttgctatgaagggccgagaaccgctctttcttccttgcacaccaaagggatgtattgaacttcttaaacgcagtggtattaccataaagggaaagcgggcagtagtggttggtcgaagtaacattgtcggcttaccggtgtcactcctactgctgaaggccgatgccactgttactacagtccattcgcacacggtggatccggaaaccatcattcgtgaggcggacattgttgttgctgcggccggacaagctatgatgataaaaggtagttggattaagcccggtgcagcggttattgatgtgggaacaaatgcggttgacgatcccagtagaaaatctgggtaccggcttgtgggtgatgtcgattttcaagaagcgtgcgaagtagcaggatgcattacgcccgttccaggtggcgtggggcccatgaccgtagcaatgcttcttaagaacacgttagatggtgctaagcgcgtgattgggaagtaaaaaacggtatcgaatcgtttccgagttttcgttgcaagaaatctgcaaatcatgttgtagttttattgagcatattagctcatgtc

SEQ ID NO: 1301 - DNA, 1368 bp, Sesamum indicum
gaagcatcgagtacaacaccaagccaaaatttgctgtcgccggattgcggtgtttatctatctacacacagcagcgcaccaacaatcattacagtagaatctattttgcttctttgctctctcgaaacgatgtcggatcataaggccaccttaatcgatggcaaggcaatcgcccaaacaatccgatcggagatcgccgccgaagtctgccgcctctccgagacatatggaaaggtgccgggtctagcggtggtaattgtggggaaaagaaaggattcacagagctatgtcaatatgaaaaggaaggcctgtgccgaagttgggatcaagtctgtcgatttggacctccccgaggaagtatccgaatctgagttgattagcaaagtccacgagttgaacgcaaatcctgatgttcatggtatcttagtacagcttccgctacctaaacatataaatgaagagaaaattttaagtgaaatatccctggacaaggatgtcgacggatttcatcctctgaacattggcaaattagcaatgaaaggcagagatcctttgtttgtcccctgcaccccaaagggttgccttgagcttctgtcacgaagtggtgttagtgttaagggaaagaatgccgtcgtggtgggtcgaagtaacatcgttggtttaccagtttcactgcttcttctgaaggaagatgctactgttactatagtccattcacgtacaaaggaaccggagagcatcgttcgtagtgctgacattgttattgctgctgcaggtcaagcaatgatgatcaagggcagctggattaaacccggtgctgcagtaattgatgtgggaacaaatgctgtagatgatccaagtaagaaatccggctataggcttgtcggggatgtggacttccaagaagcaagtaaagtagctggatggataactccagttcctggtggtgttgggccgatgaccgttgccatgctgctgaagaataccttagacggagctaagagagtgatagagcaatgactttgctttctggcatcgaataagatgacccataatcttctctctttagcagtactactggattgattcgcatgtcctattggatcgatatctgatgatcttagttgacattgtaatgataaaatgaggtttatgtatcaagattgctttctgatttcttcctgaattgatggtaagccgtgttctagaggatagcgagatagttaatttaatatgcttcgggagtgtaataatatcccacggaggacgctgtgctgtgtgtttccctgatctccttttgagttaatagtttatatgtgggttggttggaagcagcacatggcaagggaaggttacaaatattcatgc

SEQ ID NO: 1302 - DNA, 1207 bp, Amaranthus tuberculatus
aatttgagaccacgaattccaaacccacgcactctctgcatattctcctcacaagattcagtcctttaaaaatggcggccacgtccgacgaaaagaaagcaaccttgatcgacggaaaagcaattgctcaaactattcgatccgaaatcgccgatgacgttcgtcttctttctgaaaaatacggaaaggtccctggattggctgtagtcatagtgggcaataggaaggattctcaaagttatgtgaatatgaaaagaaaagcgtgtgctgaagtggggatcaagtccattgacgtagaccttcctgagcaagttcccgagcctgaattgattgccaaggttcatgaattaaatgacaatcctgaagtacatgggatacttgttcagcttccattgcccaaacatatcaatgaagaaaaagttttgagtgaaattagcattgagaaagatgtagatggtttccatcctttgaacattggaaaacttgcaatgaaaggaagagaaccactcttccagccttgcacccctaagggttgtcttgaacttctgtctcgaagtggaatcagtgtcaaaggcaagaaggctgttgttgtaggtcgtagtaatattgttggtttgccagtttcacttctccttctgaaagcagatgccactgtcagtattgtccactctcgcactactgatcctgaaaacataatacgtgaagctgacatcgtcattgctgcagcaggacaagccatgatgattaaaggtgaatggctaaagccaggtgctgctgttattgatgtgggaacaaacgcggtggatgatccaagtaagaagtctggttatcggctggtgggggatgttgacttccatggagctagtaaagtagcagggtggataactccagtccctggaggtgttggtcccatgactgtagccatgttactgaggaacaccgtagatggtgcaaagcgcgtgattgagcaatgatcatttcctcctttttcaataaggcatgtctcatgctatttttccttttaaggtttataggaatttcattgaatgttaatatgattcaagtctttgcttctttcgattttgctcaatgtcactataattatatgacttactctttattgtattttcttgattgtgaacctctgtttgttcgaaccaatttcttcattctttttaatgttatgtagatggtgtatttagttgac

SEQ ID NO: 1303 - DNA, 909 bp, Brassica napus
taatcgatgggaaggcggtcgctcacacacaaaagaaacgatttatctgagaaacacggcaaggtcccaggactagcggtggtcatagttggggcacgaaaagattctcagacttacgtgaacatgaagaggaaagcttgcgctgaggttgggatcaagtcattcgatgttgacttacctgaggatgttcctgaagctgatcttataaccaaagttcatgaactaaattcagatcctgaagcccatggtatattagtgcaactcccattgcctaaacatatcaacgaggagaatgttctgggtgcaatcagcattgataaagacgtagacggcttccatcctttgaatattggtaagctagctatgaaaggtagagagcccctcttccttccatgcaccccaaagggttgtttggagctcttggtgagaagtggaataaagataaagggccaacgagcagttgtagtaggtcggagtaacattgttggtttgcctgtttcgcttctactgctcaaggctgatgctactgtcacaactgtacattctcacaccaaggatcctgaggctatcataaaagaagctgacatcgttattgctgcagctggacaagcctgcatgattaagggagactggataaagccaggggctgcagtgatcgatgtgggaactaacgcggtcagcgacccgtgtaggaaatcaggataccgtttggttggtgatgttgattttgcagaagcttctaaagtcgcagggttcattactcctgtccctggtggtgtaggcccaatgacagtggctatgctgctcagaaacaccttagacggcgccaagcgggtcattggccagtaaactatcttttctgtatgtaatctatgatacatttctataattgtgttctctgcttgatga

SEQ ID NO: 1304 - DNA, 1226 bp, Manihot esculenta
gctttgatttgtgaacacgtgaggctgctgagaatctgcagtactacagcactttgctaaactcctatcgtgtctgtgagtaactgtttgtcacagaccaaccacttaagcgacgccgtctacacccatttctacatatggcgtcaccgtcagatcacaaggccaccataatcgacggcaaggccatagcccagaccgtccgatctgaaatcgccgacgaagtccgtcaactctctgagaaatacggcaaggttccaggattggctgttgtcatcgtaggcaacagaaaggattctcaaagctatgtaaatatgaaaagaaaggcttgtgctgaagttggtataaagtcatttgatatagacctcccagaacaaatatctgaagctgagctgatcagcaaggtccatgagttgaatgcaaatcctgatatacatggaatattggttcagctgccattgccaaagcatattaacgaagagaaagtcttgagtgaaatccatcttgagaaggatgtggatggttttcatcctctcaacattggcaaacttgctatgaaaggcagagaacctctttttgttccctgtactcccaagggttgcctggaacttctttcgcgaagtggtataagcataaagggaaaaaatgctgttgttgttggtcgcagcaacatagttggattaccagtgtcactgcttcttctgaaagctgatgctactgttaccattgtccattcccgttctgatgaccaagagaggatcattcgtggagctgacatcattatcgcagccgctgggcaagcaatgatgatcaagggcagctggattaaacctggagctgcagttattgatgttggaacaaatgctattgatgacccaagtaagaagtcgggctataggctagtgggagatgtagattacaaggaagcatgtaaggtagctggatggatcacccctgttccaggtggtgtaggaccaatgactgttgcaatgctactcaagaacaccttggatggtgcaaagcgtgtattcatgcagtaatagtccatgtatttttctctttcaaatatactttcgtcaatagcttttcataagccctatcctctgtcttcacatcttaattaactcccgattttatgggaaatcatgcatacttttgttggatatgctttgcaaaactcttaggattttgcttttgtttccgttgtttgctaataatttgaccttcag

SEQ ID NO: 1305 - DNA, 1434 bp, Centaurea maculosa
ttttgtgattcagtcgccggagaactccgccgttaaccgccatcatccaccggccaaacattctctatatttcactagcaaacagggttggtgtaatctcgatttccaagtagttatcactatgtcgttgccagtagatcataaggctaacatcatcgatggaaaagcaatcgcacaaacaatccgttccgaaatagcttcggaagtcagcaacttgatcgagaaatatggcaaggcgccaggacttgctgtggtcatcgttggacatagaaaagattcacagagctacgtaaatatgaagagaaaagcgtgtgccgaggttggaatcaagtctatcgacatagaccttccggaacaagtacccgaagatgagttgatcgcaaaggtccacgagttaaatgaagatcccgatgttcatggcatattggttcaacttcctttgccgaaacacataaatgaagaaaaagttttaactgcaatcagcatcgagaaggatgtagatggctttcatcctctgaacatcggcaaacttgctatgaagggccgagaaccgctctttcttccttgcacaccaaagggatgtattgaacttcttaaacgcagtggtatcaccataaagggaaagcgggcagtcgtggttggtcgaagtaacattgtcggcttaccggtttcgctactactgctgaaggccgatgccaccgttacagtagtccattcgcacacggtggatccagaaaccatcattcgtgaggcggatattgttgttgctgcggccggacaagcaatgatgataaaaggtagttggattaagcccggtgcagcggttattgacgtgggaacaaatgcggttgacgatcccagtagaaaatccgggtaccggctcgtgggtgatgtcgattttcaagaagcatgcgaagtagcaggatgcattacgcccgttccaggtggcgtggggcccatgaccgtagcaatgcttcttaagaacacgttggatggtgctaagcgcgtgatcgggaagtgaaaaaacggtatcgaatcgtttccgagttttcgttgcaagaaatatgcaaatcatgttgtagttttgtagagcatattagctcatgtcattttgagtctctctgaatgtgtaagaatattgctctttttcaacaatggattttgattacaagtgaacttggttcgggttcgagttcgagttcgtagtattatgtgacgctcgaactcgatttggtagcagaacgctttcgatgcggatttgagcttagcttgagaaaagactgtgtgtttgaatagtgtgaagatgttgcatgtttataggataataagaggtggtttattagctgaaaaacatgcattgctaaataaaaattggtccaaatgaacatttctctcttgtaattagcttcctagctatttttctatcagttttat

SEQ ID NO: 1306 - DNA, 1090 bp, Cirsium arvense
ccgttaaccgccatcatccaccggccaaaacattctctctatatttcactaaccaaaaagggttggtgtaatctcgatatccaagtagttatcactatgtcgttgcctgtagatcataaggctaacatcatcgatggaaaagcaatcgcacaaacaatccgttccgaaatagcttcggaagtcagcaacttgatcgagaaatatggcaaggctccaggacttgctgtggttatcgttggacatagaaaagattcacagagctacgtaaatatgaagagaaaagcgtgtgccgaggttggaatcaagtctatcgacatagaccttccagaacaagtacccgaagatgagttgatcgcaaaggtccacgagttaaatgaagatcccgatgttcatggcatattggttcaacttcctttgccgaaacacataaatgaagaaaaagttttaactgcaatcagcatcgagaaggatgtagatgggtttcatcctctaaacatcggcaaacttgctatgaagggccgagaaccgctctttcttccttgcacaccaaagggatgtattgaacttcttaaacgcagtggtatcaccataaagggaaagcgggcagtcgtggttggtcgaagtaacattgtcggcttaccggtgtcactcctactgctgaaggccgatgccaccgttactacagtccattcgcacacggtggatccggaaaccatcattcgtgaggcggacattgttgttgctgcggccggacaagctatgatgataaaaggtagttggattaagcccggtgcagcggttattgacgtgggaacaaatgcggttgacgatcccagtagaaaatccgggtaccggctcgtgggtgatgttgattttcaagaagcgtgcgaagtagcaggatgcgttacgcccgttccaggtggcgtggggcccatgaccgtagcgatgcttcttaagaacacgttggatggtgctaagcgcgtgatcgggaagtaaaaaacggtatcgaaccgttttcgagtttttgttgcaagaaatctgcaaatcatgttgtagttttattgagcatattagctcatgtcattttgac

SEQ ID NO: 1307 - DNA, 1288 bp, Gossypium hirsutum
tcttttacgagtcgttgaagccaaatcttagaccgctcatcattcaccgcaaaaaatggcatcgccatctgatcgtaaagctaccattatcgacggcaaagccatcgctcagacgatcaggtctgaaatcgccgacgaggtccgtcatctctcccagaaatacggcaaggtgccgggcctagctgttgtaattgttgggaacaggaaagattctctaagctatgtgggaatgaagagaaaagcctgtgctgaagttgggattagatcttttgatatgaatctccctgaagaagtacttgaatccgagttgatcagcaaagttcacgagctaaatgcaaatcctgatgtacatggcatattggttcagcttcctttaccaaagcacataaatgaagagaaagttttgggtgaaatcagtcttgaaaaagatgtagatggttttcaccctttgaatatcggcaaacttgcgatgaaaggccgagaacccctttttcaaccttgtactcccaaggggtgtcttgaactgctatctcgtagtggtgtaagtgtaaagggaaaaaatgctgttgttgtgggtcgaagtaacatagttggattgcctgtttccttgctgcttctcaaggctgatgctactgttaccattgttcattcacgtacaccagatcccgaaaggctagttcgtgaagctgacattgttatagctgcagcaggacaagctatgatgatcaaaggcagttggatcaaacctggtgctgcggttattgatgttggaaccaatgccgtcgatgacccaactaagcgatcaggatacaggttagtgggagacgtggattttgaagcagcatgtagggttgctggatggataacacctgttcctggtggcgttggcccgatgacagtcgcaatgctgctccggaataccttagatggtgcaaagcgtgtgattgaggaatgaggtatctcatttccatcacttgtttacttcataataaaatttgcttaagtttaacctctgagttgcatctctgacttcaaacaaaaaaaagtgtaaggaatcattgcctccctcccatactcaaaaagtgtaatagaaatcaatttcagaaagctttacagagctgttttaggacttgggattttgtctgttgcaggtttaaacatgttcaccttttctttccatgaaggttccaaatatgctgtcagtttctgtatttaagcataggttaattaaaatttcttaccttttcgatttaaaatttcaagttaaataatttatattgttaatatt

SEQ ID NO: 1308 - DNA, 1418 bp, Panax ginseng
atcggtagttcttcgaattcgaaggaaaaggtgagcgctataggagaataattaatcagattcatacttcaaaaatggcggccacatcggatcagaaggcaaccatcatcgacggtaaagcaatcgcacagacaatccgatctgaaatcgcctccgaagttcgacttctctctgaaaaatactccaaggtcccaggattggctgtagtcattgtaggaagtaggaaggattctcaaagctatgtgagtatgaagaggaaggcatgtgctgaagttgggattaagtcctttgacatagaccttccagaggatgtagctgaagccgaattgatagccaaggtgcatgagttaaatgcaaatcctgatgtacacggtatactagtccagcttccattgccaaaacatataaatgaagagaaaatcctaactgaaatcagcctcgagaaggatgtagacggctttcatcctctgaacattggaaagcttgctatgaaaggcagagatcctctgtatcttccttgcactcccaagggatgtcttgaacttctatcacgaagtggtattagcataaagggaaagaaggcagtagtggtgggtcgaagcaacatagttggattaccagtgtcactcctacttctgaaggcagacgccacagttactgtagtccactcacgtactcaagatccagagagaatcattcgtgaagcagacatagttattgctgcagcaggacaggcgatgatgataaaggggagctggataaaacctggtgctgcagtgattgatgtagggacaaatgccgtagatgatccaagtagaaagtcaggctataagcttgtgggagatgttgattttcatgaagcatgcaaggtagctggatggatcactcctgttcctggaggagtgggaccgctgacggttgcaatgttactcaaaaataccttggaaggtgccaagcgtgtgatcgagcagtaaatatacagtcacgacctcaatagaaatgttcaagtcaggacatcaagagaacaaatttgacgaggttcagaagatgagctctctgctgcaaacataaaagttatggtattgttcctcagaggtggaatctagctctttgctccacctttctaatgatctgatttaaagtaggattcagtttctaagcttattctgttatgatcattaacagagggaactaccaagagacataaatattttgtaattctcgagaaaaaaatttctctgaaacgtgcaactcttcttgtacatgtatttttgtgatgctatgaagtcatacattggaaatagagttgagctttggcctagacatgggaaattgggaatatgcaccgtgattagtttcaaacacctgatcctattgaaattcccacaagtttcgagtgacgccgcgtgttgatgtga

SEQ ID NO: 1309 - DNA, 1485 bp, Gossypium raimondii
caaatcctgacgcttggatgtatgtataaaaatctgaactacaagggacaaaaatggaaaatgaaagaacgagcgggcgggtcctcgagattcggcccgagagacagaatccaaaaaggccaggtgtcagcagctgcgtgccttaaccgaagtggtatgagtgaggtggtttttggtgatgaagtcttttacgagtcgttgaagccaaatcttagaccgctcatcattcaccgcaaaaaatggcatcgccatctgatcgtaaagctaccattatcgacggcaaagccatcgctcagacgatcaggtctgaaatcgccgacgaggtccgtcatctctcccagaaatacggcaaggtgccgggcctagctgttgtaattgttgggaacaggaaagattctctaagctatgtgggaatgaagagaaaagcctgtgctgaagttgggattagatcttttgatatgaatctccctgaagaagtacttgaatccgagttgatcagcaaagttcacgagctaaatgcaaatcctgatgtacatggcatattggttcagcttcctttaccaaagcacataaatgaagagaaagttttgggtgaaatcagtcttgaaaaagatgtagatggttttcaccctttgaatatcggcaaacttgcgatgaaaggccgagaacccctttttcaaccttgtactcccaaggggtgtcttgaactgctatctcgaagtggtgtaagtgtaaagggaaaaaatgctgttgttgtgggtcgaagtaacatagttggattgcctgtttccttgctgcttctcaaggctgatgctactgttaccattgttcattcacgtacaccagatcccgaaaggctagttcgtgaagctgacattgttatagctgcagcaggacaagctatgatgatcaaaggcagttggatcaaacctggtgctgcggttattgatgttggaaccaatgccgtcgatgacccaactaagcgatcaggatacaggttagtgggagacgtggattttgaagcagcatgtagggttgctggatggataacacctgttcctggtggcgttggcccgatgacagtcgcaatgctgctccggaataccttagatggtgcaaagcgtgtgattgaggaatgaggtatctcatttccatcacttgtttacttcataataaaatttgcttaagtttaacctctgagttgcatctctgacttcaaacaaaaaaaagtgtaaggaatcattgcctccctcccatactcaaaaagtgtaatagaaatcaatttcagaaagctttacagagctgttttaggacttgggattttgtctgttgcaggtttaaacatgttcaccttttctttccatgaaggttccaaatatgctgtcagtttctgtatttaagcataggttaattaaaatttcttaccttttcgatttaaaatttcaagttaaataatttatattgttaatatttgtcatcaaaatt

SEQ ID NO: 1310 - DNA, 1406 bp, Prunus mume
cacacacacacttttctctctcataaccgcagctactactcaacggcaacgacagcacccaccaaccaataactccgtgaatcggcaaagtaacacattgaggttggagctcctcctcatcagaaaccctcatctcttcaagactgagtgagtggttgatcaatggcatcacaatcagatcacaaggctgcgataatcgatggcaaagccatagcgcagaccatccgaaacgaaattgctgaggaagtccgccatctctcccagaaatatggcaaggttccgggactggcagtagtgatagtagggaacagaaaggactcccaaagctatgtgagcatgaagcgaaaggcatgtgctgaagtcggcattctatccttggacattgacctccctgaggatgtgtcccaagttgacctcattgccaaagttcatgaattaaacgccaatcccgatgtacatggtatactagttcagcttccgttgccaaagcatataaatgaggagaaagtgttgagtgaaatcagcattgagaaggatgtcgatggctttcatcctctcaacattggcaagcttgcaatgaaaggcagagaacctttattccttccttgcactcccaagggctgtctggaacttctctcacggagtggcataagcataaagggaaagaaggcagtggtggtgggcagaagtaacatagttggattgccggtttcgttgctgcttttgaaagcagatgctacagttaccgtagtccattctcattctcatgatccagagagtatcattcgtgaagcggacattattattgcagcagcagggcaggcaatgatgatcaagggtagttggataaaaccaggtgctgcagtcatcgatgtcggcacaaatgcaatagacgactcgagtagaaagtcaggctatagattggtgggagatgttgatttccaggaagcatgtaaggttgctggatgggtaactcctgtgcctggaggcgtcggcccaatgactgttgcaatgttactcaagaacactttggatggtgctaagcgtgttattgcacaataaaaactgttgctaagcgtgccctctcactcaaaattctagtgggcctaatttagaattttgattttgaagatttacttcagagccttttttatatttattttttgttaaaaagtcttgggaatttcactcccagttttaaccgatcttgtgttggttcatgcatacgcgatagtatgatacatatgcttgtatgaatacttaattgactaaattctccttaacaggttttttttagtataaatgatagtcaaaattacaaaagataagggtttatgatgtcatgtgtgggttcgaacctgagaccactaatatgcaaatcaagaccattttttactggattagac

SEQ ID NO: 1311 - DNA, 2416 bp, Prunus mume
cacacacttttctctctcataaccgtagctactactcaacggcaacgacagcacccaccaaccaataactccgtgaatcggcaaagtaacacattgaggttggagctcctcctcatcagaaaccctcatctcttcaagactgagtgagtggttgatcaatggcatcacaatcagatcacaaggctgcgataatcgatggcaaagccatagcgcagaccatccgaaacgaaattgctgaggaagtccgccatctctcccagaaatatggcaaggttccgggactggcagtagtgatagtagggaacagaaaggactcccaaagctatgtgagcatgaagcgaaaggcatgtgctgaagttggcattctatccttggacattgacctccctgaggatgtgtcccaagttgacctcattgccaaagttcatgaattaaacgccaatcccgatgtacatggtatactagttcagcttccgttgccaaagcatataaatgaggagaaagtgttaagtgaaatcagcattgacaaggatgtcgatggctttcatcctctcaacattggcaagcttgcaatgaaaggcagagaacctctattccttccttgcactcccaagggctgtctggaacttctgtcacggagtggcataagcataaagggaaagaaggcagtggtggtgggcagaagtaacatagttggattgccggtttcattactgcttttgaaagcagatgctacagttaccgtagtccattctcattctcatgatccggagaatatcattcgtgaagcggacattattattgctgcagcagggcaggcaatgatgatcaagggtagttggataaaaccaggtgctgcagtcatcgatgtcggcacaaatgcaatagacgactcgagtagaaagtcaggctatagattggtgggagatgttgatttccaggaagcatgtaaggttgctggatgggtaactcctgtgcctggaggtgtcggcccaatgactgttgcaatgttactcaagaacactttggacggtgctaagtgtgttattgcacaataaaaactgttgccaagcgtgccctctcactcaaaattctagtgggcctaatttagaattttgattttgaaaatttactttagagacttttttatatttattttttgttaaaaagtcttgggaatttcacttcctaactcagcttcccaaaccccatgttttcatttgcaattctctcattagagcattctctcactcccacactcctcgtaatcagattcataatcatatccctctctctatctacatccacatgcataaaagctctattcttcccaataacttcaccttccctttccttctaaagtccctagctgattcccacgacttcaaacaagggcaatgcttgcatacccatgtcttaaaattgggtcatctctatgatatttacgtgcaaaactcaagaacaccttggacccgctcggttttcagtaacctctgcaatgggctttgtagggtgttcaacttgttcttcaatcttcttctaaacagtatttttgtaacctctctgcagtggggtttgcaggggtgtttgggatttcttccatgctcctttggaatgaaagagagttggaaaatgagtaaaagcctcacatacatagtggactgttgtatattgatttatatagtaattgtacaatcccttacaatcactgatatctacatagtgggcattaataaaaaagaatcattgatacctacaatcagttacaggtgaggaagaagaagagtcctgagtcataaagagggcagctgatcagatgaggaagaagaagagtcctgagccatcttgaacagtggtagaggggtcctgagccatcttggagagtggtagagagtctgggcaacttttggatatacagcttctggaactttttaaggtataggtaagaaaactgtttttctcttgtggggacgtaaaaatatcatcagcattagctgctatctcagcctctttgaaatatttcatcgagcaaggccctctctagatggagacttataacagagaagacagcaagtgataaatttgttaggtggaccgtgggtgaaaatgacaaatctatcgaggtcccatgccatgagaaatctatggaggggtccaaagctgatatacaagttggccaagacccaggagagatgttatcttagctagcaaagggttgaagaaagcacttggcaatgcagtacttttgtttcttttaaatttcaatgagaactccttaatcacgattaattctacagattttctataatgttctgaatatgttagcagtagcaggaaagaaacagagcacacaacaacattttgtattaaattattctgctacaataaatggggataagttgttccatatccaaaa

SEQ ID NO: 1312 - DNA, 1506 bp, Fragaria vesca
tccgaatcattttactaaacggggtcttatgtattttgcttctagctaaggatttgggtgaaattctggcaaagcttgcatcttggtttctgggtcttctcgtttaggttgttataactgttgactagcttgtgtgaaggaaaatggttgtatttcctggaggaaattaagcaacaggatattgatgatatgattcagctcagctgcacatgttcaaatgataactaggaaaatggaaacgaagctgttcttaaattccttatcagaagtcagaaacccaatagaccgagagagtggttgatcaatggcgtcacagtcagaaggtcaggcaaagataattgatggcaaaaccatagcacagactatccgatctgaaattgctgaggaagttcaccatctatctcagaaatatggcaaggtccctggactggcagtagttattgtggggagcaggaaggactcccaaagctatgtcagcatgaagcgaaaggcatgtgctgaagttggcattaaatctgtggacatagatctccctgagaatgtgtctctagatgatctcatagccaaagttcacgaattaaatgtgaatcctgatgtacatggcatacttgttcagcttccgttgccaaggcatattaatgaagagaaagtcttaagtgaaatcagcattgagaaggatgtagatgggtttcatcctctcaacatcggcaagcttgcaatgaaaggcagagaacctttattcctcccttgcactcccaagggctgtcttgaacttctgtcgcggagtggtataagcatagcgggaaagaaggcagtggtggtgggaagaagtaacatagttggattgccagtttcattgctgcttttgaaagccaatgctactgttaccatagttcattccaacacttctgatcccgagactatcattcgtgaagcggatattattattgctgcagtaggacaggcaatgatgatcaagggtagctggataaaaccaggtgctgcaatcatagatgttggcacaaatgctgtggatgactccagcaaaaagtcgggttatagattggtcggggatgtagatttccaagaagcatgtaaggtagctggatggataactccagttcctggtggagttggtccgatgactgttgcaatgcttctcaagaacacattggatggtgctaagcgtgtgattgcagagtaaagaaggactaaaggcagctgttaatctgtttttagtccccataataagctgttgctaatttcaggagacaattttgcaatggagtttacaggctttgatggacaatcttgtagttttcagtttttcactgatattgcatggtgttatgaatactttgtaaactaaatcctttctgagtttgatttctttcttcccaaattccttttagctttctattgttactgtaaaattttgtcaaaactaaactaaatttgtatttgtgccaaagatagtaaagagtaaatcgttataatgatgcaatc

SEQ ID NO: 1313 - DNA, 1425 bp, Valeriana officinalis
cactagtactagtgtgaggatctgagagcaaggctcatctgattcttcctagaaatggcgtcgtcggagcataaagccaccatcatccatggcaaactaattgctcaaacgattagatctgaaatcgcctccgaagttcgcatcctgtctgatcaatatggaaaggtcccaggactggcagtagttatagtaggaaataggaaagattctcagagctatgtgaacatgaagagaaaggcatgtgctgaggttggaattaagtccattgatatagaccttcctgagcaagtacctgaatctgagctcatcagcaaggttcatgaactaaatgctgatcctgaagtacatggtatacttgtccagcttccattaccgaagcatataaacgaagagaacatattaactgaaattagcattgagaaagatgttgatggctttcatcctttaaacattggaaagcttgctatgaaaggcagagaacctctgttcgttccttgcactcccaagggatgcattgaacttctttcaagaagcggtatcaccataaaaggaaagaaggcggttgtcgtaggtcgaagcaacatagttggattaccagtttcattgttgcttctcaaggctgatgctactgttactgttgttcactcacatactaaagatccagagactatcattcgtgaagcggacattgtgattgctgcagcaggacaggcatcgatgataaaagggagttggattaaacccggggcagctgttattgatgtgggaacaaattccgtagatgatccgagcaaaaaatcgggatatagacttgtaggagatgtcgattatgctgaagcttgtaaggtagctggctggattactccggttcctggaggtgttggaccgatgaccgttgcaatgttgctcaagaacactctggagagtgccaaacgcgtgtttcaaaactaaaccattctccggcttctctgtcggttcttgtaactccaggttttgaaattctcgcaatctcattctacgtagataaatttaaaataaaatcatgtgcttgcatatgtttcttagattagtagtatgtatcacagagcaccgtgctgacgatatctagataatctggagtaaatgttgttcttattcgtctcatactctcatctgtactgacatttcttattgcttcttttgttacctagcgtgcttttatgtgcgtgattgcatgcatcattatacatatatagaaagataggttacttaaatattttgctaaaaaaaataggttacataaatatattagatcatggtgggcgtatacaacgtccctttacttgctacaacatgactagtttagtttgactatgtatgatgtacgttagtaaactcttagttgtttagacaacagacaagactcgaagtcgtggtagtaaggtt

SEQ ID NO: 1314 - DNA, 1079 bp, Platanus occidentalis
ccagtgaacgtttttcaggattcgaggtcccgtcaatgtcgtcgtcatcatcgtcggatcatcaggcttccatcatcgatggcaaagccattgctcagacgatccgatctgaaatcgctgccgaagttcaccatctcttaaacaaatacggcaaggtccctggactggctgttgtcattgtgggtagcaggaaagattctcaaagctatgtgaatatgaaaaggaaggcatgtgctgaagttgggatcaagtcatttgatgtagaccttccagagcaagtatctgaagaagatgtgatcaagaaggtccatgaattaaatgcacatcctgatgtacatggaatactggttcaacttccattgccaaagcatataaatgaggagaaagtattaagtgaaatcagcattgataaggatgtggatgggtttcatccactgaacattggcaagcttgcgatgaaaggcagagaacctttgtttctgccttgcacacctaagggatgtcttgaacttctatcacggagtggaataagtgtaaagggaaagagggcagttgtggtaggtagaagcaacattgttggattgccagttgcactgctgcttctcaaggcagatgcaaccgttaccatagttcactcacatacccatgattctgagaacatcattcgaggagcagatattgttattgctgcagcaggacaagcaatgatgatcaagggtgattggattaaacctggtgcagccgttattgatgttggaacaaatgctgttgatgacccgcgtaagaaatcaggttacaggcttgtaggagatgtggacttccatgaagcatgtaaggtagctggatgggtgactccagttccaggtggtgtgggcccaatgactgttgcaatgctactcaagaataccttggacggagctaaacataaaatggagcagtaaatccttatcttctgtagttttgttttattaatttttcataatattatgttgtgaatcttatcagtggaaaaaataaagtatgttgacatcttaaagctttgatcttaaaaggaaacattgctattaatgaaatatttt

SEQ ID NO: 1315 - DNA, 1110 bp, Daucus carota
tatatcctcctcgtattttgtgccttacctatacataaactcatacatttgctcaatcaacttgtttcaaaaatggcgtcgccgtcggatcaccaggccaccgtcatcgacggcaaggcaatagctcagactattcgatctgaaatcgcgtcggaagttagcattctctccgaaaagtactccaaagtcccaggattggctgttgtgattgtaggatgtaggaaggattctcagagctatgtgagcatgaaaaggaaggcatgtgccgaagttgggattaaatccttcgacatagatcttccggaggacgtacctgaggctgaattgattgccaaggtagatgagttaaatgcaaatcctcaagtacacggtatacttgtccagcttccactaccaaaacatataaatgaagagaaaatattatctcaaatcagcctcgagaaggatgtcgatggctttcatcctctgaacattggcaagcttgccatgaaaggaagagaccccctgtttcttccttgcactcctaagggatgtcttgaacttttgtcaagaagtggtattagcattaaggggaagaaggcagtagtggtgggtcgaagtaacattgttggattaccagtttcacttctacttcttaaggcggatgccactgttaccgtagtccactcacgtactccagatccagagagttacatacgtgaagcagacatagtgattgctgcagcaggacaggcaatgatgataaaaggaagctggataaagcctggtgctgctgtgattgatgttgggaccaatgctgttaatgatccaagtcgaaagtcagggtataggcttgtgggagatgttgattttcaggaagcttgtaaggtagccggttggattacacctgttccaggaggcgtaggaccactgactgttgcaatgttactccaaaatactttggaaggtgccaagcgagtgatcgggcagtaaatttcagtaaatttatgttgctacttgctagaggcatcaaggtctgaacagttctaaagaacaacccttggtggatgaaattttcactctctctagtgtttgctgcgactggcaagttgcagatatgtattatttttt

SEQ ID NO: 1316 - DNA, 990 bp, Chrysanthemum coronarium
tagtcggttgttattgctatggcattgcctgtagaccatagagcccagattatcgatggaaaagcaattgctcaaacaattcgtgatgaaatcgcatccgaagtcagtatcttggttgagaaatacggcaaggcaccaggacttgctgtggtgattgttggacacagaaaagattctcaaagctatgttaatatgaagagaaaagcatgtgcagaggttggaattaagtctattgacatagaccttccagaacaagtgcccgaagctgaattgatcgcaaaggtccacgagttaaatgcagatcccgaagtacatggcatattggttcaacttcctttaccgaaacacataaacgaagaaaaagtcctaacagaaatcagtatcgacaaggatgtagatggctttcatcctctcaacattggcaaactggcaatgaaaggcagagacccgctctttcttccttgcaccccaaagggatgtatcgaacttttgaaacgcagtggtgttaccataaagggaaagcgggcagtggttgttggtcgaagtaacattgttggcttaccggtctcgctgctgttactgaaagcagatgctacagttactgtagttcattcacatacacccgatccagaatgtatcattcgtgaggcagacatcgttattgctgcagctggacaagctatgatgataaagggtagttggctaaaacctggtgctgcagttatcgacgtcggtacaaatgcagttgacgatgctagtaaaaaatcaggatacaggcttgtaggtgatgttgattatcaggaaggatgtaaagtggccggatgtattacgcccgttccaggaggtgtgggacccatgaccgtagctatgctccttaaaaacactttggatggcgccaaacgtgtcatcgggcagtagaccaattctaagtcattgcagttttttgttacaagacatgtgatatagcaaaatactattttacatcatgtt

SEQ ID NO: 1317 - DNA, 1215 bp, Cirsium arvense
ccacaccagttaacatcgtatccgtctttcatcgtcggcacaccgccattgttatacacgaaaaacactgtgctgttaatcgccatccacattctctctctattattgaatcgaaacgattcctaaaatccagcaaaaagttctggatttctgctgtttgccgcctaatcaggttggtggagtctcgatatccaagtagtttatcattatggcgttgcctgtagatcataaggccaacatcattgacggaaaaacaatcgctcaaacaatccgttctgaaatagcttctgaagtcagtaacttgatcgagaaatatggcaaggcaccgggacttgctgtggtcatcgttggacatagaaaagattcacaaagctacgtaaatatgaagagaaaagcatgtgccgaagttggaatcaagtctattgacatagaccttccggaacaagtacccgaagctgagttgatcgcaaaggtccatgagttaaatgtggatcccaatatacatggcatattggttcagcttcctttgccgaaacacataaatgaagaaaacgtcttaactgcaattagcatcgaaaaggacgtagatggttttcatcctttgaacatcggcaaacttgctatgaaaggccgagaaccgctctttcttccttgcacaccaaagggatgtattgaacttcttaaacgaagtggtattaccataaagggaaagcgggcagtggtggttggtcgaagtaacattgttggcttaccggtttcactactactgctgaaggccgatgccacagttactatagttcattcgcacacggtggattcggaaaccatcattcgtgaagcggatatcgttattgctgcagctggacaagctatgatgataaaaggtagttggattaagcccggtgctgcagttattgacgttggaacaaatgccgttgatgatcctagtagaaaaagcggatatcggcttgtgggtgatgtcgatttccaagaagcatgtaaagtagctgaatggattacgcccgttccaggtggcgtggggcccatgactgtagcgatgcttcttaaaaacacgttggatggtgccaaacgtgttattgggaagtaaaaaaccgttaagaaatcatttccgttttttttttattgtcaaatgatgttgtagttttattaagcatatataagctcatttgattttgacgctttgaatgttataag

SEQ ID NO: 1318 - DNA, 1273 bp, Fagopyrum esculentum
gttattgtcttattcatacagcgactcacaaactgtaatcagagggtaacctgcggtctcagatctcatggcgacttcatcggaacatacggcgtccattatcgacggcaaggcaatcgcccagaccattcgatctgaacttgccgatgaagtccgcatcatgtccagtaaattcggcagagtaccaggattggccgtggtaattgttggtaataggaaggattctcaaagctatgtgaacatgaaaagaaaagcttgtgctgaagttgggatcaagtccattgacattgatctacccgagcaagtgtccgaagctgagctgatcggaaaagttcacgagttaaatgcaaaccctgatgtacatggtattttggtccagcttccattgcctaagcatatcaatgaagagaaagttttgggtgaaatcagcatcgaaaaggatgtagatggcttccatcctttgaatatcggaaaacttgccatgaaaggcagagatcctctatttcaaccttgcaccccaaagggttgtcttgagttgctgtcacgaagcggcatcagtgttaaaggaaagaaggctgttgttgtaggtcgcagtaacattgttggattaccagtttcattacttctattgaaagctgatgctactgttactacagtccattcccgtactgatgagccggagaaacatattcgtgaagcggatattgtaattgctgctgctggacaacctatgatggttagaggtgattggctaaaacctggtgcagccgtgatagatgtcgggacaaatgcagttgatgatcctactaagaagtctggttacaggctagtaggagatgtacattttgccgaagcttgcaaagttgcagggtggattacacctgtccccggaggcgtggggccgatgactgttgcaatgttacttcggaatactgtggatggtgccaagcgagtaatcgagaactgagatatgctttcttcacattaaggcatgtcttcattgtaccttttattgtctatcaaatgaatgttgttcattgatcatcctggtacctgctttataaacttcaatcagcaagatagtcattttcttactagtttttatgaattcaacttttttaaatgtgtttctaggcaatttcactgtttctcttctggctgccaattgatcagatgatctaaagcagttgtctattggaagagttttaaaggcaaatatgagttggcaaaagcttcggcccatatctttcagtgaagtatactaacgcattat

SEQ ID NO: 1319 - DNA, 1127 bp, Ipomoea nil
gatcggcgaggaggagagcataaacatcactacatcgacgcagtcgacgagttccggataaaggtctgtgcactggaaacgcaataccgccgtcgccctgtcaggaatcatctcatttgcgccgtgaatccacccagctcgagctgcaatgtcatcaggatcagatcatcaagccaccgtcatagatggtaaagctattgcacaaaccattcgatctgagattgcctcggaaataaaagtcatgttggagaagtatggccaggtgccagggttggcagtagtcattgtaggaaatcggaaagattctcaaagctatgtgaatatgaagagaaagtcttgtgctgaagttgggattaagtcctttgacatcaaccttccagaggatgtacctgaagctgaattaattagcaaggtccatgagctgaatgctaatcccgatgtgcatggtatattggtgcagcttccgctaccaaaacatataaatgaagaaaaagtattaggcgaaatcagtctggagaaggatgtagatggctttcatcctctaaacattggcaagcttgcaatgaaaggcagagatcctttgttccttccatgcaccccaaagggttgccttgaacttctattccgaagtggtgttaccataaaagggaagaaggcagttgtggttggtcgaagcaacattgttggattgccagtttcgttgctacttctgaaggaagatgcaactgtcactatagtccattctcgcactaaggatccagagagcttcattcgcgaagcagacattgttattgcagcagcaggacagccaatgatgatcaaaggaagctggattaaacccggagctgctgtgattgatgttggaacaaatgctgtagacgatccaactaagaaatcgggttataggctcgtgggtgatgtcgattttcaggaagcgtccaaggtagctggatgcataactccagttcctggtggcgtcgggccactaacagtcgcaatgcttctgaagaatacattggatggagctaaacgagttattgagaagtagccttgttgttttgttggattttaaggcactgtctaagttgaagtttatgagtttatcaacctttcctgaagctcaagaa

SEQ ID NO: 1320 - DNA, 1061 bp, Quercus alba
atggggaactccaattttaactccaaatcgtgactttcaatcgagtctcttcggataaacatggcatcaccgtcggatcacaaggccaacattatcgacggcaaagccatcgctcaaaccatccgcaatgaaatcgccgctgaagtccaccaactatcgcaaaaacacggcaaggtcccagggctggctgtagtgattgtgggcaacaggaaggattctcaaagctatgtgaatatgaagagaaaggcatgtgctgaagttgggattaagtcgtttgacatagaccttccggagcaagtttctgaagctgagttgatcgctaaagttgatgagttaaatgcaaatcctgatgtacatggaatattggttcaactcccattgccaaagcatataaatgaagagaaagttctgactgaaatcagcattgagaaggatgtagatggctttcatccgctgaacattggcaagcttgcaatgaaaggcagagatcccttgttccttccttgcacccctaaggggtgtcttgaacttctgtcacgaagtggtataactgtaaagggaaagaaagcagttgtggtgggtcgaagtaacatagttggattgccagtttccctgctacttctgaaagcagatgctacagttaccatagtccattcacattctcaagatcctgaaaaagtcattcgtgaagcagacatcattattgcagcagcagggcaagcaatgatggtcaaaggtagttggatcaaacctggtgctgcagttattgatgttggcacaaatgctatcgatgacccaagtaagaagtcaggctataggctagttggagatgttcattaccaggaagcatgtaaggtagctggatggataactcctgttccgggtggagtggggccaatgactgttgcaatgctactgaagaatactttggatggtgctaagcgtgtaattgagcattaaatccatgtctttgttcactttcagaataagatgttgcctatgagatacagttttgaaacacattttattcgtatcatccaataagaatttgctttcctgtt

SEQ ID NO: 1321 - DNA, 1262 bp, Chenopodium quinoa
aagaatcaaccgcatattcagattgagatagattcaatcaaaatgtctgcaaaaattatcgacggaaaagccattgctcagactattcgatccgaaatcgccgatgaagttcgtcttctatctcaaattcacgctaaggtccctggactggcagtagtcatcgtgggcaacaggaaagattctcaaagctatgtgaatatgaaaaggaaagcatgtgctgaggtggggatcaagtcctttgacatagaccttcctgagcaagtttcagagcctgaattgatcgccaaggttcatgagttaaatgcaaatcccgaagtacatggtatacttgttcagcttccattgcccaaacatataaatgaagaaaatgttttaagtgaaataagcattgagaaggatgtagatggtttccatcctctgaacatcggaaaacttgcaatgaaaggcagagaccccctcttccagccttgcacaccaaagggctgtcttgagcttctgtctcgaagcggcatcagtataaaaggcaagaaggcagttgttgtaggtcgtagtaatattgttggattgccggtttcactactcctcttgaaagcagatgcaaccattagtattgtccactctcgtacaactgatcctgaaagcatcattcgtgaagctgacatcgtcattgctgcagcaggacaagccatgatgattaaaggtgactggatcaagcctggtgctgctgtgattgatgtggggacaaatgcagtggatgatccaagtaagaagtcaggttaccgtcttgtgggggatgttgatttccatgaagttagtaaagtagcaggatggattactcctgtccctggaggtgttggacccatgactgtagccatgcttttgagaaatactctggatggtgccaaacgtgtgatcgggcaatgagcacctctcatcaaggcatgccccatgctattcctcctattaagagttcaatagaaatttgtctgtgattatctggttctggttttggttctgttgatttcgctcatgtttcataacagtattacatttagactcttgttgaagtatcatatctttcacaagtagagtggtgctgtctgtattgttagggatcagtatcctgttcagggaataaattgtgtaatttctgaagaatgtgatattacatgatgtatttgtctctcttgatgtaatgctgtccttagcaatgctcttagataggaaaaatacatcatttaatatcacattcttcagaaatt

SEQ ID NO: 1322 - DNA, 1196 bp, Silene vulgaris
gttgaatctggccttggatagaatcaacaaaaatgtcgacgccggagcatcaagctaaattaatcgacggcaaagcaattgctcagacaatccgatcggaaatcgccattgaagttcgtcaattatccgatacctatgccaaggttcctggattggcagtagtccttgtcggtgagaggaaggactctcaaacttatgtgaatatgaaaaagaaggcatgcgcagaggtgggaatcaagtcatttgaagttgaacttcctgagcaagtttctgaatctgagttgatctccaaggtgcatgatctgaatacaaatcctgaagtacacggtatactagttcagcttccgttacctaaacatattaacgaagaaaatgtattaagtgcaatcagcatcgaaaaggatgtggatggcttccatcctttgaatattggaaagcttgcaatgaaaggaagacatcctctctttgagccttgcaccccaaagggctgtattgagcttctgtctcggagtggtgtcactataaaaggcaagaaggcagttgttgtagggcgaagtaacattgttggactgccagttgcactccttctcttgaaagcggatgcaactgttagtattgtccactctcgtacaagtgatcctgaacagataattcgtgaagctgatatcgtcatcgccgcagcaggacaagccatgatgattaaaggcgactggattaagcctggtgctgcggtaatagatgtagggacaaatgcaattgatgatccaagtaaaaagtcaggctacagactggttggagatgttgatttccatgaggctagcaaagtggcaggatgtataactcctgttcctggaggtgttggccctatgacagtagccatgctgctgaggaataccgttgatggagccaagcgtgtgattcagaagtgatctctgttcttcattaaggtgcctggaagaactctgcagtattacaaaggcactgcatcaatgttataaacttaaaggactaaaggccgtgaaggaacgacaggaattcgaaatcagtctaccgaataaagtctcgaaattctccctccttagtttcatttacctagcaatacgacttgtaaagttggttcagtgcggttcaaatatgaaattttgaacctaaaccttaccctaccaaagatctgccaggacatgaatgatatgagc

SEQ ID NO: 1323 - DNA, 1214 bp, Vinca minor
aactccaataggtacagtagaattgagtatactactaatttcatttggagaaggatggcgtcggcaccggaggatcagaaagccaccataatcgacggcaaagcaatagctcaaacaatcagatctgagatcgccgaccaagtccggctgctctccgagaagtacaacaaggtaccagggttggcagtagtgattgtaggtagtaggaaggactctcaaagctatgtgagtatgaagaggaaagcatgtgctgaggttgggattaagtcttttgacatagaccttccagaggacgtatccgaagctgctgtgatcgacaaggtccatgagttgaatgcaaatcctgatgtacatggtatattggtccagctaccacttccaaagcatataaatgaagagaaagtattgagtgaaattagcttggagaaggatgttgatggatttcaccctctgaacattgggaagcttgcaatgaaaggcagagaacctctattctctccttgcacccccaagggttgtattgagcttctttcacggagtgggattaccataaagggcaagagggcagttgtggtaggtagaagcaacatagttgggttaccggtttccctactacttctcaaggaagatgctactgtcactgtggttcattcccgtactaaggaacctgagaatattattcgtgaagctgacattgttattgctgcagcaggacaagcaatgatgattaaagggagttggattaaacccggtgctgcagttattgatgtggggacaaatgcggttgaagacccgaagaagaaatcaggttacagacttgttggagatgttgatttcgaagaagcatgtaaagtagctggatacataactccagttcctggtggtgttggtccaatgactgttgccatgctactgaagaacacattcgacggggctaagcatgtcattgagcactgatttctatttcagttaccttttcaaaatgtgaaattatataataaaatttttttaaaattttaaggttctatttggctgtgggaataagaacttatcttactattttcaaaatattctaacttcaggttattgtttcatctgttgttgtttcttttaggactaggatcttcactttctagttccttttgtttcattatgggcatttttcctcttcattgttctgttgattggtcagaggggttggccccttcctcaac

SEQ ID NO: 1324 - DNA, 1282 bp, Citrullus lanatus
cagacggacccatttctcgcgaaccacaattgatctacccaatccaagcccatcagattcctctcgatcaattccatggttgcatcaactcatgagtacacaatcaatccttctcaatctcagctcatccgttacgctgttctgtgagccattgccactggtaccagcaattcagaattggtaagcattttcgccttctcacctgcaaaaatggcgtccgaatccgatcacaaagctacaataatcgacggcaaagcaatcgcacagactgtcagatctgaaatcgcagaggaagtgaacaaactctctgagaaatatggaaaggttccaggactggcggtggtgattgtggggaatagaaaggattcgctgacctatgtaactatgaagagaaaggcttgcgcggaagtcggaatcaagtcctttgagattgatcttcctgagaaagtgtctgaggctgaattgatcagcaaggtccatgagctcaatgccaatcctgaagtacatgggatattggttcagcttcctttgccaaatcacataactgaagagaaagttctatctgaaatcagcattgagaaggatgtagatggctttcatcctctgaacattgggaagcttgcaatgaaaggcagagatcccttattcctaccttgcactccgaaggggtgtcttgagctgctgtcacgaagtggaataagcatcaggggaaagaaagcagttgttatggggcgaagcaacatagttggattaccagtttcattgttgcttcttaaagcagatgcaactgtgacaattgtccattcacgttctgtcgatccagaaagtgttatccgcgaagcagacattgtgattgctgcagcaggacaggcacaattgatcaaggggagttggatcaaaccaggtgctgcagtcatcgatgtcggtacaaatgcagttgatgatccaaccaagaagtcgggctaccggctggtcggggatgtagattttcaggaagcttgtaaggtagctggttggataactcctgttcctggtggcgttggccctatgactgttgccatgctgcttaggaatactctggatggggctaagcgtgtgatcgagcagtgaagatatacctcagcttgttatggattctcgtagcactttttgagagtaatttcgaaataaatggtttatttgtttggtgcttgtactcgtagttggtttctacagaaaattatggagtaatttaaaacaaaacaaaacacctaaatcttgaaaatcaatttgaattaaaaaa

SEQ ID NO: 1325 - DNA, 1153 bp, Daucus carota
cattctctccgaaaagtactccacaactgcaccccaagctacggatattatatcctcctcgtattttgtgccttacctatacatacactaatacatttgctcaatcaacttgtttcaaaaatggcgtcgccgtcggatcaccaggccaccgtcatcgacggcaaggcaatagctcagactattcgatctgaaatcgcgtcggaagttagcattctctccgaaaagtactccaaagtcccaggattggctgttgtgattgtaggatgtaggaaggattctcagagctatgtgagcatgaaaaggaaggcttgtgctgaagttgggattaaatctttcgacatagatcttccggaagacgtgcctgaggctgaattgattgccaaggtagatgagttaaatgcaaatcctcaagtacacggtatacttgtccagcttccattaccaaaacatataaatgaagagaaaatattatctcaaatcagcctcgagaaggatgttgatggctttcatcctctgaacattggcaagcttgccatgaaaggaagagacccgctgtttcttccttgcactcccaagggatgtcttgaacttttgtcaagaagtggtattagcattaaggggaagaaggcagtagtggtgggtcaaagtaacattgttggattaccagtttcacttctgcttcttaaggcggatgccactgttaccgtagtccactcacgtactccagatccagagagttacatacgtgaagcagacatagtgattgctgcagctggacaggcaatgatgataaaaggaagctggataaagcctggggctgctgtaattgatgttgggactaatgctgtaaacgatccgagtcgaaagtcagggtataggcttgtgggagatgttgattttcaggaagcttgtaaggtagctggttggattactcctgttccaggaggagtaggaccactgactgttgcaatgttactccaaaatactttggaaggtgccaagcgagtgatcgggcagtaaatttcagtaaatttatgttgctacttgctagaggcgtcagggtctgaacagttctaaagaacagcccttggtggatgaaactgacactctctctggtctgtgctgtgactggcaagttgcagatatgtattaa

SEQ ID NO: 1326 - DNA, 1063 bp, Castanea mollissima
tcggataaacatggcatcaccgtcggatcacaaggccaaaattatcgacggcaaagccatcgctcaaaccattcgcaatgaaatcgccgctgaagtccaccaactatcgcaaaaacacggcaaggtccctgggctggctgtagtgattgtgggcaacaggaaggattctcaaagctatgtgaatatgaagagaaaggcgtgtgctgaagttgggattaagtcgtttgacatagaccttccggagcaagtttctgaagctgagttgatcgctaaagttgatgagttaaatgcaaatcctgatgtacatggaatattggttcaactcccattgccaaagcatataaatgaagagaaagttctgactgaaatcagcattgagaaggacgtagatggctttcatccgctgaacattggcaagcttgcaatgaaaggcagagatcccttgttccttccttgcacccctaaggggtgtcttgaacttctgtcacgaagtggtataactgtaaagggaaagaaagcagttgtggtgggtcgaagtaacatagttggattgccggtttccctgctacttctgaaagcagatgctacagttaccatagtccattcacactctcaagatcctgaaaaagtcattcgtgaagcagacatcattattgcagcggcagggcaggcaatgatggtcaaaggtagttggatcaaacctggtgctgcagttattgatgttggcacaaatgctatcgatgacccaagtaagaagtcaggctataggctagttggagatgttcattaccaggaagcatgtgaggtagctggatgggttactccagttccgggtggtgtgggaccaatgaccgttgcaatgctactgaagaatactttggatggtgctaagcgtgtaattgagcattaaatccatgtctttgttcactttcagaataagatgttgcctatgagatacagttttgaaacacattttattcgtatcatccaataagaattttgctttcctgttacaattcactgttgaattttggttttgctggtatgaatttataaaatcgac

SEQ ID NO: 1327 - DNA, 1170 bp, Ambrosia trifida
acccacacacccacctctcaatctcttattgtcactagatttgtgctcctgtttaactatcactcaggttggttgaatcttgatatattgtgttattattcagatggcattgcctgtagatcataaagcaaacatcattgatgggaaattaatcgcacaaacgattcgttctgaaatagcctctgaagtcagtgtcttggttgagaaatatggcaaggcacctggacttgctgtagtaatcgttggacataggaaagattctcaaagttacgttaatatgaagaggaaagcgtgtgctgaggttggaattaagtcaattgacattgaccttccggaagaagtaccggaagctgaactgatagcaaaagttcatgaactaaatgcagatcccgatgtacatggcatattggttcaacttcctttgccaaaacacattaatgaagaaaaagttttaactgaaatcagcatagaaaaggatgtcgatggctttcatccgctcaacattggcaaactcgctatgaaaggcagagacccactctttcttccttgcaccccaaagggatgtattgagcttcttaaacgcagtggagttaccataaagggaaaacgagccgtggttgttggcagaagtaacattgtagggttaccagtttcattgctgctactgaaagaagacgctacagttactgtagttcactcacgtacagaagacccgcaaagtattattcgtgaggcagacattgttattgctgctgcaggacaagctatgatgataaaaggtagctggataaaacctggtgctgcagtgatagatgtgggaacaaatgcagtcgatgattccactagaaaatcaggatataggctggtgggtgacgtggattttcaagaagcatgtaaggtggctggatggattacacctgtcccaggaggtgtgggacccatgacagtagcaatgctccttaaaaacacattggatggtgctaaacgtgtgattggtcactaaattaaccttaattttctgttaccagaagtcttctaaaaaaaatacataccgatgttgtaccttttttgaggtcgtttaatattgacttttggtctgtattaagaatattgttaatttcttttctttctttttttcaataataatgggaaatgggttgtatcaaaaaa

SEQ ID NO: 1328 - DNA, 1186 bp, Artemisia annua
gatctgtgtgttaaaaaaagcatcaagattttgtttggtgggatcttgatatactcagttgttggttgttatcgctatggcattgcctgtagaccataaagcacacattattgatggaaaagcaattgcacaaacaattcgtgatgaaatcgcctctgaagtcaaaattttggttgagaaatatggcaaggcaccaggacttgctgtggtgattgttggacacagaaaagattctcaaagctatgttaatatgaagagaaaagcgtgtgccgaggttggaattaagtctattgacatagaccttccagaacaagtgcccgaagctgaattgatcgcaaaggtccatgagttaaatgcagatcccgaagtacatggcatattggttcagcttcctttaccaaaacacataaatgaagaaaaagtcttaacagaaatcagtatcgacaaggatgtagatggctttcatcctctcaacattggcaaactggcaatgaaaggcagagaccctctctttcttccttgcaccccaaagggatgtattgaacttctgaaacgcagtggtgttatcataaagggaaagcgggcagtggttgttggtcgaagtaacattgttggcttaccggtgtcactgctgttactgaaagcagatgctacagttactgtagttcattcgcgtacacccgatccagaaaatatcatacgtgaggcagacattgttattgctgcagctggacaagctatgatgataaagggtagttggctaaaacctggtgctgcagttatcgacgtgggtacaaatgcagttgatgatcctagtagaaaatctggatacaggcttgtaggtgatgtcgattatcaagaaggatgtaaagtcgccggatgtattacgcccgttccagggggtgttggacccatgaccgtagcaatgctacttaaaaacactttggacggcgccaaacgtgtgatcgggcagtaaaccaattctaagtcattccagttttcattactgagacatgttattatagcaagtactatttcatcatgttgtagttttgttgatcatataaacttatttcattttgactgtataatagtattattcattttcaacgacaactggctttggtttacagttctatctaaagtttatttatatatttattcatcatatggttgatattggaaa

SEQ ID NO: 1329 - DNA, 1347 bp, Cucurbita pepo
gtagcgcagtccatcgcccaaaatcgaagcccatcagattcctcaactgcgatttcatggttgcacctattcagcgagtctaaaatcaatccttctcgatctcagctcatccattacaaccttctgcgagagacattgtcactggtcgcaattcagaagggataagcattttcgccttgtcacctgcaataatggcgtccgaatccgagcacaaagctacaataatcgacggcaaacaaattgctcagactgttagatctgaaatagcggaggaagtgaaaaaactctctgagaaatacggaaaggttccggggttggcggttgtgattgtggggagtagaaaggattcgcagagttatgtgaacatgaagagaaaggcttgcgcggaagttggaatcaagtcctttgattatgatcttcctgagcaagtgtctgaggccgaattgatcagcaagatccatgagttgaatgcgaatcctgaagtgcatgggatattggttcaacttcctttgccaaagcacataaatgaggaaaaagttttatctgaaatcaacattgagaaggatgtagatgggtttcatcctctgaacattgggaaacttgcaatgaaaggcagagatcccttattcctaccttgcactccaaaggggtgtcttgagctactgtcacgaagtggaataagcattaggggaaagaaggcagttgttatggggcgaagcaacatcgttggattaccagtttcattgctgctccttaaagcagatgcaactgtgacgattgtccattcccgttctgtcaatccagaaagtgttatccgcgaagctgacattgttattgctgctgcaggacaggcacaaatgatcaagggcagttggataaaaccaggggctgcagtgattgatgttggtacaaacgcagttgatgatcccaccagaaagtcgggctaccggctggttggggatgtagatttccaggaagcttgtaaagtggctggttgggtaactcctgttcccggtggtgtgggccctatgactgttgccatgctgcttaggaacactttagatggagctaagcgtgtgatcgagcagtgataccatacccatatcaagtggcttcattgttgtgtttctaaggtcttgcaaatttgcggagacaattttgtagggaaaataaaaccttaataatcgtgtggatatcttgaagaatgaataattttagcttgttgaatgttaatatggatccttgtgggactttcttagtaatttataaataaatgttctacctattttgtgcgaaaaaaaaaaaaaataaaatactgtgtgtgtactaccatcgttctttcgtagg

SEQ ID NO: 1330 - DNA, 1259 bp, Solanum melongena
aacaacaaaacaaaaagagtgaaatatttccacagtgccctcttcgtctcacctactctccaatttttcttacagatctgccgaaataatttctgggctaaaattagcaagaatttgttgctcagtgtgaagttataggcaattcatctctcatctgaagatacaatggcatcaccgtcagatcacaaggctaccatcattgatggtaaagcaattgctcaaactattcgttctgagattgcttcggaagtccaacgtctttcagaaaagtatggcaaggtccccgggttggcagttgtcattgtaggaaataggaaggattcacaaagttatgtgaatatgaagagaaaatcttgtgctgagctttgcatcaagtcttttgacgtagacctcccagaggatgtagctgaagctgaggtgattagcaaggtgcatgagctgaatgctaatcctgatgtacatggtatactggtacagcttccgttaccaaaacatattaatgaagagaaagttctatgtgaaatcagtctggaaaaggatgtagatggctttcatcctctgaatattggcaagcttgcaatgaaaggccgacaacctttgttcaacccttgcacacccaagggatgcattgagcttttagtccgaagcgggattagcataaaggggaagaacgcagttgtggttggtcgaagcaacattgttggattaccagtatctctgcttcttctgaaggaagatgccactgttactatagtccattcacgcaccaaggaaccagagaagatcattcgtgaagcggacattatcattgctgctgcagggcaggctatgatgatcaaaggcagctggatcaaacctggtgctgcagtaattgatgttgggacaaatgctgtagatgatcctactaggaagtcaggttacaggctcgttggagatgtcgattttcaggaagcatgtaaggtggctggctggataactccagttccgggaggcgttggaccaatgactgttgcaatgcttctgaagaatacactggatggagctaaacgagttatcgagaagtaaacacttcatttgctctgtagaacaacacaataagaagatatgcctaaggcttcttagctattgacaatacattgaagaaataacaatgagattgttcttgttatatggagttttgtattgaaaagtcttgaagttttataacccctctcttgttacgcatcgatcaaatatatatcggatcttaggtttatagc

SEQ ID NO: 1331 - DNA, 1174 bp, Euphorbia peplus
gagtagttagagagagttcagcgctgcctgcaattcttatcgtctctatctatctagtcgtatctccccaaaccaaataatggcgtcaccgtcagatcacaaggccaccataatcgacggtaagaccatagcccagaccatacgatctgaaatcgccgacgaagtccgtcttctctctcagaaatactccaaggttccaggattggctgttgtcattgtagggaatagaaaggattctcaaagctatgtaaatatgaaaagaaaggcatgtgcagaagttgggatcaaatcacttgatgtagacctccccgaacaaatatctgaaactgaactcatcgccaaggtccaccaactaaatgcaaattccgatgtacatggaatattggttcagcttccgttgccaaagcatattaatgaagagaaggttttgagtgcaattagtattgaaaaggatgtggatggttttcatccgctgaatatcggcaagcttgcaatgaaaggcagagaacctctttttcttccctgcacccctaagggatgtctggaacttctatcacgaagtggtatagatataaaggggaaaaaggcagttgttgtaggtcgtagcaacatagttgggttgccagtgtcattgctgcttctgaaagcagatgcaactgttaccatagttcattctcgttctgaagatcaagaaagtatcattcgtgaagctgacatcattattgcagcagcagggcaagctatgatgattaaaggaagctggattaagcctggtgctgcagtaattgatgttggaacaaatgctgttgatgacccgactaagaaggcaggttataggctagtcggagatgtagattacaaggaagcatgcaaagtagccggatggattactcctgttccaggtggtgttggtccaatgactgttgcaatgctactcaagaacacattagatggtgcaaagcgtgaatttgaacagtaatgctccacaatttttctcttcacaattggacctagcacattctgaccccttgtactgtttattttttgtaatcgtgtgtctgcaattttgttggaatccaagaatttatttatgcttagaaactgtctcaatatattgtctaaattttcattttcaatgtcgaactgaagaaaaacgttaagactgtttgatatg

SEQ ID NO: 1332 - DNA, 1068 bp, Chenopodium quinoa
tttctcccttatcttgctgcctgcccacgagttgcgcgaaatgacaattttacccttgctaaaagccctcttgcaaatcgaagacaaactgacaaattatatccaacacaacgcctatgtgcatcactcctgaagaatcaaccgcatattcagatagattcaatcaaaatgtctgcaaaaattatcgacggaaaagccattgctcagactattcgaaacgaaatcgcggatgaagttcgtcttctctcccaaaatcactctaaggtccctggactggcagtagtcatcgtgggcaacaggaaggattctcaaagctatgtgaatatgaaaaggaaagcttgtgctgaggtggggataaagtccttcgacatagaccttcctgagcaagtttcagagcctgaattgatcgccaaggttcatgagttaaatgcaaatcctgaagtacatggtatacttgttcagcttccattgcccaaacatataaatgaagaaaatgttttaagtgaaataagcatcgagaaggatgtagatggtttccatcctctgaacattggaaaacttgcaatgaaaggtagagaccccctcttccagccttgcacaccaaagggctgtcttgagcttctgtctcgaagcggcatcagtataaaaggcaagaaggcagttgttgtaggtcgtagtaatattgttggattgccggtttcactactcctcttgaaagcagatgcgaccattagtattgtgcactctcgtacaactgatcctgaaagcataattcgtgaagctgacatcgtcattgctgcagcaggacaagccatgatgattaaaggtgactggatcaagcctggtgctgctgtcatcgacgtggggacaaatgcagtggatgatccaagtaaaaagtcaggttaccgtcttgtgggggatgttgatttccatgaagttagtaaagtagcaggatggattactcctgtccctggaggtgttggacccatgactgtagccatgctattgagaaatactctggatggtgccaaacgtgtgatcgggcaatgagacccctcatcaaggcat

SEQ ID NO: 1333 - DNA, 1287 bp, Tropaeolum majus
cggccgggggtgccggtaagtgtttcagagaggctttttggaagaaattatgattgcatggaaaattagatatgaaatatgcgttttactatgattaattttggttgatttggcttcattttgcattatatatcatcataatcttcactgttgatttctaacaaattatcttaattgaccgaattgaggatctcgagttacctactcaatctggaccctttggcaagatattttaatggctacggagatgtcatcagatcgtaaggccacaaaaattgatggtaaagctattgctcagaccattcgatcagaaattgccgatgaagtcaagaatctctcaactaaatatggcaaggtcccaggactggctgtagtcatagtagggtccagaaaggattctcagagttatgtgggtatgaagagaaaagcatgcgctgaggctggaatcaaatcctttgatatagacctcccagaggatgtatccgaagctgatgttatttgcaaggttcacgagttaaacgcgaatcctgatgtacacggtatattggttcaacttccattgccaaagcatataaatgaagagaatgttttaggtgaaatcagccttgtgaaagatgtggatggcttccatcctctaaatattggcaagcttgccatgaaaggcagagagccacttttcgttccttgcacccccaagggatgtctcgaacttctttcacggagtggtataagtgtaaggggaaaaaaggcagttgttgttggtcgaagtaacatagtgggattgcccgtttcactgctattgttgaaagcagatgcaaccgtttctatagttcactcgcgtacccctgatcctgagagaataattcgtgaagctgacatcattattgctgcagcaggacaagcaatgatgataaagggcagttggataaaacccggtgctgcggttatagacgttggaacaaacgctgtggacgacccaagtaggaaatcaggttataggttggttggagatgtagacttcaaggaagcatctgaggtagctgggtggataactccggtccctggtggtgtaggcccaatgactgttgcaatgttgctaaagaataccttagacggcgccaagcgagttatcgaacagtaactaacgtcgtttttctgtggtttacttttgttttcctatgatctttctgttgtatcataccaagtttttagtacttgtgtatctgagtttaaactgcttttgatatcggttctgacatgggtaataataagtctttgacaatatga

SEQ ID NO: 1334 - DNA, 1056 bp, Vinca minor
tccgttattatccttgcctctcatgtaactccaatagttacagtagaattgggtagactaccaatttcatttggagaaggatggcgtcggcaccagaggatcagaaagccaccataatcgacggcaaagcaatagctaaaacaatcagatcagaggtcgccgcccaagtccggcagctctccgagaagtacaacatggtaccagggttggcagtagtgattgtaggtagtaggaaggactctcaaagctatgtgagtatgaagaggaaagcatgtgctgaggttgggattaagtcttttgacatagaccttccagaggacgtatccgaagctgctgtgatcgacaaggtccatgagttgaatgcaaatcctgatgtacatggtatattggtccagctaccacttccaaagcatataaatgaagagaaagtattgagtgaaattagcttggagaaggatgttgatggatttcaccctctgaacattgggaagcttgctatgaaaggcagagaacctctattctctccttgcacacccaagggttgtattgagcttctttcacggagtgggattaccataaagggcaagagggcagttgtggtaggtagaagtaacatagttgggttgccggtttccctactacttctcaaggaagatgctactgtcactgtggttcattcccgtactaaggaacctgagaatattattcgtgaagctgacattgttattgctgcagcaggacaagcaatgatgattaaagggagttggattaaacctggtgctgcagttattgatgtggggacaaatgcggttgaagacccgaagaagaaatcaggttacagacttgttggagatgttgattttgaagaagcatgtaaagtagctggatacataactccagttcctggtggtgttggtccaatgactgttgccatgctactgaagaacacattagacggggctaagcatgtcattgagcactgatttctatttcagctaccttttcaaaatgtgaaattatataataaaaaaaatttaaaattttaaggttctattt

SEQ ID NO: 1335 - DNA, 1153 bp, Chrysanthemum coronarium
atctaaaaaagcaccaagattttgtttggttagattgtgatatatcagttagttagttgttattgctatggcattgcctgtagaccatagagcccagattatcgatggaaaagcaattgctcaaacaattcgtgatgaaatcgcatccgaagtcagtatcttggttgagaaatacggcaaggcaccaggacttgctgtggtgattgttggacacagaaaagattctcaaagctatgttaatatgaagaggaaagcgtgtgccgaggttggaataaactctattgacatagaccttccagaacaagtccccgaagctgaattgatcgcaaaggtccatgagttaaatgcagatccccaagtacatggcatattggttcagcttcctttgccgaaacacataaacgaagagaaagttctaacagaaatcagtatcgacaaggatgtagatggctttcatcctctcaacattggcaaactggcaatgaaaggcagagacccgctctttcttccttgcaccccaaagggatgtattgaacttctgaaacacagtggtgttaccataaagggaaagcgggcggtggttgttggtcgaagtaacattgttggcttaccggtctcgctgctgttactgaaagcagatgctacagttactgtagttcattcacatacacctgatccagaatgtatcattcgtgaggcagacatcgttattgctgcagctggacaagctatgatgataaagggtagttggctaaaacctggtgctgcagttatcgacgtcggtacaaatgcagttgatgatcctagtagaaaatctggatacaggcttgtaggtgatgtcgattatcaagaaggatgtaaagtggccggatgtattacgcccgttccaggaggtgtgggacccatgaccgtggctatgctccttaaaaacactttggatggcgccaaacgtgtgatcgggcagtagaccaattctaagtcattccagtttttcgttacaagacgtgatatagcaaatactattgcttcatgttgtaagttttttagcatacaagcctattatcgttttggctgtataatagtatttcttcattttcaacgacaattggctttggttacagttcaatctaaagtaagtttcacttgtttgttc

SEQ ID NO: 1336 - DNA, 1030 bp, Chrysanthemum coronarium
aaagcaccaagattttgtttggttagattgtgatatatcagttagttagttgttattgctatggcattgcctgtagaccatagagcccagattatcgatggaaaagcaattgctcaaacaattcgtgatgaaatcgcatccgaagtcagtatcttggttgagaaatacggcaaggcaccaggacttgctgtggtgattgttggacacagaaaagattctcaaagctatgttaatatgaagagaaaagcgtgtgccgaggttggaattaagtctattgacatcgatcttccggaacaagtgcgcgaagttgaattgatcgtaaaggtccatgagttaaatgcagatcccgaagtacatggcatattggttcagcttcctttgccgaaacacataaatgaagaaaaagttctaacagaaatcagtatcgacaaggatgtagatggctttcatcctctcaacattggcaaactggctatgaaaggcagagacccgctctttcttccttgcaccccaaagggatgtattgaacttctgaaacgtagtagtgttaccataaagggaaagcgggccgtggttgttggtcgaagtaacattgttggcttaccggtctcactgctgttactgaaagcagatgctacagttactgtagttcattcacatacacccgatccagaaagtatcatacgtgaggcagacattgttattgctgcagctggacaagctatgatgataaagggtagttggctaaaacctggtgctgcagttatcgacgtcggtacaaatgcagttgatgatcctagtagaaaatctggatacaggcttgtaggtgatgtcgattatcaagaaggatgtaaagtggccggatgtattacgccagttccaggaggtgtgggacccatgaccgtagctatgctacttaaaaacactttggatggtgccaaacgtgtgatcgggcagtaaaccaattctaagtcattccagtttttcgttacaagacgtgatatagcaaatactattgcttcatgttgta

SEQ ID NO: 1337 - DNA, 2102 bp, Petroselinum crispum
gtggaaataaaataaaatagttcaactcgaaaacagagatattttatccttctcttttgccttacctatacatacacatacacacactcatcctcacttcttcaatctacttaaataattacacaaaaatggcgtcgccgtcggatcaccaagccaccgtcatcgacggcaaagcaatagctcaaacaatccgatctgaaatcgcgtcggaagtcactactctctcccaaaaatactccaaagtcccgggattggctgttgtcattgtaggatgtaggaaggattctcagagctatgtgagcatgaaaaggaaggcatgtgctgaagttgggattaaatcctttgacatagatctaccagaggatgtacccgaggttgagttgatcgccaaggtagatgagttaaatgcaaatcctgaagtacacggtatacttgtccaacttccgttgccaaaacatataaatgaagagaaaattttatctcaaatcagcctcgagaaggatgttgatggttttcatcctctgaacatcggaaagcttgccatgaaaggaagagatcccctgtttcttccttgcactcctaagggatgtcttgaacttctgtcgcgaagtggtattagcataaagggaaagaaggcagtggtggtgggtcgaagtaacattgtcggtttaccagtttcacttctacttctcaaggcggatgccacggttactgtagtccactcacgtactcaagatccagagagtttcattcgtgaagcagacatagttattgctgcagcgggacaggcgatgatgataaaaggaagctggataaaaccaggggctgctgttattgatgttgggacaaatgctgtaaatgatccaagtcgaaaatcagggtataggcttgtgggagatgttgattttcaggaagcatgtaaggtagccggttggattactcctgttccgggaggagtaggaccactaactgttgcaatgttactccaaaatactttggaaggtgccaagcgagtgatcgggcagtaaattattgttgctacttgctagagttgtcaaagtctaaacagttctacaagacaaccttggagagtgataacgatatgctctctcgtctgtgctgcatctaacaagttgcagatatgcattatttttcttgagttaagagtgtgcatattggaggttctctcttagacagcctttttataatcttgcaaccaatgcaaatgatgaaaaagcctcctgatctcttttaaatagggttcagcaagtatattctgttttgatggttaataaagtgaagtgagctgttgtattttatgtaatttttcaaaaataaaatattttgtattgaacaatttttgtaagctgcacttttcttcatcagctttctaattgtttcttacgctagaaatgatgttctgcattgaccaatatatgattctatgcccttatcaaggaaatgccgacacctaacaatttgcagaaaggacactgtcagggctgtagtttgtaactgtgtttttcggtttggagctcaattaaatcattgctctttggttgctatccgcaactttagttaaaattttcaaaatctgtcattgctgttcgcagctttactgaaattttccttgtgtgtgttgtagaaagctgggtaacagatgtacacccaccttgtgatcaatgggcgctccgtgctatagattcggagaagtatttaagtggtaactcagccgaagatatatgtgcacgtgtttgatgatggtaagctgtgtatggtgtatctcaaggttgattagatttactcagataatccttagccagctaatttgatcctgtacctcataacggaataggagttgaatactccaagaaatgagtgatctagcttagaaatatgaaaccccgttgctttcaccaatatataagataaataaataaattataatggacagatgacagaaggtttagaagtaacctcaattgtagttgggatttcaatgccggattaactgtagacgggttagtgggataataagacagaggcatacttatatattcgaagacgagtatactataagaatattgcttatactgtttacc

SEQ ID NO: 1338 - DNA, 1131 bp, Castanea mollissima
aaaagctgagttggtggatgccaactccaattttaagctgaaatcgtgactttcaatagagtctcatcggataaacatggcatcaccgtcggatcacaaggccaaaattatcgacggcaaagccatcgctcaaaccattcgcaatgaaatcgccgctgaagtccaccaactatcgcaaaaacacggcaaggtccctgggctggctgtagtgattgtgggcaacaggaaggattctcaaagctatgtgaatatgaagagaaaggcgtgtgctgaagttgggattaagtcgtttgacatagaccttccggagcaagtttctgaagctgagttgatcgctaaagttgatgagttaaatgcaaatcctgatgtacatggaatattggttcaactcccattgccaaagcatataaatgaagagaaagttctgactgaaatcagcattgagaaggacgtagatggctttcatccgctgaacattggcaagcttgcaatgaaaggcagagatcccttgttccttccttgcacccctaaggggtgtcttgaacttctgtcacgaagtggtataactgtaaagggaaagaaagcagttgtggtgggtcgaagtaacatagttggattgccggtttccctgctacttctgaaagcagatgctacagttaccatagtccattcacactctcaagatcctgaaaaagtcattcgtgaagcagacatcattattgcagcggcagggcaggcaatgatggtcaaaggtagttggatcaaacctggtgctgcagttattgatgttggcacaaatgctatcgatgacccaagtaagaagtcaggctataggctagttggagatgttcattaccaggaagcatgtgaggtagctggatgggttactccagttccgggtggtgtgggaccaatgactgttgcaatgctattgaagaatactttggaaggtgcaaagcgtgtaattgagcattaaatccatgtctttgttcactttcagaataagatgttgcctatgagatacagttttgaaacacattttattcgtatcatccaataagaattttgcttcctgttacaattcactgttgaattttggttttgctggtatgaatttataaaatcgacaaa

SEQ ID NO: 1339 - DNA, 1502 bp, Cucumis melo
cctaaaatttttaatcatttcttgaaggctatggtattgaactattttttagaatgttttgggtgctaggttggtccgcgactaaggggtaccaatctcgagcccttagtcctctaaaatgtcgcgcccaaggtcataacccaaatcaaatgacttacccatttggcatccttcctcgtcggccgaagaaaataggccacacaaaattgcacacggacgtacccatttctcgccaaacacaatcagaccgcccaaatccaagcccatcggatttctctccaccgattccatggctgcatcaactcactgactacacaatcaatccttctcaatctcacctcgtctattacatcgttctctgagccattacctctggcagctgcaaattcaattcagaagtaataaccattttcgttttctaacttgcaaaaatggcgtccgaatccgaccacaaagctacaataatcgacggcaaaaagatcgcacaaactgtcagatctgaagtcgcggaggaagtgaacaaactctctgagaaatatggaaaggttccaggactggcggtggtgattgtggggaatagaaaggattcgcttacctatgtaaatatgaagaggaaggcttgcctggaagtcgggatcaagtcttttgagattgatcttcctgagcaagtgtctgaggctgaattgatcagcaaagtccatgagcttaatgccaatcctgaagtacatgggatattggttcagcttcctttgccgaaccacataaatgaagagaaagttctatctgaaattagcattgagaaggatgtagatggctttcatcctctgaacattgggaagcttgcaatgaaaggcagagatcccttgttcctaccttgcactccgaaggggtgtcttgaactgctgtcgcgaagtggaattagcatcagaggaaagaaagcagttgttatggggcgaagcaacattgttggattaccagtttcattgttgcttcttaaagcagatgcaactgtcacaatcgtccattcacgttccgttgatccagaaagtgttatccgcgaagcagacattataattgctgcagcaggacaggcacaaatgatcaaggggagttggattaaaccaggtgctgcagtcatcgatgtcggtacaaatgcagttgatgatccaaccaagaagtcgggctaccggctggtcggggatgtagatttccaggaagcttgtaaagtagctggttggataactccggttccgggtggcgtaggtcctatgactgttgccatgctgcttaggaatactttggatggggctaagcgtgcgatcgagcagtgaaaaagacaccgcagcttgttaccgatcctcgtgggactttttcggagtaatttcaaaataaatggttcgtttgttttgtgctatcttttttttgtactaataatagttgatttttcattgaaaataatggattaattaaaatcaaatcaaaacacaccccaatgttgaaaa

SEQ ID NO: 1340 - DNA, 1472 bp, Nicotiana benthamiana
gtctcacctacccccaattgtcagctccatattgtctcttcttgcaaatgaaagattttatctaatccgacgacccaatttctctgctacaacttcaagattttcttttcttgtatgaaacctgaaattatagggaagttatctctcgtttgaagaaacaatggcatcaccatcagatcacaaggctaccgtcattgacggtaaagccattgctcaaactattcgttctgagattgcttctgaagtccgacgcctttcagaaaagtatggcaaggtccctgggttggcagtagtcattgtaggaaataggaaagattctcaaagttatgtgaatatgaagagaaaatcgtgcgctgagcttggcattaagtcttttgacatagacctgctagaggacgtagctgaagccgaattaattagcaaggtccacgagctgaatgctgatcctgatgtacatggtatactggtacaacttccattaccaaaacacattaatgaagagagagttcttggtgaaatcagtctggaaaaggatgtagatggctttcatcctctgaatattggcaagcttgcaatgaaaggcagacaacctctgttcctcccttgcacgcccaaggggtgcatcgagcttttgcatcgaagtgggattagcataaaagggaagaatgccgttgtggttggtcgaagtaacattgttggattaccggtgtctctgctgcttctgaaagaagatgctactgttactatagtgcactcacgcaccaaggaaccagaaaaaatcgttcgtgaagcagacattattattgctgccgcaggacaggctatgatgatcaaaggcagctggattaaaccgggtgctgcagtaattgatgtagggacaaatgctgtagatgatcctactaggaaatcaggttataggcttgttggagacgtcgattttcaggaagcatgtgaggtagctggatgtataactccagttcctgggggtgttggaccaatgactgttgcaatgcttctcaagaataccttggatggagctaaacgagttatcgagaagtaaacactttcttcagctcttacatctacaataaaatgtcaaggcttctaagctgcaagaaaaccatcgtttagaggcgtcactttcattcaagaaatagcaatgagcctcttcctgtgatgtggcattcgggtttggaaggttatttggcgtcaaagaacttcgtgaaatctaaacttttcactaggactggtgaagttaaaacactttcttgcttgggtagcctaaggcgttgaactacaagattgtagcagtagttcattttacaatgtcactcggaaaatgcgctatacatctaatgaaaaaatgatccttcttctgttaccaacttcaaaaccaatagtatgtttttcatagtaattctttgttctttcgttgatatgaactcctaataatacaattgtcctttgtaacc

SEQ ID NO: 1341 - DNA, 1149 bp, Quercus alba
aatttgttgactaaagcctctgtttggttcgtgagaaaatttggcacaagaaagctgagttggtggctgagttcccaactccaatttaaagtccaagctatctaatcagttggacaaagatgtcggatcacaaggccaatattatcgacggcaaagccatcgctcaaaccatccgcaatgaaatcgcttctgaagtccactatctctcaaacaaacacggcaaggtcccggggctggctgtagtgatcgtgggcaacaggaaggattctcaaagctatgtgagtatgaagagaaaggcatgtgccgaagttgggatcaagtcttttgacatagaccttccagagcaagtttctgaagctgatttggttgctaaggttcatgagttaaatgcaaatcctgatgtacatggcatattggttcaacttccattgccgaagcatataaatgaagagagagttctgactgaaatcagcattgagaaggatgtggatggctttcatccactaaacattggcaagcttgcaatgaaaggcagagaacccttgttccatccttgcacccccaaggggtgtcttgaacttctgtcacgaagtggtataactataaaggggaaaaaggtagtcgtggtgggtcgaagtaacattgttggattgccagtttcactgctgcttctgaaagcagatgctacggttaccatagtccattcacattctcaagatcccgaaagaataattcgtgatgcagacatcattattgcagcagcagggcaggcaatgatggtcaaaggcagttggatcaaaccaggtgctgcagttatcgacgttggcacaaatgcaatcgatgacccgagtaagaagtcagggtataggctagttggagatgttgatttccaggaagcatgtaaggtagccggatggataactcctgttccaggtggtgtgggtccaatgactgttgcaatgctattgaagaatactttggaaggtgctaagcgtgtaattgagcattaaatccatgtctttgttcactttcataataagatgtttatgtcacaatccatcatcgaattttgcttctttgcttgtatgaattgtatatgatgacaatgttttgtaagtgccaatgaagcaatgagtacggctaagaaga

SEQ ID NO: 1342 - DNA, 932 bp, Prunus persica
gagtgagtgtttgatcaatggcgtcgcaatcggatcacatggccgcgataatcgacggaaaagccatagcccagaccatccgaaacgaaattgcagaggaagtccgccatctctcccagaaatatggcaaggttccaggactggcagtagtgattgtagggaacaggaaggactctcagagctatgtgagcatgaagaggaaggcttgtgctgaggttgccattaaatccttggacatagacctccctgagtatgtgtcccaagacgacctcattgccaaagttcatgaattgaatgccaatcccgatgttcatggtattctagttcagcttccattgccgaagcatattaatgaggagaaggtgttgagtgaaatcagcatcgagaaggatgttgatggcttccatcctctcaacattggcaagctcgcgatgaaaggcagagaacctctgttccttccttgcactcccaaggcaagacacttgaggctgcctggaacttctgtcacggagtggcataagcataaagggaaagaaggcagtggtggtgggcagaagtaacatagttggattgccagtttcgttgttgcttttgaaagcagatgctacggttactgtagtccattctcattctcacgatccagaaagtatcattcgtgaagcagacattattattgctgcagcagggcaggcaatgatgatcaaggggagttggataaaaccaggtgctgcagtcattgatgtcggaacaaatgctatagacgactcaagtagaaaatcaggctatagattggttggagatgtcgatttccaggaagcatgtaaggttgctggatgggtaactcctgttcctggaggcgtgggcccaatgactgttgcaatgttactcaagaatactttggatggtgctaagcgtgttattgcaaaataaaa

SEQ ID NO: 1343 - DNA, 1126 bp, Primula obconica
gtcgcaatcggacgatcagaaaacggctcacataatcgacggcaaagcaatcgctcagactattcgatcggaaatcgcttctgaggtccgccacctgtccgacaatttcggcaaggtcccgggattagctgtagtaattgtaggaactaggaaggactctcaaagctatgtgagtatgaagagaaaagcttgtgccgaagttgggattaagtctttcgatgtggaccttcctgagcaagtacccgaagatgagttgattagcaaggtccacgagttaaatgcagatcccagtgtacacggtatattagttcagctgcctcttccaaagcacattaacgaagagaaagtgttgagtgcaatcagcattgagaaggatgttgatggctttcatcctctcaacattggcaagcttgccatgaaaggcagagatcctctcttccttccttgcacccccaagggttgccttgagcttttatcgagaagtggcataaccataaagggaaagaatgctgttgtggtgggtagaagtaacattgttggattgccagtttcgcttttacttctcaaagctgatgccactgttactgtggtccactcgcgtaccccgaatcctgaaaaaatcatcagtgaggcagacattataatcgccgcagcaggacaagccatgatgattaaggggagctggataaaaccgggtgctgcagttatagatgtgggaacaaatgcagttgatgatccgagtaaaaaagcgggttataggctcgtaggtgatgtggatttcaaagaagcgtgtaaagtagcaggtgcgataactccggtccctggtggagtgggccccatgactgttgctatgctgcttcagaatactttggagggtgccaaaagagttatcacgcactaaaaagtgacgtcttcagttttaattttttgttcatccgaagttcatttttgtgataggaaatgtgtcttgctcaatagcacgtttttgtagtacttgttaatcaatcaataagtgaaataatgaatatatgtttatgtatctatcgacggtatagcttctttatgcttatgcaattatctcattgttatatagctgtacgagtgttgataaatatacattgaactt

SEQ ID NO: 1344 - DNA, 1255 bp, Chrysanthemum coronarium
gcatcaagattttgtaagttttataaatttgctaacttgaatcaagcttattagcttggttttgtgcttattgggatttgatacattggataagcagttttggataagcagttttgaataagcagtataaacacccctttaattcaaactacttattgttctgcataaaaagttcgatcggatcttgagatataagttagtcggttgttattgctatggcattgcctgtcgaccataaagcacacattattgatggaaaagcaattgcacaaacgattcgtgatgagattgcctctgaagtcaaaaatttggtcgagaaatatggcaaggcaccaggacttgctgtggtgattgttggacacagaaaagattctcaaagctatgttaatatgaagaggaaagcgtgtgccgaggttggaataaactctattgacatagaccttccagaacaagtccccgaagctgaattgatcgcaaaggtccatgagttaaatgcagatccccaagtacatggcatattggttcagcttcctttgccgaaacacataaacgaagagaaagttctaacagaaatcagtatcgacaaggatgtagatggctttcatcctctcaacattggcaaactggcaatgaaaggcagagacccgctctttcttccttgcaccccaaagggatgtattgaacttctgaaacacagtggtgttaccataaagggaaagcgggcggtggttgttggtcgaagtaacattgttggcttaccggtctcgctgctgttactgaaagcagatgctacagttactgtagttcattcacatacacctgatccagaatgtatcattcgtgaggcagacatcgttattgctgcagctggacaagctatgatgataaagggtagttggctaaaacctggtgctgcagttatcgacgtcggtacaaatgcagtcgacgatgctagtagaaaatcaggatacaggcttgtaggtgatgttgattatcaggaaggatgtaaagtggccggatgtattacgcccgttccaggaggtgtgggacccatgaccgtggctatgctccttaaaaacactttggatggcgccaaacgtgtgatcgggcagtagaccaattctaagtcattattttgttgagcatattagcttatatttcattttggctgtataatagtattgttctttttcatatggttaataaaggtcttataaccggaaaaaagaaaccagttatgaagacgggtatggtg

SEQ ID NO: 1345 - DNA, 1437 bp, Cichorium intybus
ataatttgtacatgttaacgcctagagggtacttataccgccggtgtgctgccgccgatagacaaaatagaacgtatgtgtctcatctctctctctcctatcctatcaaaaagggttctcaaagcttctacgatctgggtctttacctaacaagtagtaaaaagctctagatctgttctatttggcgcctactcaggttggtggagtcttgagatggcattgcctgtagatcataaggccaacatcatcgatggaaaagcaatcgcacagacaattcgttctgaaatcgcctctgaagtcagtaccttgattgagaaatatggcaaggcaccagggcttgctgtagtcattgttgggcacagaaaagattctcaaagttatgtaagtatgaagagaaaagcctgttgtgaggttggaatcaggtctattgacatagaccttccagaacaagtgcctgaagctgagttgattgcaaaggtccatgagttaaatgcagatccagatgtacatggcatattggttcagcttccattgccgaaacacataaatgaagaaaaagttttaacagaaattagcattgacaaagatgtagatggctttcatcctctcaacattggcaaacttgctatgaaaggaagagaaccgctttttcttccttgcaccccaaagggatgtattgaacttcttaaacgcagtggtattaccataaaaggaaagcgggcagtggttgttggtagaagtaacattgttgggttaccagtttcactgcttctattgaaggaagatgccacggttactgttgtacattcacgcacagaagatccagaaactatgattcgtgaggcagacattgttattgctgcagcgggccaagctatgatgataaagggtagttggattaagcctggtgctgcggttattgatgtggggacgaatgcagttgatgatgctagtagaaaatcagggtataggcttgtgggtgatgttgattttcaggaagcgtgtaaagtggctggctgggttacgcctgttccagggggtgtggggcccatgactgtagcaatgcttcttaaaaacactttggatggtgccaaacgtgtgatcgggcagtaaagtgtttcgattttcattataagcaatttgcatatgatgctgttgtagctttttgactctcggagtgtataagaatattgtccattgtcaacaattgattttgattgtataatcgaatctcaagcaaggcctttggccagggctatgggttggatagcaagagttttcaagctcttagcctttttaagataaatgatcaaactatatatattttaatccaaacatctctaataattttgtttaatactagcttacggctatgatttgtggagaagaatatatcagatgattatggttctaaattaagctgtttcattttttgct

SEQ ID NO: 1346 - DNA, 1031 bp, Allium cepa
tacactcttgagtatcaacgggccgcgtctcctcgattaaaagaagggcgcataaacccaaggctgttatcttcattatcagtacactcttccacccaactccaattcattccagatcaaagagaaaacagattatacataataatggcaaaaataatcgacggcaaagcaatagctcaagacatccgtagtgaaattgcacaagaagtccaaatcctctctcaaaatcaccacacggttcctggattggctgtggtgatagttggtacaagaaaagattcgcagagctatgtgaatatgaagagaaaagcttgtgctgaagttggtatcaagtcttttgattttgatttgcccgaagagatctccgaaaccgatgttattgctgaagttcatgaattgaatgctaatcctgatgtacatggtattctagtgcaacttccattgccaaaacatattaatgaagaaaaagtgttaagtgagatcagcatagagaaagatgttgatggatttcatcccttgaatattggcaagcttgctatgaaaggcagagaaccactattttcaccttgcacacccaagggatgccttgaacttttatcaagaagtggagtaaatgtgaaaggaaaaagagcagtcgtggttgggcgaagcaacatagttggccttcctgtatctttgcttcttcttaaagcagatgcaactgtgactgttgttcattcgcgtactcctgatccagaaaacatcatccgagaagctgacattgttatagctgcagctgggcaagcaaatatgataaagggagattggataaaaccgggagcagcagtgatcgatgtgggcacaaatgcagtagacgatccaagtagaaagtcggggtacaggcttgtgggcgatgttgattttcaagaagcgagcaaagtggctggatatttgactccagtacccggtggtgttggtccaatgacggttgctatgcttctcaaaaacaccttggatggtgccaagcgcaaaatcgaacagtgaagaaaaaa

SEQ ID NO: 1347 - DNA, 1028 bp, Allium cepa
tagttacggggagtacactcttgagtatcaacgggccgcgtctcctcgattaaaaggagggcgcataaacccaaggctgttatcttcattatcagtacactcttccacccaactccaattcattccagatcaaagagaaaacagattatacataataatggcaaaaataatcgacggcaaagcaatagctcatgacatccgtagtgaaattgcacaagaagtccaaatcctctctcaaaatcaccacacggttcctggattggctgtggtgatagttggtacaagaaaagattcgcagagctatgtgaatatgaagagaaaagcttgtgctgaagttggtatcaagtcttttgattttgatttgcccgaagagatttccgagaccgatgttattgctaaagttcatgaattgaatgctaatcctgatgtacatggtattctagtgcaacttccattgccaaaacatattaatgaagaaaaagtgttaagtgagatcagcatagagaaagatgttgatggatttcatcccttgaatattggcaagcttgctatgaaaggcagagaaccactattttcaccttgcacacccaagggatgccttgaacttttatcaagaagtggagtaaatgtgaagggaaaaagagcggtcgtggttgggcgaagcaacatagttggccttcctgtatctttgcttcttcttaaagcagatgcaactgtgactgttgttcattcgcgtactcctgatccagaaaacatcatccgagaagctgacattgttatagctgcagctgggcaagcaaatatgataaagggagattggataaaaccgggagcagcagtgatcgatgtgggcacaaatgcagtagacgatccaagtagaaagtcggggtacaggcttgtgggcgatgttgattttcaagaagcgagcaaagtggctggatatttgactccagtacccggaggtgttggtccaatgacggttgctatgcttctcaaaaacaccttggatggtgccaagagcaaaatcg

SEQ ID NO: 1348 - DNA, 1143 bp, Ananas comosus
cctcctccatccatggcgacaatcatcgatgggaaagccatcgcccaaaccatccgaaacgagatcgcccaggaggttcgatccctctccgacgctcaccacaaggttccggggctcgcggtggtgatcgtggggacgcggaaggactcgcagagctacgtgaacatgaagcgcaaggcatgcgcggaggtcgggatccgctccttcgatctcgatctccctgagcagatctccgaatccgagctcattgcgaaggtccacgaattgaatgcgaatcccgatgttcacggaatattggttcaacttccattgccaaaacatataaatgatgagaaagtcctaagtgagattaatattgataaagatgttgatggatttcacccactcaatattggcaagctagctatgaaagggagagagccattatttctcccctgcacaccgaagggatgcctagagcttctatcacgaagtggaattactataaaaggcaaaagggctgttgttgttggccgtagcaatattgttggattacctgtagcattgcttcttctgaaagcagatgcaactgtgacgatcgttcactcccatactcccgattcagaaaccattattcgtgaagccgacattgtcattgctgcagctggacaagccatgatgatcaagggagattggataaaacctggtgctgcagtcattgacgtgggaacgaatgcagttgatgatcccagcaagaaatcgggttacaggctcgtcggggatgtcgacttccaagaagcaagcagagtggcgggatggatcactcccgtgccggggggtgttggcccgatgaccgtcgcaatgttgctcaagaacacactagatggagctaagcgaaagatcgcacagtgagatatcgtttcttgatttcaactaagtgctttcttgtacattttgggtaataaaatttaatggaattgattatgtgagattgttgcccaattcagctactaatgtttaactttgacatgtacaacagttctttaagtagaagatgatgagaagaacagtttttctcgaacaatgaattctaattctattaagtgtcaacagtttactcgcaataaatatgacacgatgatattgagcctattttttaaagta

SEQ ID NO: 1349 - DNA, 1400 bp, Cichorium intybus
gttacattttttgcaacaaaagattttctttagattatcttaaacaaaatatataatttgtacatgttaacgcctagagggtagttataccgccggtgtgctgccgccgatagacaaaatagaacgtatgtgtctctctctctctctctctctctctctctctctctctcctatcctatcaaaaagggttctcaaagcttctacgatctgggtctttacctaacaaagtagtaaaaagctctagatctgttctatttggcgcctactcaggttggtggagtcttgagatggcattgcctgtagatcataaggccaacatcatcgatggaaaagcaatcgcacagacaattcgttctgaaatcgcctctgaagtcagtaccttgattgagaaatatggcaaggcaccagggcttgctgtagtcattgttgggcacagaaaagattctcaaagttatgtaagtatgaagagaaaagcctgttgtgaggttggaattaggtctattgacatagaccttccagaacaagtgcctgaagctgagttgattgcaaaggtccatgagttaaatgcagatccagatgtacatggaatattggttcagcttccattgccgaaacacataaatgaagaaaaagttttaacagaaattagcattgacaaagatgtagatggctttcatcctctcaacattggcaaacttgctatgaaaggaagagaaccgctttttcttccttgcaccccaaagggatgtattgaacttcttaaacgcagtggtattaccataaaaggaaagcgggcagtggttgttggtagaagtaatattgttgggttaccagtttcactgcttctgttgaaggaagatgccacggttactgttgtacattcacgcacagaagatccagaaactatgattcgtgaggcagacattgttattgctgcagcgggccaagctatgatgataaagggtagttggattaagcctggtgctgcggttattgatgtggggacgaatgcagttgatgatgctagtagaaaatcagggtataggcttgtgggtgatgttgattttcaggaagcgtgtaaagtggctggctgggttacgcctgttccagggggtgtggggcccatgactgtagcaatgcttcttaaaaacactttggatggtgccaaacgtgtgatcgggcagtaaagtgtttcgattttcattataagcaatttgcatatgatgctgttgtagctttttgactctcggagtgtataagaatattgtccattgtccacaattgattttgattgtataatcgaatcctcagcaaggccttggccagggctatgggttggatagcaagacttttcaagctcttagcctttttagataaatgatcaaactatatatatttca

SEQ ID NO: 1350 - DNA, 1333 bp, Echinacea purpurea
cggccgggggacaatagatagttttacaagtttacatgtatcaaccaaaaccgaacaacccgatggatctaaacccacccggcccgtcggcggcgccactcacgacaaaacaagcttgccctttcattttcgatcatcacccacctctccatcttttattgttactagatttttgtaaatctgtagtaaaaaagccccagatttgtgctgctgtttgcctgctactacaggttggttaaatcttgatatcttggttattatccagatggcattgcctgtagatcataaagcaaacatcattgatggaaaattaatcgcacaaacaattcgttctgaaatcgcttctgaagtccgtatcttggttgagaaatatggcaagtcacctggacttgctgtagtaattgttggaaatagaaaagattctcaaagttatgttaatatgaagagaaaagcgtgtgctgaggttggaataaagtcaattgacattgaccttccggaagaagtacccgaagccgaattgattgcaaaagttcatgaattgaatgcagatccaaacgtacatggcatattggttcaacttcctttgccaaaacacataaatgaagaaaaagttttaactgaaatcagcattgaaaaggatgtcgatggctttcaccctctcaacattggcaaatgtgctatgaaaggcagagacccactctttcttccttgcaccccaaagggatgtattgaacttctgaaacgcagtggagttaccataaagggaaaacgggccgtggttgtcggtagaagtaacattgtagggttaccagtttcattgctgctattgaaagaagacgctacagttactgtagttcactcacgtacagaggacccacaaagtattatttctgaggcagacattgttattgctgcagcaggacaagctatgatgataaaaggtagttggattaaacctggtgcagcagttatagatgtgggaacaaatgcagttgatgattctactagaaaatcaggatacaggcttgtgggtgacgtggattttcaggaagcatgtaaagtggctggatggattacacctgtccctgggggtgtggggcccatgacagtagcaatgctccttaaaaacacgttggatggtgctaaacgtgtgattggtgtgtaaattaatcttaatattctgttacaagaatctgaatgcctaccgatgtagtacctttttgaggtcgtttgattttgacattatctattatctatatatactaaatttttgaacattgggagtaatagtacttagagagaatttccgttttcgtccctgaggtttgactgt

SEQ ID NO: 1351 - DNA, 1081 bp, Flaveria ramosissima
ccacctcacgatctctcactgctactggatcaaaacgattattcaaagcttatgcaattataccatctgggtgtttatctgttgtaaaaaagccctagatttgtgctctttggctgctaattaggcaggtgaaatcttgatatcttgaatattatcagcatggcattgtctgtagatcataaagcaaacatcattgatggaaagttaattgcacaaacaattcgttctgaaatcgcctctgaagtcagtaacttggttgagaaatatggcaaggcccctggacttgctgtagtaattgttggaactagaaaggattctcaaagttatgttaatatgaagagaaaagcgtgtgctgaggttggaatcaagtcaattgacattgaccttcctgaagaagtacccgaagctgaattgatagcaaaaattcatgaattaaatgcagatcccaatgtacatggcatattggttcaacttcctttgccaaaacacataaatgaagaaaaagttttaactgaaatcagcattgaaaaggatgttgatggctttcatcccctcaacattggcaaacttgctatgaaaggcagagacccactctttcttccttgcaccccaaagggatgtattgaacttctgaagcgaagtggagttaccataaagggaaaacgggccgtggttgttggtagaagtaacattgtcgggttaccagtctcattgctgctgctgaaagaagacgctacagtcactgtagttcactcgcgtacagcagacccgcaaagtattatttgtgaggcagacattgttattgctgcagcaggacaagctatgatgataaaaggcagttggattaaacctggtgctgcagtaattgatgtgggaacaaatgcagttgatgatgctagtagaaaatcagggtacaggctggtgggtgacgtggattttgtggaagcatgcaaagtggctggatgcgtgacacctgtccccggcggtgtgggacccatgactgtagcaatgctgcttaagaacacgttggatggtgctaaacgtgtgattggtcagtagattaatcttaaattttgtgtta

SEQ ID NO: 1352 - DNA, 1310 bp, Nicotiana benthamiana
tatggaactagcagtcctgaaattatagggaagttatctctcgtttgaagaaacaatggcatcgccgtcagatcacaaggctaccatcattgatggtaaagcaattgctcaaactattcgttctgagattgcttctgaagtccgactcctttcacaaaagtacggcaaggtccctgggttggcagtagtcattgtgggaaacaggaaggattctcaaagttatgtgaatatgaagagaaaatcttgtgctgagcttggcattcaatcttttgacatagatctcccagaggacgtagctgaagatgaattgattagcaaggtccatgagctgaatgctaatcctgatgtacatggtatactggtacagcttccgttaccaaaacatattaatgaagagagagttctaggtgaaatcagtctggaaaaggatgtagatggctttcatcctctgaatattggcaagcttgcaatgaaagacagacaacctctgttcctcccttgcacgcccaagggatgcatcgagcttttacatcggagtgggattagcataaaggggaagaatgcagttgtggttggtcgaagtaacattgttggattaccagtgtctctgctccttctgaaggaaaatgccactgttactatagttcactcgcgcaccaaggaaccagaaaaaatcgttcgtgaagcagacattattattgctgctgcggggcaagctatgatgatcaaaggctgctggatcaaacctggtgctgcagtgattgatgtagggacaaatgctgttgatgatcctagtaggaagtcaggatataggcttgtcggagatgtcgattttcaggaagcatgtaatgtagctggatggataactccagttccgggaggtgtaggaccgatgactgttgcaatgcttctcaagaataccttggatggagctaaacgagtcatcgagaagtaaacactttctttagctctttacacctacaataagatgtcaatgctgctaagctgctgatattttcttatatttaaagaaaaccatacatttagaggtggcactttcaatagagaaatagcaatgagactattgctgtgatgtggaattcatgttgggaattcaatgagcttcgcaaaatctaacgttttcactagaactggtgaagttaagatactttattgctacgatagcctaaggtcttgaactacaagattttagcatttctttttgcaatgtcactttgaaaatgcactacatctgatgaaaaaaaggatccttcttctattaccaacttcagagccaaatgtttttataa

SEQ ID NO: 1353 - DNA, 1095 bp, Nicotiana benthamiana
cagccctgaaattatagggaagttatctctcgtttgaagaagcaatggcatcgccatcagatcacaaggctaacatcattgatggtaaagcaattgctcaaactattcgttccgagattgcttctgaagtccaactcctttcagaaaagtacggcaaggtccctgggttggccgtagtcattgtaggaaataggaaagattctcaaagttatgtgaatatgaagagaaaatcatgtgctgagcttcacattaagtcttttgacatagacctgctagaggacgtagctgaagctgaattaattagcaaggtccacgagctgaatgctgatcccgatgtacatggtatactggtacagcttccgttaccaaaacacattaatgaagagagagttcttggtgaaatcagtctggaaaaggatgtagatggctttcatcctctgaatattggcaagcttgcaatgaaaggcagacaacctctgttcctcccttgcacgcccaagggatgcatcgagcttttgcatcgaagtgggattagcataaaagggaagaatgccgttgtggttggtcgaagtaacattgttggattaccagtgtctctgctgcttctgaaggaagatgctactgttactatagtgcactcacgcacaaaggaaccagaaaaaattgttcgtgaagcagacattattattgctgccgcaggacaggctatgatgatcaaaggtagctggattaaaccgggcgctgcagtaattgacgtagggacaaatgctgtagatgatcctactaggaaatcaggttataggcttgttggagacgtcaattttcaggaagcatgtaaggtagctggatggataactccagttccggggggtgttggaccaatgactgttgcaatgcttctcaagaataccttggatggagctaaacgagttatcgagaagtaaacactttctttagctcttaatatatcaaggctgctaaactgctgatattttcttatatttaaagaaaaccatacatttagaggtgtcactgtgatgtggaattcgtgttggcgtcaaagagcttcgtgaaatctaaacttttcactggaac

SEQ ID NO: 1354 - DNA, 1085 bp, Allium cepa
ggcaaaaataatcgacggcaaagcaatagctcaagacatccgtagtgaaattgcacaagaagtccaaatcctctctcaaaatcaccacacggttcctggattggctgtggtgatagttggtacaagaaaagattcgcagagctatgtgaatatgaagagaaaagcttgtgctgaagttggtatcaagtcttttgattttgatttgcccgaagagatctccgaaaccgatgttattgctgaagttcatgaattgaatgctaatcctgatgtacatggtattctagtgcaacttccattgccaaaacatattaatgaagaaaaagtgttaagtgagatcagcatagagaaagatgttgatggatttcatcccttgaatattggcaagcttgctatgaaaggcagagaaccactattttcaccttgcacacccaagggatgccttgaacttttatcaagaagtggagtaaatgtgaaaggaaaaagagcagtcgtggttgggcgaagcaacatagttggccttcctgtatctttgcttcttcttaaagcagatgcaactgtgactgttgttcattcgcgtactcctgatccagaaaacatcatccgagaagctgacattgttatagctgcagctgggcaagcaaatatgataaagggagattggataaaaccgggagcagcagtgatcgatgtgggcacaaatgcagtagacgatccaagtagaaagtcggggtacaggcttgtgggcgatgttgattttcaagaagcgagcaaagtggctggatatttgactccagtacccggtggtgttggtccaatgacggttgctatgcttctcaaaaacaccttggatggtgccaagcgcaaaatcgaacagtgaagaaaaaagagagatgggaattaagcagaatatgatggaaattagttgtatcgagatattcaataattaaacttggtctttcatgtataaattatcagatattcaataattaaacttggtctttcatgtataaattatctttattgcctgtatatcatctgtagttgctgcgctttgcaaacttgaatgaataaggtggacgttattt

SEQ ID NO: 1355 - DNA, 1342 bp, Populus trichocarpa
aaacaacccctacccctagtcccttcacttcagccaccaatcttcgtgtcaagctgactttaatttgctgatcttcttctaactggtgagaaaaccaagctccgactcctttccaacactcctttaatggcgtcccaatcggaacataaagccaccgtaatcgacggcaagctcatcgctcaaacaatccgatcagaaatcgccgaggaagtccgtcaactctcagagaaatacggcaaggttcctgggttagctgtagtaattgtgggcaataggaaggattctcaaagctatgtgggtatgaaaagaaaagcgtgtgctgaagttgggattcagtcctttgacatggacctccctgagcaaatatctgaagctgaactcgtttccaaggttcatgagttgaacgcaaatcctgatgtgcatggaatattggttcagctgccactgccaaagcatataaacgaagagaaagttttaagtgaaattagtcttgcaaaggatgtagatggctttcatcctctgaacatcggcaaacttgcaatgaaagacagagagccgcttttccaaccctgcacccccaagggttgtcttgaacttctacatcgaagtggtgtaagtataaagggaaaaagggcagtagttgtaggtcgcagtaacatagttggattaccagtttccttgcttcttctgaaagcagatgccactgttactgtggtccattcacgttctaatgatcaagaaagcatcattcgtgaagctgacatcattattgcagcagcagggcaaccaatgatgataaaaggaagttggattaaacctggtgctgcagttattgatgttgggacaaatgctgtcgatgatccaagtagaaagacaggttataggttagtgggagatgtggatttcaaggaagcatgtaagatagctggatgtattactccagttcctgggggcgtgggtccaatgactgttgcaatgctgctcaagaacactttggaaggtgcaaagcgggttattgtgcagtagtgcttcaattttgttcaattatagttgatgatttcgctctatcctaactcaagtctcataggaaaacaatgtttccgtaagttcagtggctaataaatcatagattttgttctgtattgtactatgtgagcttcagaattttcaatctttgcaaatttttgcaagagtttcaaactgaacaacttttattgtgattgggatgaaaaataaattaagaaactagctttatatgctagtgtgatctttgttatcagtaattctctatagtgtttacagtatgatatctttatccacagtaatactcggcttctgatgc

SEQ ID NO: 1356 - DNA, 1323 bp, Populus trichocarpa
gtcccctcacttcagccaccaatcttcgtgtcaagctgactttaatttgctgatcttcttctaacgagtgagaaaaccaagctcagactcctttccaacactccttcaatggcgtcccaatcggaacataaagccaccgtaatcgacggcaagctcatcgctcaaacaatccgatcagaaatcgccgaggaagtccgtcaactctcagagaaatacggcaaggttcctgggttagctgtagtaattgtgggcaataggaaggattctcaaagctatgtgggtatgaaaagaaaagcgtgtgctgaagttgggattcagtcctttgacatggacctccctgagcaaatatctgaagctgaactcgtttccaaggttcatgagttgaacgcaaatcctgatgtgcatggaatattggttcagctgccgctgccaaagcatataaacgaagagaaagttttaagtgaaattagtcttgcaaaggatgtagatggctttcatcctctgaacatcggcaaacttgcaatgaaagacagagagccgcttttccaaccctgcacccccaagggttgtcttgaacttctacatcgaagtggtgtaagtataaagggaaaaagggcagtagttgtaggtcgcagtaacatagttggattaccagtttccttgcttcttctgaaagcagatgccactgttactgtggtccattcacgttctaatgatcaagaaagcatcattcgtgaagctgacatcattattgcagcagcagggcaaccaatgatgataaaaggaagttggattaaacctggtgctgcagttattgatgttgggacaaatgctgtcgatgatccaagtagaaagacaggttataggttagtgggagatgtggatttcaatgaagcatgtaagatagctggatgtattactccagttcctgggggcgtgggtccaatgactgttgcaatgctgctcaagaacactttggaaggtgcaaagcgggttattgtgcagtagtgcttcaattttgttcaattatagttgatgatttcgctctatcctaactcaagtctcataggaaaacaatgtttccgtaagttcagtggctaataatcatagcttttgttctgtattgtactatgtgagcttcagaattttcaatctttgcaaatttttgcaagagtatcaaactgaacatcttttattgtgattgggatgaaaaataaattaagaagctagctttatatgctagtgtgatctttgttatcagtaattctctaaagtgtttacagtatgatatctttatccacagtaatactcggcttctgatgc

SEQ ID NO: 1357 - DNA, 985 bp, Raphanus sativus
tatctgagaaacacggcaaggtcccaggactagcggtagttatagttggggcacggaaagattcacagacatatgtgactatgaagaggaaagcgtgtgccgaggttgggatcaaatcatttgatgtggacctaccagaggatgtttctgaagctgatcttataaccaaagttcatctactcaattcagatcctgatgttcatggtatattagttcaactcccattgccgaaacatattaatgaggagaatgttttaagtgcaatcagcattgataaagatgtagatggcttccatcctctgaatattggtaagctagccatgaaaggcagagaacccctcttccttccatgcacccctaagggatgtttggaactcttagtaagaagtggcataaagataaaagggcaacgagctgttgtagtaggtcggagcaacatcgttggattgcctgtttcgcttctactgctcaaggctgatgctactgttaccaccgtacattcccacaccagagatcctgaggctatcatacgggaagctgacatcgttattgctgcagccggacaagcctgcatgattaagggggactggattaagccaggggctgcggtgatcgatgttggaaccaatgcagtgagcgacccgagcaggaaatcaggataccggttggttggagatgtggattacgcagaggcttgtaaagttgcagggttcgtaactccggtccctggtggtgtaggtccaatgaccgtggcaatgctgctcaggaacaccttagacggcgccaagcgggtcattggccagtaagatatccatcctactgtatgttataaatgaatctcaagttttatccattatataattaagctctccctttcataacacaattattcctctaaaataaatcctttgactgtttgttttcccgccaatttgtacacaacatgaggcttagcatcattttaataaatcaaaaaacagcttat

SEQ ID NO: 1358 - DNA, 1336 bp, Solanum lycopersicum
aaaaaaaaatatcttctccctaaatctcacctactctccttcgtcagctccaattttcgccaatatttatttcttacagatctgaagagccgattcctattaattgactaaaagtgttgaagttataggtaatttatatctcgtctgaagatacaatggcatcgccatcagatcacaaggctaccatcattgacggtaaagcaattgctcaaactattcgttctgagattgcttctgaagtccaacgtctttcagaaaagtatggcaaggtccccgggttggcagttgtcattgtaggaaataggaaggattcacaaagttacgtgaatatgaagagaaaatcttgtgcggagctgtgcattaagtcttttgacatagacctcccagaggatgtagctgaagctgaggtgattagcaaggtccatgagctaaatgctgatcctgatgtacatggtatactggtacagcttccgttaccaaaacatattaatgaagagagagttctatgtgaaatcagtctggaaaaggatgtagatggctttcatcctctgaatatcggcaagcttgcaatgaaaggcagacaacctttgttcaacccttgcacgcccaagggatgcatcgagcttttagtccgaagtgggattagcataaaggggaagaacgcagttgtggttggtcgaagcaacattgttggattaccagtatctcttcttcttctgaaggaagacgccactgttactgtagtccattcacgcaccaaagaaccagagaaaatcattcgcgaagcagacattatcattgctgccgcaggacaggctatgatgatcaaaggcagctggatcaaacctggtgctgcagtaattgatgttggaacaaatgctgtagatgatcctacaaggaagtcaggttataggctcgttggagatgtcgattttcaggaagcatgtaaggtggctggctggataactccagttccgggaggcgttggaccaatgactgttgcaatgcttctgaagaatacattggatggagctaaacgagttatcgagaagtaaacacttcattggctctgtagaccacaataaggtatgtcaaggcttcttagctaattgacaatacatttagaaatgacaaaaattacaatgagattgttcttgtgatatggtatttcatgtcgaaagtattacaaccactcgcttattatgcattgatcaaatatattatcggatatcactgtttatactacaagaacttgttgaattctgaactatatcgttacactagcaatgtgggagtacacaataattattgtattaggttactacatgaattgtta

SEQ ID NO: 1359 - DNA, 1209 bp, Triphysaria pusilla
cttgtacaacacctttccaaaaatcccctgatgccggatcgcgtttttcttatctacacacttcacgcaccaacaaccaatttcgtcgctttccacagctctcagaaaagatgtcggatcataaagccaccttaatcgacggcaaagcaatcgccaaaacaatccgatcggaaattgccgccgatgtccgccgcctctcggagactcacggcaaggtgccaggtctagcagtggtaattgtggggcaaaggaaggattctcagagctatgtcagcatgaaaaggaaggcctgtgctgaagttggaatcaaatctatcgatttggacctccctgagaatgtatccgaatccgaattgatttgcaaagtccacgaattgaacgcgaatcctgatgttcatggaatattggtacaactacccttgcctaaacatataaatgaagagaaaattttaactgagatatcgctggaaaaggatgtcgatggatttcatcctctaaacattggtaaattggcaatgaaaggcagagatcctttgttcgtcccttgtaccccaaagggctgcattgagcttctaaaccgaagtggcgtgagtattaaggggaagaatgctgttgtggtgggccgaagtaacattgttggtttaccagtttcgctgctccttctgaaggaagatgctactgtcactgtagtccattcgcgtacaaaggaaccagagagcattgttcgtaatgctgatattattatagctgctgcagggcaagcaaatatgatcaaaggcagctggattaaacctggagcagcggtaattgatgtgggaacaaacgctgtagatgatccaagtaagaaggctggttataggctagttggggatgtcgattttcatgaagcgtctaaggtagccggatggataactcctgttcctggcggtgttgggccgatgactgttgcaatgctgctaaagaataccttggatggtgctaagagggtgatggagcgttaatttttttagctcacttagaaaatgtaataatcttggactccggaaaattaatctggttggccttgttttcttttcttttatgatctggatgaatttcgtggggcgatgttttatatatgtaacgattgtcagttacgtccattgctggcattcatgttctggacaaggacgataaggttaattaaaatacctcagaccttttctacaa

SEQ ID NO: 1360 - DNA, 1088 bp, Flaveria ramosissima
gctactggatcaaaacgattactcaaagcttatgcaattataccatctaggtgtttatctgttgtaaaaaagccctagatttgtgctctttggctgctaattaggcaggtgaaatcttgatatcttgaatattatccgcatggcattgcctgtagatcataaagcaaacatcattgatggaaagttaattgcacaaacaattcgttctgaaatcgcctctgaagtcagtaacttggttgagaaatatggcaaggcccctggacttgctgtagtaattgttggaactagaaaggattctcaaagttatgttaatatgaagagaaaagcgtgtgctgaggttggaatcaagtcaattgacattgaccttcctgaagaagtacccgaagctgaattgatagcaaaagttcatgaattaaatgcagatcccaatgtacatggcatattggttcaacttcctttgccaaaacacataaatgaggagaagttttaactgaaatcagcattgaaaaggatgttgatggctttcatcccctcaacattggcaaacttgctatgaaaggcagagacccactctttctcccttgcaccccaaagggatgtattgaacttctgaagcgcagtggagttaccataaagggaaaacgggccgtggttgttggtagaagtaacattgtcgggttaccagtttcattgctgctgctgaaagaagacgctacagtcactgtagttcactcgcgtacagcagacccgcaaagtattatttgtgaggcagacattgttattgctgcagcaggacaagctatgatgataaaaggtagttggattaaacctggtgctgcagtaattgatgtgggaacaaatgcagttgatgatgctagtagaaaatcagggtacaggctggtgggtgacgtggattttgtggaagcatgcaaggtggctggatgtgtgacacctgtccccggaggtgtgggacccatgactgtagcaatgctgcttaagaacacgttggatggtgctaaacgtgtgattggtcagtagattaatcttaaattttgtgttacgaggattttgattactcatgttgtaac

SEQ ID NO: 1361 - DNA, 1154 bp, Beta vulgaris
aaaatggcggcgacgtcgtcggaaaataaggcatcgttaattgatggaaaagccattgctcagtgtatccgatcagaaatcgccgatgaagttcgtcttctctctcaaaagtatggaaaggtccctggactggcggtagtcattgtgggcaacaggaaggattctcaaagctatgttaatatgaaaagaaaagcatgtgctgaggttggaattaactctttggacatagaccttcctgagcaggtttctgagccggaattgatcgccaaggttcatgagttaaatgcaaaccccgaagtacatggtatacttgttcagcttccattgcccaaacatattaatgaagaaagagttttaactgaaataagcattgagaaagatgtagatggattccatcctctgaacatcgggaaacttgcaatgaaaggcagagaacccctgtttcatccttgcacgccgaagggctgtcttgagcttctgtctcgaagtggcatcagcataaaaggcaagaaggcagttgttgtaggtcgtagtaatattgttggattgccagtttcactcctcctcttgaaagcagatgcaaccgttagtattgttcactctcataccactgatcctaaaagtatcatccgtgaagctgacatcgtcatagctgcagcaggacaagccatgatgattaaaggtgactggataaagcctggtgctgctgtgattgatgtggggacaaatgcagtggatgatccgagtaagaaggcaggctaccggctggtgggggatgtcgatttccatgaagtgagtaaagtagcaggatggataacgcctgtccctggaggtgttggtcccatgactgtagccatgctacttagaaataccttggatggcgccaaacatgtgatcgagcagtgaaggctccttcctttcctatgaagggcatgttctatgatattctcccatttaagagtttgtacaagtttgagtgtaagaagtatatggttcaggtctttgcttctctggattttgatcatgttgaaaatactctcttcaaagaatacctctgattaggatgttgctttttagatcgatatggatcaatatttagttgggggaattattttgtcatttctgataaatgtgatatagattttggtgcaaaa

SEQ ID NO: 1362 - DNA, 1120 bp, Flaveria ramosissima
aaaagccctagatttgtgctctttggctgctaattaggcaggtgaaatcttgatatcttgaatattatccgcatggcattgcctgtagatcataaagcaaacatcattgatggaaagttaattgcacaaacaattcgttctgaaatcgcctctgaagtcagtaacttggttgagaaatatggccaggcccctggacttgctgtagtaattgttggaactagaaaggattctcaaagttatgttaatatgaagagaaaagcgtgtgctgaggttggaatcaagtcaattgacattgaccttcctgaagaagtacccgaagctgaattgatagcaaaagttcatgaattaaatgcagatcccaatgtacatggcatattggttcaacttcctttgccaaaacacataaatgaagaaaaagttctaactgaaatcagcattgaaaaggatgttgatggctttcatcccctcaacattggcaaacttgctatgaaaggcagagacccgctctttcttccttgcaccccaaagggatgtattgaacttctgaagcgcagtggagttaccataaagggaaaacgggccgtggttgttggtagaagtaacattgtcgggttaccagtttcattgctgctgctgaaagaagacgctacagtcactgtagttcactcgcgtacagcagacccgcaaagtattatttgtgaggcagacattgttattgctgcagcaggacaagctatgatgataaaaggtagttggattaaacctggtgctgcagtaattgatgtgggaacaaatgcagtagatgattctactaaaaaatcagggtacaggctggtgggtgacgtggattttgtggaagcatgcaaagtggctggatgcgtgacacctgtccccggcggtgtgggacccatgactgtagcaatgctgcttaagaacacgttggatggtgctaaacgtgtgattggtcagtagattaatcttaaattttgtgttatgaggattttgattactcatgttgtaacttttgtgtcgtttgattttgactttatagtttatcaagaataatgttttgttttctttattcaataatgaggtttacatgaatttatattcaatgatg

SEQ ID NO: 1363 - DNA, 1129 bp, Flaveria ramosissima
cgatctctcactgctactggatcaaaacgattactcaaagcttatgcaattataccatctgggtgtttatctgttgtaaaaaaagccctagatttgtgctctttggctgctaattagcaggtgaagtcttgatatcttggatatttcaacatggcattgccggtagatcataaagcaaacatcattgatgggaaattaatcgcccaaacaattcgttctgaaatcgcatctgaagtcagtaacttggttgagaaatatggcaaggcacctggacttgctgtagtaattgttggaactagaaaggattctcaaagttatgttaacatgaagagaaaagcgtgtgtcgaagttggaattaagtcaattgacattgaccttccagaagaagtacccgaagctgaattgatagcaaaagttcatgaactaaatgcagatccaaatgtacatggcatattggttcaacttcctttgccaaaacacataaatgaagaaaaagttctaactgaaatcagcattgaaaaggatgttgatggctttcatcccctcaacattggcaaacttgctatgaaaggcagagacccactctttcttccttgcaccccaaagggatgtattgaacttctgaagcgcagtggagttaccataaagggaaaacgggccgtggttgttggtagaagtaacattgtcgggttaccggtctcattgctgctgctgaaagaagacgctaccgttactgtagttcactcgcgtacagcagacccgcaaagtattatttgtgaggcagacattgttattgctgcagcaggacaagctatgatgataaaaggtagttggattaaacctggtgctgcagtaattgatgtgggaacaaatgcagttgatgatgctactaaaaaatcagggtacaggctcgtgggtgacgtggattttgtggaagcatgcaaagtggctggatgtgtgacacctgtccccgggggtgtgggacccatgactgtagcaatgctgcttaagaacacgttggatggtgctaaacgtgtgattggtcagtagattaatcttaaattttgtgttaagaggattttgattactcatgttgttaacttttttgtcgtgtgattttgactttata

SEQ ID NO: 1364 - DNA, 1051 bp, Flaveria ramosissima
aaggttatgcttttataccatctgggtgtgcatctgttgtaaaaagccctagatttctgctgtttagctgctaatcaggcaggtgaaatcttggtatcttggatattatccacatggcattgccggtagatcataaagcaaacatcattgatgggaaattaatcgcacaaacaattcgttctgaaatcgcatctgaagtcagtaacttggttgagaaatatggcaaggcacctggacttgctgttgtaattgttggaactagaaaggattctcaaagttatgtcaatatgaagagaaaagcgtgtgctgaggttggaattaagtcaattgacattgaccttccagaagaagtacccgaaactgaattgatagcaaaagttcatgaattaaacgcagatccgaatgtacatggcatattggttcaacttcctttgccaaaacacataaatgaagaaaaagttttaactgaaatcagcattgaaaaggatgttgatggctttcatcccctcaacattggcaaacttgcaatgaaaggcagagatccactctttcttccttgcaccccaaagggatgtatcgaacttctgaaacgcagtggagttaccataaagggtaaacgggccgtggttgttggtagaagtaacattgttgggttaccggtctcgttgctgctactgaaagaagacgctacagttactgtagttcactcgcgtacagcagacccgcaaagtattatatgtgaggccgacattgttattgctgcagcaggacaagctatgatgataaaaggtagttggattaaacctggtgctgcagtgattgatgtgggaacaaatgcagttgatgatgctagtagaaaatcagggtacaggctggtgggtgacgtggattttgtggaagcatgcaaggtggctggatgtgtgacacctgtccccggaggtgtgggacccatgactgtagcaatgctgcttaagaacacgttggatggtgctaaacgtgtgattggtcagtagattaatcttaaattttgttgttacgaggtattttgatt

SEQ ID NO: 1365 - DNA, 1135 bp, Elaeis guineensis
tgcatccggttcatgtccaaccgagccgccagggtccgatctttttcaccgcaaactcctcgatactccaccgcccacccgtggctcctgctcactgatctctcttctctcctcttcctctcgtcggcgtcaatggcgacgatcatcgacggcaaggcgatcgcccaaaccatccgaaacgagatcgccagcgaagtccgatccctctcccagaactacaacaaggtgccgggtctggcggtggtgatcgtggggacgcggaaggactcgcagagctacgtgagcatgaagcgcaaggcctgcgcggaggtgggcatccggtccttcgatctcgatctccctgaggatatctccgaggccgacctcatcgagaaggtccaccagttgaacgccgatgccgatgtccatggaatacttgttcaacttccgttgccaaagcacataaatgaagagaaagtcttgagtgaaatcagtattgaaaaagatgttgatggatttcatcctctaaatattggcaagctagcaatgaaaggcagagagccattatttctcccctgcactccaaagggatgccttgaactactatcacgaagtggtgtaagtataaaaggcaaaaaggcagttgtagttggtcgcagcaatattgttggattaccagtgtccttgcttcttctgaaagcagatgcaactgtgacaattgttcactcccatactcagcatcctgagcatatcatccgtgaggctgatatagttattgctgctgctggacaagcaatgatgatcaaaggagactggataaaacctggagctgcagtaattgatgttggaaccaatgctgttgatgacccaagtaagaagtcaggttatagacttgttggggatgtggacttccaggaagcaagcaaggtggctggatggatcactccagttccaggaggtgttggcccaatgacggttgctatgttgcttaagaacactctggatggtgctaaatgtaaaattgcacagtaaaaatagacattttagctaaatttgttcttcttgttgtgcatttaattagagaatataataaactatttgatttgagactattattaaaaaaaaaaaacaaagtagaactagcgaacgagacaca

SEQ ID NO: 1366 - DNA, 1212 bp, Solanum tuberosum
gactctttctactactctctcgatcgagtgagtagttctacttcactgttcgttaaattttcagatctcttcagttttctctccgattcagaagttgtgaagttgtaggcaatttatctctcgtctgaagatacaatggcatcaccatcagatcacaaggctaccatcattgatggtaaagcaattgctcaaactattcgttctgagattgcttctgaagtccaacgtctttcagaaaagtatggcaaggtccccgggttggcagttgtcattgtgggaaataggaaggattcacaaagttacgtgaatatgaagagaaaatcttgtgctgagctttgcattaagtcttttgatatagacctcccagaggatgtagttgaagctgaggtgattagcaaggtccatgagctaaatgctaatcctgatgtacatggtatactggtacagcttccgttaccaaaacatattagtgaagagaaagttctatgtgaaatcagtctggaaaaggatgtagatggctttcatcctctgaatatcggcaagcttgcaatgaaaggcagacaacctttgttcaacccttgcacgcccaggggatgcattgagcttttagttcgaagtgggattagcataaaggggaagaacgcagttgtggttggtcgaagcaacattgttggattaccagtatctctcctccttctgaaggaagacgccactgttactgtagtccattcgcgcaccaaggaaccagagaaaatcattcgtgaagcggacattatcattgctgctgcagggcaggctatgatgatcaaaggcagctggatcaaacctggtgctgcagtaattgatgttgggacaaatgctgtagatgatcctacaaggaagtcaggttataggctcgttggagatgtcgattttcaggaagcatgtaaagtggctggctggataactccagttccgggaggcgttggaccaatgactgttgcaatgcttctgaagaatacattggatggagctaaacgagttatcgagaagtaagtacttcattggctctgtagaccacaataagatatgtcaaggtttcttagctattgacaatacatttagaaatgtcaaaattacattcttgtgatatggaaatttcgtgtcgaaaaatcatgaagttttataaccactcgcttattatacattgatcaaatatatatatcggatcac

SEQ ID NO: 1367 - DNA, 1200 bp, Solanum phureja
tagagaggctgtttccaaaagaccctcggcttgagtaacataacctaaagttatacagcagtgtggtgaaaacgttgtgatgttgtaggcaatttatctctcgtctgaagatacaatggcatcaccatcagatcacaaggctaccatcattgatggtaaagcaattgctcaaactattcgttctgagattgcttctgaagtccaacgtctttcagaaaagtatggcaaggtccccgggttggcagttgtcattgtgggaaataggaaggattcacaaagttacgtgaatatgaagagaaaatcttgtgctgagctttgcatcaagtcttttgatatagacctcccagaggatgtttctgaagctgaggtgattagcaaggtccatgagctaaatgctaatcctgatgtacatggtatactggtacagcttccgttaccaaaacatattagtgaagagaaagttttatgtgaaatcagtctggaaaaggatgtagatggctttcatcctctgaatatcggcaagcttgcaatgaaaggcagacaacctttgttcaacccttgcacgcccaggggatgcattgagcttttagttcgaagtgggattagcataaaggggaagaacgcagttgtggttggtcgaagcaacattgttggattaccagtatctctcctccttctgaaggaagacgccactgttactgtagtccattcgcgcaccaaggaaccagagaaaatcattcgtgaagcggacattatcattgctgccgcagggcaggctatgatgatcaaaggcagctggatcaaacctggtgctgcagtacttgatgttggaacaaatgctgtagatgatcctactaggaagtcaggttataggctcgttggagatgtcgattttcaggaagcatgtaaggtggctggctggataactccagttccgggaggcgttggaccaatgactgttgcaatgcttctgaagaacacattggatggagctaaacgagttatcgagaagtaagtacttcattggctctgtagaccacaataagatatgtcaaggtttcttagctattgacaatacatttagaaatgtcaaaattacattcttgtgatatggaatttcatgtcgaaaaatcatgaagttttataaccactcgcttattatgcattgatcaaatatatatcggatcacagtttatacta

SEQ ID NO: 1368 - DNA, 1168 bp, Triphysaria pusilla
tgccggatcgcgtttttctatctacacacttcactcgccaacaaccattctcgtcgctttctacagctctcagaaaagatgtcggatcataaagccaccttaatcgacggcaaagcaatcgccaaaacaatccgatcggaaattgccgccgatgtccgccgcctctcggagactcacggcaaggtgccaggtctagcagtggtaattgtgggggagaaaaaggattcccagagctatgtcagtatgaaaaggaaggcctgtgctgaagttggaatcaaatctatcgatttggacctccctgagaatgtatccgaatccgaattgatttgcaaagtccacgaattgaacgcgaatcctgatgttcatggaatattggtacaactacccttgcctaaacatataaatgaagagaaaattttaactgagatatcgctggaaaaggatgtcgatggatttcatcctctaaacattggcaaattggcaatgaaaggcagagatcctttgttcgtcccttgtaccccaaagggttgcattgagcttctaaaccgaagtggcgtaagtattaaggggaagaatgctgttgtggtgggccgaagtaacattgttggtttaccagtttcgctgctccttctgaaggaagatgctactgtcactgtagtccattcgcgtacaaaggaaccagagagcattgttcgtaatgctgatattattatagctgctgcaggacaagcaaatatgatcaagggcagctggattaaacctggggcagcggtaattgatgtgggaacaaacgctgtagatgatccaagtaagaaggctggttataggctagttggggatgtcgactttcatgaagcgtctaaggtagccggatgtataactcctgttcctggcggtgttgggccgatgactgttgcaatgctgctaaagaataccttggatggtgctaagagggtgatggagcgttaattttttttgctcacttaaaaatgtaataatcttggattccggaaaattgatctggttggccttgttttttttctttaatgatctggttgaattttgtggggagatgttttatgtaacgactatgaatcacgtccattgctgatattcttgttctggacaaggacgatgaagttaattaaaatacctcggaccttttctc

SEQ ID NO: 1369 - DNA, 1736 bp, Vitis vinifera
cgccacttcatttctcgaggatgaagcctacacaccttcccggcgatggtcctcagacaacggtcggagagaggctccggctggcctatgaggcggccgtcatggccgtcgcccggaactgggcagtgaagggtggtggtgttccaattcctaaagaaattgagagaagaaaacactgctcagctgccgacgaccccattagaaccatgatgttcttggggtcttggaaccatacctagatcaataacttccttgatattatcataaatcactggatcttcaatcctaaagtattcatatcaaaattgtaatcctctgtactactcctcatgttcagatgattgtacctgtgaatctgaaggtatatatatattaataaatgaaagatttctatgattgatgtcaattattttttttaattttttttttctgaagtctataattattataatagtggggataaaaatcttatatatggaagcttttaattaaaaatagaatttaaatttttaatttttttctgtcagaattagaatttgatctcattaattttattattattattttaaaattttctgtgaattattgggtatttttattttatcatatgaaaattaaaattgttagaggaaaattttaaaaaagccacgtgtaaagctcacgttgattggtcacggagttgtgtcctacctactggtgggtggtagtggactgtctgcgattcccaatctacagtcagaccacatagttccacccaatctccaatctaccctctgttctgtccgatggcgtcgccggacggtcacaaggcttcaatcatcgacggcaaagccatcgctcaggcgatccggtcggaaatcgccgaagaagtccgtcatctctccgagaagtacggcaaggttccggggctggcggtggtcatcgtcggcaacaggaaggattcgcagagctacgtgagtatgaagagaaaggcgtgtgccgaagttggtattaagtcttttgatgttgacctgccggagcaagtattggagtctgaattgatcggcaaggtccatgagttaaatgctcttcctgatgtacacggtatactggttcagcttccattgcctaagcatataaatgaagagaaagtattaagtgaaattagccttgagaaggatgttgatggttttcatcctctgaacattggcaagcttgccatgaaagggagagaacctctgttccttccttgcactcctaagggttgtcttgaacttctatccaggagtggtataagtgtaaagggtaagaaggcagttgttgtgggtcgaagtaatatagttggattgccggttgcactactacttctgaaagctgatgccactgttactgttgttcattcacatactcaagatccagagagtatcattcgagatgcagacattgttattgctgcagcaggacaagcaatgatgattaagggcagctggatcaaacctggtgctgctgttattgatgtggggacaaatgctgttaatgatccaagcaaaaagtcaggttataggcttgtaggagatgttgatttccaggaagcatgtaaggtagctggatgggtgactcctgttccgggaggtgtgggtccaatgaccgtggcaatgctgctcaagaatacattggatggtgcaaagcgcgtgattgaacaattgttggaatcaccacaacacaattagtttttggaacactcttgaaaggatgtt

SEQ ID NO: 1370 - DNA, 1307 bp, Prunus persica
acttttctctctcataaccgtagctactactcaacggcaacgacagcacccaccaaccaatcactccgtgaatcggccaagtaacacattgaggttggagctcctcctcatccgaaaccctcatctcttcaagactgagtgagtggttgatcaatggcatcacaatcagatcacaaggctgcgataatcgatggcaaagccatagcgcagactatccggaacgaaattgctgaggaagtccgccatctctcccagaaatatggcaaggttccgggactggcagtagtgatagtagggaacagaaaggactcccaaagctatgtgagcatgaagcgaaaggcatgtgctgaagtcggcattctatccttggacattgacctccctgaagatgtgtctcaagttgacctcattgccaaagttcatgaattaaacgccaatcccgatgtacatggtatactagttcagcttccgttgccaaagcatataaatgaggagaaagtgttgagtgaaatcagcattgagaaggatgtcgatggctttcatcctctcaacattggcaagcttgcaatgaaaggcagagaacctttattccttccttgcactcccaaggcaagacaaagacaattgagttatggctgtctggaacttctgtcacggagtggcataagcataaagggaaagaaggcagtggtggtgggcagaagtaacatagttggattgccggtttcgttgctgcttttgaaagcagatgctacagttaccgtagtccattctcattctcatgatccagagagtatcattcgtgaagcggacattgttattgctgcagcagggcaggcaatgatgatcaagggtagttggataaaaccaggtgctgcagttatcgatgtcggcacaaatgcaatagacgactcgagtagaaagtctggctatagattggtgggagatgttgatttccaggaagcatgtaaggttgctggatgggtaactcctgtgcctggaggcgtcggcccaatgactgttgcaatgttactcaacaacactttggatggtgctaagcgtgttattgcacaataaaagctgttgctaagcgtgccctctcactcaaagttctagtgggcctaatttagaattttgattttgaagatttacttttagagacttttttatatttattttttgttaaaaagtcttgggaatttcactcccagttttaaccgatctttgtgttggttcatgcatacatgatacatatgcttgtatgaatagttaattgactaaattctccttaatagtttttttttagc

SEQ ID NO: 1371 - DNA, 990 bp, Cyclamen graecum
agccccatctttctctacaagcagttcattatccggagggagagagagagggcttgtttggtgttaatggcgacgcaatcggaggaagagaagagtgcgcgtatcatcgacggaaaagctattgctcagactatccgatcggagatcgccgccgaggtccgccgcatctccgacaaattccacaaggttccgggattagcagtggtcatagtaggaactaggaaggactctcaaagctacgtgagtatgaagagaaaagcttgtgctgaagttgggattaagtctttcgatattgaccttcccgagcaagtacccgaagctgagttgattagcaaggtccacgaattgaatgcagatcccctcgtacacggtatattagttcaactgcctctgccgaagcacataaatgaagagaaagtcttgagtgaaatcatcatagagaaggacgtagatggctttcatcctcttaacattggcaagctcgccatgaaaggcagagatcccctgttccttccttgcaccccaaagggttgccttgagcttctatctaggagtggcataagcataaagggaaagaaggccgttgtggtaggtagaagtaacattgtgggattgccagtttcacttctactactcaaggctgatgccactgttacagtggtccactcgcatacccctgatcccgaaaaaatcatcagcgaggcagacatcataatcgccgcagcaggacaagcaatgatgattaagggcagttggatcaaacctggtgctgcagttatcgacgtgggaacaaatgcagttgatgatccgactaagaagtcgggctacagactcgtgggtgatgtggatttcaaagaagcgtgcaaagtagcaggagcaataactccggtcccaggtggggttggccccatgactgttgctatgctgcttcagaataccttggagggtgccaagagagttatcatgcagtaagacattacagtttttcgt

SEQ ID NO: 1372 - DNA, 1317 bp, Cocos nucifera
acgtagctctgcgagtccttccgaccacaaactccccgatactccaacacgcccgcccgttgctgccactcactgatccttctctgctcttctcttgctttcgtcggcgtcaatggcgacgatcatcgacggcaaggcgatcgcccaaaccatccgaaacgagattgccagcgaagtccgatccctctcccagaactacaacaaggtgccgggtctggcggtggtgatcgtgggaacgcggaaggactcgcagagctacgtgagcatgaagcgcaaggcctgcgctgaagtgggcatccggtccatcgatttcgatctccctgaggacatctccgaggccgacctcatcgagaaggtccaccagttgaacgccgatgccgacgtccatggaatactggttcaacttccattgccaaaacacataaatgaagagaaagtcttaagtgaaatcagtattgaaaaagatgttgatggatttcatcctctgaatattggcaagctagcaatgaaaggcagagagccgttatttctaccctgcaccccaaagggatgccttgaactactatcacgaagtggtgtaagtataaaaggcaaaaaggcagttgtagttggtcgcagcaatattgttggattaccagtgtccttgcttcttctgaaagcagatgcaactgtgacaattgttcactcccatactcaacatcctgagcatatcacccgtgaggctgatatagttattgctgcagctggacaagcaatgatgatcaaaggagactggataaaacctggagctgcggtaattgatgttggaaccaatgctgttgatgacccaagtaagaaatcaggttatagacttgttggggatgtggacttccaagaagcaagcaaggtggctggatggatcactccagttccaggaggtgttggcccgatgacggttgctatgttgctcaagaacactctggatggtgctaaacgtaaaattgcacagtaaaaaatagacattcagctagttttgttcttcttgttgtgcatttaattagagaatataataaaatatttgatttgagactattattaatcactttctgtacatcagtattgtgaactgagtgcctagattgaaatatacctctttaggtctgagcattaagaaggatccccatttttctagcagataatatgataaatagttcaatgataacatcaacctgattagccaacttgctgaattcataaaaattaaggcttttcaatattaagaacttgagactgctctcaggaagtgaaatttcagaaaacggcagctatttgatcctc

SEQ ID NO: 1373 - DNA, 1152 bp, Allium cepa
aaagaagggcgcataaatccaaatcgctgtcatcttcattatcagtacgctcttccacccactccaatccattccagatcaaagaaaaaacagattatacataataatggcaaaaataatcgatggcaaagcaatagctcaagacatccgtaatgaaattgcacaagaagtccaaatcctctctcaaaatcaccacacggttcctggattggctgtggtgatagttggtacaagaaaagattcgcagagctatgtgaatatgaagagaaaagcttgtgctgaagttggtatcaagtcttttgattttgatttgcccgaagagatttccgagaccgatgttatcgctaaagttcatgaattgaatgctaatcctgatgtacatggtattctagtgcaacttccattgccaaaacatattgatgaagaaaaagtgttaagtgagatcagcatagagaaagatgttgatggatttcatccctcgaatattggcaagcttgctatgaaaggcagagaaccactattttcaccttgcacacccaagggatgccttgaacttttatcaagaagtggagtaagtgtgaaagggaaaaaagcggtcgtggttggtcgaagcaatatagttggccttcctgtatcattgcttctccttaaagcagatgcaactgtgactattgttcattcgcatactcctgatccagaaagcatcatccgagaagctgacattgttatagctgctgctgggcaagcaaatatgataaagggagattggataaaaccgggagcagcagtgatcgatgtgggcacaaatgctgtagatgatccaagcagaaagtcgggatacaggcttgtgggagatgttgattttcaagaagggagcaaagtggctggatatttaactccagttcctggaggtgttggtccaatgacagtcgctatgcttctcagaaacacgttggacggagccaagcgcaaaattgcacggtgaacagaaaggaaagttgagaattaagaataatatgatagaaataagttgtatcaatatatatatttaattactatactgcatctttcatgtataaatgatctttactgcctgcataaatgaataagtaaaccctgttttatggtctgtgtattagttttgatacagca

SEQ ID NO: 1374 - DNA, 1068 bp, Ambrosia trifida
ggttggttgaatcttgatatcttggttattattcagatggcagatcataaagcaaacatcattgatggaaaattaatcgcacaaacgattcgttctgaaatcgcctctgaagtcagtatcttggttgagaaatatggcaaggcacctggacttgctgtagtaattgttggacataggaaagattctcaaagttacgtaaatatgaagaggaaagcgtgtgctgagcttggaattaggtcaattgacattgaccttccggaagaagtaccggaagctgaattgatagcaaaagttcatgaactaaatatagatcccgatgtacatggcatattggttcaacttcctttgccaaaacacattaatgaagaaaaagtcttaactgaaatcagcattgaaaaggatgtcgatggctttcatccgctcaacattggcaaacttgctatgaaaggcagagaccctctctttcttccttgcaccccaaagggatgtattgagcttcttaaacgcagtggagttaccataaagggaaaacgggcggtggttgttggcagaagtaacattgtagggttaccagtttcattgctgctactgaaagaagacgctacagttactgtagttcactcacgtacagaagacccgcaaagtattattcgtgaggcagacattgttattgctgcagcaggacaagctgtgatgataaaaggtagctggattaaacctggtgctgcagtgatagatgtgggaacaaatgcagtcgatgattccactagaaaatcaggatataggctggttggtgacgtggattttcaagaagcatgtaaggtggctggatggattacacctgtcccaggaggtgtgggacccatgacagtagcaatgctccttaaaaacacattggatggtgctaaacgtgtgattggtcagtaaattaaccttaactttctgttaccagaattctgaatgcctactgatgttgcctttttttaggtagtttaattttgacattttgtctgtattaagaatattgttaattttttttcaataataacgggttgcatcaaaaaagaa

SEQ ID NO: 1375 - DNA, 1019 bp, Ambrosia trifida
ttttttaatcatcacccacccacacacccacctctcaatctcttattgtcactagatttgtgctcctctttaactatcactcaggacagggttggttgaatcttgatatattggttattattcagatggcattgcctgtagatcataaagcaaacatcattgatgggaaattaatcgcacaagcgattcgttctgaaatcgcctctgaagtcagtgtcttggttgagaaatatggcaaggcacctggacttgctgtcgtaatcgttggacataggaaagattctcaaagttacgttaatatgaagaggaaagcgtgtgctgagcttggaattaggtctattgacattgaccttccggaagaagtacccgaagctgaattgatagcaaaagttcatgaactaaatatagatcccgatgtacatggcatattggttcaacttcctttgccaaaacacattaatgaagagaaagtcttaactgaaatcagcattgaaaaggatgtcgatggctttcatccgctcaacattggcaaacttgctatgaaaggcagagaccctctctttcttccttgcaccccaaagggatgtattgagcttcttaaacgcagtggagttaccataaagggaaaacgggcggtggttgttggcagaagtaacattgtagggttaccagtttcattgctgctactgaaagaagacgctacagttactgtagttcactcacgtacagaagacccgcaaagtattattcgtgaggcggacattgttattgctgcagcaggacaagctatgatggtaaaaggtagctggattaaacctggtgctgcagttatagatgtgggaacaaatgcagttgatgattccactagaaaatcagggtacaggctggtgggtgacgtggattttcaggaagcatgtaaggtggctggatggattacacctgtcccaggaggtgtgggacccatgacagtagcaatgctccttaaaaacactttggatggtgctaaacgtgtgattggt

SEQ ID NO: 1376 - DNA, 1180 bp, Arnica chamissonis
tgtgcctaaaatttcatatcatcacccacctctcgctctctcactgtgactggatcaatagaattcctcaaaatctgtaccatcagggcgtgtaactgtagtaaaaagccctagatttgtgctgtttgactgctgctcaggtaggtgaaatcttgatatcttggttattattcacatggcgttgcctgtagatcataaagcaaacatcattgatggaaaaataattgcacaaacaattcgttctgaaatcgcctccgaagtcagcaacttggttgagaaatatggcaaggcacctggacttgctgtagtaattgttggaaacagaaaagattctcaaagttatgttaatatgaagagaaaagcgtgtgctgaggttggaattaagtcaattgacattgaccttccggaagaagtacctgaagccgaattgattgcaaaagttcatgaattaaatgcagatcccagtgtacatggcatattggttcaacttcctttgccaaaacacataaatgaagaaaaagtcttaactgaaatcagcattgaaaaggatgttgatggctttcatcctctcaacattggcaaacttgctatgaaagacagaaaccctctctttcttccttgcaccccaaagggatgtatcgaacttctgaaacgcagtggaattacgataaagggaaaacgggccgtggtggttggtagaagtaacattgttgggttaccagtttcattgctgctactgaaagaagacgctacggttactgtagttcactcacggacagcggacccgcaaagtattatttgtgaggcagacattgttattgctgcagcaggacaagctatgatgataaaaggtagttggattaaacccggtgctgcagttattgatgtgggaacaaatgcagttgatgattctaccagaaaatcagggtacaggctggtgggtgacgtggattttgcggaagcatgcaaagtggctggatgggttacacccgttccagggggtgtgggacccatgactgtagcaatgctgcttaaaaacacgttggatggtgctaaacgtgtgattggccagtaaattaatcctaattttctgttacgagaattctgaataccaatgttgtaacttttttgtcgtttgatattggctttttgaatgtattaaggatattgtttattatac

SEQ ID NO: 1377 - DNA, 1154 bp, Tragopogon dubius
tctctccctctctctcgattaaaagcttcgacgatctgggtctctacctaacaagtagtaaaaagctctagatatctcagttgccattgctatggcattgcctgtggatcataaagccagcatcattgatggaaaagcaatcgcacagacaattcgatctgaaattgcttctgaagtcagtaccctgattgagaaatatggcaaggcgcccggacttgctgtagtcatagttggacatagaaaagattctcaaagctatgtaagtatgaagagaaaagcatgtgcagaggtgggaattaagtccattgacatagaccttccagaacaagtacctgaagccgagctaatagcaaaggtccatgagttaaatgcagaccctagcgtacatggcatattggttcagcttccattgccaaaacacataaatgaagaaaaagttttaacagaaatcagcatcgacaaagatgtagatgggtttcatcctctaaacatcggcaaacttgctatgaaagggagagaccccttgtttcttccttgcaccccaaagggatgtatcgagcttctgaaacgaagtggtattcctataaagggaaagcgcgcagtggttgttgggcgaagtaacattgtagggttacccgtttcactccttttactaaaagaagatgccacagttactgttgttcattcgcgtacagtggatccagaaagtattatccgcgaggcagatattgttattgctgcagcaggccaagctatgatgataaagggtagttggattaaggctggtgcggcggttattgatgtggggacgaacgcggttgatgattcaagtagaaaatcagggtatcggcttgtgggcgatgttgattttcaggaggcgtgtgaagtggctggatgggttacgcctgttcccggggtgtggggcccatgactgtagcaatgctgcttaaaaacactttggatggtgctaaaagggtgatcgggcagtaaaccaaagaaatctggatatcgtatttatggtgttgtagtttttgagcatattagctcatttaattttgacttatttaaatgtataagaattgtcttatgggatttgtgttaagataattttgggaccatttaaatgttatgttatcactaaaatcggattgaag

SEQ ID NO: 1378 - DNA, 888 bp, Vinca minor
attatcgacggcaaattaattgctcaaactatcagatctgagatcgccgccgaagtccggctgctctccgaaaagtacaacaaggtaccaggattgcagtagtgattgtaggtaataggaaggactcccaaagctatgtgagtatgaagaggaaggcatgtgctgaggttgggattaagtcttttgacattgaccttccagaggaggtatctgaagctgccttgatcgacaaggtccatgagttgaatgcaaatcctgatgtacatggaatactggtccagcttccacttccaaagcatataaaggaagagaaagtattaagtgaaattagcttggagaaggatgttgatggatttcaccctctgaacattggaaagcttgcaatgaaaggcagagaacctctattctctccttgcacccccaagggttgtattgagcttctttcacggagtgggattaccataaagggaaagagggcagttgtggtaggtagaagtaacatagttggattgccggtgtctctactacttctgaaggaagatgctactgtcactgtggtgcattccggtactaaggaacccgagagtattattcgtgaagctgacattgtaattgctgcagcaggacaagcaatgatgattaaaggaagttggattaaacctggtgctgctgttattgacgtggggacaaatgctgttgatgacccaaagaagaaatcaggttacagactcgttggagatgttgatttccaagaagcatgtaaagtagctggatacataactccagttcctggcggtgttggtccaatgacagttgcaatgctactgaagaacacattagacggagctaagcatgtcattgagcactgatttctgtttcagatcataa

SEQ ID NO: 1379 - DNA, 1070 bp, Amorphophallus konjac
cttttactgtctctgatcccttctcgccatggcgttggaagagcagcaacagcgtccaacggcgaagatcatcgacgggaaggccatcgcccaggccatccgggatgagatcgccgccgaagtccggtccctctccgaggcgcacggcacggtgccggggctggcggtcgtgatcgtgggctgcaggaaggactctcagagctacgttgccatgaagaggaaggcatgcgccgaggtgggtatccgctccttcgacctcgacctccccgaggacattcccgaggcggacgtcatccggaaggtccatgagctcaacagcaatccggaagttcacggaatattggttcagcttcccctaccaaggcatataaatgaagagagagtgctaagtgaaataaacattgacaaagatgttgatggattccatcccctaaatattgggaagcttgccatgaaaggcagagagccgttgtttcttccttgcaccccaaagggatgtcttgaacttttatcaagaagtggcataacaataaaaggcaaaagagctgtagttgttggtaggagcaatatagttgggttaccagtggctttgctgcttctgaaagcagatgcaactgtaactattgttcattcgcatactcatgatcctgaaagcatcattcgtgaagcagatattgttattgctgctgcaggacaagcaatgatgatcaaaggagactggcttaagcctggtgccgctgttattgatgtggggacaaatgctattgacgacccaagtagaaaatcaggttatagacttgtaggcgatgtggacttccaagaagcaattaaggtggctggatggcttactccagtcccaggaggtgttggaccaatgactgttgcaatgctgctccagaacaccttggatggtgctaagcgcaaagttaatcaataaaatgtgctcactttaaatgactgttgtttaatgtttgagctgtgatctgtgtagacaataaaagttgcccttttgccttaatgaattgtttagtaactttcttgttctattcctgtaagtgttagtttgattc

SEQ ID NO: 1380 - DNA, 1212 bp, Chelidonium majus
ctgtaacagattctgcatttctgaagctctaaaacacccatcaatggcgtcatcagaagaacaccatcaaaagaaggcctgtataattgatggtaaagccattgctcaaactatacgttctgaaatcaccactgaagttcaacatctatcagaaaaatacggcaaggttcctggactagctgttgttattgtaggccacaggaaagattctcaaagctatgtgaatatgaagagaaaggcctgtgctgaagttggtattaggtccttcgatgtggatctgccagagcaagtatctgaggctgaagtgatccaaaaggttcacgagttaaacgttcatcctgatgtccatggaatactagtccagcttcccttgccaggccacataaatgaagaaaacgtgttgagtgaaatcagcattgaaaaggatgtagatgggtttcatcctctgaacattggcaaacttgccatgaaaggcagagaacccctgtttcagccttgcacacccaagggatgccttgagcttctaacacggagtggtataagtataaagggcaagagagcagttgtagttggtagaagcaatatagttggactacctgttgcgctgctacttctgaaagcagatgctaccattactgtagttcactcacgtaccaccgattctgaaagcatcatccgtgaagcagacattgtgatcgctgctgcaggacaagcaaaaatgatcaagggtgattggattaaacctggcgcagctgtgattgatgtggggacaaacgctgttgatgacccaagtagaaaagcaggttacaggctagtgggcgatgtcgacttcaatcaggtatcaaaggtggctggttgggtgactccggttcctggaggcgtgggacccatgactgtggcaatgctactcaagaataccttggatggtgccaagcgtaagatagagcagtaaatcgctttcttttctaaatcctggatagtgcattgatggatattgcatctagaactaaagttttgtatggaaacatgctttatttttctgttaggccagtattctaatgtttaaactttggctatcaaactaaataatatgtgccttagcaattgcgaaatatcggatttgtcgttataatctgtataaaaaagtatatgtaccttttgagaagaccacagggagtctaatccccgatgtggcttagtcttctagtttaa

SEQ ID NO: 1381 - DNA, 1291 bp, Fagopyrum esculentum
gacttgatcttggagagatattccacactgaatcaagtgtcggaaatggcgacatcgtcagagcactcggccacgattatcgacggcaaggatatcgctcagacgatccgatctgaaatctccgatgaagtccgcgtcatgtccgaaaattttggcagagtccctggactagccgtggtaattgttggcagcagaaaagattctcaaacctatgtaaatatgaagagaaaagcatgtgctgaggttgggatcaaatctttcaacatagatctaccagagcaagtctccgaagctgaacttgttgataaagttcacgaattaaatgcaaactctgaagtacatggcatactggttcagcttccattgcccaagcatatcaacgaagagaaagttttgagtgagatcagcatcgagaaggatgtagatggattccatcctttgaacattggcaaacttgcaatgaaaggcagagaccctctatttcaaccttgcaccccaaagggttgtcttgagttgttgaaacgaagtggcatcactgtcaaagggaagaaggctgttgttgttggacgaagcaacattgttggattgccagtgtcgctacttcttttaaaagcagatgctactgtcactgttgtccattcccgcactagtgaaccggagaaaattattcgtgaagctgatattatcattgctgcagcaggacaagctacgatgatcaagggtgattggataaaacctggtgctgctgtgatagatgttgggacaaatgcagttgatgatcccacaaagaagtcaggttacagacttgtgggagatgtaaatttccaggaggcttgcgaagttgctggttggattactcctgtgccaggaggtgtggggccaatgaccgtagcaatgttacttcagaatactttggacggtgctaagcgtttgatcaagaactgagctgcgttcttcttgagaaacatgaaaggaaaagaaactgaagctttctgtttcattttgccatgatcaatcttgtgagacaaattgtcaaaaacgtcagaggtgagtaaaatgatgaacaagcatgatgggtccccagcactggtggtggtggtggtggtgaatcaactgcatcaggaaagtgagagatttatggtggatcgatatgatcggcctcgactttcaaacactctatagcataagcacttgcatgccctatatagactatagtctatgatgttggagtcgttttcacacagaattatatgcaactgtacaatttcaccacaaccacttttaagtataa

SEQ ID NO: 1382 - DNA, 1133 bp, Flaveria ramosissima
tgctactggatcaaaccgattactcaaagcttatgcaattataccatctgagtgtttatctgttgttaaaagccctagatttgtgctctttggctgctaattaggtagggggagtcttgatatctttgttattatccacatggcattgccggtagatcataaagcaaacatcattgatggaaaattaattgcacaaacaattcgtgctgaaatcgcatctgaagtcagtaacttggttgagaaatatggcaaggcacctggacttgctgtagtaattgttggaactagaaaggattctcaaagttatgttaacatgaagagaaaagcgtgtgccgaggttggaattaagtcaattgacattgaccttcctgaagatgtacccgaagctgaattgatagcaaaagttcatgagttaaatgcagatcccaatgtacatggcatattggttcaacttcctttgccaaaacacataaatgaagaaaaagttttaaccgaaatcagcattgaaaaggatgttgatggctttcatcccctcaacattggcaaacttgctatgaaaggcagagacccgctctttctcccttgcaccccaaagggatgtattgaacttctgaagcgaagtggagttaccataaagggaaaacgggccgtggttgttggtagaagtaacattgtcgggttaccagtttcattgctgctactgaaagaagacgctaccgtcactgtagttcactcgcgtacagcagacccgcaaagtattatttgtgaggcagacattgttattgctgcagctggacaagctatgatgataaaaggtagttggattaaacctggtgctgcagtaattgatgtaggaacaaatgcagttgatgattctactaaaaaatcagggtacaggctggtgggtgacgtggattttgtggaagcatgcaaagtggctggatgcgtgacacctgtccccggcggtgtgggacccatgactgtagcaatgctgcttaagaacacgttggatggtgctaaacggttgattggtcagtagattaatcttaaattttgtgttatgaggattttgattactcatgttgtaactttttgtcgtgtgattttgactttatagtgtattaagaataatg

SEQ ID NO: 1383 - DNA, 1214 bp, Lippia dulcis
cacgaatcatcatcttcaattgagcgtaatctagctgcaaatctcactcacaaccatgtcggatcacgaggtcactataatcgacggcaaagcagtcgcccaaacaatcagatcggagatcgccgccgaagtctgccgcctttccgaaacttacggcaaggttcccggtctagccgttgtgattgtggggcaaaggaaggattcacagagctatgtgaatatgaaaaggaaagcttgtgcggaagttggaatcaagtcacttgatttggaccttccagaggatgtatccgaatctgacttgatttgcaaagttcatgaattgaatgccaatcctgatgttcatggtatactcgttcagcttccactgcctaaacacataaacgaagagaaaattctaactgagatatccctgggaaaggatgtcgatggatttcatcctctgaacattggcaagttagcaatgaaaggcagagatcctttgtttgtcccgtgcaccccaaagggttgcatcgagcttctaactcgccatggcattactattaagggaaagaatgctgttgtggttggcaggagtaacatagttggtttgccagtttccttgctccttctaaaggaagatgccactgtaactatagtccactcacgtaccaaagaaccagaaaccattattcgtaatgccgacatcatcatagctgctgcaggacaagcagcaatgatcaagggcagttggatcaaaccctgtgctgcagtaatcgacgtaggaaccaatgctgtggatgatccaagtaagaaatctggttataggcttgttggggatgtggattttcaggaagcatgtaaggcagccggatgcataactccagtacccggaggcgttggaccgatgactgttgcgatgttgctaaagaacaccttggatggagctaagagagtaatagagggttagtgtctcattttctgaagattaataagatctttcgcggtttatattgggtggaatatggtatcccctgtcaaaatatagggtgtgcgtaaacgaactgtgggtattatatttcttcataattttgtcatttgcattctatggtggtcttgttttaggcctaaaatatttgctttgatattttatttagtatcctacaaaaactccgacttactctttcccaaattttatttcgaaaacttaagaagttaatctctattttaaaaaagaa

SEQ ID NO: 1384 - DNA, 1103 bp, Plantago ovata
actccaggcatctatcactgactttctctctgcaaaaacatggcggatcataaggctaccttgatcgacggcaaggcaatcgcccaaacaattagatccgaaatcgccgccgatgtccgccgcctctccgaaactcacggcaaggtgccaggtctggccgtggtaatcgtggggaataggaaggattctcaaagctatgtgagtatgaaacggaaggcctgtgcggaggttggaatcaagtcctttgattcggatcttcctgaggatgtatctcagtctgaattgattagcaaaatccatgagttgaacgaaaatcctgatgttcatggtatcttggtacagcttcccttgcctaaacacataaatgaagagaaaatattgcaggagatatccctagagaaggatgtcgatggatttcatcccctgaatattggaaaattagcaatgaagggcagagatcctctttttgttccttgcacgccaaagggatgcatcgagcttctaacacgaagtggcattagcatcaagggaaagaatgctgttgtggtgggtcgaagtaacatagttgggttaccggtttctctgctgcttctgaaggaagatgccactgtcactgtagtccactcacgtactaaggaaccagagagcatcatccgtcaagctgacattattattgcagcagccggacaaccaatgatgatcaagggaagttgggtcaaaccgggtgctgcagtaattgatgtaggaacaaatgctgttgatgacccaacgaggaaaactgggtataggctcgttggagatgttgatttcaatgaagcatccaaggtggctggatggataactcctgtccctggtggtgttggaccaatgactgtcgcaatgctattaaggaataccgtcgatggagctaagagagtaattgagcattaaaactttccattttcctttcaattgcatgcctttcatataattgtattatgtataccgtgttttagaatattatttgccgagagacaaatttttgcacttgattaatttatctttgcatttgaaatctttgactcagaagcttgttgccagctatgttcatcattatgaatcta

SEQ ID NO: 1385 - DNA, 1056 bp, Helianthus annuus
aaagccctagatttgtgcagctgttgactgttactcaggttggttgaatctttgatatatcggttattataccaacatggcattgcctgtagatcataaagcaaacatcattgacggaaaattaatcgcgcaaacaattcgttctgaaatcgccgctgaagtcagtgtcttggttgagaaatatggcaaggcacctggacttgctgtagtaattgttggacatagaaaagattctcaaagttacgttaatatgaagaggaaagcgtgtgctgagcttggaattaggtcaattgacattgaccttccggaacaagtacacgaagccgaattgatagcaaaagttcatgaattaaatgaagatcccaatgtacatggcatattggttcaacttcccttgccgaaacacataaacgaagaaaaagttttaaccgaaatcagcttggaaaaggatgttgatggctttcatcctctcaacatcggcaaacttgctatgaaaggcagagacccgctctttcttccttgcaccccaaagggatgtattgagcttctgaaacgcagtggagttaccataaagggaaaacgggccgtggttgttggcagaagtaacattgtagggttaccagtttcattgctgctactgaaagaagacgctacagttaccgtagttcactcacgtacaccagacccgcaaagtattatctgtgaggctgacattgttattgctgccgcaggacaagcgatgatgataaaaggtagttggattaaacctggtgctgcagttatagatgtgggaacaaatgcagttgatgatgctagtagaaaatcaggatacaggctggtgggtgacgtggattttcatgaagcatgtaaagtggctggatggattacacccgtcccgggcggtgtgggacccatgaccgtagcgatgctccttaaaaacacgttggatggtgctaaacgtgtgattggtcagtaaattattaatcttaattttctgttaccagaattatgaatgcctacagatgttgtaccctttttgaggtcgtttaattttga

SEQ ID NO: 1386 - DNA, 1027 bp, Helianthus annuus
aaagccctagatttctgcagctgttgactgttactcaggttggttgaatctttgatatattggttattatagccacatggcattgcctgtagatcataaggcaaacatcattgatgggaaattaatcgcacaaacaattcgttctgaaatcgccgctgaagtcagtgtcttggttgagaaatatggcaaggcacctggacttgctgtagtaattgttggacatagaaaagattctcaaagttacgttaatatgaagaggaaagcgtgtgctgagcttggaattaggtcaattgacattgaccttccggaacaagtacatgaagccgaattgatagcaaaagttcatgaattaaatgaagatcccaatgtacatggcatattggttcaacttcccttgccaaaacacataaacgaagaaaaagttttaaccgaaatcagcttggaaaaggatgttgatggctttcatcctctcaacatcggcaaacttgctatgaaaggcagagacccgctctttcttccttgcaccccaaagggatgtattgagcttctgaaacgcagtggagttaccataaagggaaaacgggccgtggttgttggcagaagtaacattgtagggctaccagtttcattgctgctactgaaagaagacgctacagttactgtagttcactcacgtacaccagacccgcaaagtattatctgtgaggctgacattgttattgctgccgcaggacaagctatgatgataaaaggtagttggattaaacctggtgctgcagttatagatgtgggaacaaatgcagttgatgatgctagtagaaaatcaggatacaggctggtgggtgacgtggattttcatgaagcatgtaaagtggctggatggattacacccgttccgggcggcgtgggacccatgaccgtagcgatgctccttaaaaacacgttggatggtgctaaacgtgtgattggtcagtaaattattaatcttaattttctgttaccagaattatgaatgcctacagatgtt

SEQ ID NO: 1387 - DNA, 1052 bp, Helianthus annuus
gccctagatttgtgcagctgttgactgttactcaggttggttgaatctttgatatattggttattatacccacatggcattgcctgtagatcataaagcaaacatcattgacggaaaattaatcgcacaaacaattcgttctgaaatcgccgctgaagtcagtgtcttggttgagaaatatggcaaggcacctggacttgctgtagtaattgttggacatagaaaagattctcaaagttacgttaatatgaagaggaaagcgtgtgctgagcttggaattaggtcaattgacattgaccttccggaacaagtatccgaagccgaattgatagcaaaagttcatgaattaaatgaagatcccaatgtacatggcatattggttcaacttcccttgccgaaacacatagacgaagaaaaagttttaaccgaaatcagcttggaaaaggatgttgatggctttcatcctctcaacatcggcaaacttgctatgaaaggcagagacccgctctttcttccttgcaccccaaagggatgtattgagcttctgaaacgcagtggagttaccataaagggaaaacgggccgtggtggttggcagaagtaacattgtagggttaccagtttcattgctgctactgaaagaagacgctacagttactgttgttcactcacgtacaccagacccgcaaagtattatctgtgaggctgacattgttattgctgccgcaggacaagctatgatgataaaaggtagttggattaaacctggtgctgcagttatagatgtgggaacaaatgcagttgatgatgctagtagaaaatcaggatacaggctggtgggtgacgtggattttcatgaagcatgtaaagtggctggatggattacacccgtcccgggcggtgtgggacccatgacagtagcgatgctccttaaaaacacgttggatggcgctaaacgtgtgattggtcagtaaattattaatcttaattttctattaccagaattatgaatgcctacagatgttgtaccctttttgaggtctttaattttga

SEQ ID NO: 1388 - DNA, 1320 bp, Mimulus guttatus
aaaaagaagaagaagattggatagaaacattgagatacatatatatacataccactggacacacacacacagtaatataacaataggtgttgaaacgaaacgaaacgatgtcgtcggccaccattatcgatgggaaagctatcgcccaaacaatccgatccgaaattgccgtcgaagttcaacgtctctcccaaacatacaacaaggtgccgggtctagcagtggtaatagtggggaaaaggaaggattcacagagctatgtgggtatgaaaaggaaggcttgtgctgaactcggtattaagtctttcgatattgaccttcctgaggatgtctcccaatctgacttgattaccaaactccaccaattgaatgccaatcctgatgttcatggtatactggtacagcttccgttgcctaaacatataaatgaagagaaaattctaacagaaatatccctggaaaaggatgttgatggatttcatccattaaacattggcaaattggcaatgaaaggcagagatcctctttttgtcccttgcaccccaaagggttgcctcgagcttttatcaagaagtggtattagtgttaagggaaagaatgcggttgtggtgggtcgaagtaatatagttggtttaccagtgtctttgctccttctcaaggcagatgctactgttactgtagttcattcacacacaaaggaaccggagaccatcattcgtaatgctgacatcattattgctgctgcaggacaagcaaaaatgataaaaggaagctggataaaagcgggtgctgcagtaattgatgtaggaacaaatgctgtggatgatccgagtaagaaatcaggatacaggctggttggggatgtggattttgaagaagcaagtaaggtagctggatggatcactccagttcctggtggtgtgggacccatgactgttgctatgctactaaagaatactttggatggagctaagagagtcattgaacattcatgattcatcttttttcttaattatatcaaaaccttattaacatctatctctattggtgttcgtcgtcgtttaccattattatgtttagtttcgcttgttgccattgtaatgctgaaaatatagaatgacggattttgatgcttcttgtttgtcattgaggttgtattatccggggaaacaaaaactattattattagtatttatgtcgtaactaagtgtttctgagtttctgcttagtattactgcttttgtgagacatggtagttatggaaatggcttctgaatattttctgggctgtcacctttaatcaggtcctttgagttgcaa

SEQ ID NO: 1389 - DNA, 1077 bp, Humulus lupulus
gaagtgagtttgtcagtcggctataagctaacagaaatccactctcaaatggcgtcatccttaccgtccgttcactcggctaaggttatcgacggcaaagccatcgcccagacagtccgatctgaaatcgcagacgaagttcgtcaactctctgagcaacacggcaaggtgccgggactggcagtggtaatagttgggaacaggaaagattcgcagagctatgtgggcatgaagaggaaagcttgcgccgaagttgggattaagtccttcgatttggaccttcccgaagacgtttcccaaaccgaactcattgccaaggtccacgagctcaacgccaatccggatgtacacggaatactggttcagcttccattgcccaagcatataaatgaagagaaagtgttgagtgaaattagcatcgagaaggatgtagatggctttcacccgctcaacattggcaagcttgcaatgaaaggcagggatcctctattccttccttgtactcctaaggggtgccttgagcttctctcacgaagtggtataagtataaaaggtaagaaggctgttgtggtgggtcgaagtaacatagttgggttgcctgtttcgttacttcttttgaaggaagatgctacagtcaccattgttcattcacgtacttctgagccagagaaaatcgtttctgaagcggacattgttattgcagcagcaggacagccaatgatgatcaaaggcagttggattaaacctggtgctgcagtaatcgatgttggcacaaatgcggtggatgaccagagtagaaagtcagggtataggctagttggagatgtagatttccacgaggcatgcacggtagcaggatggattactcctgttccgggtggcgtaggcccaatgactgttgcaatgcttctcaagaacactttggaaggcgccaagagtgccatggcaaaataaagcttgtcttcccaaatcgtggcatggtcagatgtaagacgttccaaacccgatgaaaatgtcacattgtaatattatgtctcataatcaaatgttggaaattttcttttgctaataaaattt

SEQ ID NO: 1390 - DNA, 2342 bp, Cannabis sativa
ctcccatcaaattttggacaacacggagttgccaccatgtagaggccatgcttacgttgtttgccacgtcattctaatatctaatatcaaatagagtttttcagtcagcctacttttcagaaaatccactctcaaatggcttcatcctcaccgtccgttcactcagctactgttatcgacggcaaatccatcgcccagacagtccgatccgaaatcgccgttgaagttcgtcaactctctgagcagtatggcaaggtaccgggacttgcagtggtaatagttgggaacaggaaagattcgcagagctatgtgggcatgaagaggaaagcttgcgctgaagttgggattaagtccttagatttggaccttcccgaggacgtttctcaaaccgaactcattgctaaggtccacgaactcaacgccaatccggatgtacacggaattctggttcagctcccactgcccaagcatataaatgaagagaaagtgttgagtgaaattagcattgagaaggatgtagatggctttcacccgctcaacattggcaagcttgcaatgaaaggcagagatcctctatttcttccttgtactcctaagggatgcattgagcttctctcacgaagtggtataactataaaaggtaagagggcagttgtggtgggtcgaagtaacatagtcgggttgcctgtttctttacttcttttgaaggaagatgcaactgttactgttgtccattcacgtactcctgagccagagaaaatcatttgtgaagcagacattgttattgcagcagcaggacaggcaatgatgatcaaaggcagttggattaaacctggtgctgccgtaatcgatgttggcacaaatgctgtggatgaccagagtagaaagtcaggttacagattagtaggggatgtagatttcaaggaggcatgcaaggtagcaggatgcattactcctgttccgggtggcgtaggcccaatgactgttgcaatgctcctcaaaaacactttggaaggcgccaagagggctataccaccacaatagaagcttctgtgagctgtgactgtcttccccgattcggaccatgtgtccttttaagcaggttgacaattgctgttctacacaaattcatggattaatattcaactaactcgacgtttttttgtctatgttctgttgctgtgaaaaaaaatggctattatatcatcaacttttcatatttttgttttccttcttgcaatggaatctggtctgatctggggtaccaatactagtccttgctgcgaaccagtagaggccactgataatgataagattcagtttgctctgaacttagagttcatggaggcagagtttttccttcgaggagcgcttggtgaggggcttgatgccataaattcatctttggcagaaggtggtccgcccccaattggtgccaggaaagccaatctcgatccccttactcataggataatcgaagagtttggttatcaagaagttggtcatatcagggccattattaacacagtaggtggatttccaaggccactaatagatctcagccctcaaaatttcgcaaaattattcaataaagcagttggtttcactctgaaaccttcatttgatccttatgcaaactcacttaactatctcttggcatcttatgtaatcccttatgtggggctggtaggctatgttggcaccatcccaggtctcacctattatactactagacgtttggcagcttcacttttgggagtggaatctgggcaggatgcagtgataagaacattgttgtatgagagaggcaaagaagaggtgtatccatatggtataacagtggaaaagtttacaaactatatatcaactcttaggaacgagctagccatgtgtggcataaaagacgaaggactaagggtacctaagaagcttggcgcggagaataggactaccagcaacattctatcagccgatgcttattcactatcttatgcgcgaacaccgccggagatattgaggacagtttatggaaccggtaatgagtctcgtcccggcggattctaccctcatggtgccaatggaaacatagctaggagcttccttttcccagataaatattaggagaagaagataactgtatggaggtctattattatgaaaccatatcactaataaatgataataattaataatacaatatttttctacgtgaattaaatatataattgattagtgactttttataagagaaatgctaaaggacactattggtgcctagtaccctcctatgtgtcagtatcgctatttgtccaactaagtatcgagtcccacatagtttaata

SEQ ID NO: 1391 - DNA, 1722 bp, Eutrema parvulum
aggaagattagatactgaaagcatggcagtagctacacattgcttcacttcaccttgtcatgaccgtattcgattattctctggaatcacaagtgatgatggtaggcttctaagaaagaggatcaatggcacattcttggtcaagattttaccctcgtcccaaaacgttgatctaaggacaactgcgagatcctcacggcccttatctggattcaggtcaggactctctaagggagtatttgatattgtggcattgacatcaaggaatgcactgaaagagctgagcaccccgctgctgctaaagcttgtgggtgttttagcttgcgcattcctcatagttccatccgcagacgcagttgatgcactcaaaacttgtgcttgcttgctaaagggttgcaggatagaactcgcaaagtgcattgccaacccctcctgcgcagccaatgtcgcgtgcctccagacttgtaataaccgtcccgatgaaaccgagtgccagattaaatgtggggatctattcgagaacagtgtagttgatgagttcaacgagtgcgctgtgtcgaggaaaaagtgtgttcctagaaaatctgatctgggggaatttcctgcccctgacccttctgttcttgtcaagaacttcaacatcggggactttgacggcaagtggtacattacaagtggcttgaatacaacctttgatacctttgattgccagcgccatgagttccactcagaagatggcaagcttgttggaaatatctcgtggagaatcaagaccccagacagcggattctttactaggtcagctgtacaaaaattcgtgcaagatcctaaccaacctgctgttttctacaatcatgacaacgagtaccttcactatcaagacgactggtatatcttgtcatcgaagatagagaagaaacctgatgactatatttttgtgtactaccgtgggcgaaacgatgcttgggatggatatggaggtgcggttgtgtacacgagaagtgctgttttacccaatagcattgtaccagaacttgaaaatgcagcaaaaagcatagggagagacttcagcacatttgtgagaacggataacacctgtggtcctgaacctccgcttgtggaaagacttgagaagacggtggaagaaggggaaaagataatcgtaaaagattttgaagagatagaagaggaagtggagaaggaagtggagaaagtcggtaagactgagatgaccttgttccagagattggctgaaggatttaacgaattaaagcaagacgaggagaatttcctgagagggttaagtgaagaagagatggagttgttgaatgagctcaaaatggaagcaaatgaggttgaaaaattatttggaaaagctttgccgatcagaaagttcagatagaagaaccaccattgttgttgaaactatattatacatattgttgttcatataaggtaatatatttttgtaaaacatttcatcattccataacaattgaatacacaagaaaaaaaggattaagacatccttttagatctcaagaagaggtgaaactggtaatgatggggatgacaataataagaatgatcaaaagcagcacaatgataccaatgcacatccattttctgctgtttctttgatgcttctttgcggtcttcagctcgttagccccatccttcacgtaatggctcgcattcatcacatgatgctcgatctcatcc

SEQ ID NO: 1392 - DNA, 1714 bp, Eutrema halophilum
aaagcaaattccttacatccgtatatcgctcactccctctccctctgcttctcgcggagctttcaatcttcgaggaagattagaagatactcaagagcatggcagtagctacatattgtttcacttcaccttgccatgaccgtattcgatttttctctggagttacaagttttgatggtaggcttctaaggaagaggatcaatggcacattcttggtcaagattttacccccttcccaaaatgctgatctaagaacaacttcgagatcctcacgtcccttatctggattcaggtcaggaacctctaagggagtatttgatattgtggcattaacatcaaggaatgcactgaaagagctgagcactccaatggtgttaaagctagtgggtgttttagcgtgcgcattcctcatagttccatctgcagacgcagttgacgcactcaaaacttgtgcatgcttgctaaagggatgcaggatagaactcgcaaagtgcattgccaacccttcctgcgcagccaatgtcgcctgcctccagacctgtaataatcgtccagatgaaaccgagtgccagatcaaatgtggggatctattcgagaacaaagtagttgatgagttcaacgagtgtgctgtgtcgagaaaaaagtgtgttcctcaaaaatctgatctcggagaatttcctgtccctgacccttctgttcttgtcaagaacttcaacatcagtgactttaatggcaagtggtacattacaagtggcttgaatccaacctttgacacattcgactgccagcggcatgagttccacgcagatggtgacaagcttgttggaaacatctcctggagaataaagaccctagacagcggattctttacaaggtcagctgtacaaaaattcgtgcaagatcctaaccaacctgctattctctacaatcatgacaatgagtaccttcactatcaagatgactggtatatcctgtcatcaaaggtagagaataaaccagacgactacatttttgtgtactaccgtgggcgaaacgatgcttgggatggatatggtggtgcggttgtgtacacgagaagtgcagtattacccaatagcattgtaccagaacttgaaaaggcagcaaaaagcataggcagagacttcagcacattcgtgagaacggataacacctgtggtcctgaacctccgctggtggagagatttgagaagacagtggaagaaggagaaaagataatcgtaaaagaggttgaggagatagaagaggaagtggagaaggaagtggagaaagtcggtaagacagagatgaccttgttccagagattggctgaaggatttaacgaactaaaacaagacgaggagaatttcctaagaggattaagtgaagaagagatggagttgttgaatgagctcaaaatggaagcaagcgaggttgaaaaattgtttggaaaatctttgccgattaggaaggtcaggtaaacgaagaagaaccatcattgttatacatactgttgttcagttcatcacataagggaatatatatatatttgtaaaaacattcttcattcaataacagttggatacagaacacgaaaggattaagacatccttttatctcaagaagaggtgaaactggtaatgattgggatgacaacaataagaatgatcaagagcagcacaatgataccaatgcacatccattttctactgtttct

SEQ ID NO: 1393 - DNA, 1749 bp, Arabidopsis thaliana
aaaaaaaattgtgggtagaggaggaggaggaggctttgttcacacaccacacgacggaacattctcttccgagtcttatccaaagcaaaatcatattttgcttaaatatcttcttctccggctctgtctctgtctctcttcttcccgcggagctttcagtttttgtttggtattgcttggtgtggggaagattagatagtgtgaagaatggcagtagctacacattgtttcacttcaccttgtcatgaccgtattcgatttttctcaagtgatgatggtattggtaggcttggcattacaagaaagaggatcaatggcactttcttgctcaagattttacctccaatccaaagtgctgatctcagaacaactggtgggagatcctcacgtcctttatctgcattcaggtcaggattctctaaggggatatttgacattgtgccattaccatcaaagaatgagctgaaagagctgaccgctccgctgttgctaaaactcgtgggtgttttagcttgcgcgttccttattgttccatctgcagatgcagttgatgcacttaaaacttgtgcatgcttattgaagggatgcaggatagaactcgcaaagtgcattgccaaccctgcctgtgcagccaatgtcgcgtgccttcagacctgcaataaccgtccagatgaaaccgagtgccagattaaatgtggggatctgtttgagaacagtgttgttgatgagttcaacgagtgtgctgtgtcgagaaaaaagtgtgttcctagaaaatctgatctcggagaatttcctgccccagacccttctgttcttgtacagaacttcaacatctcggactttaacgggaagtggtacattacaagtggcttgaatccaacctttgatgccttcgactgccagctgcatgagttccacacagaaggtgacaacaagcttgttggaaacatctcttggagaataaagaccctagacagtggattctttactaggtcagccgtacaaaaattcgtgcaagatcctaaccaacctggtgttctctacaatcatgacaacgagtaccttcactatcaagatgactggtatatcctgtcatcaaagatagagaataaacctgaagactatatatttgtatactaccgtgggcgaaacgatgcttgggatggatatggtggtgcagttgtatacacgagaagttctgtattacccaatagcattataccagaactcgaaaaagcagcaaaaagcataggcagagacttcagcacattcattagaacggataacacatgtggtcctgaacctgcgctcgtggagagaattgagaagacagtggaagaaggtgaaaggataatcgtaaaagaggttgaagagatagaagaagaggtagagaaggaagtggagaaggtcggtaggactgagatgaccttgttccagagattggctgaaggatttaatgaactgaagcaagacgaggagaatttcgtgagagagttaagtaaagaagagatggagtttttggatgagatcaaaatggaagcaagtgaggttgaaaaattgtttgggaaagctttgccaatcaggaaggtcaggtagaaacaagaaccaccattgttgtacaaactatattatacatactgtgttcggttcatataaagtaatatttttgtacacagtcatcatcattccataacaattggatacagaaaacacaaggattaaacatcctttgagcgaaacaaacaacga

SEQ ID NO: 1394 - DNA, 1932 bp, Arabidopsis lyrata
gagatatttggagaaaacaagcgcctaggacaaaaatgtgggtagaggaggaggcggcttcgttcacacaccacacgacggaacactctcttccaagccttatccaaagcaaagcatatttttcttaaatatcttcttctccgtctctgtctctcttcttcccgcggagctttcaatctttgcttggtattggcttggggaagattagagagtaaagctaatggcagtagctacacattgtttcacttcaccttgtcatggccgtattcgattcttctcaagtgatgatggtaggcttggcattacaagaaagaggatcaatggcactttcttgctcaagattttacctccaatccaaaatgctggggggagatcctcacgccctatatctgcattcaggtcaggattctctaaggggatatttgacattgtggcattaccatcaaaaaacgaactcaaggagctgaccactccactcttgctaaaactcgtgggtgttttagcctgcgccttcctcattgttccatctgcagacgcagttgatgcacttaagacttgtgcatgcttattgaagggatgcaggatagaactcgcaaagtgcattgccaaccctgcctgcgcagccaatgtcgcgtgcctccagacttgtaataaccgtccagatgaaaccgagtgccagatcaaatgcggggatctttttgaaaacagtgtagttgatgagttcaacgagtgtgctgtgtcgagaaaaaagtgtgttcctagaaaatctgatctcggagaatttcctgccccagacccttctgttcttgtccagaacttcaacatctcggactttaacgggaagtggtacattacaagtggcttgaatccaacctttgatgccttcgactgccaggtgcatgagttccacacagaaggtgacaacaagcttgttggaaacatctcctggagaataaagaccctagacagtggattctttactaggtcagctgtacaaaaattcgtgcaagaccctaaccaacctggtgttctctacaatcatgacaacgagtacctccactatcaagatgactggtatatcctgtcttcaaagatagagaataaacctgacgactatatatttgtatactaccgtggacgaaacgatgcttgggatggatatggtggtgcagttgtatacacgagaagttctgtattacccaatagcattataccagaactagaaaaggcagcaaaaagcataggcagagacttcagtacattcattagaacagataacacatgtggtcctgaacctccactggtagaaagaattgagaagacagtagaagaaggggaaaggataatcgtaaaagaggttgaagagatagaagaggaagtagagaaggaagtggagaaagttggtaagactgagatgactttgttccagagattggctgaaggatttaacgaactgaagcaagacgaggagaatttcgtgagagagttcagtaaagaagagatggaatttttggatgagatcaaaatggaagcaagtgagattgaaaaattgtttggtaaagctttgccaattaggaaggtcaggtagaaccaagaaccaccattgttgtccagactatattatacatactgtgttcagttcatataaagtaatatttttgtacacattcatcattctataacaattggatacaaaacatcctttgagcgaaacaaaccacaattggtaaacactaaacatagtatctcaagaagaagagctgaaactagtatggttaacatagtatctcaagaagagctgaaactgtgatcaagaggattaagacaatttttgtaaaaagcattcatcatttcattaaaaatggatacaggaagacaaagggattaagacattttttcagcacacaaaaggattaagacatccaatgggcg

SEQ ID NO: 1395 - DNA, 1576 bp, Cajanus cajan
cttgttcagattcttccatccagaaatcattaaataaaaagagactccaactccaatccaagatcttcataattcacttgagagttgagttgagacacatgtgcatccaaccaaacacaaacacaaacagagacagagacagagacagagagtgataggaataggatgcacgccaagacagactccgaggtaacaagcctggcggcgtcgtcccccacgcgctcccctccgcggcggcctctctactacgtgcagagcccctccagggactcccacgacggcgagaagaccgccacgacgtcgtttcactccacgcccgttctcagccccgtgggttctcccccgcactctcgccactcctcctccacgcgcttctcctccaagaaggaccacactcacaacaccctcaagccctggaagcgaatcgacgtcatcgaagaagaaggccttctccaaggggatgatcgccgccactccctccctcgccgctgttactttctcgccttccttcttggctttctgcttctcttctccctcttctctcttatcctctggggggctagtagacccatgaaacccaagatctccatcaagagcataaagttcgatcacgtaagggtccaagctggttcggattcaacaggggtggccactgatatgatcacaatgaattccacgttgaaattcacataccgcaacacgggcacatttttcggggtccatgtcaccgccacacccgtggaactttcctactcagagatcgtaattgcttcgggaaacatgaagaagttttatcaatctaggaggagccaaaggttggtgagtgtggcagtgatgggtaacaagatccctctatatgggagtggtgctagcctaagtagcacaacgggtgtgcccacagtgcctgtgccattgaaccttaattttgtgctacgatctagggcttatgttcttgggaaattggtgaaaccaaagtactacaaaaccattcaatgttccatcactttggatcccaagaagctcaatgctcctatttccctcaagaaatcttgcacatatgattgattcatacatgggatagagaagaagtggaagaatgcacatggaatagaattatttgtaagaaaaaaataaataaagattattttatgattaatgggttcttttgaaaatggggatacagctcacagggcagtgacatggacgcgtttttgggactgtttggctgcctcaatttgcggaaagacaaagacatgttgggttcggtagagaaatgtgtcttgtgacaatttgtgagtcatcatttcatcaagactttatttatttagtactattattgtactaattatttatccgattttaatttattgattgtaaaagtgacaagtgatttgattcattcaatctcaatgttgtaattttatctttttcttatgtaattatggtgtaattatagagatataaatttcgcttattgatcgagtagtttcttgatcgtgagtttcatggtggagtcattagtggagagtgcatgttcaacgtatcatgaattgatttcttttatgatgcttttcaa

SEQ ID NO: 1396 - DNA, 1802 bp, Glycine max
aatacagttgcaaattgcagtgcagtcaaagacttatggatgacagaacacagagtcgttggttccattccatgccgctctacctttacaaaaaaaatacaacatgtgtcatattcaacttcaattatccagttgttcagattcttccttcccctgcataaatcatcatcattaaaaaaatcaaaaaacaccctccaactccaagaccttattcacacatgtgctagtggaaccaataaccaaaccccaacacacacataacacaaacaacacagatcaagtttctcattccctagacagatcccaacaacaacatagacaacacagagaatgcacgcaaagacagactcagaggtaacaagcctcgccgcgtcttcccccacgcgctcccctccacgccgtcctctctactatgttcagtctccctcacgagactctcacgacggcgagaaaaccgcaacgacgtcgtttcactcaacgcccgttctcagcccctctgcctctcctcctcactcgcgccactcctcctccacgcgcttctccaagaaagaccatagccacagcctcaagccgtggaagcaaatcgatgttattgaagaagaagggcttcttcaaggggatgatcaccataacgggcttccacgtcggtgctactttctcgcgttcgttgttgggtttttggttctcttctccttcttctcgcttatcctttggggggctagtaggcccatgaagcccaagatcaacatcaagagcataaagtttgatcatgttagggtccaagcaggttcggatgcaacaggggtagccaccgatatgattacattgaattccactttgaaattcgcataccgcaacacaggcacattttttggggtccatgtcacatccacacccgtggaactgtcctattcagacattgtaattgcttcgggaaatatgaagaagttttatcaatctaggaggagccaaaggttggtgagtgtagcagtgatgggtaacaagatccctctatatggaagtggtgctagcctaagtagcacaacgggtgtgcccactgtgcctgtgctattgaacctcaactttgtgctacgatctagggcttatgtgcttgggaaattggtgaagcctaaatactacaaaaccattcaatgttccataactttggatccaaaaaagctcaatgctgcgatttccctcaagaaatcttgcacatatgattgatacatgtgacggagagcaagtgggaattatttgaaaaataataataataataaaaatattgttttatgattaatgtgttcttttgatgtgaggaaagaaatggtacagccagagggcagtgtgccaaggacgcgtttttgggactgcttgggctgcccaaattgcctcaaattgcggtaagacaaagacatgcatgttgggttcggtagagaaatgtaatcttgtgattgatcatttcatgaagacatttttttgggttgattatttgtccgattttaatttattaattgtaaaagtgacaggtaatttgaattcattcaatctcagtgttgtaattgcatctttctccatgtaattatggtgtaattatagccatataaatttcgctttttgattgagttgtttctatctgttaggtaaggtccatggtgagagtgcatgttcaggatcaggtcaacgggtcatgaattgatttcattcactatgtttttcaaaattaacattattcttacgttaatttgtaggaaaaaaaaatggatgattttgcccaacaaatgtactagtagcttttaaaaggt

SEQ ID NO: 1397 - DNA, 1711 bp, Glycine max
cgctgtactttactaaaaaatacaacatgtgtcacattcaacctcaaatctccagttgtccagattctcccttccagtgcataaatcatcattaataatctcacttcattagttcattcagacacgcatgtgcaaccattagccaataaccaaaccccccaacacacatatcagaacacacagcacaacacagttcaagtttctcgtttccctaaacagatcctaacaacacaacacaaacacggagaaacaaaaatgcacgcaaagacagactcagaggtaacaagcctcgccgcgtcttcccccacgcgctcccctccacgccgtcctctttactacgttcagtctccctcgcgagattctcacgacggcgagaaaaccgcaacgacgtcgtttcactccacgcccgttctcagcccctctgcttcccctcctcactcgcgccactcctcttccacgcgcttctcgaagaaggaccatagccatagtcttaagccgtggaagcaaatcgatgttattgaagaagaagggcttcttcaaggggatgatcgccgcaacgggcttccacgtcggtgctactttcttgctttcgttgttgggtttttggttctcttctcgttcttctcgcttatcctttggggggctagtagacccatgaagcccaagatcaccatcaggagcataacgtttgatcatgtaagggtccaagctggttcggatgcaacaggggtagccaccgatatgatcacattgaattccactttgaaattcacataccgcaacacaggcacattttttggggtccatgtcacatccacacccgtggaactttcttattcagacattgtaattgctgcgggaaatttgaagaagttttatcaatctaggaggagccaaagattgctgagtgtatcagtgatgggtaacaagatccctctatatggaagtggtgctagcctaagtagcacaacgggtgtgccaacactgcctgtgccattgaacctcaactttgtgctacgatctagggcttatgtgcttgggaaattggtgaagcctaagtactacaaaaccattaaatgttccatcacattggatcccaaaaagctcaatgctgctatttccctcaagaaatcttgcacatatgattaatatgcatatgatggagaacaagtggaatgcacatgtaaaagaattatttgaagaaaaaaaattaataaaaatattattttatgattaatgtgttcttttgatgtgaggaaagaaatggtacagctcagagggaagtgtgacaaggacgcgtttttggaaatgttttgctgcccaagttgcctcaaattgcggaaagacaaagacatgcatgttgggttcggtagagaaatgtaatcttctgattgatcatttcatgaagactttttttgtgttgatttaattatttgtgcgattttaatttattaattgtaaaagtgacaggtaatttgaattcattcagtttcaaagttgtaattgcatctttctccatgtaattatggtgtaattatagccatataaatttcgctttttgtaatttagttccatggtgagggtgcatgttcaggatcaagtcaacgggtcgggtcaggaattgatttctttcactatgcttttcaaaattaacattattcttacgttaatttgtagaaaaaaattgaaaacaaaaatattaaacacaagt

SEQ ID NO: 1398 - DNA, 1357 bp, Lotus japonicus
ggacataggttacacataacataacaaagtcccaagtttctgtcattctacattctttcaaggacaggttccatcaaagaaggaaaaatgcatgccaagacagactcagaggtgaccagcatttctgcatcatcccctgcaagatccccacctcgccgtcctctctactttgttcagagcccctcaagggactctcacgacggcgagaaaaccgtcaccacttccttccactccactcctgttctcagccccaacgcttcccctcctcattcttcatcctccactcggttctctgctcctcaccgcaagaaagacaaccaccaccaccaccacagtctcaagccatggaagcagatcgatgtcattgaggaagaagggcttctccaaggggaagatcgtgacagaactctctctcgtcgctgctacttcctcatttttcttctgggatttcttctcctcttcacactgttttcgcttattctctggggtgctagcagacccatgaaacccaagatttttatcaagagcataaagtttgatcatgttcaagtccaagctggttcagattccactggggtggctactgatatgatctccatgaactctactttgaaattcacataccgtaacactggcacattctttggggttcatgttgcatctacacccttagaactgtcctattcagaaattgtgattgctgcagggaatatgaaggagttttatcaacatagaaggagtcacaggttggtgagtgtggcagtgatgggcaacaagatccctctgtatggaagtggtgctagcttgagcagcacaactggtatgccaactgtgccagtgccattgaacctgaactttgtgctgcgatccagagcttatgtcctagggaaattggtgaagcccaagtactacaagaggattcaatgttccatcaccttggatcccaagaagctcagtgctccaatccccctcaagcattcttgcacatataaatgattgatagtgttggagaattattggaaataataacacaagagaaattcattctatgattaattggttctcctgagatgcagaaagaacacagctcagagggcatgatgattgggactgtttggctgctcaagtgcctcaaactgctcaaagacaaaggcatgttgggttcgatagataaaatgtgatttgtgagtgatcattccaagaagttttttttaatcatttgtatgattttaatttaattaatgttaaagttgtaaaagtgagaagtaatttgaatttatttatttattcattcaatctcaattgacatctgtagactgaagttgcatttttatgtaattatagtgtaatcatagcc

SEQ ID NO: 1399 - DNA, 1706 bp, Cicer arietinum
attaatataacatttatttatcgataaattaattgtatttaaaaaatgagaaagaaatagtgattacctggttccataatgctgtcatttaacaaaaaggtcagtatcaaactcaaatctccagttgtacagattcttccactctccaaattttcattatttctatttttctatattacctaacaaaaacaaaaactcaacacataacaaataatcaaattccttaaactcactcctattatcataggtaacactttttaataatcttcattctttcattcataaaaacaataaaagaaaaacaaaacaagaacaaaaaaagatgcataggaaaacagattcagaaggaacaagcttagcaacatcatcaccaacaagatcaccaccacgaagaccaatctattatgttcaaagtccatcaagagattcacacgatgaaaaaactgtcacaaattcattccattcaacgcctgttcttagtcctgttgcttcacctcctcactcttcatcttccactaatttctcttctcaaacacgcaaaaagcatcatcatcaacatcatcataatcatagtcataagccatggaagcaaattgatgtgattgaagaagagggtcttcttgagagagaagatcggagtggctcttttcctcggagatgttactttcctgcttttgttgttgggtttctgcttttgttttcgttgttttcggttattctttggggtgctagtagacatatgaagcctaagattgttgtcaagagcataaagtttgatcatgttagggttcaagctggttcagattcaactggggtggccactgatatgatcacaatgaattctactttgaaattcacataccgcaacactggcactttctttggagtccatgtttcagctacacccttggaactgtcctattcagatataactattgcttcagggaatatgaaggagtttcatcaatctaggaagagtcaaaggttagtgagtgtgacagtgacaggtaacaagattcctttatatggaagtggtgctagtcttagcagcacaacaggcactcctacattgccagtgccattgaaccttaactttgtccttagatcaagagctaatgtgcttgggaaattggtgaagcccaaatactacaagaggattcaatgttccatcactttggatcctaagaaacttggtgctccaatttccctcaagaaatcttgcaaatattattgatgcatgtgaaagggacacaagtgtaaaagtattattggaaaaaaacaaatgattattatttgatttaatggattaagagattcttttaagatgtggatggaagtgatgggaatacagctcacaatgaaggatgattaggacatgtttttgggctttgaattatgcaatgacaaagacaaagaccatgttggtttctttagggaaatgtgagttgtgatgtgagttgtgatgtgagttctcattatatgaagacatttctttttttttttgtatgttgtattttaataatttgtcccattttgattaaattgatctaaaaatgagaagtaatatgaaattttattcaatgttaatgttgtaattgtattttttttaaataatggaagacactaaaggaacaagctcttttatgttagtgtagaaaggtaaactaataaatgaactatagatacattagtatatatttcaacaa

SEQ ID NO: 1400 - DNA, 1374 bp, Trigonella foenum-graecum
tcataaattatagttcatagaacaatgcatgcaaagacagattcagaggttacaacaacaagccaagcaacatcatcaccaacaagatcaccaccacgtcgaccactgtactatgttcaaagtccatcacacgacggtgaaaaaaccgtcactacttccttccattcaacacctgttcttactcctgttgcttcacctcatcactcttcttcttccactcatttctctgcttcaaagaaggagcaacaacacaaccataatcatggtgtgaagccgtggaagcagattgatgttattgaggaagaagggcttcttgatggggaagagaggaatggtggatattctaggagttgttattttcttgcttttgttgttgggttctttgttttgttcagtttgttttcgattattctttggggtgctagtagacctatgaagccaaagattgtgatcaagagcataaagtttgatcatgttactgtccaagctggttcggattcgactggagtggccactgatatgatcaccatgaactctactttgaaattcacataccgcaacacaggcactttctttggagtccatgtttcagctacaccattggaactgtcctattcagatatagtgattgcttcaggaaatatgaaggagtttcatcaatctaggaagagtcatagattggtgactgtggcagtgatgggtagcaaggttcctttgtacggaagtggtgctagccttagcagcacaacgggtatgcctacattgccagtgccattgaaccttaactttgtgatgagatcaagagctaatgtacttgggaaattggtgaagcccaaatactataagaagattcaatgttccatcactttggatcctaagaaacttggttctgtagcttccctcaagaattcttgcacatatgattgaatgaatattcatacatgtgaaaggaattcggattgactgcggtcggtaatcccccgcattcacgcagtccgtatatcagtggtcattggattgatatcagatgatctagaactaagtgcaaattttgatctttttccaaaactaaaatatcagtcataacatctgaattgtctgatttcaatccaacgactattgatgtggcaaaagtgtaaatgttggaaattgccgaccctataaaatctgaattccgtgtgaaaatgacacgagaaaagcacgtgtaaaagaattattagatgattttttttaggtgacaacttagttacccacattttatgagtgggtaaacaagaattctttttttttttattaatggaataataaatgtttttgggtatgtgggatggaaatgatgggggatacagctcagaatgcaggatgaatatgaca

SEQ ID NO: 1401 - DNA, 1033 bp, Cajanus cajan
gtatgcgtgtgaaacaaaagcgtcacgcaataaatcgaggccatccatccaagcaaaaattagaataatgaaaaagatgaatggagcaaaatgttgtgattgaaattgttggattatatatacacgcgtcatcgtatacgaagctttatgttactttgtccaaagttaaaagggttgtaaaatcctgagttagttcaacttcaaccccatttctttctccaagttcacacacatggcaaaggataggtgtattggtgtggctttggatttctccaagagtagcaagcatgctctcaaatgggcacttgagaacttagctgataaaggtgacaccatttatgtcattcacgttaaccccaactctctagacgagtctcgcaaccagttatgggcaaaatctggttctcctcttattcccttgcaagagttcagagagcctgagattatgaaaaaatatggtgttgagattgatattgaggttcttgatttgcttgacactgcttccagacaaaaagaggtgcacattgttacaaaaatatactggggggatgcaagagagaagcttttggatgctattgaagatctgaagctggattcgttggttatgggaagcagaggcctcagcacaatccaaaggatactattgggaagtgttagcaactttgtgatgacccatgctccttgccctgtgactatagtcaaggaacctagcagcagcaagtaaagatgatcaatttgggagagagcttttaaatttcatatgatcttttttcttgcattgtacttgatccagttgggtcatattccctttcctaagtattttggtgtcttctaagttatgagtatttgagttatatataagatttactgtaatctagctttcactcgacattattgaagggataatttaatttgagtggcgtataaggccattaggccttcaaaattttattgtagtaattgaatttctttgatttaaatggatcatatactctgcacaatccaattcatttaatgggtgtctacaaaataa

SEQ ID NO: 1402 - DNA, 896 bp, Vigna unguiculata
actactttgtacgaaatctaaacccttcgtcaacttctgtgttgttcttctacttctactctgttcgccaacttcagacacaaaccatggcaaaggacaggacaattggtgtggctttggatttctccaacagcagcaagaatgctctcaaatgggcgcttgagaacttagctgataagggtgacaccatttatgtcattcacatcagctccaattctatagacgagtctcgcaacaagctatgggaaaaatctggttctcctctgattccattgcaagagttcagagagcctgagattatgaaaaagtatggtgttcaccctgatattgaggttcttgatattcttgacactgcttcaagacagaaggaggtgcacattgttgcaaaaatttactggggggatgcgagagagaaacttctggatgcaattgaagatctgaagctggattcgctggttttgggaagcaggggccttagcacaatccaaaggatcattttgggaagtgtaagcaactttgtgatgactcatgcttcttgcccagtgactatcgtgaaggaacctagcagcagcaagtaaagataatcaattgggagagaacatttaagttttaagtttcatatgatattttccttgcagtgttcttgatctagcagagtcatatttcacttttcttaagtattatggtgtctgatgagaatgataataagaatgagtcatatgcgatacttgtgtattttagctcactctttgactttgaaggaataatttaatttgagtgccatactgtagtccttaaatttccgagatttatattaatgttgttgaaatcataatcctacgtaatttctatgttttgttgcataaactcttgatatgtatcgaagtttgcacggc

SEQ ID NO: 1403 - DNA, 873 bp, Glycine max
agattaccttgtccaaaaccaaaactttttgtcaattcatttcttgttgttagactctgcttctttctccaacttcacacacaaaaaaacatggcaaaggatagaacaattggtgtggctctagatttctccaaaagcagcaagaatgctctgaaatgggcatttgagaacttagccgataaaggtgacaccatttatgtcattcacatcaacccaaactctctagacgagtcccgcaacaagctatgggcaaaatctggttctcctcttattcctttggtagagttcagagagcctgagattatgaaaaagtatgatgttgaaattgatattgaggttcttgatatgcttgacactgcttcaagacaaaaagagatccacattgttacaaaaatatattggggggatgcaagagagaagcttttggatgctattgaagatctgaagctggattcgctggttatgggaagcaggggcctcagcacaatccaaaggatcatattgggaagtgtaagcaactttgtgatgacaaatgctccttgccctgtgactatcgtcaaggaaccacctagcagcagcaagtaaagatgatcactttgggagagaacatttaaatttcatatgatatttttcttggattgtacctgaactagttgggtcaattcccttacagttcgctcctttcctaagtattagtttggtgtctaagacgagaatttgaattatatataagatttactgtactttataactttcactgcttgactttattgatggaataatttaatttgagtgccatataaggtcatcagtcctccaaaattttcttgtaataattgaatttctgtgatttatattaattaatcttgtgga

SEQ ID NO: 1404 - DNA, 899 bp, Glycine max
acattactttgtccaaaactacaacctttgtcaatttctttcttgttcgactctgcttctttctccaacttcacacacacacacacacaaaaaaaacatggcaaaggatagaacaattggtgtggctctggatttctccaaaagcagcaagaatgctctgaaatgggcacttgagaacttagccgataaaggtgacaccatttatgtcattcacattaactccaactctctagacgagtcccgcaacaagctatgggcagaatctggttctcctcttattcctttggtagagttcagagagcctgagattatgaaaaagtatgatgttcaaattgatattgaggttcttgatttgcttgacactgcttcaagacaaaaagagatccacattgttacaaaaatatactggggggatgcaagagagaaacttttggatgctattgaagatttgaagctggattcgctggttatgggaagcaggggcctcagcacaatccaaaggattatattgggaagtgtaagcaactttgtgatgacccatgcctcttgccctgtgactatcgtcaaggaaactagcaaggaaactagcagcagcaagtaaagatgatcaatttgggagagaacatttaaatttcacatattattttttttcttgcattgtacctgatctagttgggccatattccctttcctaagtattattttggtgtctaagataaatttatgatttactgtactttatagttttcactcctttttattgaggcaataatttaatttgagtgccatatataaggccatcaggcctccaaaattttattgtagtcaatgaatttctgtgatttatgttatgttgacaattaacatctcaaattagtcgtaaaatcccaagtaatttc

SEQ ID NO: 1405 - DNA, 1010 bp, Lotus japonicus
ggaaccttagattacttgaagagctagctttcccccttgtcaagtatatttggtgttggacagatctgcattctctgcctttaggaacaaaattaacatggcaaaggataggaccattggtgtggctttggacttctccaagagcagcaaaaacgctctgaaatgggcacttgagaacttggctgataaaggtgacaacatttacatcattcacatcaaccccaactctctagatgaatctcgtaacaagctttggggcaaatctggttctcccctgattcctttgaaagagttcagagagcctgaggttatgaccaagtatgatgttcaaattgatattgaggttcttgatttgcttgacactgcttccaggcagaaagaggtgaacattgttacaaaaatatactggggtgatgcaagagagcaacttctggatgctgttgaagatctgaagcttgattctctggttatgggaagcaggggtctcagcacaattcaaaggataatattgggaagtgtgagcaattttgtgatgacccatgccccttgccctgtgactatagtcaaggattcaagcagcagcaacaagtgaagggaaattgatcaatttggattgggagtgggagggcattaaaatttcgaattcctgctttgtactttgagctctagtgggacatccatcatctgtttccttattattttggtttcaaagttgagaatttgtgattacttatgattgaggcccggttttgggtttcaagttcaacccttgactttaacgaaggaataatgtaatttcagtgccatattaggccaaataccctccaaattttaattttattatattctggataaatttttttttctaccaatcaattctgaaatttacaataatttttatattaagatacataattcttggagtactgattcttttttttttgcactccatatttttttttaatctcattttcactaatattttattcttatttctcttttgtattcat

SEQ ID NO: 1406 - DNA, 789 bp, Cyamopsis tetragonoloba
cacgaggctgtcttctccacaaaattcacaaacacagagaattgattgaaaagaaaaagaaatcaaagatgggaaaagatagaagcattggtgtggctttggatttctcaaagagcagcaaaaatgctctgaaatgggcacttgagaatttagctgataaaggtgacaccatttacatcatccacatcaatcacaattctcttgatgaatctcgcaatcagctttgggaaaaatctggttctccacttattcctttgacagagttcagagagccagaggttatgaagaagtattgtgttcaaactgatattgaagttcttgatttgcttgacactttctcaagacaaaaagaggtgaacattgtgacaaaaatatactggggtgatgcaagagagaagcttttggatgctattgaagatctgaagctggattctctggttatgggaagcaggggtctcagcacaatccaaaggataatattgggaagtgtaagcaactttgtgatgacccatgcaccttgccctgttactattgtcaaggattctagcttcaccaccaagtaaattacagatgatgcatcaatttcttggcagaacatttgagcattaatttaatttggttggtcatattctgtttactccatatatttatgtattttgggttcaaatttgagaatttaatttggattatattatgataatatatcctttgaactttcaatccttgacttctttattgaaggaataatgtaatttgagtgccatattaggccaacatggtctccaatat

SEQ ID NO: 1407 - DNA, 558 bp, Acacia harpophylla
ggccaaaggtatttctggattctcttccgttcttataacaacgcacaatctctctcacacacagacgcagagaaacaaaggaagacgacgatggtaaaggatcggaaaatcggtgtcgctctcgacttctccaaaagcagcaagaacgctctcaaatgggctctggacaatttggccgacaagggagacatcatttacatcatccacatcaatcccaacactctcgatgagtcccgtaaccagctttgggctcaatccggttctcctcttattcctttggctgagttcagagagccagagattatgaagaagtatgatgttcagacggatatcgaggttcttgatttgctcgacactggtgccaggcagaaagaggtgaacattgtgacgaaaatatactggggggatgcgagggagaaacttctggatgccatagaagacctgaagctggattctctggtaatgggaagcagaggccttagcactatcagaaggataatattgggaagtgtgagcaactttgtgatgactcatgctccttgcccagtgaccatcgtg

SEQ ID NO: 1408 - DNA, 880 bp, Arachis hypogaea
gccatcttatgctatctgcgacacaaatctacttctctcttgaagctatcttaggtttagaatctcatgttttaccaagttccactcatcctttgaagctgtttgttatttgttcaactttgtttgtacacaagttgagaacctaagaaagatatcatcatggtgaaagataggaaaattggtgtggctatggacttttccaatagcagcaagaatgctctaagttgggcacttgagaatttggctgataaaggtgacaccttttatataatccacattaaccctaatgatcttgatgaatctcgcaccaagctttgggccaaatctggttctcctcttattcctttgaaagagtttagagagccagaggttatgaaaaagtatggtgtccaaattgatattgaggttcttgatttgcttgacactgcttccagacaaaaagaggtgaacattgttacaaagttgtactatggtgatgccagagagaaacttttggatgctgttgaagatctgaagctggattctattgttatgggaagcaggggtctcagcacaatcaaaaggatcatattgggaagtgtcagcaactttgtagcaacccatgctccttgccctgtaacaattgtcaaggaatctaacagcaccagcaagtgaagatgacccagatttgaaggaacatggcacttatttatttatatttataatgatctgtttcttgcattgttcttgagctctattctattggatcatcatattctgtttttcaagtgttttttgttttcaaaggtaagggttgagattataaaatgacatgatggtatattgttttaagtttcaatccttgactatatcgaaggaaataaggtaatttgtgtgccaa

SEQ ID NO: 1409 - DNA, 806 bp, Trigonella foenum-graecum
cttcttcatcttattcttctctcaactcaatttttcctcattcacaaacaaaaatgccaaaagatagaactattggtgtggctttggatttctccaagagcagcaagaatgctctcaaatgggctcttgagaatttagctgataaaggtgacaacatttacatcatccacatcagccatgattctcttgaggaaggtcgtaatcagttatgggccaaagatggttctcctcttattcctttgaaagagttcagagaacctgagataatgaagaagtatggtgttcagattgatattgaggttcttgatttgcttgacaccttttcaagacaaaaagaggtgaatattgttacaaaagtgtactggggtgatgcaagagagaaacttatagatgctgttgaagatctgaagctggattctcttgttatgggtagcaggggtctcagcacaattcaaaggatactattgggaagtgtaagcaactttgtgatgaccaatgcttcttgccctgtgactattgtcaaggataatagcagcagcagcaagtaaagatgatcaatttgtgatagcattttaatttggaatgatatctgtttcttgcattgtacttgagatctagtttgtcaacttctgtttcttcatttcagattataaattatgactatctggttaactttattgaaggaataataataataataatgtaatttgagagtcataagtcatgatagcactccaaaatttattacttgattatccaatttattggtttcacatgctctgtacaaccagacacataaattgtta

SEQ ID NO: 1410 - DNA, 718 bp, Pisum sativum
aaaaatgccgaaagatagaactattggtgtagctttggatttctccaaaagcagcaagaatgctctcaaatgggctcttgaaaatttagctgataacggtgacaacattacatcatccacatcagccaagattccgttgatgatctcgcaatcagctatggtccaaatctggttctcctttgattcctttgaaagagttcagagacctgagatcatgaacaagtatggtgttcagattgatattgaggttcttgatttgcttgacactttttcaagacaaaaagaggtgaatgttgttacaaaagtgtattggggtgatgcaagagagaaacttttggatgctgttgaagatctgaagctggattctcttgttatgggaagcaggggtctcagcacaattcaaaggatcttattgggaagtgtaagcaactttgtgatggctaatgctccttgccctgtgactattgtcaaggacaatatcagcaccagcagcaagtaaagacgatgatcaatttgcgatggcatttaagtatggaatattctgtttcttgcattgaacttgaactcttgttgataatcttctgtttccttatttcggatttatattatgttatgactatatctatctggtttactttattgaaagaataataatgtagttttagttttatcatcatccatatattgctatccatattgtgccgaaaaaaaaaaaaaa

SEQ ID NO: 1411 - DNA, 770 bp, Trifolium pratense
aattttatatatacaaaggtctgtttttattttcttcttcttgtttcttctttcaactcaacttctcctcattcacaaaaatggtaaaagatagaactattggtgtagctttggatttctccaagagcagcaagaatgctctcaaatgggcacttgataatttggctgataaaggtgacaacatttacatcatacacatcagccatgattctcctgatgaatctcgtaatcagctttgggctcaatctggttctcctctaattccattgaaagagttcagagaacctgagataatgaaaaagtatggtgttcaaattgatattgaggttcttgatttgcttgacactgtttccagacaaaaagaggtgaatattgttacaaaagtgtactggggtgatgcaagagagaaacttttggatgctgttgaagatcttaagcttgattctcttgttatgggaagcaggggtctcagcacaattcaaaggatactattggggagtgtaagcaactttgtgatgactaatgctccttgccctgtgactattgtcaaggataatagcagcagcagcagcaagtaaagaactaaagatatgatgaatttgtgcttgcatttaaatttgggatgatctgtttcttgcattttatatattatatatgagcaataaggcataggattagtgctactagatgtccctctgatatctactagttactctgatgtcttaatgctcttaatagttaaaaaataatttgtttcctgcactgtactt

SEQ ID NO: 1412 - DNA, 771 bp, Medicago truncatula
tcttcttcttttcccaactcaatctctcatcattcacaaacaaaaatggcaaaagatagaactattggcgtggctttggatttctccaagagcagcaagaatgctctgaaatgggcacttgagaatttagctgataaaggtgacaacatttacatcattcacatcagccatgattctcttgatgaagctcgtaatcagttatgggccaaagatggttctcctcttattccgctgaaagagttcagagaaccagagataatgaagaagtatggtgttcagattgatattgaggttcttgatttgcttgacactttttcaagacaaaaagaggtgaatgttgttacaaaagtgtactggggtgatgcaagagagaaacttatggatgctgttgaagatctgaagttggattctcttgttatgggtagcaggggtctcagcacaattcaaaggatattactgggaagtgtaagcaactttgtgatgaccaatgctccttgccctgtgactattgtgaaggataattgcagcagcagcagcaagtaaagatgaatagcatttaaatttggaatgatatctgtttcttgcattgtatttgagctctagtttgtcaaacttctgtttcttcatttgagattataaattatgactattttggttaactttattgaagaaataaataatgatgtaatttgagagcattatagtactccaaaatttattagtttcacatgctctgtacaaccagacacataaatttttattcatattgtg

SEQ ID NO: 1413 - DNA, 787 bp, Vicia sativa
tcttcttcttcttctctcaactaacattctcattcattcacaaaaatgccgaaagatagaaccatcggtatagctttggatttctccaaaagcagcaagaatgctctaaaatgggcacttgaaaatttagctgacaaaggtgacaacatttacatcatccacatcagccaagagaatctcgatgagtctcgcaaccagctctgggccaactccggttctcctttgattcctttgaaagagttcagagaacctgagatcatgaaaaagtatggtgttcaaattgatattgaggttcttgatttgcttgacactttttcaagacaaaaagaggtgaatattgtttcaaaagtatattggggtgatgcaagagagaaacttcttgatgctgttgaagatctgaagctggattctcttgttatgggaagcaggggtctcagcacaattcaaaggatcataatgggaagtgtaagcaactttgtgatgactaatgctccttgccctgtgactattgtcaaggataatatccgcaccagcagcaagtaaagatgaacaatttgtgatggcatttaaatatggaatgttgtgtttcttcttgcattgtacttgatctcttgtagatcatcttctgtttccgtatttcagattatacattatgttatgacttatatctatctgctttacttcattgaaagcataataatgtagttttagttttatcatccataaattgttatccatattgtgccataagttatattacaggtttatgcctaaacagaagcacaaa

SEQ ID NO: 1414 - DNA, 941 bp, Cicer arietinum
caatcaacctctgtccctctctctccccacacccaatgcgtcttacattttatgcaatatatatatatatatatatacattgtgaatgacctttaaacccttgtcaaagttatttgttcttctctaaactcaaaattcaactcaatctctcttcattcacaaagatgggaaaagatagaataattggtgtggctttggatttctccaacagcagcaagaacgctctaaaatgggcacttgagaatttagctgaaaaaggtgacaacatttacatcattcacataagccatgattctcttgatgagtctcgtaatcagatatgggccaaatctggttctcctcttattccgttgaaagagttcagagaacctgagataatgaagaagtatggtgttcaaattgatattgaggttcttgatttgcttgacactgtttcaagacaaaaagaggtgaatattgttgcaaaagtatattggggggatgcaagagagaaacttttggatgctattgatgatctgaaactggattctctggttatgggaagcaggggtctcagcacaattcaaaggatattattgggaagtgtaagcaactttgtgatgactcatgctccttgccccgtgactattgtcaaggatctgagcagcaccagcagcaagtgatagttatcaatttgagagtgcatttaaatttgaaatcatctgtttattgtattgaggtacttgaaattatgctatattattatgatcactttctggtttattttattgaagaaataatgaatttatgtaattcacacttattttaggactctataatttaattactcatccaatttattgattttcacatgatctatacaactagacccatactcgattcgtgtcataaccaaatgattttttaatacaaattctgacatcaaataattttagtttttt

SEQ ID NO: 1415 - DNA, 934 bp, Castanea mollissima
gcgtgtctcaggaaagaagcaagagtgaaagaaaacaatgggaaaggataggaaaataggtgtggcaatggatttctcaaagagcagcaagaacgctctaaaatgggctatagataatttggcagacaaaggtgacacccttttcatcatccacaacaatcccaacagtctcgatgagtctcgcggccagctttgggctcagtctggctctcctcttattcctttgtctgagttcagagaacccgaggttatgaagaagtacaatgttcagactgatattgaagttcttgatacgcttgacactgcttcgagacagaaagaggtgaacattgttacgaaattgtactggggagatgcaagggagaagcttctacaagctgttgaagatctgaagctggactctctagtaatgggaagcaggggacttggtactatccaaaggattattctggggagtgtgagcaactatgtgataacacatgcttcttgccctgtgactgtagtcaaggattcaagcgttggccagcactgatttggatttggattttgagtgatctattctattacggatcaatagcatgagcaatgttacattttatgttttcctgaattttagatactttcctctttggactgttattgaaaaccaaatggatggatatgtattcaccttatcatcaattacgaagaataatcttacttggtcgtagtacatatgagagaacggatgagcactacgccgtagtaattgaataatttttctttctagaatctagatatttgttcttggaattgaaagttaaacatatgccacaagagtcaagaaacggatgggttcagaagtctcttggtttatggattaaattctttgctgatcttggttagtagtctttcttttatgggttaaattctttgccggtctttgtcaaccaaa

SEQ ID NO: 1416 - DNA, 843 bp, Castanea mollissima
tgacaacaaaaccagacaataaccactgtctccgctttagattcttggctttggctttttcatcttttgtaacgctcacacacaccaaacgcgttattctttttcttctgatttcaaaagagagaagaagaagaaaggaaaagaaagaagcaagagtgaaagaaaacaatgggaaaggataggaaaataggtgtggcaatggatttctcaaagagcagcaagaacgctctaaaatgggctatagataatttggcagacaaaggtgacacccttttcatcatccacaacaatcccaacagtctcgatgagtctcgcggccagctttgggctcagtctggctctcctcttattcctttgtctgagttcagagaacccgaggttatgaagaagtacaatgttcagactgatattgaagttcttgatacgcttgacactgcttcgagacagaaagaggtgaacattgttacgaaattgtactggggagatgcaagggagaagcttctacaagctgttgaagatctgaagctggactctctagtaatgggaagcaggggacttggtactatccaaaggattattctggggagtgtgagcaactatgtgataacacatgcttcttgccctgtgactgtagtcaaggattcaagcgttggccagcactgatttggatttggattttgagtgatctattttattacggatcaatagcatgagcaatgttacattttatgttttcctgaattttagatactttcctctttggactgttattgaaaaccaaatggatggatatgtattcaccttatcatcaattacgaagaataatcttacttggtcgtagta

SEQ ID NO: 1417 - DNA, 851 bp, Prunus persica
ctgctgcttaatccataagcttctcaaaccatcctctttctctgcttttctgtcttttgaactttcacacgccacaactgtgtcatcttgtccgatcagaataacccaagtggtgcaggagagagagagagagagagaaacatcagaatgggaaaggataggaagattggcgttgccatggacttctcaaagagcagcaagaacgcgctggaatgggctgtggacaatttgcttgacaagggtgacaccctttacatcatccacatcaaccccaactcgctcgacgagtctcgtacccaactctgggcccaatctggttctcctctgattccattgacagagttcagagagcccgagatcatgaagaagtatgatgtgcgaactgatattgaagttcttgatacacttgacactgcttccaggcagaaagaggtgaacattgtgacaaaactgtactggggagatgcaagggagaagcttcttcaagcgattgaagatctgaagctggactctttggtcatgggaagcagaggccttggtaccatcaaaaggatcctgctggggagtgtgagcaactatgtgctgacaaatgctccaatccctgtgaccattgtcaaggacccaagcttgcaacaccattgaatcatggacagttggaaactttggatttggtttttcaataatgtttcatcaccttggacatgggcattgcttgatgatttttatgttttacttgatcgtggtttactagaacatttcaagttatgatgtcgaacggatggaaatgtactctgttttgaatagcaatgaatttggttgggctccattggttccggctgtgtgtgtattaa

SEQ ID NO: 1418 - DNA, 953 bp, Arachis hypogaea
tgggattttggggtttggcacacccatttcagttatcacttatcactgtcgccagtatcatcaccctcattcctcatacatatattcaactattcatcaatcttaattcaagtcctgtgtttgtttttttctcattagatacaactctgtgttctccgatcatcagtgaaaaccatgggaaaggacaggaaagtgggagtagcaatggacttctcaaagagcagcaagaatgctctgaaatgggcacttgacaacttggctgataaaggtgacactttctatatcatccacatcaaccctaattctcctgatgaatctcgtaaccagctttggctcaaagatggttctcctctgattcctttgacggagtttagagagcaagagattatgaacaagtatgcagttcaaactgatattgaggttcttgatttgcttgacactgctgcaagacaaaaggaggtgaacattgttgcaaaaatttattggggtgacgcaagagagaaacttctggattctattgaagatctgaaactggactcaattgtactgggaagcaggggacttagcacaatccaaaggataatattgggaagtgttagcaactttgtgatgacacatgccccatgccctgttaccattgtcaaggattcaagcaccaccaagtagtgtatacatatgatgatcaatttgttgggagagcatttcagtaatctttatctttatctagctttatatgactatatactatactctttctatatttatgttctttgtattgtggcttcagtgttgagaattgagaataaggtattattttatattttccatattatcaaaagtataatgtaatttgaggagacatattagggattatatgtctttggattctcatttgtgacgggagttatggcgagattgtgactttttgtcgtttggttgtaaaaaaaaaaaaa

SEQ ID NO: 1419 - DNA, 1057 bp, Quercus alba
tagtatcagccccgggagacccacaatcaagtagactcgcgtcgcgtgcaaacgtggatggccctgattcagttatacgtatcaacaatggagcgtacaagtattcttttcaagaacccattttttgctgaattttcaagaacccatttggtacgcagtaacttgtcttctatataaagattggcctttacaacctgcttaaccattaagcattaaaaaaaccaatccctgtaaacaaagcagacaaaaaccattgtctccgctttagattcttggctttggctttttatcttttgtaacgctcacacaccaaacgcgttattctttttcttctgattacaaaagagggaagaagaagaaaggaaaagaaagaagcaagagtgaaaaaaaacaatgggaaaggataggaaaataggcgtggcaatggatttctcaaagagcagcaagaacgctctaaaatgggctatagataatttggcagacaaaggtgacacccttttcatcatccacaacaatcccaaccgtctcgacgagtctcgcggcgagctttgggctcaatctggctctcctcttattcctttgtctgagtttagagaacccgaggttatgaagaagtacgatgttcagactgatattgaagttcttgatacgcttgacactgcttcgagacagaaagaggtgaacattgttacgaaattgtactggggagatgcaagggagaagcttctacaggctgttgaagatctgaagctggactctctagtaatgggaagcaggggacttggtactatacaaaggattattctggggagtgtgagcaactatgtgataacacatgcttcttgccctgtgactgtagtcaaggattcaagcgttggccagcactgattttactgatttggatttggattttgagttacgtatggtatcaatagcatgagcaatgttacattttatgttttcctgaatttaagataacttttctcttgggactattattgaaaaccaaatagatggatatgtattccccttatcatcaaatatgaagaataattta

SEQ ID NO: 1420 - DNA, 1095 bp, Prunus mume
gtaaaaaacgcatacaagccaccattttccctgcagctataattcgtcatcttctttatattccgccgctgcttaatccataagcttctcaaaccatcctctttctatgcttttctgtcttttgattgttcacacgccacaactgtgtcttcttgtccgatcaaaataaccaaactggtgcagaacagagagtgagagacatcagaatgggaaatgataggaagattggcgttgccatggacttctcaaagagcagcaagaacgcgctggaatgggctgtggacaatttgcttgacaaaggtgacaccctttacatcatccacatcaaccccaactccctcgacgagtctcgtacccaactctgggcccaatctggttctcctctgattccattgacggagttcagagagcccgagatcatgaagaagtatgatgtgcaaactgatattgaagttcttgatacacttgacactgcttccaggcagaaagaggcgaacattgtgacaaaactgtactggggagatgcaagggagaagcttcttcaggcgattgaagatctgaagctggactctttggtcatgggaagcagaggccttggtaccatcaaaaggatcctgctggggagtgtgagcaactatgtgctgacaaatgctccaatccctgtgaccattgtcaaggacccaagcttgcaacaccattgaatcatggacggttggaaactttggatttggtttttcaataatgtttcatcacctttggcatgggcattgcttaatttttatgttttacttgatcgtggtttactagaacatttcaagttatgatgtctaaacggatggaaatgtactctgatttgaatagcaatgaatttgtgtgtattaatttggtttgtctcattgccttcacgcgcattcatgaaattattgaatttcttgacaagaaacaggtcatgctcagtattataagagcatttacaatgggcattctaaaccatctcctttgatattagggacgaattggaaaaatacaatttcaactaggggcggagccacactgggatcagtgtggtcctgggcctccactcaagtttttata

SEQ ID NO: 1421 - DNA, 767 bp, Arachis hypogaea
aaaattcgccatcttatgctatctgcgacacaaatctacttctctcttgaagctatcttaggtttagaatctcatgttttaccaagttccactcatcctttgaagctgtttgttatttgttcaactttgtttgtacacaagttgagaacctaagaaagatatcatcatggtgaaagataggaaattggtgtggctatggacttttccaatagcagcaagaatgctctaagttgggcacttgagaatttggctgataaaggtgacaccttttatataatccacattaaccctaatgatcttgatgaatctcgcaccaagctttgggccaaatctggttctcctcttattcctttgaaagagtttagagagccagaggttatgaaaaagtatggtgtccaaattgatattgaggttcttgatttgcttgacactgcttccagacaaaaagaggtgaacattgttacaaagttgtactatggtgatgccagagagaaacttttggatgctgttgaagatctgaagctggattctattgttatgggaagcaggggtctcagcacaatcaaaaggatcatattgggaagtgtcagcaactttgtagcaacccatgctccttgccctgtaacaattgtcagaatctaacagcaccagcaagtgaagatgacccagatttgaaggaacatggcacttatttatttatatttataatgatctgtttcttgcattgttcttgagctctattctattggatcatcatattctgtttt

SEQ ID NO: 1422 - DNA, 3407 bp, Theobroma cacao
gaatctttgctagtttgagcaaagatcaatcacaaaacttcatgtcttaaaacaacaattctatcagaattaactttttacagtcccttatctagcctgctggccctcaacaatccaagcaatttactgcagcagcacagtttgaacaaattttcaacgtccatgggcttttccatcgttagtttccttattggaatttgatttattaagcaaggaaagtgaacccttttttccttcagaattcccactgcaaccccacttgcaattcttttacgggcctgagttacagggtcatactcaaacactattggtgtacagataagaggaatatttctattcatatcttgatcacatggaaatcacagaggcaaccgttgaattcttgcgtgcaaaaatattcaacgtaaataactaagaaaaagaatatcttcacgccatcttccaatggacgccaagcaagcttactgtcatcataccatccatcacaaagcttgatttacactttgacggcccagattaaacctttctccttccccttctctctttttgtctttctatataaggccttgcggctgcgacctcctcattcttgaaaccgtcattcagctttacagaacctttattttttttggcttctatcatcaacgtgcagacaggaaacttgttgactcttcttgcgaagaaagaaaatggcgaaagataggaagattggggtggctatggacttctcaccgagcagcaagaacgctctacaatgggctgtagataacttggctgacaagggagacaccctttatatcatccacatcaacgccaactctctcgatgagtctcataacgctctctgggctaaatccggttctcctcttattcctttgacagagtttagagagcctgagattatgaagaagtacgatgttaaacctgatattgaagttcttgacatgcttgacactgcttcaagacaaaaagagatacacattgtaacgaaactgtactggggaggagatgctagggaaaaaattcttgatgctgttgagggtctgaaacttgactctttggtcatgggaagcagaggacttggaaccgttcaaaggatcatcttggggagtgtgagcaactacgttatgacacatgcttcttgccctgttaccatcgttaaggaatcaagctccatgaagcactgacatgcttgacactgcttcaagacaaaaagagatacacattgtaacgaaactgtactggggagaagatgctagggaaaaaattcttgatgctattgaggatctgaaacttgactctttggttatgggaagcagaggacttggaactgttcaaaggatcatcttggggagtgtgagcaactacgttatgacacatgctccttgccctgttaccatcgttaacagcaattttcacaacaaattggcatcagagcttcgggttcgtttcacacagtggcagagaatgatgaaagatctccttgtgcagataggtttaatgcgccccttgctaggaaaagaggaagggcaaccaaatgacatgaaggatgttgaatgggcagagttggagcaaaggtgtgtaaagttagagaaaatttacttggcgaaaagtctttctaacaagttgcagcttaggcgaaagttgtatcgcttaaagatggaggagaatggagacctcatgaagcatatgaatgaattcaatggaatcattgatcagttgaagaaggttgatgtcaagggattgtcctacaaaagggatgaaagtaacgagaacaaaggtgagtgtactttcgttgctgaaggtgataattgtgatgtccttacaatttcagaaaatatggatgcaaattctgattggtatttagattttgcttctgctactcacatatgttatcaaaaaaattgttttgatttacttcaagaaggggtgactgggaatttgactttgggtaataagtcaatagtgaaggtcatgggtcttgtagtggtgaaaatcaaaatgtttgatggggttgtgcgctctttgggtggtgtggcctatgtcccaaagatgcataagaatctaatatcattgagcttgttagactctaaagggtatggatattctgcttgtgatggagtagtaaaagtcacacaaggcgacatggtcctgatgagggggaatttgcataatggcttgtatcatctagaatgtgaggcctcgaaaggatgggaacagtgcacaggagatggtagctaccaaagtgagatttcattggctgaggaggtgatgaaagattctcatggtgtagatgatggtgaaaggacgaaaaatcttaccaatagtgaattggaagggtcgttgaggtccctttccgaagtcaattagtgccattgacttgacggctacacagctgcattggccgttttgtggaatcaagtgttggaccatgcttgattcgatatgtgtagttgtggtaattataaaggccaatgatttaaaaagtcttatgcttagagagttgttcaaggtgttggaaagtaggtggagttaggaagttgcaattagttgcgattagtggaagaggtttaaggagtttgaattcaagtcaaaggtggagatttgttgagttttaggttgactagaattctagatcttatttgattaggatttttgtttgtatacaatattaagtagttgtatggttttaaacttcttattccatatcgaatcctaatcacattatactttgtacttttatactataaaagtggatttttaggctttagaatacaagtagtactttgagagctctagagagggaacatcttgtaactctatcttttgctctagttggagcgagagtggtttgagtgagtgttcttgggaggttattgaggaagagtgtgcaagggatcttgggttattttgagaatcataaaggtcaatttattgtactttaaattctcaataatagaagaacagtttcactccgtggacgtagggaagaggtcgaaccatgtaaattcttgtgtttttctatttacttaatttctctgaattttatctttgttgattcttgagcaattttcacaacattaatgaatcaagctctatgaagcactgataagttcatatatttcgtctttcatttacaaaaaattatctgatgaacggctgttccttccgagtgtatgctttgaatcggctcgatgtgctgttcctgtctggttgatcatgttttctaagtagcttaaggagttaaaaggttgtgttaccaaattcttaaagtgcggtactttgtcgtttaatttattcctttggtattgattttgttaccctacaactgaaatcatagcccttcatggtgccgaaaagcgagtcaagacatggaatttaataacaaaagcttttgtctttgtcca

SEQ ID NO: 1423 - DNA, 962 bp, Cajanus cajan
acgtagctgaaactgaaaaagatgaaaaattgaaggaggtggtgacggtgtttgatggagcaaacggtatggtgtcatttaccggtgctgctaagggcaaattcaaaagaatccattgaatgcattcttcaaaccctttggagaacccgaaaaactggtcttaccacttctgaccgatgcatcatccacgaaatgctccacctccaaaacgaatccgatctcgatccacttctggtttgcctccgaatgttaatcaggaggtgtgtttatgagaacaccagcaaggaggatattccgaagttgtttcccacggaagttctgcctgaattgcagaaacttttgacacttttgttgcacaagtttcagccagagtggcaacaagatgtgctcaaagatcagaatattgtgcctcggttgaaggcaatgacatggaatatggcaaatgtggataaagaatcagcagaccctgcagctgtaattaatttgaagcttcaaaatgatgctcaatttcactcaggagagcaagatgtgaagttccagttggctactgattctctagataatatgctgaaagccatgcactgtattagagaccagttttctaccatggatgaggcactgaatggtcactagtaccagcagtggcggatccaggactcagagtcagtggaggcattaaatgagaacatagatgacacatgaaagacccaagcagggggaatcaaaactgggtcaagttttggtggggagttgtggtatcattcggaccaaagcctcaactgaccagatgacttatgtagttcggtattatttatatggagaaacagaaaaaaaaaaaaattgataatagtcacgctttttgcatcaaaaaattccaacaatttataaacttatagtttaatgaatggagcagtttccttttccaaataagaaactcctttggttgtggatgtgacaactta

SEQ ID NO: 1424 - DNA, 642 bp, Vigna unguiculata
gagtacctaaaatagtgagtgagaggttagagtttgagagtttaacaatggatggtctagttcagcagctgcagaagcaacttgttgattacactgcttccctatttcatgagggttttttggatgagcaatttaaccagcttcagcaacttcaagatgaaagtaacccagattttgtggttgaagtggtgactctgttttttgaagacgcggagaggcttcttaatgagctcacaaaaacactagcccagcctaccattgattttaaaaagttggatgctcatgttcaccagttgaagggtagcagctccagcattggagcacagagagttcacagagtctgcatttccttccgaaactcttgcgaggagcaaaacgttgaagggtgtcttaaaaacttgcaacaagtgacacacgagtactccttggtgaaaaacaagcttgaaactctcttcaggatggagcaacagattttggctgctggtgggtagtgtgagacgaggcagagacaattggaatttggcacaaatcatgtctaatctgcaaacgaaacagacccacttctatgttgtatttttcactttgtgtatgattttgtcaagtggatcatggtcttgaaatatatcatttgagcaatattta

SEQ ID NO: 1425 - DNA, 798 bp, Glycine max
cacactatataaactaggcagaagaagaaatcagtacctaaaaaaatattgagtggctggttagaacttgagactaataatggatggtatagttcaactgcagaggcaacttgttgattatactgcttccctatttcatgagggttttctagatgaccaatttaaccagcttcagcaacttcaagatgaaagcaacccagattttgtggttgaagtggtgactctcttttttgaagatgcggagaggcttcttaatgagctcacaaaaacactaggccagccaagcattgattttaaaaggttggatgctcatgttcaccagttgaagggtagcagctccagcattggagcacagagaattcacagagtctgcatttccttccgaaactcttgtgaggagcaaaacgttgaagggtgtcttaaaaacttgcaacaggtgaaacaggagtattccttggtgaaaagcaagcttgaaactctcttcaggatggagcaacagattttggctgcaggtgggtagtgtgatacgaggcagagatattttgcagccattgcaatttgcaaacaacactccgaacaaatcatgtccaatctgcaaacaaagcaaccccacttctatgttgtattttaactttgtgtatgattttgtccagtggatcatggttgtgaaattggatttatcatttaagccagagttggcccatatttagtccaaaagcaatgtgaataacccatgatctcttagctgttcaaatattaactatcttaatttttgcctataaactgtcttcgataata

SEQ ID NO: 1426 - DNA, 872 bp, Glycine max
aaaaccacactatataaactaggcagaagaagaaatgagtacctaaaaaaatattgagtgggtggttagaacttgagactaataatggatggtatagttcagctggagaggcaacttgttgattatactgcttctctatttcatgagggctttctagatgaccaatttaaccagcttcagcaacttcaagatgaaagtaacccagattttgtggttgaagtggtgactctcttttttgaagacgcggataggcttcttaatgagctcacaaaagcactaggccagccaagcattgattttaaaaggttggatgctcatgttcaccagttgaagggtagcagctccagcattggagctcagagaattcacagggtctgcatttccttccgaaacacttgcgaggagcaaaacgttgaaggctgccttaaaaacttgcaacaagtgaaacacgagtattccttggtgaaaagcaagcttgaaactctcttcaggatggagcaacagattttggccgcaggtggatcggtttctaggtagtgtgatacgaggcagagatgttttgctgccattgtaatttggaaacaacactcagaacaaatcatgtccaatctgcaaacaaaacaaccccacttctatcttgtatttttcactttgtgtatgattttgtccagtggatcaggtcgtgaaattggatttatcatttaagccagagttggcccatatttagtccaaaagcaatgtgaataacccatgatctctcagctgtttagatattaactatcttaatttttgccaatgaactgtcttctataatatagggcgtgcgtggttgaataaactgtcttacacttgatgcaataaccagtacaaag

SEQ ID NO: 1427 - DNA, 972 bp, Cajanus cajan
aggagtgataagagagtttgagttgacatttgagtctcccggcgttacgaaacctggatctcctctttgtcttctccggcgaagcagtgaagcattcttcaatcactcttctactccgtgtgcgaaccactcttctcctccgcgagttcactgcgactctgacattttatttttaattttacggaacgttcaatatggatggcatagttgagctgcagagacaacttattgattatactgcttccctattccatgagggctttctggatgaacaatttaaccagcttcagcaacttgaagatgaaaataacccaggttttgttgttgaagtggtcactctcttttttgaagacgcggataggcttcttaatgaactcacaaaagcattaggccagccaagcgttgatttcaaaagtttggatgctcatgttcaccagttgaagggtagcagctccagcattggagcacatagaattcacagagtctgcatttcctttagaaactcttgtgaggagcaaaacgttgaagggtgtcttaaaaacttgcaacaagtgaaacatgagtactccttggtgaaagacaggcttgaaactctcttcaggatggagcaacagattttgaacgcaggtggatcagttcgtaggtagtggtacgaggcagaaatgttttgctgcaattgcaatttgcaaacaacactcagaacaaatctgcaaacaaaatagccccacttctatgttgtatttttcactttgtgtatgattttgtcgagtggattatcatggtcttgaaatttgatttatcattaaaacaagagttgatccattgttagtccaaaatcaatgtgaataagcatgctcctacggttaaaagaaaaaataagaggctggatctctcatatcttcaaatagtaatttttgtcatgattgttacaatattaaaataatgtttgattaataaaaattatgttatata

SEQ ID NO: 1428 - DNA, 929 bp, Lupinus angustifolius
ccacatattttgacatttaccaaatttctatccagatattagtagttgccagtagagactcaaaaaaaaaactcacattatatatataagccacacatcagaatacatgggggcctaagatcttcagtgaaagttgaaaactgaaacaaataatggatattatggttcaacttcaaaggcaactttttgattatactaattctctattccatgaggggtttctagatgaacaatttaaccagcttcaacaacttcaagatgaaagcaacccagattttgtggttgaagtggtgactctcttctttgaagatgcagagaggcttcttaatgagttgactaatacattgagccaagaaaacattgattttaaaagattggatgctcatgttcaccagttaaagggtagcagctccagcattggtgcacagagaattcacacagtctgcatttccttcagaaactcatgtgaggagcaaaatgttgaagggtgtcttaaaagcttgcaacaagtaaaacaggagtattccacagtgaaaagcaagcttgagactctcttcaagatggagaaacagattttggcagcaggggggtcagttttctaggtagtgtgaaatgaggcagagatgtttgatgcaatttgcaaacaacactaagaagtcagaagaagagatcatgtccaatctgccaacagaacaacaacaacaaccacttatttgttgtactttttctcttttgtttatgattttgtccactctacctagctctttatatttggatttatcatttcagccaaagtttatccatttctactccacaagcaatgtgaataacccatgctccttttgtttattcaagaatgtaaaaaaatgatgctgggcttataatatgttcaatattaactacccatctttgccaacaaatcaaaagaa

SEQ ID NO: 1429 - DNA, 680 bp, Glycyrrhiza uralensis
tgacctaagatcttattataagtgactagttaaaacttgagactagtaatggatggtatggttcttctgcagaggcaacttgttgattatactgcttccctattccaagagggctttctagatgatcaatttaaccagcttgagcaacttcaagatgaaagcaacccagattttgtggttgaagtggtgactctcttctttgatgatgcagagaggcttctcaatgagctcacaagagcactaggacaggaaagcattgattttaaaaggttggatgctcatgttcaccagttgaagggtagcagctccagtattggcgcacagagagttcaaagagcctgcatttccttcagaaactcttgcgaggagcaaaacgttgaagggtgtctgaaaagcttgcaacaagtaaagcacgagtattccttggtgaaaagcaagcttgagactctcttcaagatggagcaacagcttctggctgcacgcggttcggtttgtagatagtgcgagacgaggcagagaagtttgctgcagttgcaatttgcaaacagctctaggaagaaatcatgtccaatatgcaaacaaaaacaaccacctctatgttgtatttttgttttataaagttgtctatgattttgtcctgtggaccttggtctttaaattggatatatatcgtttaacct

SEQ ID NO: 1430 - DNA, 972 bp, Lupinus angustifolius
agtacatggggaaagttcccacagattttgacattcaccaaaatctctatcgagacattagtagttgccactagagaacaaaactctctatatataagccaagcattagaagaagaaatgagtgcctaagatcttcagtgaatgttgcaaactgagacaaataatggatgttatggttcaactgcagagacaacttgttgattatactgcctctctattcaatgaggggtttctagatgaacaatttaaccagcttcagcaacttcaagatgaaagcaacccagattttgtggttgaagttgtaactctcttctttgaagatgcagagaggcttcgtaatgagatgacaatagcattaagtcaggaaagcattgattttaagaggttagatgctcatgtccaccatttgaagggtagcagctccagcattggtgcacagagaattcacagggtctgtatttccttcagaaactcatgtgtggagcaaaatgttgaagggtgtcttaaaagcttgcaacaagtaaaacaagagtattccttggtgaaaagcaagcttgagactctcttcaagatggaacaacaaattttggttgcaagggagtcagttttctagttagtgtgaatgtttgatgcaattgcaatttgcaaacaacacaagaactcagaagataacatgtccaatatgccaacaaaacaacaaccacttctttgcttatgattttatccactctctctatctagcttgttaaattggatttctcatttaagccaaagtttatactctagtctacaagcaatgtgaataacccatgctcctttgcttcattaagaacattaaaaaaatgaagctggacctctcgtctgtgcaatattaagtaccttcttcatctttgcctacaaattaaaagaatggcctcgtcaattttctcgtctttatttatatcatatatatagcgtggtcatctttttgca

SEQ ID NO: 1431 - DNA, 756 bp, Manihot esculenta
aaagaccaaagaggcaaagagtgacttcacattccttatttatcttctagccaaggtaacttggagaagagctacaatggatggtttagttcagtttcaaagacagttagttgactacacagcttcacttttccatgagggattcttggatgaacagtttaatcaacttcaacagctgcaagatgaaagcaacccagattttgttgttgaagttgtatctcttttctttgaagattcagaaaggcttcttaatgaactggccaaatctctagaccagcaaagtgtagatttcaaaagaatagatgctcatgttcatcagttgaagggtagcagctctagcataggagctcagagagttcagaaagtctgcattgccttcagaaactactgtgatgagcagaacactgaaggatgcctgaagtgcctgcagcaagtgaagcatgagtactctcttgtgaaaaccaagcttgaaactctgttcaagcttgagcaacaagtactggcagctggaggatcaattcctttacctatctgatgaagtgattacagcaagcaaaatgggattttggattatgtagaggagatttccttttctatcttcattgcttcttttacatttttcaattgaaactgcttaagctttaaagggttgcttcaaccttttagcgtaggtttgtattatatgcaatgacgaagaatgtgaataaacccttgcagcattttgttccttaatgaagaatgtctgcaacattcacc

SEQ ID NO: 1432 - DNA, 1478 bp, Brassica oleracea
caactcatcgtcgaaaaaccactgaaccaatctcgagatggagtcacgcgtgctgctacgcgccaccgcaacggtcaccggcgtaccgcaactgaggcgaccgatcagagcgatcaaccgccagttcagcactgcgtcgtcgtcgttcacggctttcgctaagccgatcggatcaatcggagagggagggaacttgatctccggtcgtcagctccgtccggtgctccttctcgatagctcgccggagaaaagagagattctcaagccggttagagccgccgctgccgagggtggtgattcagctggggagacgaaagttggattcctcgggaagtatccgtggcttgtcaccggattcttcttcttcatgtggtacttcttgaacgtgattttcaacatccttaacaagaagatctacaattacttcccttacccctattttgtatcggttattcacttgttcgttggagttgtctactgcttggtgagctggtccgtgggtcttcctaaacgggctccaattaactcggacatcctcaaggtattgataccagttgcagtgtgtcacgccataggccatgttactagcaacgtgtccttcgcagccgtcgctgtgtccttcactcacaccataaaagcactggagccattcttcaatgcgtctgcttctcaattccttcttggacaaccgatccccataacactatggttgtctttagctcctgttgtactcggagttgcaatggcttcactcactgagttgtcattcaactggcttggtttcatcagcgccatgatatcaaacatctctttcacttacagaagcatcttctccaagaaagccatgactgatatggacagtacaaatgtctacgcttacatctccatcatcgctcttttcgtctgccttcctcctgccatcatcgtcgaagggcctcaactgttgaagcacggtttcaatgacgcgattgctaaagtgggaatgactaagttcatctctgatctcttctgggttggaatgttttaccatctctacaatcagttggctactaatacgttggagagggtagcaccattgactcacgctgttggaaacgttctgaaacgtgtcttcgtgatcggattctccatcgttatcttcggaaacaagatatcgacgcagacaggtatcggaactggaatagccattgctggagttgcactctactctgtcattaaggccaagatcgaagaagagaaacggcaaggtaagacggcgtagagagctacggccgagggcggtcaacggttgcgtaaacaattcctccgatgaatatctatataataaaataaccaaaaatgcaatagtattttgtatcgtacaatcaaacattgtttttgagtttctcttctcgttgtttttctttttaaagcttatatattatttttttattctgcgtcttttcttccagtggacaacattgttgcaatttcttctg

SEQ ID NO: 1433 - DNA, 1649 bp, Brassica juncea
tcacaactcatcgtcgcaaaaccactgaaccaatctcgagatggagtcacgcgtgctgctacgcgccaccgcaacggtcaccggcgtcccgcagctgaggcgaccgatcagagcgatcaaccgccaattcagcactgcgtcgtcgtcgttcacggctttcgctaagccgataggatccatcggagagggagggaacctgatctccggtcgtcagctccgtccggtgctccttctcgagagctcgccggagaaaagagagattctcaagccggttagagccgccgctgccgagggtggtgattcagctggggagacgaaagttggattcctcgggaagtatccgtggcttgtcaccggattcttcttcttcatgtggtacttcttgaacgtgattttcaacatccttaacaagaagatctacaattacttcccttacccctattttgtatcggttattcacttgttcgttggagttgtctactgcttggtgagctggtccgtgggtcttcctaaacgggctccaattaactcggacatcctcaaggtattgataccagttgcagtgtgtcacgccataggccatgttactagcaacgtgtccttcgcagccgtcgctgtctccttcactcacaccatcaaagcactggagccattcttcaatgcgtctgcttctcaattccttcttggacaaccgatccccataacactatggttgtctttagctcctgttgtactcggagttgcaatggcttcactcactgagttgtcattcaactggcttggtttcatcagcgccatgatatcaaacatctctttcacttacagaagcatcttctccaagaaagccatgactgatatggacagtacaaatgtctacgcttacatctccatcatcgctcttttcgtctgccttcctcctgccatcatcgtcgaagggcctcaactgttgaagcacggtttcaatgacgcgattgctaaagtgggaatgactaagttcatctctgatctcttctgggttggaatgttttaccatctctacaatcagttggctactaacacgttggagagagtagcaccattgactcacgctgttggaaacgttctgaaacgtgtcttcgtgatcggattctccatcgttatcttcggaaacaagatatcgacgcagacaggtatcggaactggaatagccattgctggagttgcactctactctgtcattaaggccaagatcgaagaagagaaacggcaaggtaagacggcgtagagagctacggccgagggcggtcaacggttgcgtaaacaaatcctccgatgaatatctatataataaaataaccaaaaatgcaatagtattttgtatcgtacaatcaaacattgtttttgagtttctcttctcgttgttttcctttctaaagcttatatatatattttttttattctgcgtcttttgcttcttgtggagaacattatgccatttcttctgcatagcgcttatctttgcagatgaaaagcataaaatgtatttattcttttctctgtctcttggagcattttacccatcatcttggacgtaaatttgtttctttctataactagtttttttttggtaatgttgctcacacacgcaacaatgatatatagttctgtat

SEQ ID NO: 1434 - DNA, 1853 bp, Brassica rapa
atccaatctacgccagtatctcaagattcttatctaatatcttcactctccaccgttggatcatatcacactattacttccaccgtaacaaaatagaccgcgaagcacgagatcacgaagtgtctcttcttgaaatacgcgacagcctcatactccgcttccttccctctcactgtcacaactcatcgtcgcaaaaccactgaaccaatctcgagatggagtcacgcgtgctgctacgcgccaccgcaacggtcaccggcgtcccgcagctgaggcgaccgatcagagcgatcaaccgccaattcagcactgcgtcgtcgtcgttcacggctttcgctaagccgataggatccatcggagagggagggaacctgatctccggtcgtcagctccgtccggtgctccttctcgagagctcgccggagaaaagagagattctcaagccggttagagccgccgctgccgagggtggtgattcagctggggagacgaaagttggattcctcgggaagtatccgtggcttgtcaccggattcttcttcttcatgtggtacttcttgaacgtgattttcaacatccttaacaagaagatctacaattacttcccttacccctattttgtatcggttattcacttgttcgttggagttgtctactgcttggtgagctggtccgtgggtcttcctaaacgggctccaattaactcggacatcctcaaggtattgataccagttgcagtgtgtcacgccataggccatgttactagcaacgtgtccttcgcagccgtcgctgtctccttcactcacaccatcaaagcactggagccattcttcaatgcgtctgcttctcaattccttcttggacaaccgatccccataacactatggttgtctttagctcctgttgtactcggagttgcaatggcttcactcactgagttgtcattcaactggcttggtttcatcagcgccatgatatcaaacatctctttcacttacagaagcatcttctccaagaaagccatgactgatatggacagtacaaatgtctacgcttacatctccatcatcgctcttttcgtctgccttcctcctgccatcatcgtcgaagggcctcaactgttgaagcacggtttcaatgacgcgattgctaaagtgggaatgactaagttcatctctgatctcttctgggttggaatgttttaccatctctacaatcagttggctactaacacgttggagagagtagcaccattgactcacgctgttggaaacgttctgaaacgtgtcttcgtgatcggattctccatcgttatcttcggaaacaagatatcgacgcagacaggtatcggaactggaatagccattgctggagttgcactctactctgtcattaaggccaagatcgaagaagagaaacggcaaggtaagacggcgtagagagctacggccgagggcggtcaacggttgcgtaaacaaatcctccgatgaatatctatataataaaataaccaaaaatgcaatagtattttgtatcgtataaatcaaacattgtttttgagtttctcttctcgttgttcttctttataaagcttatatattatttttttattctgcgtcttttcttccagtggacaacattgttgccatttcttatgcattgcccttatcttagcagatgaaaagcataataatgtatttattcttttctcattctcttggagcattttacccatcatcttcgacttaaatttgtttatttctgtaattagtttttcttggtaattttattcacaaaacaatgatttatataattctatatcaaattattgtaaaagcaaactcaaattaaac

SEQ ID NO: 1435 - DNA, 1574 bp, Brassica napus
tggacgcctgcggaccggtccggaatctcgggtcgacccacgcgtccgatcgtcgaaaaaccactgaaccaatctcgagatggagtcacgcgtgctgctacgcgccaccgcaacggtcaccggcgtaccgcaactgaggcgaccgatcagagcgatcaaccgccagttcagcactgcgtcgtcgtcgttcacggctttcgctaagccgatcggatcaatcggagagggagggaacttgatctccggtcgtcagctccgtccgttgctccttctcgatagcttgccggagaaaagagagattctcaagccggttagagccgccgctgccgagggtggtgattcagctggggagacgaaagttggattcctcgggaagtatccgtggcttgtcaccggattcttcttcttcatgtggtacttcttgaacgtgattttcaacatccttaacaagaagatctacaattacttcccttacccctattttgtatcggttattcacttgttcgttggagttgtctactgcttggtgagctggtccgtgggtcttcctaaacgggctccaattaactcggacatcctcaaggtattgataccagttgcagtgtgtcatgccataggccatgttactagcaacgtgtccttcgcagccgtcgctgtgtccttcactcacaccataaaagcactggagccattcttcaatgcgtctgcttctcagttccttcttggacaaccgatccccataacactatggttgtctttagctcctgttgtactcggagttgcaatggcttcactcactgagttgtcattcaactggcttggtttcatcagcgccatgatatcaaacatctctttcacttacagaagcatcttctccaagaaagccatgactgatatggacagtacaaatgtctacgcttacatctccatcatcgctctcttcgtctgccttcctcctgccatcatcgtcgaagggcctcaactgttgaagcacggtttcaatgacgcgattgctaaagtgggaatgactaagttcatctctgatctcttctgggttggaatgttttaccatctctacaatcagttggctactaatacgttggagagggtagcaccgttgactcacgctgttggaaacgttctgaaacgtgtcttcgtgatcggattctccatcgttatcttcggaaacaagatatcgacgcagacaggtatcggaactggaatagccattgctggcgttgcactctactctgtcattaaggccaagatcgaagaagagaaacggcaaggtaagacggcgtagagagctacggccgacggcggtcgacggttgcgtaaacaattcctccgatgaatatctatataataaaataaccgaaaatgcaatagtattttgtatcgtacaatcaaacattgtttttgagtttctcttctcgttgtttttctttttaaagcttatatattatttttttattctgcgtcttttcttccagtggacaacattgttgcaatttcttctgcattgcacttatctgagcagatgaaaagcataataatgtatttattcttttctc

SEQ ID NO: 1436 - DNA, 1576 bp, Brassica oleracea
gactgtcacaactcatcgtcgaaaaaccactgaaccaatctcgagatggagtcacgcgtgctgctacgcgccaccgaaacggtcaccggcgtaccgcaactgaggcgaccgatcagagcgatcaaccgccagttcagcactgcgtcgtcgtcgttcacggctttcgctaagccgatcggatcaatcggagagggagggaacttgatctccggtcgtcagctccgtccgttgctccttctcgatagcttgccggagaaaagagagattctcaagccggttagagccgcctctgccgagggtggtgattcagctggggagacgaaagttggattcctcgggaagtatccgtggcttgtcaccggattcttcttcttcatgtggtacttcttgaacgtgattttcaacatccttaacaagaagatctacaattacttcccttacccctattttgtatcggttattcacttgttcgttggagttgtctactgcttggtgagctggtccgtgggtcttcctaaacgggctccagttaactcggacatcctcaaggtattgataccagttgcagtgtgtcacgccataggccatgttactagcaacgtgtccttcgcagccgtcgctgtgtccttcactcacaccataaaagcactggagccattcttcaatgcgtctgcttctcagttccttcttggacaaccgatccccataacactatggttgtctttagctcctgttgtactcggagttgcaatggcttcactcactgagttgtcattcaactggcttggtttcatcagcgccatgatatcaaacatctctttcacttacagaagcatcttctccaagaaagccatgactgatatggacagtacaaatgtctacgcttacatctccatcatcgctctcttcgtctgccttcctcctgccatcatcgtcgaagggcctcaactgttgaagcacggtttcaatgacgcgattgctaaagtgggaatgactaagttcatctctgatctcttctgggttggaatgttttaccatctctacaatcagttggctactaatacgttggagagggtagcaccgttgactcacgctgttggaaacgttctgaaacgtgtcttcgtgatcggattctccatcgttatcttcggaaacaagatatcgacgcagacaggtatcggaactggaatagctattgctggcgttgcactctactctgtcattaaggccaagatcgaagaagagaaacggcaaggtaagacggcgtagagtgatacggccgacggctgtcgacggttgcgtaaacaattcctccgatgaatatctatataataaaataaccaaaaatgcaatagtattttgtatcgtacaatcaaacattgtttttgagtttcgcttctcgttgtttttctttttaaagcttatatattatttttttattctgcgtcttttcttccagtggacaacattgttgccatttcttctgcattgcacttatctgagcagatgaaaagcataataatgtatttattcttttctctttctcttggagcattttacccatcatcttcgactt

SEQ ID NO: 1437 - DNA, 1466 bp, Brassica juncea
cgcgacgacctcacacttcgcttccttccctctctcactgacacaactcaactcctgaatcaatcccgagatggagtcacgcgtgctgctacgcgccaccgcaacggtcaccggcgtcccgcagctgaggcgaccgatcagagcgatcaaccgccagttcagcactgcttcgtcgtcgttcacggctttcgctaagccgatcggatcagtcggagagggagggaacctgatctccggccgtcagctccgaccgattctcctcctagatagctcgccggagaagagagagattctcaagccggttagagccgccgctgccgcgggtggtgattcagctggggagacgaaagctggattcctcgggaagtatccgtggcttgtcaccggattcttcttcttcatgtggtacttcttgaacgtgattttcaacatcctcaacaagaagatctataattacttcccctatccctattttgtttcggctgttcacttgttcgttggagttgtttactgcttgctgagctggtccgtgggccttcctaaacgtgccccaattgactcgaacctcctcaaggtattgataccagttgcagtctgtcacgccataggccatatcactagcaacgtttccttcgcagccgtcgctgtctccttcactcacaccatcaaagcgctggagccattcttcaatgcgtctgcttctcaattccttcttggacaaccgatccccataacactatggttgtctttagctcctgttgtactcggagttgcaatggcttcactcactgagttgtcattcaactggcttggtttcatcagcgcgatgatatcaaacatctctttcacttaccgaagcatcttctccaagaaagccatgactgatatggacagtacaaatgtctacgcttacatctccatcatcgctctcttcgtctgccttcctcctgccatcatcgtcgaagggcctcagctgttgaaacacggtttcagcgacgcgattgctaaagtgggaatgactaagttcatctctgatctcttctgggttggaatgttttaccatctctacaatcagttggctactaacacgttggagagagtagcaccattgactcacgctgttggaaacgttctgaaacgtgtcttcgtgatcgggttctccatcgttatcttcggaaacaagatatcgacgcagacaggtatcggaactggaatagccattgctggagttgcactctactctgtcattaaggccaagatcgaagaagagaaacggcaaggaaagacggcatagacggccaacggcggtcgacggttgcgtaaacaattcctccgacgaatatttatataataaaataaccaaaaatgcaatagtattttgtatcgtataaatcaaacattgtttttgagtttctcttctcgttgttcttctttataaagcttatatattatttttttattctgcg

SEQ ID NO: 1438 - DNA, 1576 bp, Brassica juncea
tatcgatccccctgtcatatcatagaccgcgaaacactcgatcacgaagtatccactcttgaaatacgcgaaaaccacatactccgcttccttccctctcactatcacaaaccatcgttccaaaaaactacagtgatcaatctcgaagatggagtcacgcgtgctgttacgcgccacggtcgccggattaccgcaactgagacgaccgatcggagcgatccaccgccagttcagcactgcgtcgccttcgttcacggcttccgctaagccgatcgggtcgatcggagagggagggaacctgatctccggccgtcagctccgaccgattctcctcctcgacagctcgacggagaagagagagactctcaagccggttagagccgccgctgccgcgggtggtgattcagctggggagacgaaagctggattcctcgggaagtatccgtggcttgtcaccggattcttcttcttcatgtggtacttcttgaacgtgattttcaacatccttaacaagaagatctacaattacttcccttatccatattttgtatcggttattcacttgttcgttggagttgtctactgcttgctgagctggtccgtgggacttccgaaacgggcaccaattaactcgaacatcctcaaggtattgataccagttgcagtctgtcacgccataggccatgtcactagcaacgtttccttcgctgccgtcgctgtctccttcactcacaccatcaaagtgctggagccattcttcaatgcgtctgcttctcagttccttcttggacaaccaatccccataacactatggttgtctctagctcctgttgtactcggagttgcaatggcttcgctcaccgagttgtcattcaactggcttggtttcatcagcgcgatgatatcaaacatctctttcacttaccgaagcatcttctccaagaaagccatgactgatatggacagtacaaatgtctacgcttacatctccatcatcgctctcttcgtctgccttcctcctgccatcatcgtcgaagggccccagctattgaaatatggtttcaacgacgcgattgctaaagtgggaatgactaagttcatctctgatctcttctgggttggaatgttttaccatctctacaatcagttggctactaatacgttggagagggtagcaccgttgactcacgctgttggaaacgttctgaaacgtgtcttcgtgatcggattctccatcgttatcttcggaaacaagatatcgacgcagacaggtatcggaactggaatagctattgctggcgttgcactctactctgtcattaaggccaagatcgaagaagagaaacggcaaggtaagacggcgtagagagctacggccgagggcggtcaacggttgcgtaaacaaatcctccgatgaatatctatataataaaataaccaaaaatgttgtatcgtacaatcaaacattgtttttgagtttctcttctcgttgttttcctttctaaagcttatatatatattttttttattctgcgtcttttgcttcttgtggagaacattatgccatttcttctgc

SEQ ID NO: 1439 - DNA, 1533 bp, Eutrema parvulum
cttccctctcactgtcacaaaaaaatcatctaaaaaccactgaagatggagtcacgcgtgctgctacgcgccaccgcaacagtcgccggaaatcctcaattgaggcgaccaatcggagcgatccaccgtcaattcagcaccgcgacgtcgtcgttcacggctttcgctaaaccgatcggagcaatcggggagggagggaatctgatctccggtcgtcagctccgtccgattctccttctcgatagctcgccggagaaaagagagattctcaagccggtcagagccgccgccgcagaaggtggagattccgctggagaaacgaaagttggatttctcgggaagtatccgtggctcatcaccggtttcttcttcttcatgtggtacttcttgaacgtgattttcaacattcttaacaagaagatctataattacttcccttatccctatttcgtgtctgttattcacttgttcgttggagttgtctactgcttggcaagctggtccgtgggccttcctaaacgggccccaattgactcgaaactcctcaaggtattgataccagttgcagtctgtcacgccttaggccatgtcactagcaacgtttccttcgctgctgttgccgtctccttcactcacaccatcaaagccctcgagccattcttcaatgcttctgcttctcagttccttcttggacaaccaatccccgtaacactatggttgtctttagctcctgttgtactcggagttgcaatggcttcgctaactgagttatcattcaactggctcggtttcatcagcgcgatgatatcaaacatctctttcacttaccgaagcatcttctccaagaaagccatgactgatatggacagtacaaacgtctatgcttacatctccatcatcgctctcttcgtctgcattccacctgccatcatcgttgaagggcctcaactgttgaagcatggtttcagcgacgcgattgctaaagtgggaatgactaaattcatctctgatctcttttgggttggaatgttttaccacctctacaatcagttggctactaatacattggagagggtcgcaccattgactcacgcggttggaaacgttctgaaacgtgtgttcgtgatcggtttctccatcgttatcttcggaaacaagatatcgacacagacaggtataggaactggaatagccattgctggagttgctatgtactctatcattaaggccaagatcgaagaagagaaacggaaaggaaagacggcatagagaaccggaggcagacggcggtcgacgggtgcataaacatttcctccgataaatgttttatataataaataaccaaaatgcaatagtatgttgtatttgtaccatcaaccattgttttcgagtttttcctctttctttttttcactttcataaaagctatatataattttttattctgcttcttttgtttttaatggagaacatttccattacttctgatatgcaattatcttgacggataaagagcataataatgtatatttt

SEQ ID NO: 1440 - DNA, 1570 bp, Eutrema halophilum
ctctcactgtcacacaaaaatcatctaaaaaccactgaagatggagtcacgcgtgctgctacgcgccaccgcaacagtcgccggaaatcctcaattgaggcgaccaatcggagcgatccaccgtcaattcagcaccgcgacgtcgtcgttcacggctttcgctaaaccgatcggagcaatcggggagggagggaatctgatctccggtcgtcagctccgtccgattctccttctcgatagctcgccggagaaaagagagattctcaagccggtcagagccgccgccgcagaaggtggagattccgctggagaaacgaaagttggatttctcgggaagtatccgtggctcatcaccggtttcttcttcttcatgtggtacttcttgaacgtgattttcaacattcttaacaagaagatctataattacttcccttatccctatttcgtgtctgttattcacttgttcgttggagttgtctactgcttggcaagctggtccgtgggccttcctaaacgggccccaattgactcgaaactcctcaaggtattgataccagttgcagtctgtcacgccttaggccatgtcactagcaacgtttccttcgctgctgttgccgtctccttcactcacaccatcaaagcgcttgagccattcttcaatgcggctgcttctcaattcattctcggacaatccatccccggaacactatggttgtctctagctcctgttgttctcggagttgcaatggcttcgctaaccgagctatcgttcaactggcttggtttcatcagtgcgatgatctcaaacatctctttcacttaccgaagcatcttctccaagaaagccatgactgatatggacagtacaaatgtttacgcttacatctccatcatcgctctcttcgtctgcattcctcctgccatcatcgttgaagggcctcaactgttgaaacacggtttcagcgacgcgattgctaaagtcggtatgactaaattcatctctgatctcttctgggttggtatgttttaccatctctacaatcagttggctactaatacattggagagggtcgcaccgctgactcacgcggttggaaacgttctgaaacgtgtgttcgtgatcggtttctccatcgttatcttcggaaacaagatatcgacacagacaggtataggaactggaatagccattgctggagttgctatgtactctatcattaaggccaagatcgaagaagagaaacggaaaggaaagacggcatagagaaccggaggcagacggcggtcgacgggtgcataaacatttcctccgataaatgttttatataataaataaccaaaatgcaatagtatgttgtatttgtaccatcaaccattgttttcgagtttttcctctttctttttttcactttcataaaagctatatataattttttattctgcttcttttgtttttaatggagaacatttccattacttctgatatgcaattatcttgacggataaagagcataataatgtatttattcaatcttttcatcgtcgtaaaagagtataataatgtatttat

SEQ ID NO: 1441 - DNA, 1173 bp, Triticum aestivum
agatggagtcacgcgtgctgctacgcgccaccgcaacggtcaccggcgtaccgcaactgaggcgaccgatcagagcgatcaaccgccagttcagcactgcgtcgtcgtcgttcacggctttcgctaagccgatcggatcaatcggagagggagggaacttgatctccggtcgtcagctccgtccgttgctccttctcgatagcttgccggagaaaagagagattctcaagccggttagagccgccgctgccgagggtggtgattcagctggggagacgaaagttggattcctcgggaagtatccgtggcttgtcaccggattcttcttcttcatgtggtacttcttgaacgtgattttcaacatccttaacaagaagatctacaattacttcccttacccctattttgtatcggttattcacttgttcgttggagttgtctactgcttggtgagctggtcctgggtcttcctaaacgggctccaattaactcggacatcctcaaggtattgataccagttgcagtgtgtcacgccataggccatgttactagcaacgtgtccttcgcagccgtcgctgtgtccttcactcacaccataaaagcactggagccattcttcaatgcgtctgcttctcagttccttcttggacaaccgatccccataacactatggttgtctttagctcctgttgtactcggagttgcaatggcttcactcactgagttgtcattcaactggcttggtttcatcagcgccatgatatcaaacatctctttcacttacagaagcatcttctccaagaaagccatgactgatatggacagtacaaatgtctacgcttacatctccatcatcgctctcatcgtctgcattcctcctgccatcatcgtcgaagggcctcaactgttgaaacacggtttcaacgacgcgatagctaaagtgggaatgacaaaattcatctctgatctcttctgggttggaatgttttaccatctctacaatcagttggctactaatacgttggagagggttgcaccattgactcacgctgttggaaacgttctgaaacgtgtgttcgtgatcgggttctccatcgttatcttcggaaacaaaatatcgacgcagacaggtatcggaactggaatagccattgctggtgttgcactctactc

SEQ ID NO: 1442 - DNA, 1614 bp, Brassica juncea
ggtcacaactcatcgttccaaaaaaccactgtatcaatctcgaagatggagtcacacgtgctgttacgcgccgcagtcaccggagtaccgcaactgagacgaccgatcggtgcgatccaccgccaggtcagcactgcgtcgtccttcacggctttcgctaagccgatcggatcagccggagagggagggaacctgatctctggtcgtcagctccgaccgattctcctcctagatagctcgccggagaagagagagattctcaagccggttagagccgccgctggagattcagctggggaggcgaaggttgggttcctcgggaagtatccgtggctcgtcaccggattcttcttcttcatgtggtacttcttgaatgtgattttcaacatccttaacaagaagatctataactacttcccctatccctattttgtttcggctgttcacttgttcgttggagttgtatactgcttgctgagctggtccgtgggccttcctaaacgtgccccaattaactcaaacctcctcaaggtattgatcccagttgcagtctgtcacgccataggccatatcaccagcaacatttccttcgcagccgtcgctgtttccttcactcacaccatcaaagcgctggagccattcttcaatgcgtctgcttcacagttccttcttggacaatcaatccccataacactatggctgtccttagctcctgttgtattcggagttgcaatggcttcgctcactgagttatcattcaactggcttggattcataagcgcgatgatctcaaacatctctttcacttaccgtagcatcttctccaagaaagccatgactgatatggacagtacaaatgtctacgcttacatctccatcatcgctctcttcgtctgccttcctcctgccatcatcgtcgaagggcctcagctgttgaaacacggtttcagcgacgcgattgctaaagtgggaatgactaagttcatctctgatctcttctgggttggaatgttttaccatctctacaatcagttggctactaatacattggagagggtagcaccattgactcacgctgttggaaacgttctgaaacgtgtcttcgtgatcgggttctccatcgttatcttcggaaacaagatatcgacgcagacaggtatcggaactggaatagccattgctggagttgcactctactctgtcattaaggccaagatcgaagaagagaaacggcaaggaaagacggcatagacggccaacggcggtcgacggttgcgtaaacaattcctccgacgaatatttatataataaaataaccaaaaatgttgtatcgtacaatcaaacattgtttttgagtttctcttctcgttgttttcctttctaaagcttatatatatattttttttattctgcgtcttttgcttcttgtggagaacattatgccatttcttctgcatagcgcttatctttgcagatgaaaagcataaaatgtatttattcttttctctgtctcttggagcattttacccatcatcttggacgtaaatttgtttctttctataactagtttttttttggtaatgttgctcacacacgcaacaatgatatatagtt

SEQ ID NO: 1443 - DNA, 1416 bp, Brassica oleracea
gtcacaactcatcgttccaaaaaaaccactgtatcaacctcgacgatggagtcacgcgtgctgctacgcgccacagtcaccggagtaccgcaattgagacgaccgatcggtgcgatccaccgtcaggtcagcactgcgtcgtcgttcacggctttcgctaagctgatcggatcagtcggagagggagggaacctgatctccggtcgtcagctccgtccgattctcctcctcgatagctcgccggagaagagagagattctcaagccggttagagccgccgctggagattcagctggggaggcgaaggttggattcctcgggaagtatccgtggctcgtcaccggattcttcttcttcatgtggtacttcttgaatgtgattttcaacatccttaacaagaagatctataactacttcccctatccctattttgtttcggctgttcacttgttcgttggagttgtatactgcttgctgagctggtccgtgggccttcctaaacgtgccccaattaactcaaacctcctcaaggtattgatcccagttgcagtctgtcacgccataggccatatcaccagcaacgtttccttcgcagccgtcgctgtctccttcacacacaccatcaaagcactggagccattcttcaatgcgtctgcttcacagttccttcttggacaatcaatccccataacactatggctgtccttagctcctgttgtattcggagttgcaatggcttcgctcactgagttatcattcaactggcttggattcatcagcgcgatgatatcaaacatctctttcacttaccgtagcatcttctccaagaaagccatgactgatatggacagtacaaatgtttacgcttacatctccatcatcgctctcatcgtctgcattcctcctgccatcatcgttgaagggcctcagctgttgaaacacggtttcagcgacgcgatagctaaagtgggaatgacaaaattcatctctgatctcttctgggttggaatgttttaccatctctacaatcagttggctactaatacgttggagagggttgcaccattgactcacgctgttggaaacgttctgaaacgtgtgttcgtgatcgggttctccatcgttatcttcggaaacaaaatatcgacgcagacaggtatcggaactggaatagccattgctggtgttgcaatgtactctatcattaaggccaagatcgaagaagataaaaagaaaggaaagacggcgtagagagcggcggtcaacggttgcataaacaattcttccggtggataatatatttatataataaaagaaccaaaatgcaatagtatgttgtatggtacaatcaaacattgttttcgagtttttcgtctcgttttcttctaaactatatactacattgttttttctgcc

SEQ ID NO: 1444 - DNA, 1870 bp, Brassica rapa
gtcatatcatagaccgcgaaacactcgatcacgaagtatccactcttgaaatacgcgaaaaccacatactccgcttccttccctctcactgtcacaactcatcgttccaaaaaaccactgtatcaatctcgaagatggagtcacgcgtgctgttacgcgccgcagtcaccggagtaccgcaactgagacgaccgatcggtgcgatccaccgccaggtcagcactgcgtcgtccttcacggctttcgctaagccgatcggatcagccggagagggagggaacctgatctctggtcgtcagctccgaccgattctcctcctagatagctcgccggagaagagagagattctcaagccggttagagccgccgctggagattcagctggggaggcgaaggttgggttcctcgggaagtatccgtggctcgtcaccggattcttctttttcatgtggtacttcttgaatgtgattttcaacatccttaacaagaagatctataactacttcccctatccctattttgtttcggctgttcacttgttcgttggagttgtctactgcttgctgagctggtccgtgggccttcctaaacgtgccccaattaactcaaacctcctcaaggtattgatcccagttgcagtctgtcacgccataggccatatcaccagcaacatttccttcgcagccgtcgctgtttccttcactcacaccatcaaagcgctggagccattcttcaatgcgtctgcttcacagttccttcttggacaatcaatccccataacactatggctgtccttagctcctgttgtattcggagttgcaatggcttcgctcactgagttatcattcaactggcttggattcatcagtgcgatgatatcaaacatctctttcacttaccgtagcatcttctccaagaaagccatgactgatatggacagtacaaatgtctacgcttacatctccatcattgctctcatcgtttgcattcctcctgccatcatcgttgaagggcctcagctgttgaaacacggtttcagcgacgcgattgctaaagtgggaatgacaaaattcatctctgatctcttctgggttggaatgttttaccatctctacaatcagttggctactaatacgttggagagggttgcaccattgactcacgctgttggaaacgttttgaaacgtgtgttcgtgatcggcttctccatcgttatcttcggaaacaaaatatcgacgcagacaggtatcggaactggaatagccattgctggtgttgcactctactctatcattaaggccaagatcgaagaagataaaaagaaaggaaagacggcgtagagagcggcggtcaacggttgcataaacaattcttccggtggataatatatttatataataaaagaaccaaaatgcaatagtatgttgtatggtacaatcaaacattgttttcgagtttttcgtctcgttttcttctaaattatatactacattgttttttctgcctcttctgttcccaatggagaacatttttaccatttcttctgcattgctatcatctagacaaataaatagcataattctctctgttcctaaaagatctatattctagttttttcacatattttaataaaacgcattaaatttacatatttgtttgtgtttatcttttttccataattttaagccaataaaaagtcaattaatgtaattaaaatttttgaaatttgcaattatttaataaacacatgcattgaaaatgtaaaaaataaatcttgtagaaacaaaaattttctctagaatatgtatcatcgtggattacagttttttctcttggtagtttgtactgttatatgtagaattgtggattg

SEQ ID NO: 1445 - DNA, 1509 bp, Brassica napus
gtcacaactcatcgttccaaaaaaaccactgtatcaacctcgacgatggagtcacgcctgctgctacgcgccacagtcaccggagtaccgcaattgagacgaccgatcggtgcgatccaccgtcaggtcagcactgcgtcgtcgttcacggctttcgctaagctgatcggatcagtcggagagggagggaacctgatctccggtcgtcagctccgtccgattctcctcctcgatagctcgccggagaagagagagattctcaagccggttagagccgccgctggagattcagctggggaggcgaaggttggattcctcgggaagtatccgtggctcgtcaccggattcttcttcttcatgtggtacttcttgaatgtgattttcaacatccttaacaagaagatctataattacttcccctatccctattttgtttcggctgttcacttgttcgttggagttgtctactgcttgctgagctggtccgtgggccttcctaaacgtgccccaattgactcaaacctcctcaaagtattgatcccagttgcagtctgtcacgccataggccatatcaccagcaacgtttcctttgcagccgtcgctgtctccttcacacacaccatcaaagcactggagccattcttcaatgcgtctgcttcacagttccttcttggacaatcaatccccataacactatggctgtccttagctcctgttgtactcggagttgctatggcttcgctcactgagttatcattcaactggcttggattcatcagcgcgatgatatcaaacatctctttcacttaccgtagcatcttctccaagaaagccatgactgatatggacagtacaaatgtttacgcttacatctccatcatcgctctcatcgtctgcattcctcctgccatcatcgttgaagggcctcagctgttgaaacacggtttcagcgacgcgatagctaaagtgggaatgacaaaattcatctccgatctcttctgggttggaatgttttaccatctctacaatcagttggctactaatacgttggagagggttgcaccattgactcacgctgttggaaacgttctgaaacgtgtgttcgtgatcgggttctccatcgttatcttcggaaacaaaatatcgacgcagacaggtatcggaactggaatagccattgctggtgttgcactctactctatcattaaggccaagatcgaagaagataaaaagaaaggaaagacggcgtagagagcggcggtcaacggttgcataaacaattcttccggtggataatatatttatataataaaagaaccaaaatgcaatagtatgttgtatggtacaatcaaacattgttttcgagcttttcgtctcgctttcttttaaattatatactacattgttttttctgcctcttctgtttccaatggagaacattgttaccatttcttctgcattgctatcatctggacagataaatagcataataacgtatatttttattgc

SEQ ID NO: 1446 - DNA, 1533 bp, Brassica napus
tgtcacaactcatcgttccaaaaaaccactgtatcaatctcgaagatggagtcacgcgtgctgttacgcgccgcagtcaccggagtaccgcaactgagacgaccgatcggtgcgatccaccgccaggtcagcactgcgtcgtccttcacggctttcgctaagccgatcggatcagtcggagagggagggaacctgatctccggtcgtcagctccgaccgattctcctcctagatagctcgccggagaagagagagattctcaagccggttagagccgccgctggagattcagctggggaggcgaaggttgggttcctcgggaagtatccgtggctcgtcaccggattcttctttttcatgtggtacttcttgaatgtgattttcaacatccttaacaagaagatctataactacttcccctatccctattttgtttcggctgttcacttgttcgttggagttgtatactgcttgctgagctggtccgtgggccttcctaaacgtgccccaattaactcaaacctcctcaaggtattgatcccagttgcagtctgtcacgccataggccatatcaccagcaacatttccttcgcagccgtcgctgtttccttcactcacaccatcaaagcgctggagccattcttcaatgcgtctgcttctcagttccttcttggacaatcaatccccataacactatggctgtccttggctcctgttgtattcggagttgcaatggcttcgctcactgagttatcattcaactggcttggattcataagcgcaatgatatcaaacatctctttcacttaccgtagcatcttctccaagaaagccatgactgatatggacagtacaaatgtctacgcttacatctccatcattgctctcatcgtctgcattcctcctgccatcatcgttgaagggcctcagctgttgaaacatggtttcagcgacgcgatagctaaagtgggaatgacaaaattcatctctgatctcttctgggttggaatgttttaccatctctacaatcagttggctactaatacgttggagagggttgcaccattgactcacgctgttggaaacgttctgaaacgtgtgttcgtgatcggcttctccatcgttatcttcggaaacaaaatatcgacgcagacaggtatcggaactggaatagccattgctggtgttgcaatgtactctatcattaaggccaagatcgaagaagataaaaagaaaggaaagacggcgtagagagcggcggtcaacggttgcataaacaattcttccggtggataatatatttatataataaaagaaccaaaatgcaatagtatgttgtatggtacaatcaaacattgttttcgagtttttcgtctcgttttcttctaaattatatactacattgttttttctgcctcttctgttcccaatggagaacatttttaccatttcttctgcattgctagcataattccctctgtttctaaaagatttatattctagttttttcacacattttaataaaacatatta

SEQ ID NO: 1447 - DNA, 1708 bp, Raphanus sativus
catctgtctcttcagccatcactttaagataagatgggccccgcagtcatctaacataagccaataatctcacgattcttatctaatctcatctttcttcaccgttagatcatattacactatcgatccgcctgtcacaacgtagaccgcgaaacacttgatcacgaagtatccactcttgaaaaccacatacttcgcttccttccctctcactatcacaaaccccatcggttccaaaaccactgaatcaatctcgaagatggagtcacgcgtgctgttacgcgccacagtcgccggactaccgcaactgagacgaccgatcggagcgatccaccgtcaactcagcaccgcgccgtcctcgttcacggctttcgctaagccgatcggatcagtcggagagggagggaacctgatctccggtcgtcagctccgaccgattctcctcctcgatagctcgccggagaagagagagattctcaagccggttagagccgccgctggagattcagctggggagacgaaagatggattcctcgggaagtatccatggcttgtcaccggattcttcttcttcatgtggtacttcttgaacgtgattttcaacatccttaacaagaagatctataattacttcccctatccctattttgtttcggctgttcacttgttcgttggtgttgtctactgcttaattagctggtccgtgggccttcctaaacgtgccccaattgactcgaacctccttaaggttttgataccagttgcagtctgtcacgccataggccatatcactagcaacgtttccttcgcagcagtcgctgtctccttcactcacaccatcaaagcgctggagccattcttcaatgcatctgcttctcagttccttcttggacaatcaatccccataacactatggttgtctttagctcctgttgtactcggagttgcaatggcttcgctaactgagttatcattcaactggcttggattcatcagcgcgatgatatcaaacatctctttcacttaccgaagcatcttctccaagaaagccatgactgatatggacagtactaatgtgtacgcttacatctccatcattgctctcatcgtctgcattcctcctgccatcatcgttgaagggcctcagctgttgaaacacggtttcagcgacgcgattgctaaagttggaatgactaaattcctctctgatctcttctgggttggaatgttttaccatctctacaatcagttggctactaataccttggagagggttgcaccattgactcatgctgttggaaacgttttgaaacgtgtgtttgtgatcgggttctccatcgttatcttcggaaacaagatatcgacgcagacaggtatcggaactggaatagccattgctggtgttgcactctactctatcattaaggccaagatcgaagaagataaaaagaaaggaaagacggcgtagagagcggcggtcaacggttgcataaacaattcttccggtggataatatatttatataataaaaagaaccaaaatgcaatagtatgttgtatggtacaatcaaccattgttttcgagtttttcttctctctttcttttaaataatatactatattgtttttctccctcttttgtttccaatggagaacattgttaccatttcttctacattgctatcatcttgacagataaaaagtttaat

SEQ ID NO: 1448 - DNA, 1629 bp, Brassica napus
gactgtcacaactcatcgttccaaaaaccactgtatcaatctcgaagatggagtcacgcgtgctgttacgcgccgcagtcaccggagtaccgcaactgagacgaccgatcggtgcgatccaccgccaggtcagcactgcgtcgtccttcacggctttcgctaagccgatcggatcagtcggagagggagggaacctgatctccggtcgtcagctccgaccgattctcctcctagatagctcgccggagaagagagagattctcaagccggttagagccgccgctggagattcagctggggaggcgaaggttgggttcctcgggaagtatccgtggctcgtcaccggattcttctttttcatgtggtacttcttgaatgtgattttcaacatccttaacaagaagatctataactacttcccctatccctattttgtttcggctgttcacttgttcgttggagttgtatactgcttgctgagctggtccgtgggccttcctaaacgtgccccaattaactcaaacctcctcaaggtattgatcccagttgcagtctgtcacgccataggccatatcaccagcaacatttccttcgcagccgtcgctgtttccttcactcacaccatcaaagcgctggagccattcttcaatgcgtctgcttcacagttccttcttggacaatcaatccccataacactatggctgtccttagctcctgttgtactcggagttgcaatggcttcgctcactgagttatcattcaactggcttggattcatcagcgcgatgatatcaaacatctctttcacttaccgtagcatcttctccaagaaagccatgactgatatggacagtacaaatgtctacgcttacatctccattattgctctcatcgtctgcattcctcctgccatcatcgttgaagggcctcagctgttgaacacggtttcagcgacgcgatagctaaagtgggaatgacaaattcatctctgatctcttctgggttggtaatgtttacctatctctacaatcagttggctactaatacgttggtagagggtaggcgaccgttgactcacgctgttggaaacgttactgaaacgtgtcttcgtgatcggattctccatcgttatacttcggaaacaagatatcgacgcagacaggtatcggaactggaatagccattgctggcgttgcactctactctgtcattaaggccaagatcgaagaagagaaacggcaaggtaagacggcgtagagagctacggccgacggcggtcgacggttgcgtaaacaattcctccgatgaatatctatataataaaataaccgaaaatgcaatagtattttgtatcgtacaatcaaacattgtttttgagtttctcttctcgttgtttttctttttaaagcttatatattattttttattctgcgtcttttcttccagtggacaacattgttgcaatttcttctgcattgcacttatctgagcagatgaaaagcataataatgtatttattcttttctctttctcttggagcattttacccatcatcttcgacttaaatttgtttctttctgtaattagtttttcttggtaattgtgctcacacaacaatgatttatataa

SEQ ID NO: 1449 - DNA, 1586 bp, Brassica napus
gaactctttgctcgaccctacgaaacgttctcaacttctcactcagctcgcacccctcctcactgtcacaactcatcgttccaaaaacccactgtatcaacctcgacgatggagtcacgcgtgctgctacgcgccacagtcaccggagtaccgcaattgagacgaccgatcggtgcgatccaccgtcaggtcagcactgcgtcgtcgttctcggctttaggttttcagctccgatcggatcagtcggagagggagggaacctgatctccggtcgtcagctccgtccgattctcctcctcgatagctcgccggagaagagagagattctcaagccggttagagccgccgctggagattcagctggggaggcgaaggttggattcctcgggaagtatccgtggctcgtcaccggattcttcttcttcatgtggtacttcttgaatgtgattttcaacatccttaataagaagatctataattacttcccctatccctattttgtttcggctgttcacttgttcgttggagttgtctactgcttgctgagctggtccgtgggccttcctaaacgtgccccaattgactcaaacctcctcaaagtattgatcccagttgcagtctgtcacgccataggccatatcaccagcaacgtttccttcgcagccgtcgctgtctccttcactcacaccatcaaagcgctggagccattcttcaatgcgtctgcttctcagttccttcttggacaatcaatccccataacactatggctgtccttagctcctgttgtactcggagttgcaatggcttcgctcactgagttatcattcaactggcttggattcatcagcgcgatgatatcaaacatctctttcacttaccgtagcatcttctccaagaaagccatgactgatatggacagtacaaatgtctacgcttacatctccattattgctctcatcgtctgcattcctcctgccatcatcgttgaagggcctcagctgttgaaacacggtttcagcgacgcgatagctaaagtgggaatgacaaaattcatctctgatctcttctgggttggaatgttttaccatctctacaatcagttggctactaatacgttggagagggttgcaccattgactcacgctgttggaaacgttctgaaacgtgtgttcgtgatcgggttctccatcgttatcttcggaaacaaaatatcgacgcagacaggtatcggaactggaatagccattgctggtgttgcactctactcaatcattaaggccaagatcgaagaagataaaaagaaaggaaagacggcgtagagagcggcggtcaacggttgcataaacaattcttccggtggataatatatttatataataaaagaaccaaaatacaatagtatgttgtatggtacaatcaaacattgctttcgagtttttcgtctcgctttcttttaaattatatactacattgttttttctgcctcttctgtttccaatggagaacattgttaccatttcttctgcattgctatcatctggacagataaatagcataataacgtatatttttattgctcttttttt

SEQ ID NO: 1450 - DNA, 1593 bp, Arabidopsis lyrata
tcgcttcctctttgctctcactgtctaaaactctgaatttcgatttcaatggagtcacgcgtgctgttacgcgccaccgcgaatgtcgtcggaattccgaaattgagacgacctatcggagcgatccaccgtcaattcagcactgcgtcgtcatcttcctcgtctttctcggttaaaccaatcggaggaatcggagaaggagcgaatctgatctccggtcgtcagcttcgtccgattcttcttctcgattcgtcggcgatcaacggcggagagaaaagagagattctcaaaccggttaaagccgccgctgctgaaggtggagataccgctggggaagctaaagttggattcctcgccaagtatccatggctagtcactgggttcttcttcttcatgtggtacttcttgaatgtgattttcaacatccttaacaagaagatctataattacttcccttatccctattttgtatcggtgatacacttgttcgtgggagtggtatactgcttgatcagctggtccgtgggccttcctaaacgagccccaattgactcgaatctcctcaaggtattgataccagttgcagtctgtcacgccataggccatgtcactagcaatgtttcctttgccgcggttgctgtctccttcacccacaccatcaaagcacttgagccattcttcaatgcggctgcttctcaattcattatgggacaatccatccccataacattatggttgtctctagctcctgttgttcttggtgttgcaatggcttcacttactgagctatcattcaactggcttggtttcatcagtgccatgatctcaaacatttccttcacttaccgaagcatcttctccaagaaagccatgactgatatggacagtacaaatgtctacgcttacatctccatcatcgctctctttgtctgcattcctcctgccatcatcgttgaaggtcctaaactactgaaccatggtttcgccgacgccattgctaaagttggaatgacaaaattcatctctgatctcttctgggttggaatgttttaccatctctacaatcagttggctacaaataccttggaaagggtcgcaccgctgactcacgcggttggaaacgtgctgaaacgtgtgttcgtgatcggtttctccatcgttatcttcggaaacaagatatcgacacagacaggtataggaacaggaatagccattgctggtgttgcaatgtactctatcattaaggccaagatcgaagaagagaaacggcaaggaaagaaagcttagagagcgacgtaagacggcggtcgacggttgcataaacaagtcctccgatggatatatttatataataaataaccaaatgcaatagtatgttgtattgtaccatcaaccattgttttcgagtttttcctttctttgtttttttgctttctgaaaagttatatataattttttattctgtttttaatggagaacatttccatttcttttgatatgcaattatcttgacggataaaaggcataataatgtatttatttgctcttatacccatcatcgtagagttaaattttaaatttatctttgtataa

SEQ ID NO: 1451 - DNA, 1579 bp, Arabidopsis thaliana
ctctttgctctcactatcaaaactctgaatttcgatttcaatggagtcacgcgtgctgttacgcgccaccgcgaatgtcgttggaattccgaaattgagacgaccaatcggagcgatccaccgtcaattcagcactgcatcgtcttcctcgttctcggttaaaccaatcggaggaatcggagagggagcgaatctgatctccggtcgtcagcttcgtccaattcttcttctcgattcgtcggcgatcaacggaggagagaaaagagaaattctcaaaccggttaaagccgccgctgctgaaggtggagataccgctggggatgctaaagttggattcctcgccaagtatccatggctagtcactggattcttcttcttcatgtggtacttcttgaatgtgattttcaacatccttaacaagaagatctataattacttcccttatccctattttgtatcggtgatacacttgttcgtgggagttgtttactgcttgatcagctggtccgtgggtcttcctaaacgtgccccgattgactcgaacctcctcaaggtattgataccagtcgcagtctgtcacgccttaggccatgtcactagcaatgtctctttcgctgcggttgctgtctccttcactcacaccatcaaagcacttgagccattcttcaatgcggctgcttctcaattcattatgggacaatccatccccataacactatggttgtctctagctcctgttgttcttggtgttgcaatggcttcactaactgagctatcattcaactggctcggtttcatcagtgctatgatatcaaacatttctttcacttaccgaagcatcttctccaagaaagccatgactgatatggacagtacaaatgtctacgcttacatctccatcatcgcactcttcgtctgcattcctcctgccatcatcgttgaaggtcctaaactacttaaccatggtttcgccgacgcgattgctaaagttggaatgactaaattcatctctgatctcttctgggttggaatgttttaccatctctacaatcagctggctaccaataccttggagagggttgcaccgctgactcacgcggttggaaacgttctgaaacgtgtgttcgtgatcggtttctccatcgttatcttcggaaacaagatatcgacacagacaggtataggaacaggaatagccattgctggagttgcaatgtactctatcattaaggccaagatcgaagaagagaaacggcaaggaaagaaagcatagaaagcagctgaagacggcggtcgacagttgcataaacaagttctccgatggatatatatatatctatataataaataaccaaatgcaatagtatgttgtattgtaccatcaaccattgttttcgagtttttcctttctttgttttttttttgctttctgaaaagttatatataaattttttattctgcttcttctctttttaatggagaacattttcatttccatttcttctgatatgcaattatcttaacggataaaaggcataataatgtatttatttgctctttctcttggagcatataccca

SEQ ID NO: 1452 - DNA, 1484 bp, Cleome spinosa
actgtcagatattttctcgaatcaccaccgcccaactgtcatggagtcacgcgtgctctcacgcgccaccgcaacaatcgccggctccccgttcttcaggcgtgttcaccgccatcacaatcatcatgcctccgcagccactgtaactttcccggcggctgtcgccgacggcggaaacgtgatatccggccgccagctccgcccttccctgcttctcgataactcatcctctgcggtgattgctgaggcggtcaccggccgcaggaagagggagattctccggccgacgcgagctgccgcttcgtcctccgccgagggtggagattccgccggagcagcaaaggtcggattcttcgacaagtacccggcgcttgttaccggcttcttcttcttcatgtggtacttcctgaacgtgatattcaacatcctcaacaagaagatttacaattacttcccttatccctacttcgtatcggttattcacttgtttgttggagtcgtgtactgcttggtgagctgggctgtgggccttcccaaacgggccccaatagactcaaaccttctgaagttgctgataccagtggctgtgtgtcacggcattggccatgtaaccagcaacgtctcattcgcagccgttgccgtctccttcactcacaccatcaaagctctcgagccgttcttcaacgcttccgcttcgcagttcatacttggacagtccatccctatcactttgtggctttctctgctccctgttgtcctcggagtttccatggcttccctgaccgagctctcattcaactggactggtttcatcagcgccatgatttccaacatctctttcacttacagaagcatctattccaagaaagccatgactgacatggacagcacgaacgtgtatgcttacatatctatcatagccctcttcgtctgcatccctcccgccatcatcgttgaagggcctcaactgctgaaacacggattcaacgacgcaatcgcgaaagttggaatgaccaaattcatctcagatctcttctgggtgggaatgttttaccatctctacaaccagctggcgaccaataccttggagagggtggcaccgctgactcatgcggtggggaacgttctgaaacgtgttttcgtgatcggtttctcgatcataatcttcggaaacaagatatctactcaaacaggaataggaacaggcatagccattgctggagttgccatctactccctgattaaggccaagatggaagaagagaaacggaaaggaaaggccgcatagagaaaggcaatggaggagggagggaggaaggagcgatctaatggatataaataacaacaaaatgcaatgttgtactgttataccattgtttctttttatataatttaattttggctttttgttttttgaatagaaccccatgcatggaccatctcttctattacaacttctaaataataattatgtatttatttgc

SEQ ID NO: 1453 - DNA, 1611 bp, Gossypium hirsutum
cttgctagcatacacacattttcgttcgttactttccattccttttctctctctctagcaatggagtcgcgattgttatcacgcgcttctgttatcaccggcttacctcagctcaggccgaagctttcgccagggattgtcaacgtttcgtttgcttcggctaagccgatcggagccgtcggtgaaggcgggaacctcatatgggggaggcaactaaggccctccttgctactagaatgctcgtcggttagcaagcgagaggtcctgaaaccggtttcggctgccgcgtcgtcaccggccgagggaggaagcgattccgccggggatgggaagattgctccggttggattcttcgagaagtatcccgcacttgttaccggatttttcttcttcatgtggtacttcttgaatgtaatattcaacattctcaacaagaagatctacaattacttcccttatccctattttgtatcggtcattcacttgttcgttggggtagtttactgtttggtgagctgggccgtaggcctccctaagcgggctcctattgattcaaacctactgaagttgttgattcctgttgctgtatgccatggacttggtcatgtaactagcaatgtctcctttgcagctgttgctgtttctttcacccacactatcaaagctcttgagcctttctttaacgctgctgcttcccagttcatacttggacaatcaataccaatcactctatggttgtctcttgctcctgttgttattggtgtatccatggcatcactgactgagctgtcattcaattggacgggtttcattagcgcaatgatttccaacatctccttcacttacaggagtatctattccaagaaagccatgacggatatggacagtacaaatgtctatgcttatatttccatcattgctctcttcgtctgtattcccccagccctcatttttgagggtcctcaattgttgaagcatggtttcaatgatgctattgctaaagtgggtatgactaagttcatctcagatcttttctgggtgggaatgttttaccatctctataatcagttggctaccaatactctggagcgggtggcaccactgacccatgcagtgggcaacgtgctgaaacgtgtatttgtcattggcttctcaatcattgtctttggaaacaagatttcaactcagactggtataggaacagtcattgcaattgctggagtggcagcctactctttcattaaggccaagatggaagaagagaaacgacaaatgaaagcagcatgagaagaaaaaaggaggcaaggaaattggaggaagtcctgatgaagaccaaatttgattttaccttgctgttattgtgaagtttttctttttccctctttcttctctatcatttcattttattttattttttaaaaaattcagagaacaaactatttataactgtggatcagcctgtgttgactgaaaaataatgtgtactgctatcacttattctgtctctcaaattaagctttatttcattagaagcttttataaattgggagtttgaaacagaatatgtgcccaaaataaaagatatcatgtgaatagtatttgtgatttcat

SEQ ID NO: 1454 - DNA, 1631 bp, Gossypium raimondii
ttgcgtctctccattaagagctcactcttgctagcatacacacattttcgttcgttactttccattccttttctctctctctagcaatggagtcgcgattgttatcacgcgcttctgttatcaccggcttacctcagctcaggccgaagctttcgccagggattgtcaacgtttcgtttgcttcggctaagccgatcggagccgtcggtgaaggcgggaacctcatatgggggaggcaactaaggccctccttgctactagaatgctcgtcggttagcaagcgagaggtcctgaaaccggtttcggctgccgcgtcgtcaccggccgagggaggaagcgattccgccggggatgggaagattgctccggttggattcttcgagaagtatcccgctcttgttaccggatttttcttcttcatgtggtacttcttgaatgtaatattcaacattctcaacaagaagatctacaattacttcccttatccctattttgtatcggtcattcacttgttcgttggggtagtttactgtttggtgagctgggccgtaggcctccctaagcgggctcctattgattcaaacctactgaagttgttgattcctgttgctgtatgccatggacttggtcatgtaactagcaatgtctcctttgcagctgttgctgtttctttcacccacactatcaaagctcttgagcctttcttcaacgctgctgcttcccagttcatacttggacaatcaataccaatcactctatggttgtctcttgctcctgttgttattggtgtatccatggcatcactgactgagctgtcattcaattggacgggtttcattagcgcaatgatttccaacatctccttcacttacaggagtatctattccaagaaagctatgacggatatggacagtacaaatgtctatgcttatatttccatcattgctctcttcgtctgtattcccccagccctcatttttgagggtcctcaattgttgaagcatggtttcaatgatgctattgctaaagtgggtatgactaagttcatctcagatcttttctgggtgggaatgttctaccatctctataatcagttggctaccaatactctggagcgggtggcaccactgacccatgcagtgggcaacgtgctgaaacgtgtatttgtcattggcttctcaatcattgtctttggaaacaagatttcaactcagactggtataggaacagtcattgcaattgctggagtggccgcctactctttcatcaaggccaagatggaagaagagaaacgacaaatgaaagcagcatgagataaaaaaggaggcaaggaaattggaggaagtcctgatgaagaccaaatttgattttaccttgctgttattgtgaagtttttctttttccctctttcttctcttatcatttcattttatttttttttttaaattcagagaacaaactatttataactgtggatcagcctgtgttgactgaaaaataatgtgtactgctatcacttattctgtctctcaaattaagctttatttcattagaagcttttataaattgggagtttgaaacagaatatgtgcccaaaataaaagatatcatgtgaatagtatttgtgattt

SEQ ID NO: 1455 - DNA, 1603 bp, Theobroma cacao
agctaccatacatacatttcgttctctctctgtctctctctctctgtggcaatggagtcgcgattgttgtcacgcgcttccaccatcactggcttccctcagctcaggccgaagctttcacgggacagcgtcaacgtgtcatttgcttcgtctaagccgatcggagccgtcggaggaggcgggaacttgatatggggaaggcagctaaggccggctctgctactcgagagctcgtcggttagtaagcgagagattttgaagccggtttcagccgccgcgtcgtcgcctgccgaaggaggaagcgattccgccggggacgcaaagattgctccggttggcttcttcgagaagtatccggctcttgtcaccggctttttcttcttcatgtggtacttcttaaatgtgatatttaacattctcaacaagaagatctacaattacttcccttatccctattttgtgtcggttattcacttgttcgttggggtagtttactgtttggtgagctgggctgtgggcctccctaagcgggctcctatggactcaaacctactgaagttgttgatccctgttgctgtatgccatgctttaggccatgtaactagcaatgtctcttttgcagctgttgctgtctctttcacccacacaatcaaagctctggagcctttcttcaatgctgctgcttcccaattcatacttggacaatccataccatttactctatggctgtctcttgctcctgttgttattggtgtttccatggcatcactgactgagttgtcattcaattggacgggtttcattagcgcaatgatttccaacatctccttcacttacaggagcatctattccaagaaagctatgaccgatatggacagtacaaatgtctatgcttatatttccatcattgctctcttcgtctgtattcccccagccatcattctcgagggtccccaactgatcaagcatgggttcggtgatgctatagctaaagtgggtatgactaaattcatctcagatctcttttgggttggaatgttttaccatctctataatcagttggctaccaacactcttgaacgggtagtaccgcttacccacgctgtcggcaatgtgctgaaacgggtgtttgtcattggcttctcaatcctgatcttcggaaacaagatttcaacacagacaggtataggaacagtcatagcaattgctggagtggcaatctactctttcatcaaggccaggatggaagaagagaaacgacaaatgaaagccgcatgagaagaaaaaaaggcatggaaatggaggaagtcacgggtgtaaagttatatgtctctcctcccggagataaaacaagtgacattgaatatccaactgttgttttgaagtttttttttttttttgctttttccgccatcaattttctttaattcagagtacaaaccattgctaatcttccatcagcctgtgttgactgaagaataatgtactgtcacttattctgtctctcaaaccaagcttttatctcatcagaagcttttgaaaggaagcttgaacagaatacgtgcaaaaaataaaagatatgtgaatagtatttattctcgca

SEQ ID NO: 1456 - DNA, 1270 bp, Manihot esculenta
atttgccacccctctctctctctttctgtctctgagtacaatcatggagtcgcgagtgctgtcacgggcaaccaccactaccgtccattctttgcctcatttacggaggcccatgcgagagagcagcacttcaagctttgtctcaatgaaaccaattggagctgttggtgaaggcggtaacatcatatgggggaggcagctccgtccatctctgctcctggaaagctctccagcaggaaaacgggagattctcaggcagaacatggcagccgcttcatctcctgctgagggaagcgattcctccggggatgcaaagattgctccggtaggtttctttaacaaatatccggcacttgtcaccggatttttcttcttcatgtggtacttcttgaacgtgatatttaacatacttaacaagaaaatctacaattactttccttatccttattttgtttcggtgattcatttgttcgttggagttgtgtattgcttggttagctgggccgtcggtcttcctaagcgcgctcccattgactcaaagctcttgaaggtgttgatacctgttgctttgtgtcacgcaataggccatgtgaccagtaatgtctcatttgcagcagttgctgtttccttcacccacacgatcaaagcgcttgagcccttcttcaatgctgctgcttctcaattcattctaggccagtcaattcccattactctatggctttcacttgctcctgtggtcattggtgtgtccatggcttccttgactgagctttcattcaattggctcgggttcattagtgctatgatttccaacatctccttcacttacaggagtatctactcaaagaaagctatgactgatatggacagcactaatgtctatgcttacatttccatcattgctctcattttctgtatcccgcctgccattattgttgagggaccacaactactgaatgtcgggtttaaggatgcaatagctaaagtgggcatgaccaaactcatctcggacctcttttgggtgggcatgttttatcacctatacaaccagttggctaccaacactttggagagggttgctcctctgacccatgcagttggcaatgttctcaaacgtgtatttgtgattggcttctcaatcgttgtctttggtaacaagatttcaacacaaactggtattggaacatgcatcgcaattgctggtgttgcaatctactctttcctcaaagccaagatagaagaggagaaacgacaaaagaaagcggcttga

SEQ ID NO: 1457 - DNA, 1280 bp, Ricinus communis
tttccctctcacctctctagagcacgagcaatggagtcgcgagtattgtcacgcgccaccaccactctctcctctttgcctcacttacggaggcctatgcgagagagcaatactaccagtttcgtttcaatgaaaccgatcggaactgtcggtgaaggcgggaacctgatatggggaaggcaactccggccatctctgcttttggaaagctctccagcaaccaaacgggagaatctccgcccaacaatggctgctgcttcttctcctgctgaaggaagcgattcctccggggataaagttgctccggtcggattttttgaaaaatatccggcactcgttaccggattcttcttcttcatgtggtacttcttgaacgtgatatttaacatactcaacaagaagatctacaattacttcccttatccttactttgtgtcagtgatccatttgttggttggagttgtttactgtttggttagctgggccgttggtcttcctaagcgcgccccaattgactcaaacctcctgaagctgttgatacctgttgccgtgtgtcatgcgttaggccatgtgaccagtaatgtttcatttgcagcagttgctgtctccttcactcatacaatcaaagctcttgagcccttcttcaatgctgctgcttctcaatttattttgggacagtcaatacccattacactgtggctttcacttgctcccgtggttattggtgtttccatggcatcattgactgagctctcattcaattggattggctttatcagtgctatgatttccaacatctctttcacttacaggagtatctactcgaagaaagctatgactgatatggacagcactaatatctatgcttacatttccatcattgctctctttgtctgtattccacctgccattattttcgagggacctcaattaatgaagtatggttttaatgatgcaattgctaaagtgggtacaaccaagttcatcacagacctcttctgggttggaatgttttatcacctctacaaccagttggctaccaacactttggagagggttgcacctcttacacatgcagtcggcaatgtgctgaaacgtgtgtttgtgattggcttctcaatcgttgtctttggtaacaagatttcaacacaaactgggatcggaacatgcattgcaattgctggagtggcaatgtactccttcctgaaggctaagattgaagaagagaaacgacagggaaaaacagcatgagaaggaaagaagcacccgtgaagaaagaa

SEQ ID NO: 1458 - DNA, 1700 bp, Ricinus communis
ctcctgggcgggtcgctgcctcacaaatattggagtaagatgatagaaactgaatcgaaaaggcgacaacatgtgaataaccgctcgacattgtcatttgagaaccacagaaaaaagaaaaaacggttctctcttcaccataagagctcactctagctacccaaagtacatttccctctcacctctctagagcacgagcaatggagtcgcgagtattgtcacgcgccaccaccactctctcctctttgcctcacttacggaggcctatgcgagagagcaatactaccagtttcgtttcaatgaaaccgatcggaactgtcggtgaaggcgggaacctgatatggggaaggcaactccggccatctctgcttttggaaagctctccagcaaccaaacgggagaatctccgcccaacaatggctgctgcttcttctcctgctgaaggaagcgattcctccggggataaagttgctccggtcggattttttgaaaaatatccggcactcgttaccggattcttcttcttcatgtggtacttcttgaacgtgatatttaacatactcaacaagaagatctacaattacttcccttatccttactttgtgtcagtgatccatttgttggttggagttgtttactgtttggttagctgggccgttggtcttcctaagcgcgccccaattgactcaaacctcctgaagctgttgatacctgttgccgtgtgtcatgcgttaggccatgtgaccagtaatgtttcatttgcagcagttgctgtctccttcactcatacaatcaaagctcttgagcccttcttcaatgctgctgcttctcaatttattttgggacagtcaatacccattacactgtggctttcacttgctcccgtggttattggtgtttccatggcatcattgactgagctctcattcaattggattggctttatcagtgctatgatttccaacatctctttcacttacaggagtatctactcgaagaaagctatgactgatatggacagcactaatatctatgcttacatttccatcattgctctctttgtctgtattccacctgccattattttcgagggacctcaattaatgaagtatggttttaatgatgcaattgctaaagtgggtacaaccaagttcatcacagacctcttctgggttggaatgttttatcacctctacaaccagttggctaccaacactttggagagggttgcacctcttacacatgcagtcggcaatgtgctgaaacgtgtgtttgtgattggcttctcaatcgttgtctttggtaacaagatttcaacacaaactgggatcggaacatgcattgcaattgctggagtggcaatgtactccttcctgaaggctaagattgaagaagagaaacgacagggaaaaacagcatgagaaggaaagaagcacccgtgaagaaagaagaatttgcatgtaaagagataatctattgctccaaagataaaaatgacaagtggagtatcctattgtcattgtgaatttttttttttcatcaattttctttcattcatgttcagtaaaaataatgtatgtcacttgctatgtctctcagaacaagctttatatcagttagtgagtttaacagaaagactcggaatgaattatgtgaatactaaactaaatttccacttctgatgaccaacaagatatgct

SEQ ID NO: 1459 - DNA, 1564 bp, Gossypium hirsutum
ggatacagttaatttgcgtctctccattaagagctcactcttgctagcatacacacattttcgttcgttcctttcctttccttctctctctctctagcaatggagtcgcgattgttatcacgcgcttctgttatcaccggcttacctcagctcaggccgaagctttcgccagggattgtcaacgtttcgtatgcttcggctaagccgatcggagccgtcggtgaaggcgggaacgccatatggcggaggcaactaaggccctccttgctactcgaatgctcgtcggttagcaagcgagaggttctgaaaccggtttcggctgccgcgtcgtcaccggccgagggaggaagcgattccgccggggaggggaagatcgctccggttggattcttcgagaagtatcctgctcttgttaccggatttttcttcttcatgtggtacttcttgaatgtaatattcaacattctcaacaagaagatctacaattacttcccttatccctattttgtatcggtcattcacttgttcgttggggtagtttactgtttggtgagctgggctgtaggcctccctaagcgggctcctattgattcaaacctactgaagttgttgattcctgttgctgtatgccatggacttggtcatgtaactagcaatgtctcctttgcagctgttgctgtttctttcacccacactatcaaagctcttgagcctttcttcaacgctgctgcttcccagttcatacttggacaatcaataccaatcactctatggttgtctcttgctcctgttgttattggtgtatccatggcatcactgactgagctgtcattcaattggacgggtttcattagcgcaatgatttccaacatctccttcacttacaggagtatctattccaagaaagctatgacggatatggacagtacaaatgtctatgcttatatttccatcattgctctcttcgtctgtattcccccagccctcatttttgagggtcctcaattgttgaagcatggtttcaatgatgctattgctaaagtgggtatgactaagttcatctcagatcttttctgggtgggaatgttctaccatctctataatcagttggctaccaatactctggagcgggtggcaccactgacccatgcagtgggcaacgtgctgaaacgtgtatttgtcattggcttctcaatcattgtctttggaaacaagatttcaactcagactggtataggaacagccgtagcaattgctggagtggccgcctactctttcatcaaggccaagatggaagaagagaaacgacaaatgaaagcagcatgagaataaaaaaggaggcaaggaaattggaggaagtcctgatgaagaccaaatttgattttaccttgctgttattgtgaagtttttatttttccctctttcttctcttatcatttcattttattttttcttttaaaattcagagaacaacctatttataactgtggatcagcctgtgttgactgaaaaataatgtgtactgctattacttgttctgtctctcaaattaagctttatttca

SEQ ID NO: 1460 - DNA, 1436 bp, Cleome spinosa
cgcgaaaacaccatatttcgcttccctcatcatctcactgtcagatattttgtcgaatcaccatcaccgtcgtcgtcatggagtcacgcgtgctctcacgcgccgccgcaaccgtcgccgggtctccgttcctcagacggatccatcgccctcacaaccaccacgtccccaccacagtgactttcccggcggcggtctgtgacggcggcaacgtgatctccggccgacagctccgcccgatcctgcttctggagagctcctccgcggcagcggtctcagacggtgggaggagagagattctccggccgccgcgagctgccgcttcgtcgtccgccgggagtgggaattccgccggggaagcgaaggtggggttcttcgacaagtacccggcgctcgtcaccggcttcttcttcttcatgtggtacttcttgaacgtgatattcaacatcctcaacaagaagatttacaattatttcccttacccctatttcgtatcgcttattcacttgttcgttggagtcgtctattgcttagtgagctgggctgtgggccttcctaaacgggccccgatagacgcgaacctactgaaggtgttgataccagtggcggtctgtcacgccattggccatgtgaccagtaacgtctccttcgctgccgttgctgtttccttcactcacaccatcaaagctctcgagccgttcttcaatgcttctgcttcgcagttcatactcggacagcctatccctatcacattgtggctctctcttgctcctgtcgtcctcggagtttccatggcttccttgaccgagctctcattcaactggactggtttcatcagtgccatgatttccaacatctctttcacatacagaagcatctattccaagaaagccatgactgatatggacagcacgaacgtgtacgcttacatctccatcatcgcgctctttgtctgcattcctcccgccgtcatcgttgaagggcctcaattgctgaaacacggattcagcgaagcaattgccaaagtgggtatgaccaaattcatatctgatctcttctgggtcggaatgttttaccacctctacaaccagctggctaccaacaccttggagagggttgcaccgctgactcatgcggttgggaacgttctgaaacgtgttttcgtgatcggtttctcaatcatagtcttcggaaacaagatttctactcaaactggaatagggacatgcatagccatagctggagttgccatgtactctttgattaaggccaggttggaagaagagaaacggaaaggaaaggctgcatagagagccaaagcgagaggaggaggaggaggaggaggaggagccatgatcttttgtttgggtataaataataacgaaatgcaatgttggaaattgtattaccattgtttctttttaatcttatttttg

SEQ ID NO: 1461 - DNA, 1890 bp, Euphorbia peplus
tgttatcacgcgccaccaccacctccgtcgtctcattacctcacctccgcagagcttcccgcgacggaagcaatggttcaagccttgtctcaatgaagccgatcggagccgtcggtgaagctgggaacctcatatggggaagacaactccgtccctctctgctcctcgagagcagctctccaaaacgtgaaaatctccggcctgttatggccggtgctgcttctactccggctgcaggaggcgattcctccggggaggctccggtcgggtttttggacaagtatccggctcttgtcacgggctttttcttcttcatgtggtacttcttgaatgtgattttcaacatattgaacaagaagatctacaattactttccctatccttacttcgtatcagtgattcatctgttcgtaggagttgtgtactgtttgggtagctgggccgttggccttcctaagcgcgctccaatcgactcaaagctcctcggtgttttggttccagttgcagtgtgtcacgcactaggtcatgtaacgagcaacatctcttttgcagcagttgctgtgtcattcacccatactatcaaagcactcgagcccttcttcaatgcttctgcttctcaatttattcttggacagccaatcccactttctctatggctttcacttgctcctgttgttcttggtgtgtccatggcatcgttgaccgaactctcattcaactggttgggattcattagtgctatgatttccaacatctccttcacttaccggagtatctactccaagaaagctatgactgatatggacagcactaatgtctatgcttacatttccatcattgctctctttgtctgtattcccccggccataatcttcgagggtcctcaactgttgaagcacgggtttagtgatgccattgctaaagtgggtatgactaagttcattacagacctcttttgggtaggaatgttctatcatctttacaaccagctggctaccaacactttagagagggttgctccgcttacacacgcagttggcaatgtgctgaaacgtgtgttcgtgatcggcttctcgatcgtgatcttcggcaacaagatttcaacccaaactggtattgggacatgcattgctattgctggagtggcaatctactctttccttaaggcgaagatagaagaagagaaacgacaagcgaaggcagcataggagttgaagaaacatggcgtgtaaagtgaaagtgtgatgtggttgtacccaagaaaataatgacaaatgaagtatcttttcttatttgtgtcttttgtgaagttattttttaaccgattttctttcattcatgttcactcaaaataatgtacattgcctgctctgtttcccagaaccggcctaccattatattagaagttctcaagtgagcttatcggaatcagaatgagaatttatatatgtagatgttaatttgcggttatctaatgaagactaagatcatatcggcttcatttatcctcagctcaacaagctaaacaatttgatctgaaatagctttttgaaacatgttacaaaaaaaaaaaaaaaaagaaaggatagaaaggtatcataagaggaggtatcagatatatttctacatatgttgatgagaagaaccagatagtaggagagtaggtaaagtaccttaccagagtagtaaagacgatagttgtctccccattggtaggtacggtagggtaccgggtacgttgactgtactaagaccctagccttggagtacgtcgtacgtacggttacctaacctaacttaccgaaacgttcacggtaacgcggtaacctagtaaagtacgttaaccttagttaccgtaacgttacgtaacgttaggaaacttcggttaaa

SEQ ID NO: 1462 - DNA, 1623 bp, Gossypium raimondii
actcttatctaagaggatagccatttgattctctcttcctctcagtaacaatggagtcgcggttgttgtcacgcgcttccaccattgccggcttgcctcagatcaggccgaagctttcgcgagactgtctcagtgtttcgtttgcttcggctaagcctatcggagccgtcggagaaggcgggaacgtgatatgggggagacagctaaggccgtcgctgttgctcgagagctcgctggccaataaacgggagattttgaagccggttctagcttccgcgtcgtcggcggccgggggaggaagcgattccgccggggacgctgagatcgctccggttggattcttccaaaagtatcccgctcttgttactggcttcttcttcttcatgtggtacttcttaaatgtaatctttaacattctcaacaagaagatctacaattacttcccttatccctattttgtgtcagttattcacttgttcgttggggtggtatattgtttgatcagctgggccgttggcctccctaagcgagctcctattgattcaaacctactgaagttgttgatccctgttgccgtatgccatgcattgggccatgtaactagcaatgtctcctttgcagctgttgctgtgtctttcacccacacaatcaaagctcttgagcctttcttcaatgctgctgcttcccaattcatacttggacaatccattccattaactctatggctgtctcttgctcctgttgttattggtgtatcgatggcatcactgactgagctgtcgttcaattggacgggtttcattagtgcaatgatttctaacatttcattcacttacaggagtatctattccaagaaagctatgaccgatatggacagtacaaatgtctacgcttatatttccatcattgcgctcttcgtctgtattcctccggccatcatttttgagggccctcaattaatgaagcatggtttcactgatgctattgctaaagttggtatgactaaattcatctcggatctcttttgggtgggtatgttttaccatctctacaatcagttggctaccaacacactagagcgggtggcaccactcactcatgcagttggcaatgtgctgaaacgtgtgtttgtcattggcttctcaatcctggcctttggaaacaagatttcaacacagacaggtattggaacagccatagctattgctggagtggcaatgtactctttcatcaaggccaggatggaagaagagaaacgacaaatgaaagcagcatgagaagaaaagaggcaaggaaatggaggaagcaaaggaaagggggtgtaaagttaggtctttcctcatgaagatttttaaaaaaaatttaaagaaaaagatgacattgaatatcctgctgctgtttttgttcaattataataattattatttccatcaattttcttttaattagtatcccaaaaccatggctaattttcaagcagtcagtagtgactgaaaataatgtatgatcacacctactttcctctctcagattaagcactgtttcctttagaagctttaatgagttgcatgaacccggaaaattctactctacgtttcagcatatatcgaaatttctaattaa

SEQ ID NO: 1463 - DNA, 1533 bp, Manihot esculenta
aaaaattagttccctctccgccataagagcttactccagcgactgaaagcatatttctctctctctctctctctctcgctctgattgtagccatggagtcgcgagtgttatcacgcgcaaccaccgccatcgggtccttgcctcccttacggaggtccatgcgagagtgcaacgcttctagctttgtctcaatgaagcctatcggagccgttggtgaaggtggtaatctcatatgggggagacaactcaggccatatcttctcctggatagctctccaacaggaaagcgggagatccttcgaccgaacatggcagccgcttcatctccggctgagggaagcgattcctcaggggatgcaaaggttgctccggtcgggttctttgaaaaatacccggcacttgtcactggttttttcttcttcatgtggtacttcttgaacgtgatatttaacatcctgaacaagaagatctacaattactttccttatccttattttgtgtccgtgattcatttattcgttggagttgtgtactgtttagtgagctgggctgttggtcttcccaagcgcgctcccattgactcaaacctcttgaagctgttgatacctgttgctctgtgtcacgcaataggccatgtgactagtaatgtctcatttgcagcagttgctgtctcattcacccacacgatcaaagcgctcgagcccttcttcaatgctgctgcttctcaattcattctaggacagtcaattcccttaagcctatggctttcacttgcccctgtggtcattggtgtatccatggcatcattgactgagctctcattcaactggattggcttcattagcgctatgatttcaaacatctccttcacttacaggagtatctactcaaagaaagcaatgactgatatggacagcactaatctctatgcatacatttccatcattgctctcattgcctgtattccacctgccattattcttgagggacctcaactactcaagtatggatttaacgatgcaattgctaaagtgggcatggtcaaattcgtctcagacctcttttgggtaggcatgttttatcacctctacaaccagttggctaccaacactttggagagggtggcaccccttacacatgcagttggcaatgtactgaaacgtgtatttgtgattggcttctcaatcgtggtctttggcaacaagatctcaacacaaactggtattggaacaagcattgctattgctggagtggcaatctactccttcctcaaggctaagatagaagaggagaaacgacaaaagaaagcggcatgagaaggaaaggaaggaaactttggctgtaaagtgttatttccattgttccaattctcaaagataaaaatgacaaatcgagtattcaatttgtcattgtgatgtctttttatttaatcaattttcttcaattcatgttcacttgaaataatgtacatttcttgctctgtctctcagaacaagttcaataagattagaagctctacagtagtttaacaac

SEQ ID NO: 1464 - DNA, 1597 bp, Chelidonium majus
tttttttgcagaaaaacactcaagaattaacaatggagtccagagtgctatccggcgccacctccacctccgccggtctcattcgacttagaaagccggcgcgagattctaattctactactactgcttcattcctctccaccaaatccatcggagatgttagtggtggcgggaatctcatctggggaagacaactccgaccatctctactcctcgagaagtctccgatgattaagctttcatctgggaaaagagaaatcctgaaaccaattctggcagccgcttcatctccatcaggaggaagcgattccgccggggaagctaaagctaaagttgggttcttggaaaagtacccagctcttgtcactggtttcttcttcttcatgtggtatttcttgaacgtgattttcaacattcttaacaagaagatctacaattacttcccatacccttattttgtatcggtggtgcatctgttcgttggtgttgtttattgtaccatcagctggggtgttggtctccccaaacgcgctccaatggactctaaccaactgaagctactcattccggtcgctgtgtgccacgctctcggccatgtgaccagtaacgtctcattcgctgcagttgccgtctcattcacccacacaatcaaagctcttgaacccttcttcaacgcttccgcttctcaattcatactcggacaaccgataccaattacactatggctatctctagcccctgttgtccttggtgtatcaatggcatctctaactgagctctcattcaactggctgggtttcattagtgccatgatctccaacatctccttcacctacaggagtatctactcaaagaaagccatgactgatatggatagtacaaatctctatgcctacatttcaatcattgctcttttcgtctgtattccaccggccatcctcattgagggaccccaactgttgaagcatggtttcagtgacgcaattgcaaaagtgggtctagtgaagttcatttcagatctcttttgggtcgggatgttttaccacctctacaaccagttagcaactaacacccttgagagagtagcacctcttacgcacgcagttggcaatgtcttgaaacgtgttttcgtgattggtttctcaatcgtaatctttggcaacaaaatttcaacgcaaaccgccattgggacaagcattgcaattgctggagtagcactttactcgtacatcaaagcaaagattgaagaagagaagaggcaagcaaaagctgcttaagaggaaaggagtatggagttgaaggaagaactggtgcaggtgtaaatgtcagtcttaccaaaactatcagttgaagcacctcctgtagttgtgaagttctcaattaattttttgtttcttgttttcttttatatcttgctgttcactggtttccagtgtaaataatagctgatttgcagttatcaattgtggatgaaataatatctctgttttcaatcaaatttcatttctagaacccagaaagctacttagctatgtgatggaaacaagtatatgaatttcgtataagaataataggagtgggaacatctggtttttga

SEQ ID NO: 1465 - DNA, 1665 bp, Fragaria vesca
aacgaatgaaaacaaacccaattaaccgctctctgcctcctccactccataagagctagctcactctagtcatatcctcccaaaccaaaaaccatggagtcgcgagtgttgtcacgcgccaccgccttcgcctcctccgtcccctccctccgtaagtcgtccccgcgccaccccgccgcagtctctttcgccgcctcgcctcgccgcccgatcggcgccgtcagcgagggcgggaacttgatctgggggaggcagctccgtccggcgctgctcctcgaggcctcgccgtcgccgtcgaggagggacgctctcaagccgtgccgtgccgccgccgccgggggtagcgattccgccggagaagcgaagcccgctccggtcgggttcctcgggaagtacccgtggctggtcaccggcttcttcttcttcatgtggtactttctgaacgtgattttcaacattttgaacaagaagatctacaactacttcccgtatccatactttgtgtcggtgatacacttggcagttggggtggtttactgtctgatcagctgggccgttggccttcctaagcgcgctcctatggactcgaaccaattgaagttgctcatccctgttgcggcgtgccacgcactcgggcacgtcaccagcaatgtctcatttgcagccgttgctgtctcattcacacacaccatcaaagctcttgagccatttttcaatgcctctgcttctcaattcatacttggacaatcaatccccttgtccttgtggttgtctctggctcctgttgttcttggtgtgtcaatggcatcactcactgagttgtcattcaactggcttggattcattagtgctatgatttcaaatatctccttcacttataggagtatctattcaaagaaagccatgactgatatggatagtaccaatttgtacgcttacatttcaatcatcgcactctttttctgccttccacctgctctcattttggagggacctcaactgcttaagcacggctttgctgatgcaattgctaaagtaggccttgtcaaattcattactgatctcgtctgggtggggttgttttaccatctctacaatcagctggccaccaacacccttgagagagtggcacctcttacacacgcagttggaaatgtgttgaaacgtgtgtttgtgattgggttctcaatcgtaatctttggtaacaagatttcaacacaaactggtattggaacggccattgcaattgctggagttgctatctactcttacctcaaggccaagatagaggaagagaaacgacaagcaaaagctgcatgagaagaaaggaagaatgggacatcgaggaaatctcacattgtaaatttcatgaatttccttcaggttggaatggcagattgagtatctattatctatgtcagagtttgttcaatttcctcttccctttttcccgcattgattcagaatacaaacacattctaattttcaatggtctcaataatgtatcaatttaatctgcccctcatatagagctcttaatcttgaagtctcccattgacagattgaataagtgattagcataataagtgagttttgcattcccattttatgtcttggaagttgtaactgcacctcaagcaagctcaatgcaacaactctatccct

SEQ ID NO: 1466 - DNA, 1383 bp, Raphanus sativus
agagagattctcaagccggttagagccgccgctgcagaaggtggtgattcagctggggagacgaaagtttgattcctcgggaagtatccatggctcgtcaccggattcttcttcttcatgtggtacttcttgaacgtgattttcaacatccttaacaagaagatctacaattacttcccttacccctattttgtatcggttattcacttgttcgttggagttgtctactgcttgctgagctggtccgtgggacttcctaaacgggcaccaattaactcgaacatcctcaaggtattgataccagttgcagtctgtcacgccataggccatgtcactagcaacgtttccttcgccgctgtcgctgtctccttcactcacaccatcaaagcgctggagccattcttcaatgcgtctgcttctcagttccttcttggacaaccgatccccataacactatggttgtctttagctcctgttgtactcggagttgcgatggcttcgctcactgagttgtcgttcaactggcttggtttcatcagcgcgatgatatcaaacatctctttcacttaccgaagcatcttctccaagaaagccatgactgatatggacagtacaaatgtctacgcttacatctccattatcgctctcttcgtttgccttcctcctgccatcatcgtcgaagggcctcagctattgaaacatggtttcaacgacgcgattgctaaagtgggaatgactaagttcatctctgatctcttctgggttggaatgttttaccatctctacaaccagttggctactaatacattggagagggtagcaccattgactcacgctgttggaaacgttctgaaacgtgtctttgtgattgggttctccatcgttatcttcggaaacaagatatcgacgcagacaggcatcggaactggaatagccattgctggagttgcactctactctgtcattaaggccaagatcgaagaagagaaacggcaaggtaagacggcatagagagcggaggctgacggcggtggacagttgcataaacaattcctcctatgaatatctatataataaataaccaaaaatatgcactagtatcttgtatcgtacaatcaaacattgtttttgagtttcgcttctcgtttatatatatttttttatattctgcgtcttttccttcccgtggagaacattgttgccatttcttctgcattgcacttatcttagcagatgaaaagcataataatgtatttattcttttctctttctcttggagcattttacccatcatcttggacttaaatttttgtctttctgtaatttttcttttcttgggaattttgctcaccctacaatgatttatataactacaacttgttt

SEQ ID NO: 1467 - DNA, 1537 bp, Fagus grandifolia
tattatattccctcaacactctcacaccgtccatcaaattattcattactctctcattctcttcacactcatcatactggtggatctatattcttttagcgtgagcccgcgtagcactggattaaacaatttaactaataagaacagtataagaccactcttctcttcactctaaaacggttcgcattactctctgctgcacattcctccctcgacaccatggagtcgcgagtgttgtcacgcgccaccaccttcgcttccttctctcaactccgcaagccaccgagagagaacaacaacagcagcaacagcgttagcttcgtctcggcgaggccgatcggagcagtgggagaaggaggaaacctgatatgggggaggcagctccgaccaattctgcttctagagagctcagggaagccgcgtttggcggcggcttcttcttcgccagccgaagggagcgattccgccggggaagcgaagatagctccggtcgggttcttgaacaagtacccatttttaattaccggcttcttcttcttcatgtggtatttcttgaacgtgattttcaacatcctgaacaagaagatttacaattacttcccgtatccctactttgtctcggttgtgcacttgtttgtcggggtggtatactgtttggtgagctgggccgtgggccttcctaagcgagctcctattgactccaacctcttgaagctgctcattcctgttgccgtgtgtcatgcacttggccacgtgaccagcaatgtctcatttgcagctgttgctgtatcattcacacatacaatcaaagctcttgagcccttcttcaatgctgctgcgtctcaattcatacttgggcaatcaatacccatcactttatggttgtctctggctcctgttgttcttggtgtgtcaatggcatcattgactgagctgtcattcaactgggttggcttcatcagtgctatgatttccaacatttcctttacttacaggagtatctattcaaagaaagccatgactgacatggatagtactaatctctatgcttacatttccatcattgctctctttgtctgcattccacctgccatcattttggagggacctcaactgatgaagtatggcttcagtgatgcaatcacaaaagtaggtcaaaccaagttcatctcggaccttttttgggtgggaatgttttaccacctttataatcagttggccaccaacaccctggagagggtggcacctcttacacatgcggttggaaatgtgttgaaacgtgtttttgtcattggattctcaatcataatcttcggtaacaagatttcaacacaaactggtattggaactgctattgcaattgctggagtggcaatctactcttacatcaaggccaagatggaagaagagaaacgagcatcgaaagcagcctaagaagaaaaagaggcgtggacaaggagcaatcatgtgttgtaaattttaaatatttccttccgaagagagattacaaaatcagtatcctatgtggtagttcatt

SEQ ID NO: 1468 - DNA, 1804 bp, Populus trichocarpa
aaaaaaaaaaatctccctccattatttctacaaaaagttcccatgttcctacttaactctcaagcacgtgcctgccgttgatcatatcttgtaactctgatccgtgatcccgttgattctcgaatgcgccaatcaaacggtagcacattgtaatattgtgctccccgaatcacaggataaaagagtaacttgaaaagcagagcaagaggaaattaaccgctcttccagagccagaaaaacaaacggttttacgagctcactctagctaccaatatcacattttcctctctctcaaagtccagcaatggagtcacgcgtcttgtctcgtgccaccaccgtcgctcacgtgcgtaggccactgcgagagagcaacggcaacactagttgcagcctcttgtcaatcaaaccgatcggagcagtcagtgagggcgggaatctgatatggggaaggcaacttcggccgtctcttcttctagaagcatcttatccggttaccgcaaggaaggagattctccggccggttatggcagcggcttcgtctcctgcagaaggaagtgattcctccggggatgggaaggtggctccggttgggtttttcgacaaatatccagctcttgttaccggttttttcttcttcatgtggtactttttgaacgtgatatttaacatacttaacaagaagatttacaattacttcccctatccatattttgtgtcggtgattcatttgtttgttggggtggtatactgtttggtgagctgggctgtgggccttcctaagcgcgctcctattgactcaaatctcctgaagctgttgattcctgttgctgtctgtcatgcattaggtcatgtgactagtaatgtctcatttgcagcggttgctgtctcctttactcacacaataaaagcacttgagcccttcttcaatgctgctgcttctcagttcatattgggacaacaaatacccataactctatggctatcgcttgcgcctgtcgttcttggtgtgtccatggcatcattgaccgagctctcatttaattggactggctttattagtgctatgatttccaacatctccttcacttacaggagtatctactcaaagaaagctatgactgatatggacagcactaatatttatgcttacatttccatcattgcgctcattgtctgcattccacctgccattattttcgagggaccccaactgatcaagcatggctttagtgatggaattgctaaagtgggtctaaccaaattcatctcagacctcttttgggttggaatgttttatcacctctacaatcagttggctaccaacaccttggagagggttgcacctcttacacacgcagtgggcaatgtgctgaaacgtgtgtttgtgattggcttttccatcgtaatctttggtaacaaaatttcaacacaaactggtatcggaactgccgttgcaattgccggagtggcgacctactcttacatcaaggccaagatggaagaggagaaacgacaagggaaagcagcatgagaaggaaagaggcattggccatgggcgaggtaaccttgtttgtaaagtaaaatcccactgttccgatgataaaaatgacaaaatgagctagcatcttgttgtcattatggagttattttttctttcatcaatcttgtttgattcagagtacagactattgctaatttgcaatcagcttatgttcaatagagaaataatgcatcacttgctctgtctctcacaacgagcttgtatgattagaggctgcagagggaatataattggcagttcttg

SEQ ID NO: 1469 - DNA, 1995 bp, Populus trichocarpa
atatcaaattaaaaagaaaaatctccctccattatttctaccttggcatctcccccataaaatattcccatattcttacttaactctcaaacacgtgttcaccgttgattaggtcgcgtgacccacacgggattcttcaaccctgatccgctactcccttattctaaatcaaaagcatcagagaggtcgtgcattgtattaacgtacaccgcgaagcaggggatagcgagtaaattgaaaaagcggaacaggaggcaattaaccgctctctcgaggggggaaaaaaaagggtttaagagctcactctaggtactaatatcacatttctctctctctctctctctctctcgatcgaagttcagccatggagtcacgcgtcttttcacatgccaccaccatcgctcacgtgcgtaggccactgcgagagagccacagcaacaccagttgcagcttcatctcgatcaaaccgatcggagcagtcggtgaaggcgggaatctgatatggggaaggcaactgcggccgtcattgcttctggaagcatcttctccgatgaatgcaaggaaggatattctccggccggttatggctgcagcttcatctccggcagaaggaagtgattcctccggggatgggaaggtcgctccgattgggtttttcgacaagtatccggctcttgtaaccggctttttcttcttcatgtggtactttttgaacgtgatatttaacatccttaacaagaagatttacaattacttcccttatccatattttgtttcggtgattcatttgtttgttggagtggtgtactgtttggtgagctggactgtgggccttccaaagcgcgctcctattgactcaaatctcctgaagctgttgattcccgttgctgtctgtcatgcattaggccatgtgaccagtaatgtctcctttgcggcggttgctgtctcctttacacacacaatcaaagcacttgaacccttcttcaatgctgctgcttctcaattcgtattgggacagtcaataccgataactctgtggctatcacttctgcctgtcgttcttggtgtgtccatggcatcattgactgagctctcattcaattggacgggctttattagtgctatgatttccaacatctccttcacttacaggagtctctactcaaagaaagctatgactgatatggacagcactaacatttatgcttacatttccatcattgcactccttgtctgcattccacctgccattcttgtcgagggacctcaactgatcaagcatggctttaatgatgcaattgctaaagtgggcctaaccaagttcatctcagaccttttttgggttggaatgttttatcacctctacaatcagttggctaccaacaccttggagagggttgcacctcttacacatgcagtgggcaatgtgctgaaacgtgtattcgtgattggcttttccatcctgatctttggtaacaaaatctcaacacaaactggtattggaacaggaattgcaattgccggagtggcaacctactcttacattaaggccaagatggaagaggagaaacgacgagggaaagcagcatgagaaggaaagaggcattggccgtgggtgaaggaaaccttgtttgtaaagtcaaattctactgctccgaagataagagtatcctgttgtcattgtgaagttattttttcccattaattttcgttgattcagagtacagactattgctaagttgcaatcagcttatgttgactagaaataatgaatcatttgctctgtctctcacaatgagctttaatgattagaagctgcagagggagtttaatagaatgagtggaaatgaaatatgcatcgccacttgcagagaagttttttttttaggttcacttggggatgcagcagcgtgatagaggaggcggtgtaactgttggagaaatccgaggttgcattccatacaaaaatcctagctttccgcgaaagatagaaaa

SEQ ID NO: 1470 - DNA, 1623 bp, Gossypium hirsutum
cttatctaagaggatagccatttgattctctcttcctctcagtaacaatggagtcgcggttgttgtcacgcgcttccaccattgccggcttgcctcagatcaggccgaagctttcgcgagactgtctcagtgtttcgtttgcttcggctaagcctatcggagccgtcggagaaggcgggaacgtgatatgggggagacagctaaggccgtcgctgttgctcgagagctcgctggccaataaacgggagattttgaagccggttctagcttccgcgtcgtcggcggccgggggaggaagcgattccgccggggacgctgagatcgctccggttggattcttccaaaagtatcccgctcttgttactggcttcttcttcttcatgtggtacttcttaaatgtaatctttaacattctcaacaagaagatctacaattacttcccttatccctattttgtgtcagttattcacttgttcgttggggtgatatattgtttgatcagctgggccgttggcctccctaagcgagctcctattgattcaaacctactgaagttgttgatccctgttgccgtatgccatgcattgggccatgtaactagcaatgtctcctttgcagctgttgctgtgtctttcacccacacaatcaaagctcttgagcctttcttcaatgctgctgcttcccaattcatacttggacaatccattccattaactctatggctgtctcttgctcctgttgttattggtgtatcgatggcatcactgactgagctgtcgttcaattggacgggtttcattagtgcaatgatttctaacatttcattcacttacaggagtatctattccaagaaagctatgaccgatatggacagtacaaatgtctacgcttatatttccatcattgcgctcttcgtctgtattcctccggccatcatttttgagggccctcaattaatgaagcatggtttcactgatgctattgctaaagttggtatgactaaattcatctcggatctcttttgggtgggtatgttttaccatctctacaatcagttggctaccaacacactagagcgggtggcaccactcactcatgcagttggcaatgtgctgaaacgtgtgtttgtcattggcttctcaatcctggcctttggaaacaagatttcaacacagacaggtattggaacagccatagctattgctggagtggcaatgtactctttcatcaaggccaggatggaagaagagaaacgacaaatgaaagcagcatgagaagaaaagaggcaaggaaatggaggaagcaaaggaaagggggtgtaaagttaggtctttcctcatgaagatttttaaaaaaattaaaaaaaaagatgacattgaatatcctgcttctgtttttgttcaattataataattattatttccatcagttttcttttaattagtatcccaaaaccatcgctaattttcaagcagactgaaaataatgtatgatcacacctactttcctctcagattaagcactgtttcctttagaagctttaatgagttgcatgaacccggaaaattctactctacgtttcagcatatatcgaaatttctaattaaagtgtagatgttaaca

SEQ ID NO: 1471 - DNA, 1555 bp, Panax ginseng
aagcagtggtatcaacgcagagtacatggggatacctgagctgcttagctcgctgtactacctcacaacccacaagcattttctctctccaaacccaatggagtcccgagtactctccggcgccaccaccatctatggtatcccacggctgagcaagccagtggcgaagctgaacaccgtcactttctccacctcgaggtcgatcagagccgtcagcgacggcggaaacctcatttggggaaggcagctccggccagccatactcctcgagacctcgccggcaagtaagcgcgagattctcaagccaaccttcgccgctgcgtcgtcgccggccgagggcagtgattccggcggggatgctaaggttggtccggtcgggttcttacagaagtatccggcacttgtgaccgggttctttttcttcatgtggtattttcttaacgtgatcttcaacatactgaacaagaagatctacaattactttccttatccttattttgtatctgttattcatttggccgttggagtagtttactgtttggggagctggactgtgggccttcccaagcgcgctcctatcgactcgaacctcctgaagttgctcatccctgttgctgtgtgccatgctctaggccacgtgaccagcaacgtctcatttgcagctgttgccgtttcatttactcacacagttaaagcgctggagcctttcttcaatgctgctgcttctcaattcatacttgggcaatcaattccgataactctttggttatcactagctccagtcgtgcttggtgtgtcaatggcatcattgactgagctgtcattcaactggttgggcttcatcagtgctatgatttccaatatctcctttacttacaggagtatatattcaaagaaagccatgactgacatggatagtactaatttgtacgcctacatttccatcattgccctctttgtgtgtataccacccgccattattttggagggacctcagcttcttaagcatggtttttcagatgccatagctaaagtgggtctgacaaagtttatctcagatcttttttgggtgggaatgttttatcacctctataatcagttggcaaccaacacccttgaaagggtggcaccccttacgcatgcagtcggcaatgtgttgaaacgtgtgtttgtgattggcttctcaattgtgatctttggcaacaagatttcaacacaaacagccattggaacaagcattgcaattgctggagtggcaatgtactcgttcatcaaggccaagattgaggaagagaaacgacaagcgaaagcagcttgagaagtaaagatttcaagggcatgaaagggtttaaatgtgttttccttccaaagaaagaggtcaaattgttgttgtgaattaagttacctatttttttttatcaatatttctttgtttcagagtacaaacaattgctaatctgcaatccatcccacgttaactggaataatatatcattctgacctaacaaaaaaaaaaaaaacaaaaaaaaacaaaaaaaaaacaaaaaagaaagta

SEQ ID NO: 1472 - DNA, 1570 bp, Euonymus alatus
acggcacaaaacggttttttctcttcccagtgtttggacacgaataccacagcatttctcagtgtgagtacaactatggagtcgcgggtgctttcacgcgctgccgcattttccgccgtaccgcgcctgccgcgagagagtggaaactctggaagcgtcgttgcggtgaggccgatcggagctattggcgagggcgggaacttgatatgggggaggcagctcaggccggctctgctgctagagagctcgcctgcgtcgtgcgtcttgtctgggaagagggagaatctgcgcccgtgcttcgctgccgcttcctctcccgccgaggggagtgattccgcaggggaacagaaggttgttccagttggcttctttaacaagtacccggctctggttaccggtttcttcttcttcatgtggtacttcctgaacgtgatattcaacatactaaacaagaagatctacaattacttcccctatccatactttgtgtcagttattcatttgctggttggcgtcgtgtactgtttggtgagctgggccgtgggccttccgaagcgtgcaccgattgactcaaaacttttgaagctgttgatccctgttgctgtatgtcatgcattaggccatgtgactagtaatatatcgtttgcagcagtagctgtctctttcacccacacaatcaaagctcttgagccgttcttcaatgcttctgcttctcagttcctactaggacaaccgatacccgttactctatggctttctctggctcctgttgtccttggtgtgtccatggcatcactgactgagctgtcattcaattggactggcttcattagtgctatgatttccaacatctccttcacatacaggagtttatactcaaagaaagccatgactgatatggacagtactaatgtctatgcatacatttccataattgctctctttgtttgtattccaccagccatcatctttgagggaccacaactgatgaagcatggttttaacgatgcaattactaaagtgggaacaaccaagttcatctcagacctcttttgggtgggaatgttttatcacctttacaaccagttggctaccaatacccttgagagggttgctcctcttacacatgcagttggcaatgtgctgaaacgtgtatttgtgattggattttcaatcttggtctttggaaacaagatatcaacacaaacaggtatcggtacatgcattgcaattgctggagtggcaatctactcttacatcaaagcccagatagaagaagagaaaagaagaactaaagcagcttgagaagacttgaagggtggggatggagccttcttgggcgaaaatcaattcctgtgatgtcgaaaatgaaaaataaatttgagtttattgtttatgttttccagttattttttgctgaaacttcctctattccgtgaacaaacagtcgcaaattagcattgtgctattgtttggctatcaataatgtaatattcagtctctcaaaccagcttatatatgtccaaacgcttttgggggaatttgacaaggaatgataactaatgctccg

SEQ ID NO: 1473 - DNA, 1228 bp, Euphorbia esula
taccttccttttctctctaatcaccaccatggagtcgcgagtgttgtcacgcgccactacctccgccgtcgtttccttacctcacctccgaagagcttcacgcgatggaagtaatgcttcaagccttgtctcaatgaaaccaatcggagccgtcggtgaagccgggaacctcatatggggaagacaactccgtccgtcgctgctcctcgagagcagctctccagctgcaaaacgtgaaattctccggcctattatggccgctgcttcttctccggctgcaggaggcgattcctccggggatgggaaggtcgctccggtcgggtttttggaaaagtatccggcactagtcaccgggtttttcttcttcatgtggtacttcttgaatgtgattttcaacatattgaacaagaagatctacaattactttccttatccttacttcgtatcggtgattcatctgttcgtaggagttgtgtactgtttgggtagctgggccgttgggcttcctaagcgcgctccaattgactcaaagctcctaggtgttctgatccctgtggctgtgtgtcacgcgctaggccatgtaacaagcaacatctcatttgcagcagttgctgtgtcattcacccataccatcaaagcactggagcccttcttcaatgctgctgcttctcaatttattcttggacagtcaatcccactctctctatggctttcacttgctcctgttgttcttggtgtgtccatggcatcactaactgaactctcattcaactggctgggattcattagtgctatgatctccaacatctccttcacttacaggagtatctactccaagaaagccatgactgatatggacagcactaacgtctatgcttacatttccatcattgctctcttcgtctgccttcccccggccataatcatcgagggtcctcaactgttgaagcacgggttcagtgatgcaattgctaaagtgggtatgactaagttcattacagacctcttctgggttggaatgttctatcatctctacaaccagctggctaccaacactttggagagggttgcgcctcttacacacgcagttgggaatgtgctgaaacgtgtgtttgtgatcggtttctcgatcgtgatctttggcaataagatttcaacccaaactggtattgggacatgcattgctattgctggagtggcaatctactcttaccttaaggcaaagata

SEQ ID NO: 1474 - DNA, 1794 bp, Quercus alba
cacacacacattgtcacaattcacatactcccccccagcgctctcccaccgttcatcgaatcattcactaatccctgatcctcgtcacactggtgtatcaaattttttaacgtgaactcgcgaggcactggattaaaaccgttttaacatcgctaccactcttctctgttggtgtgaataagagctgtgtttagcaaccacaagtacattttggatttctctctctctatctcttagaaaaccatggagtcgcgagtgttgtcacgcgctagcaccttcgcttcactctctcagctccgaaagccaccaagagagaacaacaacaacaacaatagcgtaagctttgtctcggcgaggccgattggagctgtgggagaaggtgggaacttgatatgggggaggcagctccgaccagctctgttgcttgagagctcatcggctgggaagcagagagagagtgtgaagccttgtttggcggcggcttcatcgtctccagggagcgattccgccggggaagcgaagcctgtcggtttcatcgagaagtacccggctctcgttactggcttcttcttcttcatgtggtatttcctgaacgtgattttcaacatcctgaacaagaagatctacaattattttccgtatccctactttgtctcggttgtgcacttgtttgtcggggtggtgtactgtttggtcagctgggctgtgggccttcctaagcgcgctcctatggactcgaacctcttgaagctgctcttccctgttgccgtgtgtcatgcacttggccatgtgaccagcaatgtctcatttgcagcagttgctgtctcattcacacatacaatcaaagctcttgagcccttcttcaatgctgctgcctctcaattcatacttgggcaatcaatacctatcactttatggttgtctctggctcctgttgttcttggtgtgtcaatggcatcattgactgagctgtcattcaactgggttggcttcattagtgctatgatttccaacatttcctttacttacaggagtatctattcaaagaaagccatgactgacatggacagtactaatctctatgcttacatttccatcattgctctgtttgtctgtattccacctgccatcattttggagggacctaaactgatgaagcatggcttcggtgatgcaatcacaaaagtgggtctaaccaagttcatcacagaccttttttgggtgggaatgttttaccacctttacaatcagttggccaccaacaccctggagagggtggcacctcttacacacgcagttggcaacgtattgaaacgtgtattcgtcattggattctcaatcatagtcttcggtaacaagatttcaacacaaactggtattggaactgctattgcaattgctggagtagcaatctactcttacatcaaggccaagatggaagaagagaaacgacaagcgaaggcagcataagaaggaaagaagtgcggacaaggggcaatcatgtgttttaaattttaaatatttccttccgaagagagttgacaaaattcgtaacctatccttactcccaaaaaaaaataaaaaattggtgtttaatatccttgtggtagttctttggtttatttgttatcttaataaattttctttcattcaagtactggcaattgctcatttgcaatcatctcatgttgactgaaaataatgaatcgccttgtctgccacaagttataacaggctttaaacagagatgatggaatgcgtgatttatgaaatgatagtaatttaccagaggta

SEQ ID NO: 1475 - DNA, 1228 bp, Euphorbia peplus
taccttccttttctctctaatcaccaccatggagtcgcgagtgttgtcacgcgccactacctccgccgtcgtttccttacttcacctccgaagagcttcacgcgatggaagtaatgcttcaagccttgtctcaatgaaaccaatcggagccgtcggtgaagccgggaacctcatatggggaagacaactccgtccgtcgctgctcctcgagagcagctctccagctgcaaaacgtgaaattctccggcctattatggccgctgcttcttctccggctgcaggaggcgattcctccggggatgggaaggtcgctccggtcgggtttttggaaaagtatccggcactagtcaccgggtttttcttcttcatgtggtacttcttgaatgtgattttcaacatattgaacaagaagatctacaattactttccttatccttacttcgtatcggtgattcatctgttcgtaggagttgtgtactgtttgggtagctgggccgttgggcttcctaagcgcgctccaattgactcaaagctcctaggtgttctgatccctgtggctgtgtgtcacgcgctaggccatgtaacaagcaacatctcatttgcagcagttgctgtgtcatttacccatactatcaaagcactggagcccttcttcaatgctgctgcttctcaatttattcttggacagtcaatcccactctctctatggctttcacttgctcctgttgttcttggtgtgtccatggcatcactaactgaactctcattcaactggttgggattcattagtgctatgatctccaacatctccttcacttacaggagtatctactccaagaaagccatgactgatatggacagcactaatgtctatgcttacatttccatcattgctctcttcgtctgccttcccccggccataatcatcgagggtcctcaactgttgaagcacgggttcagtgatgcaattgctaaagtgggtatgactaagttcattacagacctcttctgggttggaatgttctatcatctctacaaccagctggctaccaacactttggagagggttgcgcctcttacacacgcagttgggaatgtgctgaaacgtgtgtttgtgatcggtttctcgatcgtgatctttggcaataagatttcaacccaaactggtattgggacatgcattgctattgctggagtggcaatctactcttaccttaaggcaaagata

SEQ ID NO: 1476 - DNA, 1560 bp, Panax ginseng
tcgccacttgtccaccactcaaactgttggtatactctctctccatgcaagataacttcatcggcgcatgttaattcaattactccctccttttttttcatacctgacctgctagctcgctgtactacctcacaacccacaagcattttctctctccaaacccaatggagtcccgagtactctccggcgccaccaccatctatggtatcccacggctgagcaaaccggtggcgaagctgaacaccgtccctttctccacctcgaggccgagcagaaccgtcagcgacggcggaaacctcatttggggaaggcagctccgtccagccatactcctcgagacctcgccggcaagtaagctcgagattctcaagccaaccctcgctgctgcgtcgtcgccggccgagggaagtgattccgccggggatgctaaggttggtccggtcgggttcttacagaagtatccggcacttgtgaccgggttctttttcttcatgtggtattttcttaacgtgatcttcaacatactgaacaagaagatctacaattactttccttatccttattttgtatctgttattcatttggccgttggagtagtttactgtttggggagctggactgtgggccttcccaagcgcgctcctatcgactcgaacctcctgaagttgctcatccctgttgctgtgtgccatgctctaggccacgtgaccagcaacgtctcatttgcagctgttgctgtttcatttactcacacagttaaagctctggagcctttcttcaatgctgctgcttctcaattcatacttggacaatcaattccgacaactctttggttatcactagctccagtcgtgcttggtgtgtcaatggcatcattgactgagctgtcattcaactggttgggcttcatcagtgctatgatttccaatatctccttcacttacaggagtatatattcaaagaaagccatgactgacatggatagtactaatttgtacgcctacatttccatcattgccctctttgtgtgtataccacccgccattattttggagggacctcagcttcttaagcatggtttttcagatgccatagctaaagtgggtctgacaaagtttatctcagatcttttttgggtgggaatgttttatcacctctataatcagttggcaaccaacacccttgaaagggtggcaccccttacgcatgcagtcggcaatgtgttgaaacgtgtgtttgtgattggcttctcaattgtggtctttggcaacaagatttcaacacaaacagccattggaacaagcattgcaattgctggagtggcaatgtactcgttcatcaaggccaagattgaggaagagaaacgacaagcgaaagcagcttgagaagtaaagatttcaagggcatgaaaggggtttaaatgtgttttccttccaaagaaagagaggtcaaattgttgttgttgtgaattaagttacctatttttcttatcaatatttctttgtttcagagtacaaacaattgctaatctgcaatccatcacacgttaactggacaaaa

SEQ ID NO: 1477 - DNA, 2098 bp, Mesembryanthemum crystallinum
ccggttggcacattcatatgcacatcataagagcacttttggtcattccaaattgtaaacccaaacagaaggcatcataacagaaccgatccacaacttcccatctcgttcctctgcttcactaacatatcttacattcttcccttccctatcctccaaaacccgaaccacctccccttctgggctcagcttcacagcgacgccgtggtgcctgcccacgaacagaatgtgcagctgctggaagctgagcgggagcttaggcaccacatttccaacccacgtgtttcttagaagccaatcagcaagccgcgtcttcttagcgtgcaaagccacccaaaattctcctttggagttcctcctcacattgtcaggaaatccgggcaaatccgcgaatgtgtcaactgtaccagcttttggaccctgaagccagtacctcaggatcctgcaagcactggtttcggctactagcacaaaggaacggtcattgcttagagctactccatttgcaaatgctagatcgcgtaacaggacagttacttgtttggttgatttgtcgtacttcattaatctgcctgtcttgtccccacttagaactgatagcatgaacccaaccggcgaattcgccggttggcttctctctttctctcacctcgagaaagatcaactcaatggagtcgcgagtgctatcacgcgccaccgcgatcgccgccctaccgcggctgagcagaccccggagagaggcggcgagtctcggaatcgccgccgtcaaacccgtcggagcggtgaaggacggcgggaacctgatatggggcaggcagctccgacccgttttgcttctggagccggtccagaccggtccggtctccagaaaagagtcgaccgcggtccagccgtgccgtgcggcggctgaagggagcgattccgccggggaggctaaggttgggtttttgcagaagtacccggctctcgtaaccggttttttcttcttcatgtggtacttcttgaacgtgatattcaacatactgaacaagaagatctacaattactttccatatccttactttgtgtcagtcatccatttgctggttggggtgatctactgtttggtgagctgggctgtgggccttccaaaacgtgctccaattgatggcaatctcctgaagctgctcatcccagttgcattgtgccatgctctaggtcatgtcaccagcaatgtctctttcgctgctgttgctgtctctttcacacacaccattaaagccttggagccctttttcaatgcttctgcttctcaattcattttgggacagcccattcccatcactctctggctctctttggctccagtcgtgcttggtgttgctatggcttccctgactgagttgtcgttcaactggaccggcttcattagtgctatgatttccaacatctcgttcacctacaggagtatttactcgaagaaggccatgaccgacatggacagtactaacgtctatgcctacattaccatcatcgctctcttcgtttgcatcccacctgcactgattatcgagggtcctcaactcatcaagtatgggtttaacgatgccattgcaaaagtgggtttaaccaaattcattactgacctcttctgggtgggaatgttttaccatctctacaaccagttggctaccaacaccctagagagggtagcaccactcactcatgcggttggcaacgtgttgaaacgggtgtttgtcattggattctccattatcatctttggcaacaagatttcgactcaaacagccattggaacttccattgccattgccggtgtagccatctactccttcatcaagggcaagatggaagaagagaaacgacaaaagaaggctgcttgaagaaatcctcggtgcaaactgggcatgcagcaggtggaagggctgtgtctgtagatttgggtaattttcctgagaaagagaacaacatgaatgttgttgtaaaaaaacttctccccctgtcaattttttcatttcggagtatgaacatttgccgatctgtaatcttgtatcgtataacaagtaataattcattgccttttgcccctcctaaaaaa

SEQ ID NO: 1478 - DNA, 1546 bp, Amsonia hubrichtii
tctctagatctcaatggagtctcgcgtgctctccggcgccaccaccattcacggtcttccgcggctggggaaaccggccgcagcaataagcaggttcagcaacacgactgcaagtttcccgacaactaagccggttggagctgtaggtgacggtgggaacttaatttggggaaggcaacttaggccggcaattctgcttgaagcttcgccggtgccaaaacgcgaagttctcattcggccatgccaaacagccgcttcttctccggctgagggcagcgattcctccggtgatgctaaggtggggttcttggagaaataccctgcgcttgtcaccggattcttcttcttcatgtggtattttctgaacgtgatcttcaatattctcaacaagaagatctataattacttcccttatccttattttgtatcggtcattcatttgtttgttggcgtggtttactgcttgttgagctggtccgtggggcttcctaagcgagctcccatggactcaaacctcctgaaactcctcattcctgttgctttttgtcacgcattgggccatgtaactagcaatgtctcatttgcagcagttgcggtgtcatttacccacacaattaaagccctcgagcctttcttcaacgctgctgcctctcagtttattcttgggcagcctattcccctaacattatggttgtcattggctccagttgtcattggtgtgtcgatggcatcattgactgagttgtctttcaactggacaggcttcatcagtgctatgatttctaacatttccttcacttacaggagcatatattcaaagaaagctatgacggatatggacagtactaatctctatgcctacatttctatcattgcactcattgtctgtattccacctgccctaattttagagggacctgtacttatgaagggaggatttactgatgcgattgctaaagtgggtttaacgaagtttatctcagatctcttctgggttggaatgttttaccacctttacaatcaggtagcaacaaacacacttgagagagtggctcctctaactcatgcggttggaaatgtgttgaaacgtgttttcgtgattgggttctcaatcatagcctttggtaacaagatttcgactcaaactggtattggaactgccattgcaattgctggcgttgcaatctactccttcattaaggccaagatggaagaagagaaaaggcaaaagaaagcagcttgaggccaaagagaccttggtgcagatttggatgattttctttcaagagacaaaccggcaaatattcaattgctctgttattgtgtagttagtcttccaatcaattttctttgttttggagtttgaacaattgctaatactcaatcacctggcagtgaccggaataatgtagcctatctcttgttacaactttgggataacaagctcagaaagtaagccagcaattatgagaattcatatgtgaatagagcattattctgtggaactgtctatttccgctcttataatgcattcgtttatgtggaa

SEQ ID NO: 1479 - DNA, 1710 bp, Vitis vinifera
aaacagttcttgtgttctccccgctcaagataacgttctcggcgtcggataactcgctgtggacgtgaataagagctcagtgtatctaccagaagcacatttcgtttcgctagctctctctcagaaaacatggagtcgagggtgttgtccggcgccaccaccatttccggcctcgtccggctccgtaaaccggtgagggacaccgtttgcttcgctcctgccagaccaatcggggctgtgggagacggcgggaacctcatatgggggaggcagctccggccagctttgatcctggagagcgctccagtcgtcggcatgaccaccggaaagcgtgagattctccggccgactatggcctccacgtcgtcgcccgccgaagggagcgattccgccggggacgctaagattgggttcttggacaagtacccggctctagttacggggtttttcttcttcatgtggtatttcctcaacgttatattcaacatcctcaacaagaagatctacaactacttcccatatccttattttgtatcggtaattcatttgtttgttggggtggtctactgtttggtgagctggggcgtcggccttcccaagcgagctcctatagactcaaacctcctgaaactgctcatccccgttgctgtatgtcatgctctaggccatgtgactagcaatgtctcctttgcagcagttgccgtctctttcacccacacaatcaaagctcttgaacccttcttcaatgctgcggcttctcaatttatactaggacagtcgatacccttaaccctatggctatctctggcccctgttgttcttggtgtgtcaatggcatcattgactgagctatcattcaactggattggcttcattagtgctatgatttctaatatctccttcacttacaggagtatctattcaaagaaggccatgactgacatggacagtactaatatctatgcttatatttccatcattgctctcattgtctgcattccaccggctctcattgtggagggacctcaactgatgaagcatggctttaatgatgcaattgctaaagtgggtctgaccaagttcctctcagatctcttttgggtgggaatgttttatcacctctacaatcagctagctaccaacaccctggagagagtggcacctctcacacatgcagttggcaacgtcttgaaacgtgtttttgtgattggtttctcgatcttggtctttggtaacaagatttcaacacaaactggtattggaacatgcgttgcaattgctggagtggcaatgtactctttcataaaggccaagatggaagaggagaaacgacaactgaaatcagcatgagaggaatacgatcatggacatgaagggcatcttggctgtagatttgaattatatcgccttccaaagaaagaaatgacaaatcaagtatcctatccttgtgaagttatttttttcaatcatttttcttcaattcagagtacaaacagttgctgatttgcaatcacctcatgttgactgcaaaataatgtatcacttggctctcagaccaagctttttatgatcggacgttgtgcaaggagtttagcagaatatgtgaggattacatatgtggatagtagattactaagcaaagagtcaatgtctggaacttttcactgcatgctcattccctgaattcttttatacaatctcatggtttta

SEQ ID NO: 1480 - DNA, 1681 bp, Medicago truncatula
acaactgatgctattttcctcccagtttcctttatcgcataacaaactctctctatatataaacataaaccttaagccataagaaagaacacactcactttcacaagtgttttgtttcaattttcttttcaagagtttttcgataatcaaatcaaaatcaaaaaatgtacagggtagcaaaagcatccgagtacctggtgataaccggagctggaatcgaagacatcaaacttgcaaagaaatcatgggttttccctggtcaatcttgcaccgtcttcgacctctcaccggtgaactataccttcgaagttcaagccatgagtgctgaaaaactgcctttcgttcttcccgctgtcttcacaattggtcctcgtgttgatgatcaggaaagcctcctcaaatacgctaaactgatttcccctcatgataaactctcgaatcatgtcaaggaactcgttcaaggaatcatcgaaggggagacacgtgtcctcgctgcttcgatgaccatggaagaggttttcagaggaacaaaagagtttaaacaagaagtattcgagaaagttcaactcgaactaaaccaattcgggttattgatttacaatgcgaatgttaagcaattggtggatgtgcctggtcatgaatatttctcctatttagggcaaaagacgcaaatggaagcagcgaatcaagctagggttgacgtgtcagaagctaagatgaaaggtgaagttggctcaaaatctagggaaggacaaacactgcagaatgcagcaaaaattaacgcggagacgaaaattattgctatgcagagggctggagagagtgacaaggagggatttagagttaggactgaagtgaaggtttttgagaatcaaagagaggctgaagtggctgaggctaattctgagttggcgaagaagaaagcggcttggactaaggcggctcaagtggctgaagtcgaggctgctaaagctgtggctctaagggaagctgagttgcaaggtgaggttgagaggatgaatgctttgactactactgagaagcttaaagctgatttacttagcaaagctagtgttcagtatgaaaccaaggtacaagaggctaactgggaattatacaagaaacaaaaagaagcagaagcaattctgtatgagaagaaggcagaggcagaagcacagaaagcattggcagatgcaacattttatgcgcgcaagcaagcagctgaagcagagctatacgcaaagaaaaaagaggcagaagggattgtgacacttgggaatgctcaaggagtgtatgtaagtacacttctcaatgcacttggaaacgactacacagctctaagggattacttgatgataaatggtggcatgtttcaagagatggctaagatcaatgctgaggcagtacatggacttgaacctaagattagtatttggactaatggaggcggaataacggaaggttctatgggcatgaaagaggttgctggtgtttacaagatgctgccacctctgtttaagactgtccatgagcaaacaggcatgttgcctcctgcttggatgggaaccttatccgacaaaagctcttaattaggaggatgcaagtattaggtttatagtagtagtaccttttattttggtaatttagcagtagtactttttattgtgtgatacatgtgtct

SEQ ID NO: 1481 - DNA, 1562 bp, Medicago truncatula
aaccaaattcagtttgtcgaaatcaaaaccatgaaaatttaccgggtcgcgaaagcatcagaataccttgtgataacaggtattctgatcaaagacatcaaacttgcaaagaaagcatggattcttcccggtcaatcctgctctgtcttggacctctcaccggtaaactacaccttcgaagttcaagctatgagcgcggagaaacttccttttgttctccccgctgtcttcactattggtcctcgtgtggatgataaggaaagccttctcaaatacgccaaacttatttcaccgcatgctagacactccaatcatgttaatgaacttgttcaaggaatcatcgaaggggagacacgtgtcctcgctgcttccatgacgatggaggaggttttcagaggaacaaaacagtttaaacaagaagtattcgacaaagttcaacttgagttgaatcaattcggattattgatttacaatgcgaatgttaagcaattggtggatgtgcgcggtcatgagtatttctcatatttgggtcaaaagacgcagatggaagccaagaatcaagctagggttgacgtggcagaagctaagatgaaaggtgaaattggttcaaaattgagggaaggacaaacgctgcagaatgcagcgaaaattgatgcagagacgaaggttattgcaatgcagagagctggagagggtgagaaggagggaattaaagtgaggactgaagtgaaagtttttgagaatcaaagagaggctgaagtggctcaagctaattctgagttggctaagaagaaagcggcttggaccaaggcggctcaggtggctgaagtcgaggcgaagaaggctgtgaaactaagggaagctgagttacaaggtgaagttgagaggatgaatgcattgactactactgagaagcttaaagcagagttccttagcaaagctagcgttcaatatgaaaccaaggtgcaagaagcaaactgggagctgtacaaaaaacagaaagaggcagaagcaattctgtatgagaagaaggcagaggcagaagcacagaaagcatcggcagatgcaacattttatgctagcaaacaagcagctgaagcagagctttatgcaaagaaaaaggaggcagagggaattgtgacagttggacaagctcaaggggtgtatgtaagtaaacttcttaatgcacttggaaacgactacacagctgtgagggattacttgatgataaatggtggcatgtttcaagagattgctaagattaacgccgaggcaatacgaggacttgagcctaagattagtatttggactaatgggggtgaagcaggtggtatgaaagaagttgctggtgtctacaagatgttgccacctttgtttaagactgtccatgaacaaacgggaatgttaccacctgcttggatgggagtcttgcctgacaaaaactcttaattgggtttagaggtttatagtagtagtacttagttttgtaatttagcagtaccttttattatgtgatcgatacatgtctgatacactagtcgtttatttgttttgggtttaaa

SEQ ID NO: 1482 - DNA, 2092 bp, Medicago truncatula
attgctcccaatttgttgttgatttaatggttagagaaagagtagtaaattcattccaatttgttgtttattccctgtgttttagtgaaatcgagatgaagtagaggttccaaacttccaattccattgtcagtacatttctctctttttgttctttttttagaggtgatttcttcttgttcttaaaaaaatatatttaataatttaattagtatactcttatgcaattatttttacattcatgaataggattttaatttatgtggcctaattaaactcatgatttaatgttaaaatatataatcaatgaaattggatggacatttttttatttttttttcggataggatggtttttgccctgagaataagtcaaataagatcctataaataagatcctacaacaaattcactagctataataaggaataagaacacagtcacttcgtccgcaaacgattatcacaattctttagcttcaattttcttattctagcttctcgaattcaaaccattatcaacatgtaccgggtagcaaaggcatcagaataccttgtgataactggcgccggaattgacgatgtaaagcttgaaaagaaagcatggatttttccaggtcaatcctgcactgtcttcgacctctcaccggtgaactacaccttcgaagttcaagccatgagtgctgaaaaactccctttcgtcctccctgccgtcttcacaatcggtcctcgtgttgacgattacgaaagcctcctcaaatatgccaaactaatttcccctcatgataaactctccaatcacgttaatgaacttgttcaaggaatcatcgaaggcgagacacgtgtcctcgttgcttcaatgacgatggaagaggttttcagaggaacaaaagaatttaaacaagaagtattcgacaaagttcaacttgaattgaaccaattcggattatggatttacaacgccaatgttaagcaattggtggatgtgccgggtcatgaatatttctcatatttgggacaaaagacgcaaatggaagcagcaaatcaagctagggttgacgtggcagaagccaagatgaaaggtgaaattggttcaaaattgagggaaggacaaacgatccagaacgcagcgaaaattgatgcagagacgaaggttattgcgatgcagagggctggagaaggtgagaaacagggaattaaagtgaggactgaagtgaaagtttttgagaatcaaagagaggctgaagtggctgaggctaattccgagttggctaagaagaaagctgcttggacaatggcggctcaagtggctgagcttgaggctgctaaagccgtggctctaagggaagctgagttgcaaggtgaggttgagaggatgaatgctttgactactactgagaagcttaaagctgatttccttagcaaagctagtgttgaatatgacactaaggtacaagaggctaactgggaattatacaagaaacaaaaagaggctgaagcaattctgtatgagaagaaggcagaggcagaagcgcaaaaagcattggcagattccacattttatgctcgcaagcaagaagctgaagcagagctatacgcaaagaaaaaagaggcagaggggattatgacacttgggaatgctcaaggagcgtatgtaagtacacttctcaatgcacttggaaacaactacacagctgtaagggattacttgatgataaatggtggcatgtttcaagagattgctaagattaatgccgaggcggtacgcggacttgagcctaagattagtatttggactaatggtggtgataataatgggggaataactgaaggtgccatgggtatgaaagaagttgctggtgtctacaagatgttgccgcctctgtttaagactgtccatgagcaaacaggcatgtttcctccggcttggatgggatctttacctgacaaaaactcttaatttggagatgcaagtattaggtttacaatagcagtaccttttattgtgtgatatgtgttttattcaccagtcttttattagttttaggttcaaactactactatgtcatatgatgatttagtttacatttttac

SEQ ID NO: 1483 - DNA, 2102 bp, Medicago truncatula
cacagttacttaatctgatcgattttcacaatcgtttctctctcgttctgtttcgattttcttgtaaccaaaatcagtgagtctcttctcaaaatcatcaagaatgaaaatttaccgggtcgcgaaagcatcagaataccttgtgataacaggtattttcatcaaagacatcaaactcaaaaagaaagcatggatttttcccggtcaatcctgcactgtcttggacctctcaccggtaaactacacctttgaagttcaagctatgagtgccgagaaacttccttttgttctccccgccgtcttcacaattggtcctcgtgttgacgatcaggaaagccttctcaaatacgccaaacttatttcacctcatgatcgacactccaatcacgttaatgaactcgttcaaggaatcatcgaaggggagacacgtgtcctcgctgcttccatgaccatggaggaggttttcagaggaacgaaacagtttaaacaagaagtatttgacaaagttcaacttgagttgaatcaattcggattattgatttacaatgcgaatgttaagcaattggtggatgtgcccggtcatgagtatttctcatatttgggtcaaaagacgcagatggaagccaagaatcaagctagggttgacgtgtcagaagctaagatgaaaggtgaaattggttcaaaattgagggaaggacaaacgctgcagaatgcagcaaaaattgatgcagagacgaaggttattgcgatgcagagagctggagagggtgagaaggagggaattaaagtgaggactgaagtgaaggtttttgagaatcaaagagaggctgaagtggctcaagctaattctgagttggctaagaagaaagcggcttggaccaaggcggctcaggtggctgaagtcgaggcgaagaaggctgttgctctaagggaagctgagttgcaaggtgaagtcgagaggatgaatgcattgactacaactgagaagcttaaagctgagttccttagcaaagctagtgttcaatatgaaaccaaggtacaagaagcaaactgggagctgtacaagaaacagaaagagactgaagcaattctgtatgagaagaaggcagaggcagaagcacagaaagcgtcggcagatgcaacattttatgctagcaaacaagcagctgaagcagagctttatgcaaagaaaaaggaggcagagggaattgtgacacttggacaagctcaaggagcgtatgtaagtacacttctcaatgcacttggaaacgactacacagctgtaagggattacttgatgataaatggtgacatgtttcaagagattgctaagattaatgccgaggcaatacgcggacttgagcctaagattagtatttggactaatggtggtgataatagtgggggaataactgatggtgccatgggtatgaaagaagttgctggtgtctacaagatgttgccacctctgtttaagactgtccatgagcaaacgggcatgttgcctcctgcttggatgggagccttatctgagaaaagctcttgattaggatgatgcaagtatttggtttatagtagtagtacttggttttggtaatttagtagcagtactttttattacgtgatcatacatgcctgatacactactcttttaattgttttgggtttaaactcttatattaaatgccaatttaattatgtctttacgtgcttggtatttcttgaatgaaaatttggcgtttaattcaaagctcctgagaaggataaaggattaacgtcacattgtagtttttgcaagtcatgaaattacaaaagctcttgtttctatttcattaaatcatgttttgaaatgggaagaatcttttaagaataattatgtacacaacattaaagtcaattaactatttgtgtacatgttgtccttgacattaacttgtatttaaaaaatgcttgacatttagttgaagtcatttgacgaagtatctattatgattacttgttgaactaatatattcattcaataatagtaacttttaatttaataattgaattagtgaaacatacgatttgtgaaaaatcatgttaatttaataattgaagtg

SEQ ID NO: 1484 - DNA, 1462 bp, Medicago truncatula
aatcaaaatccaacaatgtacagggtagcaaaagcatccgagtacctggtgttaaccggagccggaatcgaagacatcaaacttgcaaagaaatcatggattttccctggtcaatcttccactgtcttcgacctctcaccggtgaactacaccttcgaagttcaagccatgagtgccgaaaaactgcctttcgttcttcctgccgtcttcacaattggtcctcgtgttgacgaccacgaaagcctcctcaaatacgctaaactgatttcccctcatgataaactctcgaaccacgtcaaggaactcgttcaaggaatcattgaaggtgagacacgtgtcctcgctgcttcgatgaccatggaagaggttttcaaaggaacaaaagagtttaaacaagaagtattcgagaaagttcaactcgagttgaatcaattcggattattgatttacaatgcgaatgttaagcaattggtggacgtgcctgggcatgaatatttctcatatttagggcaaaagacgcaaatggaagcagcgaatcaagctagggttgatgtggcagaagctgagatgaaaggtgaagttggttcgaaatctagggaaggacaaacactgcagaatgcagcaaaaattgacgcagagacgaaagttattgcgatgcagagggctggagagagtaacaaggagggatttagagttaggactgaagtgaaggtttttgagaatcaaagagaggctgaggctaactctgagttggcgatgaagaaagcggcttggactaaggctgctcaagtggctcaagttgaggctgctaaatctgtggttctaagggaagctgagttgcaaggtgaggttgagaagatgaatgctttgaaaaattgtactgagaagcttaaagctgatttacttagcaaagctagtgttcaatatgaaaccaaggttagtttagctaactgggaattatacaagaaacaaaaagaagcagaagcaattctgtacgagaagaaggcagaggcagaagcacagaaagcattggcagatgcaacattttatgcgtgcaagcaagcagctgaagcagatctatacgcaaagaaaaaagaggcagaggggattgtgacacttggaaatgctcaaggagcgtatgtaagtacacttctcaatgcacttggaaacgactacacagctctaagggattacttgatgataaatggtggcatgtttcaagagatggctaagattaatgctgaggcagtacgtggacttgaacctaagattagtatttggactaatggaggtgacaatggaggcggaataaccgaaggttctatgggtatgaaagaggttgctggtgtctacaagatgctgccacctctgttcaagactgtccatgagcaaacaggcatgttgcctcctgcttggatgggaaccttatccgacaaaagctcttaattaggaggatgcaaga

SEQ ID NO: 1485 - DNA, 1385 bp, Medicago truncatula
tagtttacgataatcaaatcaaaatcaacaatgtacagggtagcaaaagcatccgagtatctggtgataaccggagccggaatcgaagacatcaaacttgcaaagaaatcatggattttccctggtcaatcttgcaccgttttcgacctctctccggtgaactacaccttcgaagttcaagccatgagtgccgaaaaactgcctttcgttcttcccgctgtcttcacaattggtcctcgtgttgacgatcaggaaagcctcctcaaatacgctaaactgatttcccctcatgataaactctcgaatcacgttaaggaactcgttcaaggaatcatcgaaggtgagacacgtgtcctcgctgcttcgatgaccatggaagaagttttcagaggaacaaaagagtttaaacaagaaatattcaagaaagttcaactcgaactaaaccaatttgggttattgatttacaatgcgaatgttaagcaattggtggatgtgcctggtcatgaatatttctcctatttagggcaaaagacgcaaatggaagcagcgaatcaagctagggttgatgtgtcagaagctaagatgaaaggtgaagttggctcaaaatctagggaaggacaaacactgcagaatgcagcaaaaattgacgcggagacgaaaattattgctatgcagagggctggagagagtgacaaggagggatttagagttaggactgaagtgaaggtttttgagaatcaaagagaggctgaagtggctgaggctaattcaaagagagctgagttgcagggtgaggttgagaggatgaatgctttgactactactgagaagcttaaagctgatttacttagcaaagctagtgttgagtatgaaaccaaggtacaagaggctaactgggaattatacaagaaacaaaaagaagcagaagcaattctgtatgagaagaaggcagaggcagaagcacagaaagcattgtcagatgcaacattttatgcgcgcaagcaagcagccgaagcggagctatatgcaaagaaaaaagaggcagaggggattgtgacacttgggaatgctcaaggagtgtatgtaagtacacttctcaatgcacttggaaacgactacacagctctaagggattacttgatgataaatggtggcatgtttcaagagatggctaagattaatgctgaggcggtacgtggacttgaacctaagattagtatttggactaatggaggtgacaatggaggcgaaggttctatgggtatgaaagaggttgctggtgtttacaagatgttgccacctttgtttaagactgtccatgagcaaacaggcatgttgcctcctgcttggataggaaccttatcagacaaaagctcttaattagg

SEQ ID NO: 1486 - DNA, 1463 bp, Trifolium pratense
gcatgggttctccccggtcaatcctgcaccgtcttcgacctctcgccggtaaactacaccttcgaagttcaggcaatgagtgccgaaaaactcccttttgttctccccgccgttttcacaattggtcctcgtgttgatgatcacgaaagtctcctcaaatatgccaaattaatcacaccacatgataaactctcccatcatgttaaagaacttgttcaaggaattatcgaaggcgagacacgtgtccttgctgcttcgatgacgatggaagaggtttttagaggaacaaaagagtttaaacaagaagtattcgggaaagttcaactcgaactaaaccaattcggtttattgatttacaatgcaaatgttaaacaattggttgatgttccaggccatgagtatttctcatatttgggacaaaagacacaaatggaagcggcgaaccaagctagagttgatgtggcagaagctaggatgaaaggtgaaattggttcaaaattgagggaaggacaaacactgcaaaacgcagcgaaaattgatgcagagacgaaggttattgcgatgcagagggctggagagggtgataaggagggaattaaagtgaggactgaagtgaaagtttttgagaataagagagaggctgaggtggctgaggctaattctgagttagctaagaagaaagcggcttggacaaaggcggctcaagtggccgaagttgaggctgctaaagctgtggctcttagagaagctgagttgcaaggggaggttgagagaatgaatgctttgactactaccgagaaacttaaagctgagttccttagcaaagctagtgtccaatatgaaaccaaggtacaagaagcaaactgggagctgtacaagaaacaaaaggaggcagaagcagttctgtttgagaagaaggcagaggcagaagcacagatagcattggcagatgctacattttatgctcgcaagcaaacagctgaagcagagttatatgcaaagaaaaaggaggcagagggaattatgacacttggacaagctcagggagtgtatgtaaatacacttttcaatgcacttggaggaaactattatgctctaagggactatttgatgattaatggtggcatgtatcaagaaattgctaagattaatgctgaggcaatacgtggacttgaacctaagattagtatttggagtaatggtggtgatagtggtggtggaataactgaaggtggtatgaaagaggttgctggtgtgtacaagatgttgccacctctctttaagactgttcatgaacaaactggcatgttgcctcctgcttggatgggaaccttctctgacaagaaaacctatgacaagaaaacttaatttggaggatgcaaactaattttaggaataaagtactaccttttattgtgtggtacatgtgtctgatttactggtcttttattagtttcaggttc

SEQ ID NO: 1487 - DNA, 1404 bp, Trifolium pratense
gcatgggttctccccggtcaatcctgcaccgtcttcgacctctcgccggtaaactacaccttcgaagttcaggcaatgagtgccgaaaaactcccttttgttctccccgccgttttcacaattggtcctcgtgttgatgatcacgaaagtctcctcaaatatgccaaattaatcacaccacatgataaactctcccatcatgttaaagaacttgttcaaggaattatcgaaggcgagacacgtgtccttgctgcttcgatgacgatggaagaggtttttagaggaacaaaagagtttaaacaagaagtattcgggaaagttcaactcgaactaaaccaatttggtttattgatttacaatgcaaatgttaaacaattggttgatgttccaggccatgagtatttctcatatttgggacaaaagacacaaatggaagcggcgaaccaagctagagttgatgtggcagaagctaggatgaaaggtgaaattggttcaaaattgagggaaggacaaacactgcaaaacgcagcgaaaattgatgcagagacgaaggttattgcgatgcagagggctggagagggtgacaaggagggaattaaagtgaggactgcagtgaaagtttttgagaatcagagagaggctgaagtggctgaggctaattctgaattggctaagaaaaaagcggcttggacaaaggcggctcaagtggctgaagttgaggctgctaaagcggtggctcttagggaagccgagttacaaggcgaggttgagagaatgaatgctttgactactaccgagaagcttaaagccgagtttcttagcaaagctagtgttgaatatgaaaccaaggtacaagaagcaaattgggacttatacaagaaacaaaaggattcagaagcaattctgtatgagaagaaggcagaggcagaagcacaaatagcattggcagatgcaacattttatgctcgtaaacaagctgctgaggcagagttatatgcaaagacaaaagaggcagaagggattgttacacttgggaatgctcaaggtgtgtatgtaagtacaattctgaatgcacttggaggcaactattatgctctaagagattatttgatgataaatggtggcatgtatcaagagattgctaagattaatgccgaggcaatacgcggacttgagcctaaaattagtatttggagtaatggtggtgatagtggtggaaaaataagtgaagatgccattggtatgaaagaggttgctggtgtgtacaagatgttgccacctctgtttaagactgtccatgaacaaactggaatgttgcctcctgcttggatgggaaccttctctgacaagaaaacctatgacaagaaaacttaatttggaggatgcaaactaattttaggaata

SEQ ID NO: 1488 - DNA, 1842 bp, Glycine max
tatatcgcggctaattggtgtagctttttatcactgcggcagaattaagcataaagatgtacaaggtagcaaacgcctcagaataccttgtgatcactggggttggaatcacagacataaagcttgcaaagaaagcatgggttctcccaggccagtcatgcaccgtcttcgacctctctccggtgaactacaccttcgaggttcaggccatgagcgccgagaagctccctttcattctccctgcagtcttcaccatcggtcccagagtggaggacgaagacagccttctcaaatacgccagactcctctcctcccacgacaagctctctcaccatgtcaaggagctagtccagggcatcatcgagggtgagacgcgtgtcctcgctgcttccatgaccatggaggagattttcagaggcaccaaatcgtttaaacaggaagtgttcgagaaggttcagctggagcttaaccagttcggccttctgatttacaacgccaacgttaagcaacttgttgacgtgccaggtcatgagtatttctcttacttgggccagaagactcagatggaagctgccaaccaagccaaagttgacgtggctgaggccaagatgaaaggagaggttggatcgaagcagagacaagggcaaacgcttcagaatgctgccaagatcgatgcggaaactaagataatatcgacgcagaggcaaggagatggtaagaaggaggaaataaaggtgaggacagaggttaaggtgtttgagaatgagagagaggctgtggtggcagaggcaaattccgagcttgcaaagaaaaaagctgtgtgggctcaaacggcgcaggtggcagaagtggaggccgccaaagctgtggctctcagagaagcggaattgcagagagaagttgagaggatgaatgctcttacaaggactgagaagcttaaagctgagttcctcagcaaagcaagtgttgagtatgaaaccaaggtacaagaggcaaactgggagttgtacaagaagcaaaaggcggcggaagcaatattgtttgagaaggagaaagaggcggaagcgcaaaaagcattagcggaggcagcatttttcagtcggcaacaagaagctgaagcagaactatttgcaaagaaaaaggaggcagaagggcttgtggcacttgggcaggcccagggggcatatttaaagacacttcttggtgcactgggaggcaactatggcaacctaagggactacttgatgataaatagtggcatgtttcaagagattgccaagactaatgccgatgcaattcgtggacttgagccaaagattagtatttggactaatggtggagatacaaatgatggctatggaagtggtgccatgaaggatgttgctggtgtctacaagatgttgccacctttgtttaagacagttcatgagcaaaccggtatgctgccacccgcttggatgggaaccctgcccgataatggttcttgagcctctgcttattaatacctccacatcatcaaatgtgtgctgctcgcttttcctcttttttattttgccgattggatgcatgttttgtaaataaggtttcttcaagctcaagctatcaagcttctgcattgctgacaacttcagttatttacattcgttatctttctcaacaagtataattagtcaaccgttaataaaaagaagaaaagaggtatcatgagagtaataaagaaatgaatctcatttttcataacagaggaaactgtgatgacttatctacaaaacccataagaaaatagaaatgcaacaacactttagcactcaaaatgcaatttcatcctcaattaacttaaat

SEQ ID NO: 1489 - DNA, 2572 bp, Ricinus communis
ctggcacaggattcttttgcaatgggctcatcggttttcacatgcaagtaaggcatcacataaaattattgcagctattgtaacattttagaggacaaaagaatgttcgatcgccttgaattttgatcagtaaacagtaattgcaagtatatttggttgtctcaaacaatgcttgtccaacacaaacaatgttctcatccatccacagtatatagataagagacgaaagaaaaggcccttgtaaatgctgtatgaaagtgatagccttgtcgatagcctacattcaaagccagcgaaaatgtttgagaaatacgttgagtcgacgatccatgtatttataagagaaagtcttcctctaaatagtgtcctcagcatgtaaatttccaagaaaatttataaattgtagaataattactctaaaatcgtatagttgacctccataaattattccttcttcaccatcctctagtgatatatatgtatatatatatatatatattccaatcagctagcagtcataaacaatcatcttccttctctgcaacttatttgcatagacttacaaacatgtatagagttgccagcccttctgagtttttagtgatcaccggagtgggtatctcggacataaagcttgcaaagaaagcatgggttcttccagggcaatcatgttctgtcttcgacgtttcaccagtcaactacactttcgaagtccaagccatgagtgctgagaaactcccttttgtcctccctgctgttttcaccatcggtcctcgtgtagacgatgatcaaagcctcttgaaatatgctaaactcatctctccacatgacaagctctctcaccatgtcaaagaactcgtccaaggtatcatcgagggtgaaactagagttcttgctgcttccatgactatggaagagatttttaaaggaactaaagagtttaagcaagaagtttttgagaaagttcagcttgaactcaaccaattcggattacttatctataacgctaacgttaaacaattggtagatgttcctggacacgagtacttctcgtatttaggtcaaaagacacaaatggaagctgcaaatcaagctagagttgatgtagcagaagcgaaaatgaaaggagagataggatcaaaggaaagggaaggacaaacgctgcagaatgcggcaaaaattgacgcagagacgaaaataatagcaacgcaaagacaaggagaagggaagaaggaggagataaaggtgaagacagaggttaagatttatgagaatcaaagagaggcagaggtggcagaggtgaacgcggagttggcgaagaagaaggcaggatgggctaaggaggcacaagttgcagaagttgaagcatcaaaagctgttacattgagagatgctgagctgcaaagagaggtggagaggatgaatgctttgactagaattgaaaagcttaaagctgagtttttgagcaaagccagtgttgagtatgagactaaggtgcaagaagcaaactgggaactgtataagaaacagaaagaagcagaagcaattctctacgaaaaggagaaagaagcagaggcgcaaaaagcaatagcagacgcgacatactacgcccggcaacaagttgctgatggagaattgtatgccaagcaaaaagaggctgaagggttagttgctctagcacaagcacaaggcacgtacctacgcacccttttggatgcattaggcggcaactatgcagccttaagggacttcttgatgatcaatggcggcatgtttcaagagattgctaaagttaacgcggaggctgttcgaggtttgcagccgaaaattagcatttggagtaacggtgcagacaacagcaacagtaataataatatcagtgatggaggtttgaaggaggtcgccggagtttataagatgttgcctcctttgctcaagactgtccaagagcaaactgggatgctgccacctgcatggatggccaccctaaccgactcttcagcccattcttgatatcaggcttggcttattttaagactaaagccgtctccaagtattgtgaatttgcaagccaatcttaactccagccggagccaaattaacaggcgataaaagtaaaagaaaaaaagaaagaaaaagacacagaaaagggtttgcctctgaattgtgaagtattgtagtggggaatattgttatccatgttaatgtccgcttataaataatttaaccattcggttaaagtatcaaaatactgtgatttctttcttctttttaaactgttttagaaagcaattagtactgcatgtttccctagtttaaggtggtctccatatgatttctccttattttcttatctttaccttcttataagtgagacatgttttttccgttccaaaaagataatatctttatctcttacagctaatgcaaagacatattctctttatcagcagtctattttctttattgtttttctcaatcaaatttagctgcgatcctcttctatttggttcttattcttataatacattacacatgccactaatactgccaatgctcacttgaaagaaaa

SEQ ID NO: 1490 - DNA, 1966 bp, Ricinus communis
ctgtatgaaagtgatagccttgtcgatagcctacattcaaagccagcgaaaatgtttgagaaatacgttgagtcgacgatccatgtatttataagagaaagtcttcctctaaatagtgtcctcagcatgtaaatttccaagaaaatttataaattgtagaataattactctaaaatcgtatagttgacctccataaattattccttcttcaccatcctctagtgatatatatgtatatatatatatatatattccaatcagctagcagtcataaacaatcatcttccttctctgcaacttatttgcatagacttacaaacatgtatagagttgccagcccttctgagtttttagtgatcaccggagtgggtatctcggacataaagcttgcaaagaaagcatgggttcttccagggcaatcatgttctgtcttcgacgtttcaccagtcaactacactttcgaagtccaagccatgagtgctgagaaactcccttttgtcctccctgctgttttcaccatcggtcctcgtgtagacgatgatcaaagcctcttgaaatatgctaaactcatctctccacatgacaagctctctcaccatgtcaaagaactcgtccaaggtatcatcgagggtgaaactagagttcttgctgcttccatgactatggaagagatttttaaaggaactaaagagtttaagcaagaagtttttgagaaagttcagcttgaactcaaccaattcggattacttatctataacgctaacgttaaacaattggtagatgttcctggacacgagtacttctcgtatttaggtcaaaagacacaaatggaagctgcaaatcaagctagagttgatgtagcagaagcgaaaatgaaaggagagataggatcaaaggaaagggaaggacaaacgctgcagaatgcggcaaaaattgacgcagagacgaaaataatagcaacgcaaagacaaggagaagggaagaaggaggagataaaggtgaagacagaggttaagatttatgagaatcaaagagaggcagaggtggcagaggtgaacgcggagttggcgaagaagaaggcaggatgggctaaggaggcacaagttgcagaagttgaagcatcaaaagctgttacattgagagatgctgagctgcaaagagaggtggagaggatgaatgctttgactagaattgaaaagcttaaagctgagtttttgagcaaagccagtgttgagtatgagactaaggtgcaagaagcaaactgggaactgtataagaaacagaaagaagcagaagcaattctctacgaaaaggagaaagaagcagaggcgcaaaaagcaatagcagacgcgacatactacgcccggcaacaagttgctgatggagaattgtatgccaagcaaaaagaggctgaagggttagttgctctagcacaagcacaaggcacgtacctacgcacccttttggatgcattaggcggcaactatgcagccttaagggacttcttgatgatcaatggcggcatgtttcaagagattgctaaagttaacgcggaggctgttcgaggtttgcagccgaaaattagcatttggagtaacggtgcagacaacagcaacagtaataataatatcagtgatggaggtttgaaggaggtcgccggagtttataagatgttgcctcctttgctcaagactgtccaagagcaaactgggatgctgccacctgcatggatggccaccctaaccgactcttcagcccattcttgatatcaggcttggcttattttaagactaaagccgtctccaagtattgtgaatttgcaagccaatcttaactccagccggagccaaattaacaggcgataaaagtaaaagaaaaaaagaaagaaaaagacacagaaaagggtttgcctctgaattgtgaagtattgtagtggggaatattgttatccatgttaatgtccgct

SEQ ID NO: 1491 - DNA, 1457 bp, Cajanus cajan
ggttgagaagcaaaataaacgatgtacagagtagcgaacgcgtcggaatacctggtgatcaccggcgtgggaatagcggatataaagcttgcgaagaaagcatgggttctaccggggcagtcatgcacggtcttcgacctctctccggtgaactacaccttcgaagttcaggcgatgagcgcggagaagcttcccttcatcctgccggcggtgttcaccatcggtcccagggtggacgacaactccagcctcctgaaatacgcgaagctgctctcctcccacgacaagctctcccaccacgtgaaggagctggtgcagggcatcatcgagggcgagacacgtgtcctggctgcctccatgaccatggaagagatcttcaggggcaccaaatccttcaagcaagaggtgttcgagaaggttcagcttgagctcaaccagttcggccttttgatctacaacgccaacgtgaagcagctggtggacgtccccggtcacgagtatttctcctacctcggccagaagactcagatggaggctgccaaccaggccaaggttgacgtggcggaggccaagatgaagggagaggttggagccaagatgcgagagggccagacgctgcagaatgcggccaagatcgacgccgagaccaatatcatatccacgcagaggcatggagcggggaagaaggaggagataaaggtgaggacggaggtgaaggtgtttgagaacgagagggaggctgaggtggctgaggctaactctgagcttgccaagaagaaagctgtgtgggctcaggcggcgcaggtggcggaggtggaggctgcaaaggctgtggcgctcagagaagccgagttgcagagggaggttgagaggatgaatgctctcaccaccaccgagaagcttaaagccgagttcctcagcaaagccagtgtcgactatgaaaccaaggtgcaagaggcaaactgggagctctacaagaagcaaaaaggtgcagaagccatattgtttgagaaggagaaagaggcagaagcacaaaaggcactcgcagaggcagcatttttcagtcggcaacaagcagcagaagcagagttatttgcaaagaaaaaagaggcagaggggcttgtggcacttgggcatgcccaaggggcatatttaagcacacttcttgctgcacttggaggcaactacgccaatctgagagactatttgatgataaataatggcatgtttcaacagattgccaagaccaatgctgatgccatacgtggacttcagccaaagattagtatttggacgaatgatgggaatgcgaatggcatgaaggatgttgctgctgtgtacaaaatgttgccacctctgtttcagacagtccatgatcaaacgggcatgctgccacccacttggatgggaaccctacccgacaactcttctaattaagtctcttcttttactatttc

SEQ ID NO: 1492 - DNA, 1628 bp, Gossypium hirsutum
caaattacaccaacaatagattcaaagaaaagaaaggagcaatatgtactataaggtagcaaatgcatcagaatatcttgtcattactggtgttggcatccaagacataaagctggccaagaaggcatggattctccctggtcagtcttacaccgttttcgacctctcccccgttaactacaccttcgaagtccaagccatgagcgccgagaagctcccctttgtcctccccgctgttttcactattgggcctcgtgtcgatgatgagcccagtctcctcaagtatgccaagcttatctctcctcacgacaagctctctaaccatgtgaaagagctcgtacaaggaatcatcgaaggcgaaacaagggtccttgctgcttctatgaccatggaagagattttcaaaggaaccaaagagttcaaactcgaggtttttgagaaagtccagcttgaactcaaccagtttggacttttgatttacaacgctaatgttaagcagcttgtggatgtccctggccacgagtacttctcttacttgggtcaaaagactcaaatggaagctgctaatcaggccaaagtggatgttgcagaggccagaatgaagggggagatcgggtccaagctacgggagggccaaacacttcaaaacgccgccagaatcgatgcggagaccaagattatatccacgcagcggcaaggagaggggaagaaggaggagataaaggtaaagactgaggtgaaggtttatgagaatcaaagagaagctgagatagctgaggcaaacgcagatttggcaaagaagaaggcaagttgggctaaggaagcgcaagtggcggaggtggaatcagccaaggctgtggcgttgagggaagctgagttgcaaagagaggtggagaggatgaacgctttgaccaggactgagaagctcaaggctgagtttcttagccaagcaagtgttgagtacgataccaaggtgcaagaagcaaattgggagctgtaccaaaaacagaaacaagcagaggcaattctgtatgagaaggaaaaagaggcagcagggcaaaaggcaatagcagatgcagcattttatggtcgtcaaagggttgcggatgtagaactgtatgcaaagcagaaagaggcggaagggcttatggcactggcacaagcccaaggtgtttatctacgaacacttttagaggcattgggcggcaattatgctgccctaagggattacttgatgatcaatggtggaatgtttcaagagattgctaagatcaacgctgaagccgtgcggggacttcagcctaagattagcatttggactaacggtggtggagaagcaattgatggtaatggaagcaacgccatgaaggaggttgctggtgtttatcggatgctgccgcccttgtttaagacggtgcacgagcaaactggaatgcttccgcctccctggatgggcacattgccggacccaaaaaaagctaccaccgattaaacaagcaaatcgtctaatcacgctttgccatgcacttccttgttttggcttttaagtattttgccttggctttacatatacggtgttgatataatcgtacaaagttattggtttggctacattgcacctgcttcgt

SEQ ID NO: 1493 - DNA, 1849 bp, Gossypium raimondii
tatattaataatatctacatgtttgcttttttatttttatttttattatattcaatcaacttatatatatatatatatatatatatatatataatatgcttcagttgtttagctcagactgagttgcacattcaaattacaccaacaatagattcaaagaaaagaaagaagaagcaatatgtactacaaggtagcaaatgcatcagaatatctggtcatcactggtgttggcatccaagacataaagctagccaagaaggcatggattctccctggtcagtcttacaccgttttcgacctctcccccgttaactacaccttcgaagtccaagccatgagcgccgagaagctcccctttgtcctccctgctgttttcactattgggccccgtgtcgatgatacgcccagtctcctcaagtatgccaagcttatctctcctcacgacaagctctctaaccatgtaaaagagctcgtacaaggaatcatcgaaggcgaaacaagggtccttgctgcttctatgaccatggaggagattttcaaaggaaccaaagagttcaaactcgaggtttttgagaaagtccagcttgaactcaaccagtttggacttttgatttacaacgctaatgttaagcagcttgtggatgtccctggccacgagtacttctcttacttgggtcaaaagacacaaatggaagctgctaatcaggccaaagtggatgttgcagaggccagaatgaagggggagatcgggtccaagctacgggagggccaaacacttcaaaacgccgccagaatcgatgcggagaccaagattatatccacgcagcggcaaggagaggggaagaagcaggagataaaggtaaagactgaggtgaaggtttatgagaatcaaagagaagctgagatagctgaggcaaacgcagatttggcaaagaagaaggcaagttgggctaaggaagcgcaagtggcggaggtggaatcagccaaggctgttgcgttgagggaagctgagttgcaacaagaggtggagaggatgaacgctttgaccaggactgagaagctcaaggctgagtttcttagccaagcaagtgttgagtacgataccaaggtacaagaagcaaattgggagctgtaccaaaaacagaaacaagcagaggcaattctgtatgagaaggaaaaagaggcagcagggcaaaaggcaatagcagatgcagcattttatggtcgtcaaagggttgcggatgtagaactgtatgcaaagcagaaagaggcggaagggcttatggcactggcacaagcccaaggtgtttatctacgaacacttttagaggcattgggcggcaattatgctgccctaagggattacttgatgatcaatggtggaatgtttcaagagattgctaagatcaacgctgaagccgtgcggggacttcagcctaagattagcatttggactaacggtggtggagaagcaattgatggtaatggaagcaacgcaatgaaggaggttgctggtgtttatcggatgctgccgcccttgtttaagacggtgcacgagcaaactggaatgcttccgcctccctggatgggcacattgccggacccaaaaaaagctaccaccgattaaacaagcaaatcgtctaatcacgctttgccatgcacttccttgttttggttttaaagtattttgccttggctttacatatacggtgttgatataatcgtacaaagttattggtttggctacattgcacctgcttcgtctctaaatttatcaaatttcttgatcttcaaaaaaatgccattctactcaacccatcttttttaaaatacaatttagttttaaaat

SEQ ID NO: 1494 - DNA, 1444 bp, Lactuca sativa
aattcaccggcgtccagtgaatatctccggccatgtatagagtagcaagtgcttcagagtatctggtgatcaccggattcgggatcgaagacatcaaaatcgcaaagaaagcatgggtacttcccggccaatcctactccgtcttcgacatttctccggtcaactacaccttcgaagtccaggccatgagcgccgagaaactccctttcattctccccgccgtattcactatcggtccacgttccgacgacgacgacagtctccacaaatacgccaagcttatctctcctcacgataagctttcgcaccatgtgaatgagctcgtcaaggggatcatcgagggggagactcgtgttcttgctgcgtctatgaccatggaagagattttcaaagggacgaaggattttaagcaggaggtgttcgagaaggttcagttggagttgaatcagttcggattgtggatctataatgctaatgtcaagcaattggttgacgttcctggacatgagtatttctcgtatttagggcagaaaacgcaaatggaagctgcaaatcaagccagggtcgatgttgctgaagccaaaatgaagggtgaaataggatccaagcttcgtgaaggacaaacgctgcagaacgcagcgaagatagatgcggagacgaagatcatagctactcagagacaaggacaaggaaagaaagaggagatcaaggtaagaacagaggtgaaagtattcgaaaatgagagggaagctgaagtggctgaagcgaacgcagagttggcaatgaagaaggcaaaatgggctaaggattcacaggtggcggaggtggaggcgaacaaggcggtggcgctgcgggcggctgagctgcagaaggaggttgagatcatgaacgcgttgactcagacggagaaactcaaggctgagttcttgagtaaagctagcgttgagtatgaaaccaaggtacaagaagcgaattgggagctttacagaaagcaaaaggccgcagaagcaattctctacgagaaagaaaaagaagcagaggctcaaaaggcgatagcggaggccacattctacactcgtcaacaagtcgccgacggtgaattatatgcaaaacagaaggaggcggagggacttgttgctcttgctcaagctcaaggtacttacatacgcacacttttgggtgccatgggaggcaactatggagctttaagggattacttgatgattaatggtggaatgtatcaagagatcgccaagattaacgccgaggctgttaagggtttgcagccgaagattagtatctggaccggcgcaaatggtggtggagagggtggtgatggtggtgcgatgaaggaggtcgccggcgtttacaaaatgttgccgccgttgtttaacacagttcatgagcaaacggggatgttgccaccagcttggatggggaagat

SEQ ID NO: 1495 - DNA, 1701 bp, Theobroma cacao
gtccagacttgtgggctcaaatacttatattttcttctctcaatccctctcccctgtaattgagtgaaaagaaagaaaaaaaaaacataatgtataaggtagcaaatgcatcagaatttctggtgatcactggcataggtatcccagacataaagcttgccaaaaaggcatggatactccctggtcagtcttgcactgtcttcgacgtctcgcctgtaaactacacgttcgaagtccaggccatgagtgccgagaagctccctttcgttctcccagcagtcttcacaatcggaccccgtgtggatgatgagcacagcctcctcaagtatgccaagcttatctctcctcatgacaagctctctaaccatgttaaagagcttgtacaaggtatcattgaaggagaaacgagggtcctagcagcttcaatgaccatggaagagattttcaaaggaaccaaagagttcaaactagaggtttttgagaaagtccagcttgagctcaaccagtttgggcttttgatctacaatgctaatgttaaacagcttgtggatgtgcctggacatgagtatttttcttacttgggtcaaaagactcaaatggaggctgctaatcaggccaaagtggatgtcgcagaggctaaaatgaagggagagatcgggtccaagctgagggaagggcaaacgctgcaaaacgctgcaaggatcgatgcggagacgaagattatatcgacacagaggcaaggagaggggaagaaggaggagatacgggtaaagacagaggtgaaggttttcgagaaccaaagagaagctgagttggctgaggctaatgcggatttggcaaagaagaaggcaggttgggctaaggaggcgcaagtggcggaggtggaggcctccaaggcagttgctctgagggaagctgagttgcaaaaagaggtggagaggatgaatgctttgaccagaactgagaagcttaaggctgagtttcttagccaagcaagtgttgagtacgataccaaggtgcaaaaagcaaattgggaactgtaccagaaacagaaacaagcagaggcaattctgtatgagaaggaaaaagaggcagctgcgcaaaaggcaattgcggatgcaacattctacggccgtcaaagggttgctgatgtagaattgtatgcaaagcaaaaagaagcggaaggactcatggcacttgcacaagcgcaaggtgtttatctacgaacccttttagaagcgttgggaggcaactacgcagccctaagggattacttgatgatcaatggtggaatgtttcaagagattgctaagatcaatgctgaagccgttcggggactgcagcctaggattagcatttggactaatggtggatctgaagcaatggatggtaatggtagcaatgcattgaaggaggttgctggtgtttaccggatgttgccgcccttgtttaagacggttcatgagcaaactgggatgctaccacctccgtggatgggcacattgtcagctgactcacaacaagctacgacggattaagacaagcctatccctgatcgtcattttgccatacactcttttttatttaactatcctgcctttgttttaaatataaattatgtttttttaaaaacaaatataaattatgttaataatacgttattgtttgtttactgtaattaacatgaaattaagggccggg

SEQ ID NO: 1496 - DNA, 1444 bp, Prunus persica
ccatcaccatgtatagagtagcaagcccttcggagtatttagtgatcactgggatcgggatcgacgacataaagcttgcgaagaaggcatggatcctcccgggccagtcctacatcatcttcgacatgtcccccgtcaactacactttcgaagtccaagccatgagctccgagaagctccccttcatgctccccgccgttttcaccattggcccccgcatcgacgacacccccagcctccacaagtacgcgaagctcatttcgcgtcacgacaagctctccagccacgtgaaggagctcgtccagggcatcattgagggagagacgcgtgtcctcgctgcctcaatgaccatggaggaggtgtttaaggggacaaaggagtttaagcaagaggtgtttgagaaggttcagttggaattgaatcagttcgggcttttgatatataacgcaaatgtcaaacagttggtggatgttcctggacatgagtattttagttacttggggcagaagacacagatggaggcggccaatcaggctaaagttgacgtggcggaggcgaggaagaaaggggagatagggtccaaggagagggaggggttgacgctgcagaacgcggcgaagattgacgctgagacgaagatctatgcgacaaagagggaaggggagggaaagatggccgagataaaggtgaaagcagaggtgaaggtgtatgagaatgtgagggaggctgaggtggcggaggcgaatgctgagctggcgaagaagaaggccgggtgggcgaaggaggcgcaggtggcggaggtggaggccgcgaaggcagtggcattgagggatgcggagctgcagacgcaggtagaaaggatgaatgccttgactaggacggagaagcttaaggctgagtttttgagtaaggccagtgttgagtatgaaacaaaggtacaagaggcaaattgggacttatacaacaagcaaaaggccgccgaagcaattctttaccaaagggagaaagaggctgaggcacagaaggcaattgcagaggcagaattctatgctcgtcaacaagttgcagatggagaattttatgcaaagaaaaaagaggctgagggtctcatagcccttggacaagcccaaggtgcatatctacgcaatcttttggatgcagttggaggcaactatgcagccatgagggacttcatgatgatcaacagcggcatgtttcaagaaattgctaaaattaatgctgaagccgtgcgtggacttcaacccaagatcagcatttggactaatggggaagtagatggcggcagcaacggggccatgaaggaggttgctggagtttacaagatgttgccaccattgttcaagacagttcatgaacaaactggaatgctgccaccggcttggatgggcactttgccaaattctggttctaacaattgaattcg

SEQ ID NO: 1497 - DNA, 1474 bp, Petroselinum crispum
acttctccacaactttcctcatcaccatgtatagagttgctagagcatcagaatacctagtgattactggcataggaatcacggatataaaaattgcgaaaaaatcatggattctccctggccaatcgtacgctgtcttcgacgtctcccctgtaaactatactttcgaagtccaagctatgagtgccgagaaactcccctttgttctccctgctgtcttcaccataggcccgcgcctcgacaatgacagccttttgaagtatgccaagctcatttcgccccatgacaagctctcaaaccatgtcaaagagcttgttcaaggtattattgaaggcgaaacacgtgttcttgcagcttcaatgactatggaagaggtttttaaaggtgccaaagaattcaaacaagaagtgtttgaaaaggtacagctcgagctcaatcagtttggactattgatttataatgcaaatgttaaacaacttgtggatgttccggggcacgagtatttctcatatttgggacagaaaacacaaatggaggctgcaaatcaagcgaaagttgatgtggcagaggctagaatgaaaggagaggttggatcaaagttaagagagggacaaacgcttcaaaatgctgcaaagattgacgcggagacaaagattatatcgacgcaaaggcaagggcagggaaggaaggaggagataaaagtgaaggcagaggtgaaggtttttgagaatgagagggaggctgaagtggcagaggcgaatgctgagctggcgaagaggaaggcagggtgggccaaagaggcgcatgtggcagaggtggaggcggagaaggcagtagcactaagggaggcagagttgcagaaagaggtggagataatgaatgcattgactcagacggagaagctcaaggctgagttcttgagcaaagctagtgttgaatatgaaaccaaggtacaagaagcaaactgggagttgtacaagaaacaaaaggaggcagaagcaattctgtaccaaaaggaaaaggaagcagaagctcaaaaagccatagctgatgcagcattttatgcccgacaacaagtagcagatggcgaattatacgcaaaacaaaaggaagcccaaggactagttgcgcttgcacaagcacaaggcacatatgtaagcacacttttgaaagctgtaggaggcaattacagtgagttaagagattacttgatgattaatgggggaatgtaccaagaaatcgcgaagattaacagcgaagcagtgagaggattgcagcccaagattagcatttggtctaatggagaaaatagtggagatggaaatagtatgaaaggaattggggaagtttataaaatgctgccacctttgtttaagacagtgcatgaacaaacgggcatgatgccgccagcatggctgggcactttgagtcacgacgcttgaaaaaccttttcaagacttgaattcctactgtg

SEQ ID NO: 1498 - DNA, 4333 bp, Medicago truncatula
aggtacaagaggctaactgggaattatacaagaaacaaaaagaggctgaagcaattctgtatgagaagaaggcagaggcagaagcacaaaaagcattggcagattccacattttatgctcgcaagcaagaagctgaagcagagctgtacgcaaagaaaaaagaggcagaggggattatgacacttgggaatgctcaaggagcgtatgtaagtacacttctcaatgcacttggaaacaactacacagctgtaagggattacttgatgataaatggtggcatgtttcaagagattgctaagattaatgctgaggcggtacgcggacttgagcctaagattagtatttggactaatggtggtgataataatgggggaataactgaaggtgccatgggtatgaaagaagttgctggtgtctacaagatgttgccgcctctgtttaagactgtccatgagcaaacaggcatgtttcctccggcttggatgggatctttacctgacaaaaactcttaatttggagatgcaagtattaggtttacaatagcagtaccttttattgtgtgatatgtgttttattcaccagtcttttattagttttaggttcaaactactactatgtcatatgatgatttagtttacatttttacatgcttggtattttttgaatggaattttggcgtttaaaacaaaacttctgacagggacaatcatcacatcgtggttatttttgttgtcggtatgcgtaagtcatgaaataacgagttctttaccaatttacagggcctcaaaattttggttatatggtagcttggtagctccaatcacttgttaaaatcatgatagttctaacctaacccacatccaccaccaacaacaaaataaattgaaatcaaatcatgcttttcgcttctactacgtcctttgacaccatccatcccttcaacttttttcctctcctggacaccatccctctcaccgctattgccgtgccgctgctcaaccatcatcactgcaattctcctctgtctgatttttatcatcctaaccgctaaattttatattattgataatttaaatagaagacgactctttgaaaaatttacgtttttattttattttatcaggagtccatttgacagtcttgattttaatatatgatatattcaatccgcttaaaaaaaaaaaagactacttttagtcttttacaaacaatacacgatgtgtcatatatatggtacactaatacaccatgcgaggtattttgaataatccccatttccattatatgttatagaaggaccacttttgtattgtaataagtagtaaatgcatacccctaaaaagaaaaaacgtaaatgcattaatatattttgcacatgcatggtcagaaataagtgcattgtttcaaatccttgtcagaaaggctattattaccagaacccatttatgaataacttgttaagcaagtttaagtccaacgtcattaactttcatttttttgttctcatatcaaaataaaattgataataaaacaaagtagtagctctttaaagttgtctctgcattgcgacatttgtttccatttctttaataaaaagcaataaatggttccaaaatgaacacgagtatctttaaattctcattactacatcaaaatcacactactacatacacctgtaaaatcaagttaccccatattaaaagtcatttgttttaatttgcgcagttttcattttcattttcgttttctgttatcacgaattcacagacaatccccccgctctcatcatgatcgttctttcctttcacaatttttaacattgcaatttgatctgcactcaattatcatcttaaagagtcaattatctgcgaaatggaagatgactcaattatctgcactcaattagtaaataaattgaatgttggtatttagggtttccactaatcctacaccctgtccttgatttgtagtgtgttaccttttaatggttataaagttgaggcctggacggagttaggtcttaatgaaaaaggtgtatgttccttcaaagataaactcatggagatggagggtgcacaagattttgaaatagagtcctcttttattgatttgttgctgataaaatatcgaaggtatgaaagccattgttaacgaggatacaatgtagctttatatcaaactaaccaagaatgagttaaaattgcggtgtttcccgtggaagcacactttaatgctacacgtactggggaaaagggtgtgaagttggttcatggaagccaaggtacgcaacttctgggctaaggaggcagagatcagagtggtgtaccttccaatagatcattatatgggtcattttacctgtgataaagattataataggaattttttgtgacgtgttgttgtatgagttagtttgtttatccaagcatggcctatatatgtacgagttgcaaaaagaattatttggattaattttgtttacttcacactccttggtctattttaaaatctctaatttcccttggaaaccttgaaaattattcaaattctaatcaaaacaattttttttgaatttttttttttccgtcaagaatgattgaaattgggtttaatatgaaacaagatgaatatccaagtgatccagcttaacttctattcctattctcaacacagaaaaactcaagttttccaaattcaaatatcatcaacagtgggacttcatcgtgtagcaaaggcatcagaataccttgtgataacaggtattctcatcaaagacataaaacttgcaaagaaagcatggattattcccggtcagtcctgctccgtcttggacctctcaccggtaaactacaccttcgaagttcaagctatgagtgccgagaaacttccttttgttctccctgccgttttcactattggtcctcgtgttgacgatcaggaaagccttctcaaatacgccaaacttatttcaccacatgatcgactctccaatcatgttaatgaacttgttcaaggaatcattgaaggggaaacacgtgtactggctgcttccatgaccatggaggagttgaatcaattcggattattgatttacaatgcaaatgttaagcaattggtggatgtgcctggtcatgagtatttctcatatctggggcaaaagacgcagatggaggcagcgaatcaagctagggttgacgtggcagagggtgacaaggagggaattaaagtgaggactgaagtgaaggtttttgagaatcagagagaggctgaggtggctgaggctaattctgagttggctaagaagaaggcagcttggactaaggcggctcaggtggctgaagttgaggcgaagaaggccgtggctctaagggatgctgagttacaaggtgaagttgaaaggatgaatgctttgactactactgagaagcttaaagccgagttccttagcaaagctagtgttcaatatgaaactaaggtacaagaagcaaactgggagctgtacaagaagcagaaagaggctgaagcaattctgtatgagaagaaggcagaggcagaagcacagaaagcgtcagcagatgcaacattttatgcttgcaagcaagaagccgaagcagagctatacgcaaagaaaaaagaggcagaggggattgtgacacttgggaatgctcaaggagcgtatgtaagtacacttctgaatgcacttggaaacaactatacagctgtaagggattacttgatgataaatggtggcatgtttcaagagattgctaagattaatgccgaggcagtacgcggacttgagcctaagattagtatttggactaatggtagtgatagtggtggtgaaaaaactgaaggtgccatgggtatgaaagaagttgctggtgtctacaagatgttgccacctctgtttaagactgtccatgagcaaacgggcatgttgcctcctgcttggatgggagccttatctgagaaaagcccttaattaggatgatgcaatgcaagtattaggtttatatcagtagtaccttttattgtgtgattgatgtgtttgattcaccagtcttttattagttttaggttcaaactattatgttatatgacaatttaatttacatttttacatgcatggtatttttttgaatgcacttttggtgtttaaaacaaaactcttgacagggactaacatcaatgatatgatccatccaatccatccatcaaacaaaaaatttgttaatatgatccatgagatccatatgattacatcacattgtggttattatattgatagcatgcataattcatgaaataacaagagttcttacttgttctc

SEQ ID NO: 1499 - DNA, 1447 bp, Manihot esculenta
gaattaacatgtatagagttgcaagcccatcagagtttctggtgatcaccggcgtcggtatctcagatttaaagctagcaaagaaagcatgggtcctcccaggccagtcgtgtaccgtctttgatgtctcgcctgtcaattacacttttgaagtccaagccatgagcgcagagaagctccctttcgtcctccctgctgtcttcaccattggtcctcgtgtagacgacgaactcagccttctaagatatgcaaagctcatctctccacatgacaagctttctcaccatgtcaaggagctcgtccagggaatcatcgaaggagaaactagagttcttgctgcttccatgaccatggaagagatcttcagaggaaccaaagagtttaaacaagaagtttttgagaaagttcagcttgaacttaaccagtttggcttgttaatctacaacgctaacgttaaacagcttgttgacgtccctggccacgagtacttctcctatctgggtcagaagactcaaatggaagctgcaaatcaagctaaagttgatgtagcagaagcaaaaatgaaaggagagataggatcaaaagagagtgagggacaaacactgcaaaacgcagcaaaaatcgacgcagagacgaagataatatcaacgcagaggcaaggagaagggaagaaggaggagataaaggtgaagactcaggttaagatatatgagaatcaaagagaggcggaggtggcggaggccaacgcagagttggcgaagaagagggcagtatggactatggaggcaaaggtggcggaagtggaagcaacaaaagcagtttcactgagggaggctgagctgcagagggaggtggagcaaatgaatgctttgaccataactgagaagctaaaagcagagttcttgagcaaggctagtgtggagtacgagaccaaggtgcaagaagcgaactgggagctctacaagaaacagaaagcagcagaagcaatcctttatgaaaaggagaaagaggcagatgcacaaaaggcaattgcagatgctgcattttacgctcgtcagcaagttgccgatggagagttatatgctaagcagaaagaagctgaaggaatgatggctctagccaaagcacaaggagtgtatctacgaactcttctggatgcattggggggcaactatgctgccttgagggatttcttgatgattaatggtggaatgtttcaagaaattgctaagcttaatgctgaggctattcggggactgcagccaaagatcagcgtttggagtaatgggagtggtgtagagatcaatgaaggagctatgaaggaggttgctggggtttataggatgttgcctcctttgtttaagactgttcaggagcagactggaatgctaccacctccatggatgggcacgttaaccgactctagccatcccactgtcgactgaat

SEQ ID NO: 1500 - DNA, 1939 bp, Populus trichocarpa
gccttgcaaaactatggaaaccgctttgtaaattccatgttaatgtcaataatattcgttgtgcaggaaaaatatttctcaaggatattctttctccactgatcatatgatattattcacctgtatatattcacctttctgaagttcatcacaacattctcttttcacccctttccttccctgattgtttgcctacttctgtgcttgttcaagttcatacacttaacaaccatgtatagagttgctagtccgtccgagtttttggtgataaccggggttggtatctctgatattaagctagccaaaaagggatggatccttcccggccagtcatgtactgtcttcgacgtttcaccggtcaactacaccttcgaagtccaagccatgagtgcagagaagctcccttttgttcttcctgctgtcttcactattggccctcgtgtggatgacgaacaaagcctctttaaatatgcaaagctcatctctcgacatgacaagctctctaaccatgttaaagagcttgttcagggtatcatcgagggtgaaaccagagtacttgctgcttccatgaccatggaagaggttttcaaaggaactaaagagtttaaacaggaagtttttgagaaagtccagcttgaacttaatcagtttggattgttaatatataatgctaatgttaaacaacttgtcgacgttcctgggcacgagtacttctcttacttgggtcaaaagactcaaatggaggctgcaaatcaagccagagttgatgtagcagaagcgaaaatgaagggagaggtaggatcaaagcaaagggagggtcaaactctgcaaaatgcggcgagaatcgatgctgaaacgaagattattgcgacgcaaaggcaaggagatgggaagaaggaggagataaaggtgaagactgaggttaagatttatgagaaccatagagaagcagaggtggcagaggccaatgctgatttggcaaagaagaaggctggttggtccaaagaagcgcaggtggcagaggtggaagcaacaaaggccgtgtccctgagggaggctgagttgcaaagggaggtggagagaatgaatgctttgaccagaactgagaagctcaaggctgagtttctgagccaggctagcgtggagtacgaaaccaaggttcaagaagcaaactgggagctgtatacgaagcagaaagcagcagaagcaattctctatgaaaagcagaaagaagctgatgcacaaaaagcaacagcagatgcaacattttatgctcgccaacaagttgctgatggggagctatattcaaagcaaaaggaagctgaaggactcgttgcacttgcacaagcacaaggagtctatatacgcaccctcttagacgcattaggcggcaattatgcagcattaagagattacttaatgatcaacagcggaatgtttcaagagattgctaggattaacgcggatgcagttcatgggttgcagcctaaaatcagcatctggactaatggaaacagtggcgaggctaacgatggaactgggggaggcaatgcaatgaaggaggttgctggggtttataagatgttaccacctttgtttaagactgttcaagaccagactggaatgctaccaccggcatggatgggcacattgacagactctagccactctaatgtgaactgagtcatggtgagcttgtgattttgttgctcgagtttgctgatatgaatactccctgtggtctcccgttgattatgcatgtgcgtgtgttcttctttttttttttttttgtatcgcaaataattcggtaataataagatgaatgtaacactgatagttcctttattttcttcgaagatcaagcctgatttaaatgtaaacacaagttataaatcggtggaaggggagaagatcttgaattatcaaattttggcactct

SEQ ID NO: 1501 - DNA, 1806 bp, Populus trichocarpa
ctggaatgtaaattccacgcaaatcttgaatgatattcgttgttcataagaatatatcacagatattccttctccactgatcatctcactggtatatattcaactttttaagttcatcacaacgttctctttcaccccctttctctgcttacttctgtgctgatttgcatataaatttagtaatgttgtataaagttgctagcccgtcggagtatctggtgataaccggagttggcatctcagacataaagcttgccaaaaagggatggatcctccccggccagtcgtgttctgtcttcgatgtttcaccggtcaactacaccttcgaagtccaagctatgagtgcagagaagctcccttttgtccttcctgctgtcttcactattggccctcgtgtagatgatgagcaaagcctcttcagatacgcgaagctaatatctccacacgacaaactttctaaccatgttaaagagcttgtccagggtatcattgaaggtgaaactagagtcctcgctgcttccatgaccatggaagagattttcaaaggaactaaagactttaaacaggaagtgtttgagaaagttcagcttgaacttaatcagtttggattgttaatatataatgctaatgttaaacaacttgtcgatgttcctgggcatgagtacttctcttacttgggtcaaaagactcaaatggaggctgcaaatcaagctagaattgatgtagcagaggcgaaaatgaagggagagataggatcaaagcaaagggaaggtcggacacaacaaaatgcggcgaaaatcgatgcagaaacgaagataatagcgacacaacgacaaggagatgggaagaaggaggagataaaggtgaagactgaggttaagatttatgagaaccatagagaagcagaggttgcagaggccaacgctgatttggcaaagaagaaggccggatggtcaatggaggcgcaggtggcagaggtggaagcaacaaaggctgtatcactgagggatgctgaattgcaaatggaggtggagagaatgaatgctttgactagaactgagaagcttaaggctgagtttctaagcaaggctagtgtggagtatgaaaccaaggttcaagaagcaaactgggagctgtataggaaacagaaagcagcagaagcaattctctacgaaaaggagaaagaggctgatgcacaaaaagcaatagcagatgcaacattctattccagacaacaagttgctgatggagaactatatgccaagcaaaaggaagctgaagggcttgtagcacttgcacaagcacaaggagtctatctacgcacccttctagacgcattaggcggcaattatgctgcattaagagattacttaatgatcaacagcggaatgtatcgagagattgctaagataaactcagacgcagttcaagggctgcagccaaaaatcagcatttggactaatggaaacagcggggagacaaacgatggagctggggcaggcaatgcaatgaaggaggttgctggagtttataagatgctaccaccattgtttcagactgttcaagagcaaactggaatgctgccaccggcatggatgggctcattaaccgactctagcaactctaatgtgaaatgaaccgtgcttgcggcagattggtgagcttgtgaatttgtaacatgaacaagcactcaatttcctctccgactacttgtgtgaatgtgtatgcgtctgtttttttgttgcgaataatttggttaatattttcttatgtaatcaaatgaatgtaattcttataattccttta

SEQ ID NO: 1502 - DNA, 1453 bp, Prunus mume
ccatcaccatgtatagagtagcaagcccttcggagtatttagtgattactgggatcgggatagacgacataaagcttgcgaagaaggcatggatcctcccgggccagtcctacatcatattcgacatgtccccagtcaactacactttcgaagtccaagccatgagctccgagaagctccccttcatgctccctgcggtcttcaccattggcccccgcatcgacgacacccccagcctccacaagtatgcgaagctcatttcgcgtcacgacaagctctccagccacgtgaaagagctcgtccagggcatcattgagggagagacgcgtgtcctcgctgcctcaatgaccatggaggaggtgtttaaggggacaaaggagtttaagcaagaggtgtttgagaaggttcagttggaattgaatcagttcgggcttttgatatataacgcaaatgtcaaacagttggtggatgttcctggacatgagtattttagttacttggggcagaagacacagatggaggcggccaatcaggctaaagttgacgtggctgaggcgaggaagaaaggggagatagggtccaaggagagggaggggttgacgctgcagaacgcggcgaagattgacgctgagacgaagatctatgcgacgaagagggaaggggagggaaagatggccgagataaaagtgaaagcagaggtgaaggtgtatgagaatgtgagggaggctgaggtggcagaggcgaatgctgagctggcgaagaagaaggccgggtgggcgaaggaggcgcaggtggcggaggtcgaggccgcgaaggcggtggcattgagggatgcggagctgcagacgcaggtggaaaggatgaatgccttgaccaggacggagaagcttaaggctgaatttttgagtcaggccagcgttgagtatgaaacaaaggtacaagaggcaaattgggacttatacaacaagcaaaaggccgccgaagcaattctttaccaaagagagagagaggctgaggcacagaaggcaattgcagaagcagagttctatgctcgtcaacaagttgcagatggagaattttatgcaaagaaaaaagaggctgagggtctcatagcccttggacaagcccaaggtgcatatctacgcaatcttctggacgcagttggaggcaactatgcagccatgagggacttcatgatgatcaacagcggcatgtttcaagaaattgctaaaattaatgccgaagctgtgcgtggacttcaacccaagatcagcatttggactaatggggccgtagagggtggcgatggtggcagcaacggggccatgaaggaggttgctggagtttacaagatgttgccaccattgttcaagacagttcatgaacaaactggaatgctgccaccggcttggatgggcactttgccaaattctggttctaacaattgaattcg

SEQ ID NO: 1503 - DNA, 1483 bp, Aquilegia formosa
acatcataaactctcaaacaaacatgtatagagttgctagtccatcagagtatctagtaatcactggtgtaggcataaaagatataaagatcgtcaagaaaggatggatccttcctggccaatcgtgcacagttttcgatgtctcacctgtaaactatacctttggggttcaagctatgagtgcagagaagctcccttttgttctccctgcagtctttactataggcccccgagttgatgatgacgaaagcttacttaaatatgctaagctcatttctccccatgacaagctgtctaaccatgttaaagagcttgttcaagggatcattgagggtgagactcgtgttcttgcggcatccatgactatggaagaaatttttaaaggcaccaaagagtttaaacatgaagtttttgggaaggtacaacttgaattgaatcaatttggacttttgatttataatgcaaatgttaagcaacttgttgatgtacctggtcatgaatacttctcctaccttggacaaaaaactcaaatggaggctgctaatcaagctagagttgatgtagctgaagcaaagatgaagggagaggttgggtcaaagcttcgtgaaggacaaacattacaaaatgccgcaaagattgatgcagagacaaagatcatatcgacacaaaggcagggagaagggaagaaagaagaaattaaggtgaaaacagaagtcaagatatttgagaataagagggaggctgaggtagctgaggcaaatgccgagttggctatgaagaaggctgggtggactcaacaggcacagttggctgatgtcgaggcagcaaaggctgtggcactgcgagcggcagaattacaaagacaggttgagatgatgaatgctatgactcagacagagaagcttaaggctgagttcctgagtaaagctagtgtggagtatgaaaccaaggtgcaagaagcaaattgggaattttacaagacacagaaggcagcagaagcagagctttatgagaaggagaaagaagctgaagcacagagagcacttgcatctgcaaagttttatgcccagcaacaatttgcagatggagaactgtatgccaaaaagaaagaggctgaaggactagttgcattagcacaagctcaaggcatctatatacgtacacttttagaggcattgggtggtaactattctgcagtaagagattatttgatgatcaatgggggtgtgttccaagaacttgcaaagattaatgctggggctgtacaaggattgcaaccaaagatcagtatatggactaatgggaatggtggggaaatgacgggtggagttggaaatggcagttctgccatgacagaggttggcggggtctataaaatgttgccaccattgtttaagaccgtgcatgagcagactggaatgcttccaccagcatggatgggtactataacagactcatcaaatatatgaaatgcctatgcaca

SEQ ID NO: 1504 - DNA, 1373 bp, Trigonella foenum-graecum
aaaactcccttttgttctccctgctgtcttcacaattggtcctcgtgtggacgatcatgaaagccttctcaaatacgccaaactaatttctcctcatgataaactctccaatcacgttaaggaactcgttcaaggaatcatcgaaggggagacacgtgtccttgctgcttcgatgacgatggaagaggttttcagaggaacaaaagagtttaacaagaagtattcgagaaagttcaacttgaattgaatcaatttggattattgatttacaatgcgaatgttaaacaattggtggatgtgcctggtcatgaatatttctcatatttgggtcaaaagacccagatggaagccgcgaatcaagctagggttgatgtcgcagaagctaagatgaaaggtgaaattggttcaaaattgagggaaggacaaacgctgcagaatgctgcgaaaattgatgcagagacgaaggttattgcaatgcagagggctggagagggtgagaaacaaggaattaaagtgaagactgaagtgaaagtttttgagaatcagagagaggctgaagtggctgaggctaattctgagttggctaagaagaaagcggcttggacgcaggcggctcaagtggctgaagttgaggctgctaaagctgtggctctaagggaagctgagttacaaggtgaagttgagaggatgaatgctttgactacaactgagaagcttaaagctgatttacttagcaaagctagtgttcagtatgaaaccaaggtacaagaggctagctgggaattgtacaaaaaacaaaaagaaggcagaagcaattctgtatgagaagaaggcagaggcagaagcccagaaagcattggcagatgcaacattttatgcgcgtaagcaagaagctgaagcagagctatacgcaaagaaaaaagaggctgaggggattgtgacacttgggaatgctcaaggagcgtatgtaagtacacttctcaatgcacttggaaacaattacacagctctaagggattacttgatgatagatggtggcatgtttcaagagattgctaagattaatgctgacgcgatacttggacttgagcctaagatcagtatttggactaatggtggtgaaaatggtgggggaataactgaaggtgccatgggtatgaaagaagttgctggtgtctacaagatgttgccgcctctatttaagacagttcatgagcaaacgggaatgttaccacctgcttggatgggaaccttatctgatgacaaaaaagctcttaattaggaggatgcaaatattattaggtttatagtagtagtacttttttttgttggtaatttagcaataatcctttatttgtgatacatgcgttgga

SEQ ID NO: 1505 - DNA, 1531 bp, Cucumis sativus
tctcaatttccgttgcgatcatgtacaaagtagcgagcgcatcggaataccttgccattaccggtgtcggaatcagcgacatcaaactcgctaagaaggcatgggttctccctggccaatcctgcaccatcttcgacatctctcccgtcaactacaccttcgaagtccaagccatgagcgccgagaaacttcctttcatcctccccgcggtcttcaccatcggccctcgctctgacgacatggactctctccttaagtacgccaagcttatttccccgcacgataagctctccaaccatgtcaaggagctcgtccagggcgtcatagagggggagactcgtgtccttgcagcctccatgaccatggaggagattttcagaggcaccaaagagttcaaacaggaagtgttcgggaaggtccagttggagctcgatcaattcgggcttttgatttacaatgctaatgttaaacagttggtggacgttcgtgggcatgagtatttttcgtatttaggacagaagacgcaacaggaagctgcgaatcaggcgaagattgatgtggcggaggcgaggatgaagggggaaattggggctaaatccagagaaggacaaacccttcagaatgctgctaagatcgacgctgaaactaagattattgccacacagaggcaagggcagggtaagaaggaggagatcaaggtcaaggcggaggttaaggtgttcgagaatgagagagaggcggaagtggcggaggctaacgccgaacttgctaagaagaaggccgcctggactagagctgcccaagtggcggaagtggaagccgcgaaagccgtcgcactccgagaggcgcagttgcagaaggaagtggagatgatgaatgcaatgaccatgacggagaaattgaaggctgaatttctcagtaaagccagcgttgagtatgaaactaaggtacaagaagcaaactgggagttgtacgacaagcaaaagaaagcggaagctgttctgttcgagaaggagagggaagctgaagcacagaaggcactagccgacgccgggttttatgctcgtcaacaagtcgccgacggagagctctatgccaaaaagaaagaagcggaaggattggtggcactggcggaggctcaagctctgtacctccgttcacttctcgaggcattgggcggcaattactccgctcttagagattacctaatgatcaacggaggcctattccaagaagttgctaaaatcaatgccgacgccattaaagggcttcagcctaagattagtgtctggaccaatggaagtggcggacagggtctagaaggaggctccggagctgggagtatagcgatgaaagaggtggccggagtttacaaaatgttgccaccgctgtttcaaacggttcatgagcaaactggaatgctgcctccgccatggatgggaagcttgggtgattcttctcagaattgaagaagaaaggtttgattttgtatatcaaatcaattaaaagatctctcaaattaactgttttt

SEQ ID NO: 1506 - DNA, 1459 bp, Malus domestica
aactaaaatgtatagagttgcaagcccttcagagtatctggtgatcacgggggtcggaatcgatgacataaagctagcaaagaaggcatggatcctccccggccagtccttcataatcttcgacatgtccccggttaactataccttcgaagtccaagccatgagctcggaaaagcttcccttcatgctccccgccgtcttcaccatcggcccacgcattgacgacatggaaagcctccacaagtacgccaagctcatttctcgccacgacaagctctccagccacgtcaaagagcttgtgcagggaatcatagaaggcgagacgcgtgttctcgctgcctcgatgaccatggaggaggtgtttaaggggaccaaagagtttaagcaagaggtgtttgggaaggttcagttggaacttaaccagtttgggcttttgatatataatgcaaatgtcaaacagttggtggatgtcccagggcatgagtattttagttacttggggcagaagacacagatggaggcggcgaatcaagcaagggttgatgtggcggaggcaaagaagaagggggagatagggtcgaagctgagggagggggagacgttgcagaacgcggctaagattgacgcggagactaagatatatgggacgaagagagagggggaggggaggatggcggagattaaggtgaaggcggaggtgaaggtgtatgagaatgtaagggaggctgaggtggccgaggcaaatgctgagctggcgaagaagaaggccgggtgggcgaaagaggcgcaggtggcggaggtggaggctgcaaaggcagtggcattgagggatgcggagttgcaaacggaggtggagaggatgaatgccttgactatgacggagaagcttaaagctgagtttttgagtaaggccagcgttgagtatgaaacgaaggtacaagaggcgaattgggagttatacaacaaacaaaaagcctcagaggcaattctttaccaaagggagaaggaggcagatgccaaaaaggcattggcggaggcagaattctgtgcacgtcaacaagctgccgatggagaattttatgccaagaaaaaagaggctgagggactcatggctcttggacaaactcaaggtgcatatctacgccaccttttggatgcagttggaggcaactatgcagccatgagagactttatgatgatcaatagtggcatgtttcaagaaattgctaagatcaacgccgaggccgtgcgcgggcttcagccgaaaatcagcatttggactaatggcgggggagagggtggtgatggtggtgcaaatggggctatgaaggaaatttccggagtttacaagatgttgccaccgttgttcaagacggttcatgaacaaaccggcatgtcgcctcctgcttggatgggcactttggacaattctcatcctagcaactaaactcagattctt

SEQ ID NO: 1507 - DNA, 1685 bp, Phaseolus vulgaris
acttgctttctagtgtaaattgtaatctctaagaaataataatggaggtattgaagattctgatttaaacatcatacgagatttatctccttctctgaattgttcttcttctcttggtatatccacgaatggcagaagcataaacatgtacagagtagcaaaggcatcagaataccttgtgatcactggagttggaatcacagatttaaagcttgcgaaaaaagcatgggttctcccgggccaggcatgcaggatcttcgacctctctccagtgaactacaccttcgaggttcaagccatgagcgcagagaagctccctttcaatctccccgccgtcttcaccatcggtcccagggccgacgacgacgccagccttctcaaatacgccaaacttctctcttcccacgacaagctctcccaccacgtggaggagctagtccagggcatcatcgagggagagacacgcgtcctcgcggcgtcgatgaccatggaggatattttccgaggcaccaagtcgtttaaacaggaagtgttcgagaaggttcagctggagcttaaccagttcggccttctcatctacaacgccaacgtcaagcagctggtggacgtcgctggccacgagtacttctcttatttgggtcagaagacgcagatggaggctgccaaccaggccaagattgacgtggcagaggcaaagatgaagggagaggttggagccaagatgagggaggggaaaacgctgcagaacgctgcgaagatcgatgcggagacaaagataatatccacgcagaggcacggggagggtgtgaaggaggagatcaaggtgagggcggagatgaaggtgttcgagaacgagcgagaggctgtggtggcggaggctaattccgagcttgccaagaaaaaagcggcgtgggcacagacggcgcaggtggcggaagtggaggcctcaaaagcagtcgcactgagggcagccgagttgcagagagaggttgagaagatgaatgctctcacaaccacagagaagcttaaagctgagttcctcaccaaagcaagtgttgagtacgaaaccaaggtacaagaggcaaactgggagctgtacaggaagcagaaagcggcagaagcaatattgtttgagaaggagaaagaggcagaagcacagaaagcaatggcggaggcagcatttttcagtcggcagcaagcagcagaagcagagctatatgcaaagaaaaaggaggcagaaggacttttggcaataggggaagcccaaggagcatacataagaacacttcttgatgcactgggaggcaactacaccaatctaagggactacttgatgataaacaatgggatgtttcaacagattgcaaagactaatgcagaagcaattcgtggacttcaaccaaagattagtatttggagcaatggcggagaaggaagtgatgttagtggtgaaatgaaagatgttgcaggtgtgtacaagatgttgccacctttgtttaagacagtgcatgagcaaacgggtatgctgccacccgcttggatgggaaccctgtcagacaaaacagcttaaactctcttctttctgctttcatgtttcttttgttcaaaatgtgcaacattacttattttttattatgtaattaggttgttttggattcgtgaaatttgaaattcatcaatttact

SEQ ID NO: 1508 - DNA, 1512 bp, Citrullus lanatus
tattcagagtctgcagagcacttttgtaactccgttccgatcatgtacagagtagcaagcgcatcggagtaccttgccattaccggcgtcggaatcgacgacattaaactcgccaagaaggcatgggttctccccggccaatcctgcaccatcttcgacatctctcccgtcaactacaccttcgaagtccaagccatgagcgccgagaagctccctttcatcctccccgccgtcttcaccatcggccctcgctccgacgacatcgaatccctcctcaagtacgccaaactcatctcccctcacgacaagctctccaaccatgtcaaggagctcgtccagggcgtaatcgagggcgagactcgtgtccttgccgcctccatgaccatggaggagattttcaagggcaccaaagagtttaaacaggaggttttcgggaaggttcagttggagctcgatcaattcgggcttctgatttacaatgctaatgtcaaacagttggtggacgttcgtgggcacgagtatttttcgtatttagggcagaagacgcagcaggaggctgcgaatcaggcgaaggtggatgtggcggaggcgagaatgaagggagaaattggggctaaatccagggagggacaaacccttcagaatgctgctaagatcgacgccgagactaagattatttcgacacagaggcaggggcaggggaagaaggaggagattaaagtgagggcggaggtgaaggtgttcgagaatgagagggaagctgaagtggcggaggcaaacgccgaactcactaagaagaaggctgcctggactagagctgcacaagtggcggaagtggaagccgcgaaagccgtcgcactcagagaggcggagcttcagaaggaggtggagatgatgaatgcaatgactatgacggagaaattgaaggctgaatttcttagcaaagccagcgttgagtatgaaactaaggtacaagaggcaaattgggagttgtacaacaagcaaaagcaagcggaagcggtcctgttcgagaaggagagggaagccgaagcacagaaggcattagccgacgccggcttttacgctcgtcaacaagtcgccgacggagagctctacgccagaaagaaagaggcggagggattggtggcactggcagaggctcaagctctttacctccgttcacttctcgatgcattggggggcaattacgccgctctcagagattacctaatgatcaatggaggcctattccaagaagttgctaaaatcaatgcggacgccattaaaggccttcagcctaaaattagtgtctggactaatgggagcggcggacaaggtctggaaggcggcgccggagctgggaatatggcgatgaaagaggtggctggagtttacaaaatgctgccgccgctgtttcagacggttcatgagcaaactggaatgcttcctccgccgtggatgggaagcttgggtgattcttctcagaattgaagaactagggtttggtttggt

SEQ ID NO: 1509 - DNA, 1737 bp, Chrysanthemum coronarium
acacactggcaagaagccaagaaccatactactccgtatataataccatcaactttgttcttcaacacaaaacacaaaaacagtcgagcaaattataatctccagccatgtatagggttgcaaaggcatcggagtacttagtgatcaccgggttcgggatcgatgacataaaaattgctaagaaagcatgggtacttccgggccaatcctactccgttttcgacatctcacccgtcaactacactttcgaagtccaagccatgagcgcggagaagctccctttcatcctacctgctgtgttcaccattggtcctcgctctgaccatgacgagagccttaacaaatacgccaggctcatttcccctcatgacaagctatcgcaccatgtgaacgagcttgtcaaggggatcattgagggtgagacgcgtgttttggctgcgtcgatgaccatggaagagattttccgaggaactaaggagtttaagcaggaggtttttgagaaagttcagcttgaacttaatcagttcgggttgtggatttacaacgcgaatgttaaacagcttgtggatgttcctggacacgagtatttctcgtacttgggacaaaagacacaaatggaagctgcgaatcaagcaagggtcgatgtttctgaagccaaaatgaagggagaaataggttcaaagcttcgagaagggaagacgctacagaacgcagcacagatagatgcggagacaaagatcatagcgactcagaggcagggacaggggaaaaaggaagagataagagtgaagacagaggtgaaggtgttcgagaatgagagggaggctgaagtggctaaagccaatgctgagctcgcaatgaagaaggcaaaatgggccaaggactcgcaggtggccgaggttgaagcaaataaagctgtggcacttagagcggccgagcttcagaaggaggttgaggttatgaacgcgttgactcagaccgagaaacttaaggccgagttcttgagcaaagcgagcgttgagtatgaaaccaaggtacaagaggccaactgggacttatacaaaaagcaaaaagccgcggaagcacttctctaccagaaagaaaaagaagctgaggctcaaaaggcaacatccgaggccacattctacgctcgtcaacaagtagctgatggtgaattatatgccaaacaaaaagaggctgagggtcttgttgcgctcgcagaagcccaaggtacctacatacgtacccttctgggtgctttgggaggtaactatggggctttacgcgattatctaatgattaatggagggatgtatcaacaaatcgcaaagattaatggtgaagccgtcaaggggttgcagccgaaaatcagcatttggaccggtgcaagtggcagtggagaaggtggtgatggaggtgcaatgaaggaagtcgccggtgtatacaagatgttgccacccttgtttaacacggttcatgagcaaaccggaatgttgccaccagcttggatgggcaagatcactgaatcccctagtcgccaatttacctaagtttaatggtatcgtataagacgttacataatctcttgtattatgagtccaagtgtcatgaaagtgagaatttgcttgtttaacttaatcttctacatgtgttggtgctacatgcttgtatttagtagcttgaaccttttcagtaagtgttatgaaatttgtatatatatatgctcgtacgtattgc

SEQ ID NO: 1510 - DNA, 1676 bp, Chrysanthemum coronarium
gtcgagcaaattataatctccagccatgtatagggttgcaaaggcatcggagtacttagtgatcaccgggttcgggatcgatgacataaaaattgctaagaaagcatgggtacttccgggccaatcctactccgttttcgacatctcacccgtcaactacactttcgaagtccaagccatgagcgcggagaagctccctttcatcctacctgctgtgttcaccattggtcctcgctctgaccatgacgagagccttaacaaatacgccaggctcatttcccctcacgacaagctatcgcaccatgtgaacgagcttgtcaaggggatcattgagggtgagacgcgtgttttggctgcgtcgatgaccatggaagagattttccgaggaactaaggagtttaagcaggaggtttttgagaaagttcagcttgaacttaatcagttcgggttgtggatttacaacgcgaacgttaaacagcttgtggatgttcctggacatgagtatttctcgtacttgggacaaaagacacaaatggaagctgcgaatcaagcaagagtcgatgtttctgaagccaaaatgaagggagaaataggttcaaagcttcgagaagggaagacgctacagaacgcagcacagatagatgcggagacaaagatcatagcgactcagaggcagggacaggggaaaaaggaagagataagagtgaagacagaggtgaaggtgttcgagaatgagagggaggctgaagtggctaaagccaatgctgagctagcaatgaagaaggcaaaatgggccaaggactcgcaggtggccgaggttgaagcaaataaagctgtggcacttagagcggccgagcttcagaaggaggttgaggttatgaacgcgttgactcagaccgagaaacttaaggccgagttcttgagcaaagcgagcgttgagtatgaaaccaaggtacaagaggccaactgggacttatacaaaaagcaaaaagccgcggaagcacttctctaccagaaagaaaaagaagctgaggctcaaaaggcaacgtccgaggccacattctacgctcgtcaacaagtagctgatggtgaattatatgccaaacaaaaagaggctgagggtcttgttgcgctcgcagaagcccaaggtacctacatacgtacccttttgggtgctttgggaggtaactatggggctttacgcgattacctaatgattaatggaggaatgtatcaacaaatcgccaagattaatggtgaagcggtcaaggggttgcagccgaagatcagcatttggaccggtgcaaatggcagtggagaaggtggtgatggaggtgcaatgaaggaagtcgccggtgtatacaagatgttgccacccttgtttaacacggttcatgagcaaaccggaatgttgccaccagcttggatgggcaagatcactgaatcccctagtcgccagtttacctaagtttattggcatcatataagatgttagtacataatatcttaaattatgagtccaagtgtcatgaaagtgagaatttgcttgtttaacaaaatgtctacatgtgttggtgctacatgcttgtatttagtagcttgaaccttttcagtaagtgttatgaaatttgtatatatatatgctcgtacgtattgcaataagaaacgagtagtgt

SEQ ID NO: 1511 - DNA, 1504 bp, Helianthus annuus
gcaagtgcatccgagtatttagtcatcaccggattcgggatcgatgacatcaaaatcgccaagaaagcatgggtacttccgggccaatcctactccgttttcgacatctctccggtcaactacacgttcgaagtcatggccatgagtgctgagaagctccccttcatcctccctgccgttttcactatcggtccacgatccgatgacgacgacagcctcaacaaatacgccaagctcatctcccctcacgataagttatcgcaacatgtgaatgaacttgtcaaggggattattgagggcgagacacgtgtcctggctgcatccatgaccatggaagagatatttaaaggaaccaaggagtttaagcaggaggtgtttgagaaagttcagttggaactgaatcagttcgggttgtggatctacaatgcgaacgttaaacagttggtggatgttcctggacacgagtatttctcgtatttaggacaaaagacacagatggaagccgctaatcaggcgaaaatcgatgtctctgaagccaagatgaagggtgaaataggagcgaagcttcgagaaggacaaacactgcagaacgcggctaagattgatgcggaaacaaggatcatatcgacgcagaggcaaggccaggggaagaaggaagagataaaggtgaggacggaggtgaaggtgtttgagaacgaaagggaggctgaggtggcagaagcaaatgctgagctggcgatgaagaaagcgaagtgggccaaagattcacaggtggcggaggtggaggcaactaaggcggtggcgcttagggaggccgagctgcagaaggaggttgagatcatgaacgcgttgactcagaccgagaaacttaaggctgagttcttgagcaaggcgagcgttgagtatgaaaccaaggtacaagaggcgaattgggagctttacaagaaacaaaaagccgcagaagcaattttgtatgagaaagaaaaagaagcagaggctcaaaaggcgacagccgaggccaccttctacgcgcgtcaacaagttgcagatggtgaactatacgcaaaacaaaaagaagctgaaggtctagttgcccttgcacaggcacaggggacatacataaggacccttttaggtgcattggggggtaactatggtgcgctaagagattatttaatgatcaatggtggaatgtatcaagagattgctaagattaacggggaggcgatcaaggggttgcagcctaagattactatttggactggtgcaggtggtgttggggacgggggtgatggtcaaggtggtgctatgaaggaggttgctggggtgtacaagatgttaccgccattgtttaacacggttcatgaacaaactggaatgttgccgccaacttggatgggcaagatcaaggatcatgattgttaaatatgaattgaagtctttagtttaatattctaatggtatcaataagagtgtataacgttaagctcttagttgggatatt

SEQ ID NO: 1512 - DNA, 1461 bp, Prunus mume
caagcatgtataaagtagcaagcccatcagaatatctggtgatcaccggcgttgggattgaggacataaggcttgcaaagaagggatggatcctccccgggcaatcctacatcatcttcgacatgtcccccgtcaactacaccttcgaagtccaagccatgagctccgagaagctccccttcatgctccccgccgtcttcactatcggccctcgcatcgacgacatgcccagcctccacaagtacgccaagctcatctctcgccacgacaagctctctacccacgtcaaagagcttgtccagggtatcatcgagggggagacgcgtgtcctcgctgcctcgatgaccatggaggaggtgtttaaggggaccaaagagtttaagcaagaggtgtttgggaaggttcagttggaactcaatcaatttgggcttttgatatataacgcaaatgtcaaacagttggtggatgtaccggggcatgagtattttagttacttggggcagaagacacagatggaggcggccaaccaggctaaagttgacgtggcggaggctaggaagaagggggagatagggtctaaggagagggaggggttaacgctgcagaatgcctccaagattgatgcagaaacaaaaatatatgccacgaggaggggaggagaggggaggatggcggagataaaggtgaacgcggaggtgaaggtgtatgagaacgtgagggaggctgaggtggcggaggcaaatgctgagctggcgaagaagaaggccgggtgggcgaaggaggcgcaggtggcggaggtggaggccgtgaaggcggtggcgttgagggatgcggagctgcagaaggaggtggagaggatgaatgccttgactatcacggagaagcttaaagctgagttcttgagtaaggctagtgttgagtatgaaacaaaggtacaagaggcaaattgggagttatacatcaaacaaaaagccgcggaagctattctttaccaaagggagaaggaggccgaggcacagaaggcaattgctgaggcagaattatatgctcgtcaacaagttgcagatggagaattttatgcaaagaaaaaagaggctgagggtctgatggcccttggacaagcccaaggtgcatatctacgcactcttttggacgccgttggcggcaactatgcagccatgagggacttcatgatgatcaaaagcggcatgtttcaagaaattgctaatatcaatgctgaggccgtgcgtggacttcaacccaaaatcagcatttggacaaatggaggcggagagggcggggatggcggccatggggctatgaaggaggtggctgaggtttacaagatgttgccaccattgttcaagacagttcatgaacaaactggaatgctgccaccggcttggatgggaactttgtccgattctcattctaccagctcggctcttaattgagttcgag

SEQ ID NO: 1513 - DNA, 1657 bp, Mimulus guttatus
tcaaatcaacatgtatcaagtcgcgagtgcatcagagtacttggtggtgaccggtgccggaatacccgacataaaaatctcgaagaaagcatggatattccccggccaaacgtacacaaaattcgacgtatctccagtgaactacacgttcgaagtacaagccatgagcgcggagaaactcccgttcatcctcccggccgtattcacgatcggcccacgcatagacgacgaggccagcctactcaagtacgccaagttgatctccccacacgacaagctctcccaccatgtcaaggaactcgtgcagggcattatcgaaggcgagactcgagtcctcgctgcttcgatgacgatggaggagattttcaaagggaccaaagagttcaaacaggaagtctttgggaaggttcaattggagctcgaccaattcgggctactgatttacaatgctaacgtgaagcagcttgtcgatgtacctggccacgagtatttttcctacttggggcagaaaactcagatggaggcggcgaatcaggcgaaggttgacgtggcggaggcgaagatgaagggtgatttggggtcgaagctgagggagggggagacgcttaggaatgcggcggcgattgatgcggagacgaagattgcgtcgacgcaaaggcagggagaggggaagaaggaggagataaaggtgaggactgaggtcaaggtatttgagaatcagagggaggctgaggtggcggaggcgaacgctgagctggcgaagaagaaggccggttgggcgaaggaggcgcaggtggcggaggttgaggcaagcaaggctgttgctttgagggatgctgagctgcagagggaggtcgagacgatgaacgccttgactcagacggagaagctcaaggctcagttcttgagcaaagccggagtcgaatacgaaacaaaggtccaagaggcgaattgggagctttacaagaagcaaaaagcggcagaagcgtacctgtacgagaaggagaaggaggcacaggcacagaaagcagtagcagatgcttctttttaccagcggaaacaagtggtggacggtgatttgtacgcaaagatgaaggaagctgaagggctgaaagcacttgccgaagctcagggcacttacatacgcacacttctcgacgcaatgggcggaaactacgcggcgttgagggattacttgatgatctccggcggtatgtaccaggatatagccaagattaactccgaggctgtgcgtgggctccagccaaagatcagcatttggaccaacggaagtggaagcggtgatggtggcgacaatagtgcgatgaaggaagttgccggagtttacaagatgctgccgccgctattcaagactgttaatgagcagactggcatgctcccgccttcatggatgggcactttgaccgacgactctacgtcaaacaattgatatcatcatatcaataattcagtatctacatagctatatattaattaggtttagatgcttcttttttcatgcttacttatttcataattaggtttagatgcttcttttttcatgtttaattaacaattgctttctggcatttttttcttaattcctactactatacattagcaatcaaatcaaaatagctttatttttcttcatcat

SEQ ID NO: 1514 - DNA, 1725 bp, Nicotiana benthamiana
attccattataactccattatagtacacctccaacaccacatctgatccacccaataccaaaatatcaaaaaacttgtgtccagaaaatgtatagagttgcaagtgcatcagagtacttggtgatcacagggctagggatcaccgatataaatatagccaagaaagcttgggtacttcctggacaatctagtagaaagtttgatgtttcccctgtgaattacacttttgaagtccaagccatgagtgctgaaaaactcccttttgttcttccagcagttttcaccatcggtcctagagttgatgatgaaggcagcctcctgaagtatgcaaaactcatctctccacatgacaaactctcgaaccatgtcaaagatcttgtgcaaggtatcattgaaggagaaactcgagttcttgctgcatcaatgacaatggaggagatattcaaaggaaccaaagagttcaaacaagaagtattcgggaaagtccaacttgaactaaaccaatttgggctattaatctacaatgcaaatgtcaaacagctagttgatgttccaggacacgagtacttctcctacttgggtcaaaagacacaaatggaagctgcaaatcaagcgaaaatagatgttgcagaagctagaatgaaaggagagattggagcaaagctaagatcaggacaaacactacagaatgccgcaaaaattgatgcagaaacaaggattatatcgacacaaagggaaggagaagggaagaaagaggagatgaaggtgaagactgaagtgaaggtttatgaaaaccatagagaagcagaagttgctgaagcaaacgcagaattggcaaagaagaaagcagggtgggctaaggatgcacaagtagcagaggtggaggcagagaaagctgtggctttgagggatgctgagttgcagagggaagtggagaggatgaatgctttggccatgacagagaagcttaaggctgaattcttgagcaaagctagtgttgagtatgaaactaaggtgcaagaagcaaattgggagctctacaagaaacaaaaagaagcagaagcatatctctacgaaaaggagaaagaagcagcagcacagaaagcaattgctgaagctgatttctacagacgtaagcagatcattgatggagatttatatgcaaagatgaaggaagcagaaggacttaaagctctagcagtagctcaaggcacctatttgcacactctcttagaagctttgggtggaaattatgctgctttaagggattacttaatgataagtggtggaatgtttcaagaacttgccaagattaatgctgaggctatccatggcctacaacccaaaatcagcatttggacaaatggaggatctcatgaggcagcagcagaaggtggtggaagtgccctaaaagaagttgctggcatctacaaaacattaccaccattgttcaagaccgttcaagaacagactggaatgttgccaccttcatggatgggcaccttgactaatgacactagtcaatgacttgttctcttcgacgaataatgttaggatcaaaatgtcacacttttgctattttgttcaaataaaaaccccacggaactggtctactagattagtgctagtgcatgcaacttgaggtttgctcagttagtgaggcatgtctatatctaagcagcaggtcaagagttttgagtcctaaggggatgatcgtcgaactta

SEQ ID NO: 1515 - DNA, 1431 bp, Prunus persica
atgtatagagtagcaagcccttcagaatatctggtgatcaccggggccgggatcgacgacataaagctggcaaagaagggatggatcctccccggacaatcttacatcatctttgacatgtcccccgtcaactataccttcgaagtccaagccatgagcatcgagaagctccccttcatgctcccggccgtcttcactatcggcccccgcatcgacgacatgcccagtctccacaagtacgccaagctcatttctctccacgacaagctctctacccacgtcaaagagcttgtccagggcatcatcgagggtgagacgcgtgtcctctctgcctcgatgaccatggaggaggtgtttagggggaccaaagagtttaagcaagaggtgtttgagaaggttcagttggaattgaatcagttcgggcttttgatatataacgcaaatgtcaaacagttggtggatgttcctggacatgagtattttagttacttggggcagaagacacagatggaggcggccaatcaggctaaagttgacgtggcggaggcgaggaagaaaggggagatagggtccaaggagagggaggggttgatgctgcagaacgctgcgaagattgacgctgagacaaagatctatgcgacaaagagggaaggggagggaaagatggcggagataaaggtgaaagcagaggtgaaggtgtatgagaatgtgagggaggctgaggtggccgaggcaaatgctgagctggcaaagaagaaggccgggtgggggaaggaggcgcatgtggcggaggtggaggccgtgaaggcggtggcgttgagggatgcggagctgcagacggaggtggagaggatgaatgccttgactaggacggagaagcttaaggctgagtttttgagtaaggccagcgttgagtatgagacaaaggtacaagaagcaaattgggagttatacaacaaacaaaaggccgcggaagcaattctctacctaagggagaaagaggctgaggcacagaaggcaattgcagaggcagaattgtatgcttgtcaacaagttgcagatggagaattttatgccaagaaaaaagaggctgagggcctcatggcccttggacaagcccaaggtgcctatctatgcaatctttgggacgcagttggaggcaactatgcagccatgagggatttcatgatgatcaacggcagcatatttccagaaattgctaagattaacgccgatgccgtgtgtggacttcaacccaaaatcagcatttggactaatggaggcggagagggcggcagaaatggggccatgaaggaggttgctggagtttacaagatgttgccaccattgttcaagacagttcatgaacaaactggaatgctgccaccggcttggatgggcactttgccaaattctggttctaacaactag

SEQ ID NO: 1516 - DNA, 1631 bp, Trifolium pratense
ctcaatttcatctcaaaatggcttgcacctctgctaattcattactccagttaaagggttcttcccaccagaggccacttttgaatttgagaacaaacatcgctgctcattactcaccacccggcttatttaacctaaagggtgacgggttaatccataaagggttcaggcatcaaagtcagaaacatattgtacctaggaataaagttactgttatacgagctgtggcaattccggtagaaccagctccagtggaaagtgtggagtacagaaaacaactagcagaacgctatggttttgagcaaattggagagccacttcccgacaatgttacattaaaggatgtcatcacttctcttcctaagaaggtttttgagattgacgatgttaaagcatggaaaactgttttgatatccgccacttcctatgcgctggggcttcttatgatttctaaagcaccctggtatctacttcccttggcttgggcttggaccggtactgctgtaactgggttctttgttataggacatgattgcgctcacaaatcattttcaacaaacaaattggtagaagacattgttgggactctggcttttttgccactaatttatccatatgagccatggcgatttaagcacgacaaacatcatgcaaaaacaaacatgttgaaagaagatactgcttggcagcctgtttggaaggatgagtttgagtcaaaaccacttttgaggaaggcaataatatttggatatggtccatttcgatgctggatgtctatagctcactggttggtctgtcacttcaatttgaagacgttcagaccaaacgaaataaagagggtgaagataagtttagcttgtgtttttgcctttatggcaattggatggcctttaattatttacaagactggaatcatgggatggataaaattctggttgatgccatggttggggtatcacttctggatgagtactttcaccatggtacatcatactgcaccacacataccattcaaatactcagaagagtggaatgctgcacaagcacagcttaatggaactgttcattgtgcttaccctcaatggatcgaggtcttatgccatgatattaatgtccatattccacaccatatatctccgaaaataccaagctacaatttacgagcagcccataaatcactccaagaaaattggggaaagtatctgaatgaagctagttggaattggcgattgatgaagacaatcttgacggtatgtcacgtgtacgataaggagcaaaattatgtttcctttgaagaagtagcccctgaagaatcaaattcaattaaatttttgaaggaagtaatgcctgattatgcctaattaggcccaacttggcttattctcatataatatttgtgtgtcagagtagataggtataccattcattttctttttaaacgttcaatcttgtttaatattgttccatttttcatattataacaagggaaaattgcttggagctctctttaagttcacgttttaagttaatcatattacctagttgtggattgtccaaggccaagccatgagagacattcattaggttaatgtagacattatattatagttaatctgaacgagattcttgtt

SEQ ID NO: 1517 - DNA, 2326 bp, Trifolium pratense
agagagagctcaatttcatctcaaaatggcttgcacctctgctaattcattactccagttaaagggttcttcccaccagaggccacttttgaatttgagaacaaacatcgctgctcattactcaccacccggcttatttaatctaaaaggtgacgggttaatccataaagggttcaggcatcaaagtcagaaacattttgtacctaggaataaagttactgttatacgagctgtggcaattccggttgaaccagctccagtggaaagtgtggagtacagaaaacaactagcagaacgctacggttttgagcaaattggagagccacttcccgacaatgttactttaaaggatgtcatcacttctcttcctaagaaggtttttgagatcgatgatgttaaagcatggaaaactgttttgatatccgccacttcctatgcgctggggcttcttatgatttctaaagcaccctggtatctacttcctttggcttgggcttggacgggaactgctgtaactgggttctttgttataggacatgattgcgctcacaaatcattttcaacaaacaaattgatagaagacattgttggaactctggcttttttgccactaatttatccatatgagccatggcgatttaagcacgacaaacatcatgcgaaaacaaacatgttgaaagaagatactgcttggcagcctgtttggaaggatgagtttgagtcaaaaccacttttgaggaaagcaataatatttggatatggtccatttcgatgctggatgtcaatagctcactggttggtctgtcacttcgatttgaaaaagttcagaccaaacgaaattaagagggtgaagataagtttagcttgtgtttttgcctttatggcaattggatggcctttaattatttacaagactggaatcatgggatggataaaattctggttgatgccatggttggggtatcacttctggatgagtactttcaccatggtacatcatactgcaccacacataccattcaaatactcagaagagtggaatgctgcacaagcacagcttaatggaactgttcattgtgcttaccctcaatggatcgaggtcttatgccatgatattaatgtccatattccacaccatatatccccgaaaataccaagctataatttacgagcagctcataaatctctccaagaaaattggggaaagtatctgaatgaggctagttggaattggcgattgatgaagacaatcttgacggtatgtcacgtgtacgataaggagcaaaattatgtttcctttgaagaagtagctccggaagaatctcattcaattaaatttttgaaggaagtaatgcctgattatgcctaattaggtccaacttttgcttattctcataatttttgtgtgtcagagtagataggtataccattcattttctttttaatttttaaatgttcaatcttgtttaatatggttccatttttcatattataacaaggggaaattgcttggagctctctttaagttcacattttaagttaatcatattacctagttgcggattgttcaaggccaagccatgagagacattcattaggttaatgtagacattatagttatagtaatctgaactagattcttgttagacaatcacgttggaagagtattatattatgcataaacagatgtctaacggataaaaaatcatgtggagtcctggcgataaacatttaattatttattttctttttggtctaagcaaagtccatattcaatcataaatgtttgcaaacttagtggaacaatatcttaattttttggggtcaacagtggaacaatatcctaaacaagtacattttcttgtggagagacagagagacacatcgatactattattttcttctgctctggtgcataatttggaccaactttgattagattaatatttagaacttctgcatagaatagaagatagtggtttggttgactaccatctgctaacatcaaatgtaataaatcaagaccttggatttatacaacatttgatggatttggtgcaatgcaacctaaagagttcaaagtgtattttatgaaatattaattaaatagggaaagtaaaagtgacctaaaagctgcagctgcaactcaccccacccaccacatgctaagtgatttctcattattcccttcaccattctaatgccaacaaaaggacttcaactcatttactccacgttagttgcaaaagataaggttaaatgaaagaaggtacaaaagtaaatatgaccacatcttaaaacaaaaaagaaggaataatttaaggct

SEQ ID NO: 1518 - DNA, 1700 bp, Trifolium pratense
ggtttatctttcccagagacagacagagagagagctcaaattcatctgaaaatggcttgcacctctgctaattcattactccaattaaagggttcttcccaccacagaccagttttgaatttcagaagaaacatcgctgctcattactcacccggcttatttaacctaaagagtgacgggttaatccataaagggttcaggcatcaaagtccgaaacattttgtacctaggaataaagttactgttatacgagctgtggcaattccggttgaaccggctccggtggaaagtgtggagtatagaaaacaactagcagaacgctatggtttcgagcaaattggagagccacttcccgataatgttacattaaaggatgtcatcacttctcttcctaagaaggtttttgagattgatgatgttaaagcatggaaaactgttttgatatcagccacttcctatgcgctggggcttcttatgatttctaaagcaccctggtatctacttcctttggcttgggcttggacggggactgctgtaactgggttctttgttataggacatgattgcgctcacaaatcattttcaacaaacaaattggtagaagacattgttggaactctggcctttttgccactaatttatccatatgagccatggcgatttaagcatgacaaacatcatgcaaaaacaaacatgttgaaagaagatactgcttggcagcctgtttggaaggatgagtttgagtcaaaaccacttctgaggaaggcaataatatttggatatggtccatttcgatgctggatgtctatagctcactggttggtctgtcacttcaatttgaagacgttcagaccaaacgaaataaagagggtgaagataagtttagcttgtgtttttgcctttatggcaattggatggcctttaattatttacaagactggaatcatgggatggataaaattctggttgatgccatggctggggtatcacttctggatgagtactttcaccatggtacatcatactgcaccacacataccattcaaatactcagaagagtggaatgctgcacaagcacagcttaatggaactgttcattgtgcttaccctcaatggatcgaggtcttatgccatgatattaatgtccatattccacaccatatatctccgaaaataccaagctacaatttacgagcagcccataaatcactccaagaaaattggggaaagtatctgaatgaagctagttggaattggcgattgatgaagacaatcttgacggtatgtcacgtgtacgataaggagcaaaattatgtttcctttgaagaagtagcccctgaagaatcaaattcaattaaatttttgaaggaagtaatgcctgattatgcctaattaggtccaacttggcttattctcatataatatttgtgtgtcagagtagataggtataccattcattttctttttaaacgttcaatcttgtttaatattgttccatttttcatattataacaagggaaaattgcttggagctctctttaagttcacgttttaagttaatcatattacctagttgtggattgtctaaggccaagccatgagagacattcattaggttaatgtagacattatattattgttaatctgaacgagattcttgttaaataatcacgttggaagagtattatattatgcataaa

SEQ ID NO: 1519 - DNA, 1667 bp, Trifolium pratense
aggtttatctttcccagagacagagagagagagagagagcttaaattcatctgaaaatggcttgcacctctgctaattcattactccaattaaagggttcttcccaccacagaccagttttgaatttcagaagaaacatcgctcctcattactcacccggcttatttaacctaaagagtgacgggttaatccataaagggttcaggcatcaaagtccgaaacattttgtacctaggaataaagttactgttatacgagctgtggcaattccggttgaaccggctccggtggaaagtgtggagtatagaaaacaactagcagaacgctatggtttcgagcaaattggagagccacttcccgataatgttacattaaaggatgtcatgacttctcttcctaagaaggtttttgagattgatgatgttaaagcatggaaaactgttttgatatcagccacttcctatgcgctggggcttcttatgatttctaaagcaccctggtatctacttcctttggcttgggcttggacggggactgctgtaactgggttctttgttataggacatgattgcgctcacaaatcattttcaacaaacaaattggtagaagacattgtgggaactctggcctttttgccactaatttatccctatgagccatggcgatttaagcatgacaaacatcatgcaaaaacaaacatgttgaaagaagatactgcttggcagcctgtttggaaggatgagtttgagtcaaaaccacttttgaggaaagcaataatattcggatatggtccatttcgatgctggatgtctatagctcactggttggtctgtcacttcaatttgaagacgttcagaccaaacgaaataaagagggtgaagataagtttagcttgtgtttttgcctttatggcaattggatggcctttaattatttacaagactggaatcatgggatggataaaattctggttgatgccatggctggggtatcacttctggatgagtactttcaccatggtacatcatactgcaccacacataccattcaaatactcagaagagtggaatgctgcacaagcacagcttaatggaactgttcattgtgcttaccctcaatggatcgaggtcttatgccatgatattaatgtccatattccacaccatatatctccgaaaataccaagctacaatttacgagcagcccataaatcactccaagaaaattggggaaagtatctgaatgaagctagttggaattggcgattgatgaagacaatcttgacggtatgtcacgtgtacgataaggagcaaaattatgtttcctttgaagaagtagcccctgaagaatcaaattcaattaaatttttgaaggaagtaatgcctgattatgcctaattaggcccaacttggcttattctcatataatatttgtgtgtcagagtagataggtataccattcattttctttttaaacgttcaatcttgtttaatattgttccatttttcatattataacaagggaaaattgcttggagctctctttaagttcacgttttaagttaatcatattaccaagttgtggattgtccaaggccaagccatgagagacattcattaggttaatgtagacattatattatagttaatctgaacgagattcttgtt

SEQ ID NO: 1520 - DNA, 1873 bp, Cicer arietinum
cacatttggtggggcccacccccaaatcgctctcgcctcatctcttctcacatataaaaacacacacgttgctccacttcattccaatttaaatcccaaagggaacaaaggaactttatcttcctcagatacagagagagcacccacagcaacttgtaacatttcatctctaaatggcctgcacccctgcaaattcattactccaattaaagggttcttcccaacagaggccagttttgaatttgagaagaaacatcgctgctcattactcacccggcttatttaacctaaagggtgatgggttaatccataaagggttcaggcttcaaagtcaaagacattttataccaaggaataaatttacagttgtacgagctgtggcaattcctgtagaaccagctccaacggaaagtacggagtacagaaaacaaatagcagaacgctacggttttaagaagattggagagccacttccagacaatgttacattaaaggatgtcatcacttctcttcctaagacggtttttgagattgatgatgttaaagcatggaaaactgttttgatatccgtcacttcctatgcgcttgggcttcttatgatttctaaagctccttggtatctacttcctctagcttgggcttggacagggactgctgtaactgggttctttgttataggacatgattgcgctcacaaatcattttcaacaaacaaattggtagaagacattgttggaactctggcctttttgccactaatttatccattcgagccatggcgatttaagcacgacaaacatcatgcaaaaacaaacatgttgaaagaagatactgcttggcagcccgtttggaaagatgagtttgattcatctccatttttgaggaaagcaataatatatggatatggtccatttcgatgttggatgtctatagctcactggctggtgtgccactttgatttgaagaagttcagaccaaatgaaataaaaagggtgaagataagtttagcttgtgtttttgcctttatagcaattggatggccattaattgtttacaagactggaatcatagggtggataaaattctggttgatgccatggttgggctatcacttctggatgagtactttcaccatggtacatcatacggcaccacacataccatttaaacactcagaagagtggaatgcagcacaggcacagcttaatggaactgttcattgtgcttatcctcaatggattgagatcttatgccatgatattaatgtccatattccacaccatatatccccgaaaataccgagctacaatttacgagcagccaataaatccctccaagaaaattggggaaagtatctgaatgaggctagttggaattggcgattgatgaagacaatcatgacggtgtgtcatgtgtacgataaggagcaaaactatgttgccttcgatgaagtcgccccagaagaatctagttcaatcaaatttttgaagcaaataatgcctgattatgcttaattagggccaagttggcttaatctcatacaaattttttatgtgtcagagtaggtaggtacaccattcattttcattttacgagttcaatcttgttcaatgtggttccattttttatttatataacaaggggaaattgcttggagctctctttaataagttcacgttttaagctaataattctatctagttgcggattgtccaagagcaagcttcctagagacattcattaggttaatgtagatgctatatagcaatctaaacaatgagattcttgttagatgatcacgttggaggagtattatatatttatattatgcataaacatatgtgtaacggattaaaaaacatgtggagtgtag

SEQ ID NO: 1521 - DNA, 2219 bp, Trifolium pratense
caattaaagggttcttcccaccacagaccagttttgaatttcagaagaaacatcgctgctcattactcacccggcttatttaacctaaagagtgacgggttaatccataaagggttcaggcatcaaagtcagaaacattttgtacctaggaataaagttactgttatacgagctgtggcaattccggttgaaccagctccagtggaaagtgtggagtacagaaaacaactagcagaacgctacggttttgagcaaattggagagccacttcccgacaatgttacattaaaggatgtcatcacttctcttcctaagaaggtttttgagatcgatgatgttaaagcatggaaaactgttttgatatccgccacttcctatgcgctggggcttcttatgatttctaaagcaccctggtatctacttcctttggcttgggcttggacgggaactgctgtaactgggttctttgttataggacatgattgcgctcacaaatcattttcaacaaacaaattgatagaagacattgttggaactctggcttttttgccactaatttatccatatgagccatggcgatttaagcacgacaaacatcatgcgaaaacaaacatgttgaaagaagatactgcttggcagcctgtttggaaggatgagtttgagtcaaaaccacttttgaggaaagcaataatatttggatatggtccatttcgatgctggatgtcaatagctcactggttggtctgtcacttcgatttgaaaaagttcagaccaaacgaaattaagagggtgaagataagtttagcttgtgtttttgcctttatggcaattggatggcctttaattatttacaagactggaatcatgggatggataaaattctggttgatgccatggttggggtatcacttctggatgagtactttcaccatggtacatcatactgcaccacacataccattcaaatactcagaagagtggaatgctgcacaagcacagcttaatggaactgttcattgtgcttaccctcaatggatcgaggtcttatgccatgatattaatgtccatattccacaccatatatccccgaaaataccaagctataatttacgagcagctcataaatctctccaagaaaattggggaaagtatctgaatgaggctagttggaattggcgattgatgaagacaatcttgacggtatgtcacgtgtacgataaggagcaaaattatgtttcctttgaagaagtagcccctgaagaatcaaattcaattaaatttttgaaggaagtaatgcctgattatgcctaattaggtccaactttgcttattctcatataatttttgtgtatcagagtagataggtataccattcattttctttttaatttttaaatgttcaatcttgtttaatatggttccatttttcatattacaacaaggggaaattgcttggagctctctttaagttcacattttaagttaatcatattacctagttgcggattgttcaaggccaagccatgagagacattcattaggttaatgtagacattattatagttacagtaatctgaacaagattcttgttagacaatcacgttggtagagtattatattatgcataaacagatgtctaacggataaaaaatcatgtggagtgtgtgatttgagattaatgcataatacttctttttggtctaagcaaagtccatattcaatcataaatgtttgcaaacttagtggaacaatatcttaattttttggggtcaacagtggaacaatatcctaaacaagtacattttcttgtggagagacagagagacacatcgatactattattatcttctgctctggtgcataatttggaccaactttgattagattaatatttagaacttctgcatagaatagaagatagtggtttggttgactaccatctgctaacatcaaatgtaataaatcaagaccttggatttatacaacatttgatggatttggtgcaatgcaacctaaagagttcaaagtgtattttatgaaatattaattaaatagggaaagtaaaagtgacctaaaagctgcagctgcaactcaccccacccaccacatgctaagtgatttctcattattcccttcaccattctaatgccaacaaaaggacttcaactcatttactccacgttagttgcaaaagataaggttaaatgaaagaaggtaca

SEQ ID NO: 1522 - DNA, 2043 bp, Phaseolus vulgaris
gcaaaaagcagaggaggaagtggtgtggtggacggagaagaaacgacaccgtccaatgcatacatgcggctgcgaagatctcttaaaggaagtccacattctgggggccccacgacgaaacgaccatataaaacacattcccatccacgacgctttcagaaacggacaaaaaaaagcgttatctctttcaaagccccaaaatcctctcttgtgagctcagattaatctgtgctcacaatggcttgcacgctcgctgattcattgctcctattcaagggctcttttcagaaaccacttcgcaagagagacattgctgcacactactccccaggcgtatttagttcaaacagtgatggacttatccggaaagggttcaggcgtcaaaggagttttgttaataggaataaggttactctcatacgtgctgtggcagttcctgtacaacaaccagctcctgtggaaagtgtggagtatagaaaacaactggctgaagactacggtttcaggcaaattgcagagccgcttccatctaatgttactttaaaggatgtcatcaattcccttcctaaggaggtctttgagattgatgatgtgaaagcatggaaatctgttttgatatctgccacttcttatgcattggggatcttcatgatttccaaagctccctggtttcttcttcctctggcttgggcatggactgggactgcagtaactgggttctttgttatagggcatgattgtgctcacaaatcattttcatccaacaaattggtagaagacatagttggaaccctggcttttttgccactgatttatccatatgagccgtggcgattcaagcatgacagacatcatgcaaaaacaaacatgctgtccgaagatactgcttggaaccctgtatcgaaggacgagtttgaatcttctccccttttgaggaaagcaataatatatggatatggtccatttcgatgttggatgtctatagctcattggttgcttttgcactttgatttgaagaagttcagaccaagtgaagtaaagagggtgaagataagcttagcgtgtgttttttcctttatagcgattgggtggccattaattatttacaagacaggaatcatgggatggataaaattctggttgatgccatggttgggctatcacttctggatgagtacgtttaccatggttcatcatactgcaccgcatattccattcagaatctcagaagagtggaatgctgcacaagcacagcttaatggaactgttcattgtgattaccctaaatggatcgagatcctatgtcatgatattaatgtccacattccacaccacatatccccgaggataccaagctataatttaagagcagcccataagtccatcgaagaaaattggggaaagtatctgaatgaggctagttggaattggagattgatgaaaacaatcatgacagtgtgtcatgtgtacgataaagagcaaaattatgttgcgttcgacgatgttgcccctgaagattctggtccaattgcatttttgaagaaaagcatgccggattatgcttaattaggtccaacctgccttttatcccatgaaattttgtatgtatcaaattaggttcgtttgccatcggttttctttttacattttcgatcttgtttaaaattgttatatcttcatatctggtttagtaagaaaattgcttgttgctctcaaagttcacacgtattagggtaatcgtgttacgaagttgcggattatccaaggcgaagccaccgagatgcattcattaagttaaagtagatgttgtggtaatctgaacagtggggttcttgttatcacgtgggaagaataatatattataaagttgtctgacggataaaaaagcacgtgagtggattgagcctactgaattacttgtgtactgacagtgttttgttattcattattgctcttttggttgtataatattatattgctgaaattcaagcatacagtttcttactaaaaaataatatacagtgtctttttatctaatgaaaa

SEQ ID NO: 1523 - DNA, 2043 bp, Glycine max
tacaatatgcggctgcgaaggtctcttaaacgcagtccacatttagagggccccacgacgaaacgaccactcgctctacatataaaacacattgccacccaccacgatttctgaaagggaaaaaaaaaaaaaaatagcaacaaaaacaagaaaaaaggttacctctttcaattttatcccttgttgtgagcttaattcaatttctgctcacacataatggcttgcacgctcgctgattcattactcctattcaagggctcttatcagaaaccagttctgaggagagacattgctgcccggtactccccgggtatatttagtctaaacagtaatgggcttatccagaaaaggttcaggcgtcaaaggaattttgttactaggaataaggttactgtcatacatgccgtggcaattccagtacaaccagctccggtggaaagtgcggagtatagaaaacagctagctgaagactacggtttcaggcaagttggagagccgcttccagatgatgttactttaaaggatgtcatcaattcccttcctaaggaggtctttgagattgatgatgtgaaagcatggaaatctgttctgatatctgtcacttcttatgcactgggtctcttcatgatttccaaagccccctggtatcttcttcctctggcttgggtatggacagggactgcaataactgggttctttgttataggacatgattgtgctcacagatcattttcgtctaacaaattggtagaagacattgttggaactctggcctttatgcctctgatttatccatatgagccttggcgatttaagcatgacaggcatcatgcaaaaacaaacatgttgcgtgaagatactgcttggcaccctgtttggaaggacgagtttgaatctactccacttttgaggaaagcaataatatacggatatggtccatttcgatgttggatgtctatagctcactggttgatgtggcactttgatttgaagaagttcagaccaagtgaagtaccaagggtgaagataagtttggcttgtgtttttgcctttatagcaattggatggccattaattatttacaagactggaatcatgggatggataaaattctggttgatgccatggttgggctatcacttctggatgagtacgtttaccatggtacatcatactgcaccgcatataccattcaaatactcagaagagtggaatgctgcgcaagcacagcttaatggaactgttcattgtgattatcctaaatggatcgagatcctatgtcacgatattaatgtccatattccacaccacatatccccgaggataccaagctataatttaagagcagcccataagtctctccaagaaaactggggacagtatctgaatgaggctagttggaattggagattgatgaagacaatcatgacagtgtgtcatgtgtacgacaaggagcaaaattatgttgccttcgacgaacttgcccctgaagattctcgtccaattacatttttgaaggaaaccatgcctgattatgcttaattatgcccaaactggctttttttctcatatgaaattttttatgtatcaaattaggttcgtatgccattcattttctttttacattttcgatcttgtttaatatagttctactagtatttttcatatcatgtataacgaaaaaattgcttgctgctctcaaagttcacgtattagggtaattatattaccaagttgcggattatccaaggtcaagtcatcgagaagcattcattaggttaaagtagatgttatggtaatctgaacagtggggttcttgttatcacgttggaagaatattatattataaagttgtctgatggataaaaaagcacgtggcgtgtggcacattggattgagcatactgagttactatactgttctgacaatgttttgttatttttttctctttttttagtatattgctgaaatttaattacagagtttccatcctcaaaaaatgtatacagtttttttcctgatctaatgaaaacatattcagcc

SEQ ID NO: 1524 - DNA, 1636 bp, Lotus japonicus
taactaactgtcatcctccacactccacaggcatatttaatataaaggttgatgggcttatccataaagggttcaggcatcaaagacatttaattcctaggaataaagttgctgtcatacgagctgtggcaattccggtagaaccagctccagctgaaagtgcggagtacagaaaacaactagccgaaagctatggttttaggaaaattggagaggatcttccagacaatgtcactttaaaggatgtcatcagttcccttcctaagaaggtctttgagattgatgatgttaaggcatggaaaactgttttgatatctgccacttcctatgctttggggctttttatgatttccaaagcaccctggtatctacttcctctggcttgggcatggacgggaactgcagtaactgggttctttgtcattggacatgattgcgctcacaaatcattttcaacgaacaaattggtagaagacattgttggaactctggcctttttgccacttatttatccatacgagccgtggcggtttaagcatgacaagcaccatgcaaaaacaaatatgttgaatgaagatactgcttggaaccctgtttcgaaggatgagtttgactcagatccacttttgaggaaagcaataatatatggatatggtccaattagatgttggatgtctgtagctcactggttgctgttgcactttgatttgaagaagttcagaccaaatgaagtaaagagggtgaagataagtttagcttgcgtttttgcttttataggaattggatggccattaattatttacaagactggaatcatgggatggataaaattctggttgatgccatggttgggctaccacttctggatgagtactttcaccatggtacatcatactgcaccacacataccattcaaagactcagaaaagtggaatgctgctcaagcacagctaaatggaactgttcattgtgattaccctcaatggattgagattctatgccatgatatcaatgtccatattccacatcacatatccccaagaataccaagctataatttacgagcagcccataagtctctccaagaaaattggggaaagtatctgaatgaggctagttggaattggcgattgatgaagacaatcatgacggtgtgccatgtgtatgataaggagcaaaattatgttgcctttgatgaacttgcccctgaagattctcaaccaattaaatttttgaagaatgtcatgcctgattatgcttaagttgatctgagctggcttattcttgtaccaatatctgtgtcaaagtaggtaggtatgccattcattttccttttacgcgttctatcatggttctattttttaattacttataacaagggaagattgctagggtctctcttaaagttcaagttctagggtaatcatattatgaagttgcggattgtccaaagccaagcccctgagaagcattcattaaggttaaagtagatgttatagatttactttaatctgaacagcgtgattcttgttagattgtcacgttgaagcaacattatattatgcatatacagttgtctaacggataatataacacgtggaatgtgatgttttgagctgaatgccttgttctgagt

SEQ ID NO: 1525 - DNA, 1685 bp, Arachis hypogaea
atataaaacgaagcacatggacgacgacccttttggatttcctccataacccaaaaaaaaaagcgttatctctttcttgtgagcagcgagctcaatggcttgcaggcttgcagattcattcatcctattcaagggttctcatcagaagccacttcagagtaaaagggccattgttgcccaatattcaccacgtgtatgtaatcttaaggaatgcgggcttatccaaaaagggtttaggcatcgtttgaactttgtccctaggaagaaagttactgtcatacaagctgtggcggttccgcttgaaccatttccggttgagagtgctgagtacagaaaacaactagctgaaagctatggttttaggcaaattggagagccactgccggatgatattactttgaaggatgtcattgattcccttccgaagaaggtcttcgagattgacgatacaaaggcatggaaaacagtattgatatctgttgcttcctatgcattggggctctttatgatttccaaagcaccttggtacctacttcctctggcttgggcatggacagggactgcagtaactgggttctttgttataggccacgactgtgctcataaatcattctcaaagaacaaattggtcgaggacattgttggaactctagctttcttgccactaatttatccatatgagccatggcgatttaagcatgacagacaccatgcaaagacgaacatgttgtatgaagatactgcttggcaccctgtttggaaagatgagtttgattcatctcctgctttgcggaatgcaataatatatggatatggtccatttcggacttggatgtctatagctcactggttgatgtggcactttgatttgaagaagttcaggacaaatgaagtgaagagggtcaagataagtttagcttgtgtttttgcctttatggcaattggatggccgttaattatttataagacaggaatcatgggatggatcaaattctggttcatgccgtggctggggtatcatttctggatgagtactttcaccatggtacatcatactgcaccgcacatacccttcaaatactcagaaaactggaatgctgcccaagcacagcttaatggaactgttcattgtgattatccccagtggatcgagattctatgccatgatattaatgtccatattccgcaccacatatccccaagaataccaagctataatttacgagcagcccacaagtctttacaagaaaactggggaaagtatctgaatgaggctagttggaactggagactgatgaagacaatcatgacagtgtgtcatgtgtatgataaacaacaaaactatgttgcctttgacgaacttgcccctgaagattcccgtccaattacatttttgaaggaagtcatgcctgattatgcctgattaggtcctagctggctcttgttaaatgaattttatgtgtcagtagttaggtatggcatccatttttttctccatgtctcttgttgtatatggtgcaaattttttcaatcacatatgattatataccaagttagagaaaattgcttggatcatgtacccaagttgcggattatctgaacgcaagcaagcaccctctaagaggtatttattaggttaaagtaaatattacagtaatctcaataacaagattcttgttccatga

SEQ ID NO: 1526 - DNA, 1799 bp, Arachis hypogaea
gcgcatttgcaaattctgttgctaatatgaacatttatgttgaatgcctacctctcggaagggaaaaaagtgaaaagtagttgagactgaagcataatgaacattgattaggaagttggttgtgattttggttctttaaatgcacaaagttgcagccgttgtactaataacaaagatagtgttcaattactcaattactttcctccaatcaccaatttggttgaccttttccttccacagtgctgaaaccatccagaacatatcgtgtttgctttcattgttgtattatcatatttgggtgtgttagtctctattttgatttttttatttaaactgttgtagtttttggatttatagtattgtaaatactgagtgctgacttcatttctcttttagaattgagaattttacaaacaattaaaaaaatcttggtggtcaatgtaccagaaaagaataaaggggaaataatgtccataaccgccttacattagttgttgcatgatattatcaagtcaaaaggatccttttacgtcaaagtaatgaaacaaaaataatttattctaagcaataataagaaaacaagaaaataagaaataagaaaatattgaatctatctaggcgcagtggtggacctttaattaatctaaacgttttttccttttatcatgtccaactttgtttgtctctgtgtgtttcacttgttcccaactcctaaatatgccaaggtccaagcccactcttcacaaaagtatgaaccacgaccctccaattgcaataaatgaacatatataataccaattcttgctgtaattttgtattcctgaaatatccaaattttgtctttcaaattgcaattttggggaaaccatcagaatgttcataggggaaccatcaatcaatcaatcaagcaataaatttattaggccatgcctagcttcaatgcatataggggatcaatgtactatttctgaattcacttgtactataagcttgataactatataaattcagtttctttatttaatgaaaacctgaatggccttcaattgagcctggctatttctcaaataaggtaactaagtatgaattacagaggcttctcttccatctaagctatattggaatatcttctctgccagctaaggtaactgataagctattgatgaattctttatgcccttgctcctctcaaatttgagtgaattaccatagcattgattagctgctgtattcttacttctgccttctttttcttaacaggatcgagattctatgccatgatattaatgtccatattccgcaccacatatccccaagaataccaagctataatttacgagcagcccacaagtctttacaagaaaactggggaaagtatctgaatgaggctagttggaactggagactgatgaagacaatcatgacagtgtgtcatgtgtatgataaacaacaaaactatgttgcctttgacgaacttgcccctgaagattcccgtccaattacatttttgaaggaagtcatgcctgattatgcctgattaggtcctagctggctcttgttaaatgaattttatgtgtcagtagttaggtatggcatccatttttttctccatgtctcttgttgtatatggtgcaaattttttcaatcacatatgattatataccaagttagagaaaattgcttggatcatgtacccaagttgcggattatctgaacgcaagcaagcaccctctaagaggtatttattaggttaaagtaaatattacagtaatctcaataacaagattcttgttccatga

SEQ ID NO: 1527 - DNA, 2015 bp, Lupinus angustifolius
gaattagcaaaataaattaaaataaaaaacctcatctctttctgccacactttcatttcaatctcttctcacaaatcaatggcttctactcttgtggatccattgctcctattcaagttctcacatcagaagcagcgatttcataaaacaaacatttctgcccaatactcaccatcgttgtttaatttaaagagtgacgagtttatccagaaagggtttaggaatcaaagacatttaattcatagggataggaagaaagttactgttgtacaagctgtggcaattccagttgaaccttcaccacttgagagtgctgaatacagaaaacaattagctcaaagctatggctttaatcaaattggagaacagcttccgagcaatgttactttgaaggatgtcattgattcccttcctaagaaggtctttgagattgatgatgcaaaagcatggaaatcagtcttggtatctgccacttcctatgctttgggtctctttatgatttccaaagcaccctggtatctacttcctctggcttgggcatggacaggaactgcagtaactgggttctttgttataggccatgattgtgctcacaaatcattttccaagaacaaattggtagaagatattattggaactttggccttcttgccactgatttatccatatgagccatggcgatttaagcatgacaggcatcatgcgaaaacaaatatgttgaaaggagatactgcttggcatcctgtttggaaaaaagagtttgattcatcaccacttttgcgaaaagcattaatatttgcatatggtccatttcgaccttggatgtctatagctcactggttggtgttgcattttgatttgaagaagttcagaccaaatgaagttaatagggtgaagataagtttagcttgtgtttttgcctttatggcaattggatggccattaattatttacaagactgggatcatgggatggattaaattctggttgatgccatggctgggatatcatttctggatgagtactttcaccatggtacatcatactgctccacacataccattcaaagactcagaagagtggaatgctgcacaagcacagcttagtggaactgttcattgtgattaccccaaatggattgaggttttatgccatgatattaatgttcatattccacaccacatatccccacggataccaagctataacttacgagcagcccataagtctatacaagaaaattggggaaagtatctgaatgaagctagttggaattggcgattgatgaagacaatcatgaccgtgtgtcatgtgtacgataaggagcgaaattatgttggctttgatgaactcgccccagaagactcccatccaattgaatttttgaaggaactcatgcctgattatgcttgattagatccaagtgactcattctcatttgagatttatctgtgtcaaagactcagagtaagtgggtacggctttcattttcttgttacaagttcatacttgtattatttggttctatattttcatatataacaagaggagaaaattgctttaagttcttttagagttcaccatttaggatactcttgttaccaagttgtggattatccaagattctaagggcatgctcctgagaaggattcggtagcttaaagtaaattttacagtgatctgaacattaatttgtattacttttgtttgagagtcaacggtagtgaacaaatcaatggtggatgatttgctgacagtgtaaaaaacctttacactgtaataatgtatacatattaaaaacacttggagtgtagtgcagagtggtttcagcataatggcttgtgctgagaaatgacaatgtttttattgaagggtatctttgttttgtgtacagacattggtcttgttactgctaaattagtatttagaacttcgataaaccttgggatttttgtatgcatttggatcagtgatgctcttcaaatcagaaccatacatatatgattttctctgta

SEQ ID NO: 1528 - DNA, 2052 bp, Cajanus cajan
taattagttgtgattctgctgccacagggataattaatctaaaccgggatgggcttatccggaaagggttcaggcgtcaaaggaattttgttactaggaataaggttactgtcgtacgggctgtggcaattccggtacagccagctccagttgaaagtgccgagtacagaaaagaactagctgaaaactatggtttcaggcaaattggagaacatcttccggatgatgttactttgaaggatgtcatcaattcccttcctaaaaaggtctttgagattgatgatgtgaaagcatggaaatctgttttgatatctgtcacttcttatgcaatggggctcttaatgatttccaaagctccctggtatcttcttcctttggcttgggcatggacagggactgcaataactgggttctttgttataggacatgattgtgctcacaaatcattttcatctaacaaattggtagaagatgttgtcggaaatctggcctttatgccactgatttatccatatgagccatggcgatttaagcatgacaggcatcatgctaaaacaaacatgttgtatgaagatactgcttggcaccctgttttgaaggatgagtttgaatcttctccacctttgaggaaagcaataatatatggatatggtccttttcgatgttggatgtccatagctcactggttgatgtggcactttgatttgaagaagttcagaccaaatgaagtaccacgggtgaagataagcttagcttgtgtttttgcctttatagcaattggatggccattaattatttacaagactggaatcatgggatggataaaattctggttgatgccatggttgggctatcacttttggatgagtacttttaccatggtacatcatactgccccgcatataccattcagatactcagaagagtggaatgctgcgcaagcacaacttaatggaactgttcattgtgattaccctaattggatcgagatcctatgtcatgatattaatgtccatatcccacaccacatatccccgaagataccaagctataatttaagagcagcccataagtctctgcaagaaaattggggaaagcatctgaatgaggctagttggaattggagattgatgaagacaatcatgacagtgtgtcatgtgtacgataaggggcaaaattatgttgccttcgacgaacttgcccctgaagattctcgtccaattacatttttgaaggaagctatgcctgattatgcataattaggtccaagctggcttttttctcaggaaatttgttatgtatcaaattaggttggtatgccattcattttttatttttttttacagtttcgtcattgtttaatatggttctatttttcatatcacgtataaagagaaaatggctcgcagatcaattgaaagttcacgtattagggtaatcacgttaccaagttttgcggattatccaaggccaagcccccgagaagcattcattaggttaaagtagatgttgtggcaatctgaacagtggggttcttgtcatcacgttggaagaatattatactataaagtagtctgacggataaaaaaacacgtggagtgtggcacagcggtttgagcttactgacttataccgtactgacaatgttttgttattattgctggccctccttttttagtatattgatgaaatataagttatacaatctctttctcacctaatgtaaagtccatattcaaccataattgtttgcaaacttagtgtggaacgagcctctaaatcataaacacaagtctttctccgcgaaagaacccaatcgatcttgtcttttgtgttttttttttcttctcttatctgctaaattctaatgtttaagtttgattaaattaatatttagaacttcgacaaaaaaaagattgtctggttggtgatctatcgtccattaacctcatagatagtagtactatctaacaactttgggattaaacctcagatagttgtactatctaacaactttgggattaatgtgaaatttttatggatttgatgcag

SEQ ID NO: 1529 - DNA, 1708 bp, Trifolium pratense
gcagctccaattccatataattatgtatatggcaactttaggtgcaaattcaaatattattattaaaactgatttaaggtttcacagaacaaaaacaacaacaaggtttcaatgtcttcctagtacagtggcagttttcaaagtattgtctttgtctactgttacaaaacctacaacacgcttgcatttcttaagacatcatcgtcattctcgtgctttggtatgccaatgtcaacataaacatgattcttctccaactcctacaaatatcccacatgtaataggaattgggatgaataggatgcttgtttctctcaaagattggagaaatttacggataatggaagtagctggcttattggtttgcattttaatggttgtaccatcagctgatgctgttgatgctctcaaaacttgtgcttgtttactcaaggaatgcagggtagaattggctaagtgtcttgcaaacccatcatgtgctgccaatattgcttgtctgcaaacatgcaacaatagacctgatgagactgaatgccaaattaaatgcggggacgtgtttgaaaacaaggtagttgatgaattcaatgaatgcgctgtctcgaggaagaaatgtgtaccaaagaaatctgatgtgggagaatttcctgttccaaacccggatgtccttgtgaagagctttaacattgctgattttagtggcaagtggttcatcactagtggcttaaatcctacctttgatgcatttgactgccaattacatgaatttcacacagaatcaaataaacttgtgggtaatataacatggagaataccaactccagatggtggatttcttacgaggtcagccgtgcagaaatttgagcaagatcctgctaatccaggaatcctctacaatcatgataatgagtaccttaactatcaagatgactggtatgttttgtcatcccaaattgagaacaaaccggacgactatatatttatatactaccgaggcagaaacgatgcatgggatggctatggtggtgccgttgtatacacaaggagtgcagttttacctgaatctatcattccggaacttgatagagcggcaaagagtgtaggaagagactttagcaagttcattagaacagataatacatgtggaccagagcctaccattgtggagaggattgagaaaaaggtagaggaaggagagaaaaccattgtgagggaagttgaagagatagaagaagaggtagaaaaagaagtagaattggttggtaaaacagaaatgagcttgttacaaaggttggcagaaggattcaaagtgtttcaagaagatgaggaaaatttcttaaaaggattatctaaagaagaaatggagatattggatagtctcaaattggaagctaaggaagtagaagagctctttggaaatgccttgccactgaggaaacttagataactcaaaaatttgagaaaaaatgttgtaacatattttttgatatacttgtttattatagaatgaattctcatgttggaggcctaatgagagttcattttgtaatataaaagaagacatcaaatagtggactgctgtttttttcttcccttagtcattttaattttttactttggttatagtatatgttcattaaattttctgtttggattatgatatatgtgaaacacacacatatctgaagtttgttattggaataatgaaatc

SEQ ID NO: 1530 - DNA, 1427 bp, Trifolium pratense
atgccaatgtcaacataaacatgattcttctccaactcctacaaacatcccacatgtgataggaattggggtcaataggatgcttgtttctctcaaagattggagaaatttacgaataatggaagtagctggcttattggtttgcattttaatggttgttccgtcggctgatgctgttgatgctctcaaaacttgtgcttgtttgctcaaggaatgcagggtagaattggctaggtgtcttgcaaacccatcatgtgctgccaatattgcttgtctccaaacatgcaacaatagacctgatgagactgaatgccaaattaaatgcggggacgtgtttgaaaacaaagtggttgatgaattcaatgagtgcgctgtctcgaggaagaaatgtgtacctaagaaatctgatgtgggagaatttcctgttccaaacccggatgtccttgtgaagagctttaacattgctgattttagtggcaagtggttcatcactagtggcttaaatcctacctttgatgcatttgactgccaattacacgaatttcacacagaatcaaataaactcgtgggtaatataacatggagaataccaactccagatggtggatttcttacaaggtcagccgtgcagaaatttgagcaagatcctgctaatccaggaatcctctacaatcatgataatgagtaccttaactatcaagatgactggtatgttttgtcatctcaaattgagaacaaaccggacgactatatatttatatactatcgaggcagaaacgatgcatgggatggctatggcggtgccgttgtgtacacaaggagtgcagttttacctgaatctatcattccggaacttgataaagcagcaaagagtgtaggaagagactttagcaagttcattagaacagataacacatgtggaccagagccttcgattgtggagaggattgagaaaaaggttgaggaaggagaaaaaaccattgtgagggaagttgaagagttagaagaagaggtcgaaaaagaggtagaaaaggttgggaaaaccgaaatgaccttgttacaaaggttggcagaaggattcaaagttttccaagaagatgaagaaaatttcttaaaaggattatctaaagaagaaatggagatattggaaagtctcaaattggaagctaaggaagtagaagagctctttggaaatgccttgccactgaggaaacttagataactcaaaaatttgagaaaaaatgttgtaacatattttttgatatacttgtttattatagaatgaattctcatgttggaggcctaatgagagttcattttgtaatataaaagaagacatcaaatagtggactgctgtttttttcttcccttagtcattttaattttttactttggttatagtatatgttcattaaattttctgtttg

SEQ ID NO: 1531 - DNA, 1235 bp, Trifolium pratense
ggctatctataatttatccatctttgtttatcgtgtctatcgaattcataggaacagaagcgcaatccttttgtccaacacaaacaacaaagaagaacatgagcagcttcataaactgcaatcactttgttcttcaccgttttcctatcatggcaatgcgctctaccttcaactatcgccacttctctcttcatatttcaaacgcttctactcaaccacaagcccaagggattgagacacctccacgtgttggatttttgggtcttggaatcatgggcaccccaatggcacaaaatctcatcaaagctggagttgatttgactgtttggaataggacaaagagcaagtgtgatcctctaatcaacttgggagctaaatataaaccatctcctgaggaagtagcggcatcttgcgatctcacatttgctatgcttgctgatcctcaaagtgcggttgatgttgctcttggtaaacatggagctgcaaatggaataggtccaggaaaaggatatgtggatgtatcaactgttgatgtggacacttctaaattgattaatgggcagataaaatccactggagcattatttttggaggctccagtttccggttccaaaaagccagcagaagatggacaattgatatttcttacagcaggggacaagaatctttatgatacggttgctccattcttggacatcatggggaaatctagattttaccttggtgatgttggaaatggagctgcgatgaaactcgttgtcaatatgatcatgggcagtatgatggcatccttttctgaaggtttacttctcagtgagaaagttgggctggatccaaaagtactagtggaggtaatttcacagggtgcgattagtgctccgatgtactcgatgaaaggcccatccatgatacagtcacattatccgactgcatttcccttaaagcatcagcagaaggatctaagacttgccctggggttagcagagtctgtttcccaacctattccaattgcagcagctgctaacgagttatataaagttgcaaaatcacacggctatagtgatgaggacttttcagctgtcattgaagcattaaaatccaaatttcagcactcagaaaaccaatgaggttcttatgaagacatgttcaagttgacttggaatcaagtatagaaaggtggcgactttgtgagactagtcaatttaaatgcaattcccaaaatgtagaatatatat

SEQ ID NO: 1532 - DNA, 1295 bp, Trifolium pratense
atctatccatctttatttattgtgtctatcgaattcaaaggaacaaaagagcaatccttttgtccaacaacacacaaacaacaaagaagaacatgagcagcttcataaactgcaatcactttgttcttcaccgttttcctatcatggcaatgcgctctaccttcaactatcgccacttctctcttcatatttcaaacgcttctactcaaccacaagcccaagggattgagacacctccacgtgttggatttttgggtcttggaatcatgggcaccccaatggcacaaaatctcatcaaagctggagttgatttgactgtttggaataggacaaagagcaagtgtgatcctctaatcaacttgggagctaaatataaaccatctcctgaggaagtagcggcatcttgcgatctcacatttgctatgcttgctgatcctcaaagtgcggttgatgttgctcttggtaaacatggagctgcaaatggaataggtccaggaaaaggatatgtggatgtatcaactgttgatgtggacacttctaaattgattaatgggcagataaaatccactggagcattatttttggaggctccagtttcaggttccaaaaagccagcagaagatggacaattgatatttcttacagcaggggacaaaagtctttatgaaacggttgcttctctcttggacatcatggggaaatcgagattttaccttggcgatgttggaaatggagctgcgatgaaactcgttgtcaatatgatcatgggcagtatgatggcatccttttctgaaggtttacttctcagtgagaaagtagggctggatccaaaagtactagttgaggtaatttcacagggtgccattagtgctccgatgtactcgatgaaaggcccatccatgatacagtcacattacccgactgcatttcccctaaagcatcagcagaaggatctaagacttgccctggggttagcagagtctgtttcccaacctattccgattgcagcagctgctaacgagttatacaaagttgcaaaatcacacggctatagtgatgaggacttttcagctgtcattgaagcattaaaatccaaatttcagcagtcggaaaaacagtgaggttcttatgaagacatgttcaagttgacttgaaatcatgtatagaaaggtcatgacttgtgagtctagtcaatttaaatgcaattctcaaaatgtagaatatatactgtttcaagcgagtaaaatttttggtgaaaaattatttttaacaaatatttcaagtagatggtcctc

SEQ ID NO: 1533 - DNA, 1222 bp, Trifolium pratense
atctatccatctttatttattgtgtctatcgaattcaaaggaacaaaagagcaatccttttgtccaacaacacacaaacaacaaagaagaacatgagcagcttgataagctgcaatcactttgttcttcaccgtttccctatcatggcaatgcgctcttccttcaactatcgccatttctctcttcacatttcaaacgcttctgctcaatcacaagggattgaaacacctccacgtgttggatttttgggtcttggaatcatgggcaccccaatggcacaaaatctcatcaaagctggagttgatttgactgtttggaataggacaaagagcaagtgtgatcctctaataagcttgggagctaaatataaaccatctcctgaggaagtggcggcatcttgcgatctcacatttgccatgcttgccgatcctcaaagtgcggttgatgttgcttgtggtaagcatggagctgcaaatggaatgggtccaggaaaaggatacgttgatgtatcaactgttgatgtggacacttctaaattgattaatgggcagataaaatccactggagcattatttttggaggctccagtttcaggttccaaaaagccagcagaagatggacaattgatatttcttacagcaggggacaaaagtctttatgaaacggttgcttctctcttggacatcatggggaaatcgagattttaccttggcgatgttggaaatggagctgcaatgaaactcgttgtcaatatgatcatgggcagtatgatggcatccttttctgaaggtttacttctcagtgagaaagttgggctggatccaaaagtactagtggaggtaatttcacagggtgccattagtgctccaatgtactcgttgaaaggtccatccatgatacagtcacattacccaactgcatttcccctaaagcatcagcagaaggatctaagacttgccctagggttagcagagtctgtttcccaacctattccgattgcagcagctgctaacgagttatacaaagttgcaaaatcacacggctatagtgatgaggacttttcagctgtcattgaagcattaaaatccaaatttcagcagtcggaaaaacagtgaggttctcatgaagacatgttcaagttgacttgaaagcatgtatagaaaggtcatgacttgtgcgactagtcaatttaaatgcaattcccaaaatgtagaatatatat

SEQ ID NO: 1534 - DNA, 1356 bp, Glycine max
gtccctcttatctgtaatgctactgggtgttgggagttgagagtgaagctcctgggtgtggtgtggtgtaggtgaagtgcaatctgtgttgatgcgttccacgttttgctgtcacttgaacctttcacccgtcatgattatgaagggcttctctgctcccatttcatcatatgtttcgcctcgagctcaagccgtcactgagccaccggcgcggattggctttttgggcctcggaatcatgggctccccaatggcccacaatctccttaaagctggtgttgatctcactgtttggaataggaccaagagcaagtgtgaccctctaatcagcctcggagcaaaatataaaccatctcctgaggaagtagcagcatcttgtgatgtcacctttgccatgctcgctgatcctcaaagtgcagtggatgtcgcttgcgggaagcatggggctgcaaatggaatgggtccagggaaaggatatgtggatgtttcaactgttgatggggacacttctaaattgattaatgggcacatgaaatccactggagccttatttttggaggctccagtttccggatcaaaaaagccagcagaagatggacaattgatatttcttacagcaggggacaaaaatctttatgaagcagttggttctctcttggacatcatggggaaatctaaattttatcttggtgatgttggaaatggagctgcaatgaaacttgttgtcaatatgatcatgggcagtatgatggcatccttttctgaaggcttacttctcagcgagaaagttgggcttgatccagatgtgctagtgcaggtagtttcacagggtgccattagtgctccaatgtactcaaccaaaggtccttccatgatacagtcgctttatccaactgcgttccctctaaagcatcagcagaaggatctaagactagccttggggttagcagagtctgtttcccaacctactccgattgcatcagctgctaatgagttatataaagttgcaaaatccaatggccttagtgatcaggatttttcagctgtcattgaagcattaaaatccaaatttcagcactcggaaaccaagtgacattcttatgagagacaagttgaagttgaaaaccgtagtaagctaggtgatatgaatcaaatatagacgtacattgtgaggcttgaccatttaaattcattccctgaattgtagaaatatatttgaatatttttccaatgttgtaaaatttttggttaaaaattgttttcaatgaacatctcgtatagatgttctcctcttaaccctttttcattggatgtccacgcatagcatacctacttctcaaggggattaaaatgtac

SEQ ID NO: 1535 - DNA, 1475 bp, Cajanus cajan
agtgagaaagtgaggagtgagggtaaaagaagaaaagaagaaaaaaaatcttgtctctcttatctatctatcgaggtagtgctgggtgtagagagtgaaggaagtgggtgagggtgaagtgcaatttgtgttgatgcgttgttccacgttttgctctcaccacttgaacctttcagccatgattatgaagcgtttctctgctcccatttcatcccacgtttcgcctcgagctcaggctataactgagccacctgcccgcgttggctttttgggcatcggaatcatgggctccccaatggcccataatctcctcaaagctggagttgatctcactgtttggaataggaccaagaccaagtgtgatcctctaataagcctgggagcaaaatataaaccatctcccgaggaagtagcagcatcttgcgatgtcacctttgccatgcttgctgatcctcaaagtgcagtggatgttgcttgtgggaaacatggggctgcaaatggaataggtccagggaaaggctatgtggatgtttcaactgttgatggggacacttctaaattgattagtgcgcaaataaactccactggagcattatttctggaggctccagtttcaggttccaaaaagccagcagaagatgggcagttgatatttcttacagcaggggacaaagctctttacgaaacagttggttctctcttggacatcatggggaaatctaaattttatcttggcgatgttggaaatggagcagcaatgaaacttgttgtcaatatgatcatgggcagtatgatggcatccttttctgaaggcttacttctctgtgaaaaagttgggcttgatccagatgtactagtgaaggtagtttcacagggtgccattaatgctccaatgtactcaaccaaaggtccatccatgatacagtctctttatccaactgcattccccctgaagcatcagcagaaggatctaagactagccctggggttagcagagtctgtttcccaatccactcctattgcagcagctgcaaatgagttatataaagttgcaaaatcccatggcctgagtgatcaggacttttcagctgtcattgaagcattaaaatccaaaattcagcactcggaaaaccagtgacattcttatgagacaaagttgaagttgaaaaccgtagtaagctaggcgacttgaaaaccagtgacattgtgaggcttgcctatttcaattcattccctgaaatgtaggatatatatttccaagggcgtaaattttttgggtggaatattgttttcaatgtacttctatatatgttatcctcttaaccatttttttaatgcaaatacgcggagactacatcggtgttgatgtgatgagaaaccaaaatcagacttacaagtaaaatgtaaaaatgagaacaactataagtaaaaatttaacctttttctatcaaggtaataccaaattaattaagagt

SEQ ID NO: 1536 - DNA, 3068 bp, Glycine max
aatttggaatcaagtagtatatgtgagtagttatggtgatggcatggcaatggtaatgcccctgtgtcctgtgagagtctgagatcgcttttctctctttcgatcttccttttccgcatttctcaacaatcgaatcgtttcctatcccacgctaatggcaaatagtgagacttgttgttcaactcagcttattgatggagatggtacattcaatgtttctgggcttgaaagtttcatgaaggaggtgaagttggctgaatgtgggctttcgtatgccgtagtttctataatgggtccacaaagtagtggcaagagcacgctattaaataatttgtttggtaccaacttcagagagatggatgcttttaagggaaggtctcaaacaaccaaaggaatctggatggctagatgtgctgacatagagccttgtacacttgtgatggatttggagggtacagatggaagagaacgtggagaggatgacactgcttttgaaaagcagagtgctctatttgctcttgctgtctcagatatagtgctaataaacatgtggtgccatgacattggccgtgagcaagctgcaaataagccacttttgaaaactgtttttcaggtcatgatgagattgtttagtccacgaaaaacaacattgctgtttgtcatacgtgataaaacaaggacaccacttgaaaatttagaacctgttttgcgagaagatattcagaagatatgggattctgttcctaaaccacaggcccacaaggaaaccccattaagtgaatttttcaatgttgaagttgttgctctttctagttatgaagaaaaggaagagcagtttaaagagcaggttgccagcttgcagaaacgattccatcattctatcgctcctggtgggcttgcaggggatcggcgtggagttgttcctgcttctggcttttcttttagttctgagcatatatggaaagtcattaaggagaacaaagatcttgaccttcctgcacataaggttatggttgcaactgtacgatgtgaagaaatcgcaaatgagaaatatgcctcttttgttgcaaatgaggattggtgtcaattggaagaggctgtgcaatctggtcctattcctggatttgggaaaaagctcagttcactccttgatacttgtttttcagagtatgatgctgaagccacctattttgatgaaggtgtgagatcttccaaacaaaagcaactacaagaaaaattgttccaacttgtccaaccagcattccaatctgcgctgggacatataagatctggaactttggataaattcaaggaggcatttgacaaggctttgaagggaggggaagggttttctgtggctgctaataattgcatcgggtctggtctggttcagtttgatgaagcatgtacagatgttgttattgaacaaacaaactgggatacatctaaagtacgagagaaactgctgcgtgatattgatgcatatgttgcaactgtacgtgcaaccaagatttctgaacttacttcatcatatgaggaaaaacttaaacaagctttgtctggacctgttgaagctcttttggatggagctaatagagatacttggccatcaataaggaatcttcttaggcgtgagactgaatcagctgtttcagggttctctgctgcacttactgggtttgatatggatgaagaaacaaggcagaaaatgattttgagtttagaggcttatgcaaggggtctggtagaaggaaaggctagggaagaagctggaagagttctaatgcgcatgaaggacaggtttacaatgttgtttagccatgattctgattcaatgcctcgtgtttggacggggaaagaagatatacgagccatcaccaagactgctcgctcttcttctttgaagttgctatctgttatggctgcaattcgtttggatgatgatgacactgacaatattgagaaagtgttagcagttgccttggtggattcgtcaccaagcagtaatgctacaaggagcatcacaatggttgatccactagcttctagcagctgggaacaggtttcatcctctaaaacattgattacacctgtccagtgcaagtctttgtggaggcaattcaagacagagacagagtacagtgtctctcaggccatttctgcacaggaggccaacaagcgcaacaacaactggttacctcccccatgggcaatagttgctttggttattctgggatttaatgaatttatgacacttctaagaaatcccttgtatttgggtgtaatctttgttggttttcttctcattaaagccctatgggtgcagcttgatgtttcgggtgaatttcgcaatggagctcttccaggaatcatatccttgtctagcaagtttattccaactatcatgaaccttatgagaaaactagcagaggagggacaaaaccctgcagctaacaatcctcagagaaccccatcaaaaaacagttacaatgatggtcatgctgtgtcatctagcgcctcatctaacttgactgcattggacaacggaactgagtatgcaagtccattaaaagatgagtaggtctcattttactgaataccaatttcttcagttggaagatggtggtgtttctggtggctgcatgcttgtccacaaaattcatgacttgtgagcattcaagacattcaaaggcattggttttttttttttttttttttgtgcaagtgccatatacagggggcaatgatttgttatgtagtccccctcttaagataggtctctttttccaatttaggcgcttcagttagttggagaagttatgctggttttgcaatcaattttgtttgtaatttatcagtgtactgagtgttttttttttttttttttgtggaaaatttattaattggattgtgtgtttatattagatttttttcaaagagatactagagttgatcgtgcttgctgcttgtaatgtcaactattgttttgcgtgtaacatggtcttggaagataagagatttttttcttatattttttgaattttcggcatgcttaacaatgttgaatc

SEQ ID NO: 1537 - DNA, 3139 bp, Phaseolus vulgaris
gtgaagcattatttggaatgaagtatatgtgtgtagttatggtgatggcatggcaatggtaacgcctctgcgagagagactctgagatcgcttccttcctttttctccctttcgatcttccttagcgcatttctccaatctcaggctaatggcaaatagtgagtcttgttgttcaactcagcttattgatggagatggtacattcaatatttctggggttgaaagctttatgaaggaggtgaagttggctgaatgtgggctttcgtatgctgtagtttctataatgggtccacaaagcagtggcaagagcacactattaaataatttgttccgtaccaacttcagagagatggatgctttcaagggaaggtctcaaacaaccaaaggaatctggatggctaaatgcaccggcatagagccttgtacacttgttatggatttggagggtactgatggaagagaacgcggagaggatgacactgcttttgaaaagcagagtgctctatttgctcttgctgtatcagatattgtgttaataaacatgtggtgccatgacattggccgtgagcaagctgcaaataagccactgttgaaaactgtctttcaagtcatgatgagattgtttagtccacgaaaaacaacactgttgtttgtcatacgggataaaacaaggacgccacttgaaaatttagaacctgttttgcgggaagatattcagaagatatgggactctgttcctaaaccacaggcccacaaggaaaccccattaagtgaatttttcaacgttgaagttgttgcactttctagttatgaagaaaaggaagagcaatttaaagagcaggttgccagtttgcggcaacgattccagcattccattgctcctggtgggcttgcaggggatcggcggggagtagttcctgcttctggtttttcatttagttctgagcatatatggaaagtcattaaggagaacaaagatctcgaccttcctgcacataaggttatggttgctactgtacgatgtgaagaaatcaccaatgagaaatatacctcttttgcagcacatgaggattggtgtcaactggaagaggctgtccaatctggccctgttcctggatttgggagaaagctcagttcactgcttggtacttgtttatcagagtatgatgctgaagccacctattttgatgaaggtgtgagatcttccaaacaaaagcaactccaagaaaaattgttccaacttgtccaaccagcattccaatctgcgttgggacatataagatctggcactttggataaattcaaggtggcatttgacaaggctctgaatggaggggaagggttttctgtggctgctaataattgcagtgcgtcttgtatggttcaatttgatgaagcatgtgtagatattgttattgaacaaacaaactgggatacatctaaagtgcgagataaattgctgcgggatattgaagcacatgttgcaactgtgcgtgcagccaagatttctgaacttacttcatcatatgaggaaaaacttaaacacgctttgtctggacctgtcgaagctcttttggacggagctagtagtgatacttggtcatcaataaggaaccttcttacgcgtgagactgtatcagctgtttcagggttctctgctgcacttactgggtttgatatggatgaagaaacaagactgaaaatgcttaaaagtttagaggattatgcaagaggtctggtagaaggaaaggccagagaagaagtaggaagagttctaatccgcatgaaggacaggtttacaatgttgtttagtcatgatgctgattcaatgcctcgtgtttggactggtaaagaagatatacgagccatcaccaagactgctcgatctgcttcattgaagttgctatctgtaatggctgcaattcgtttggatgatgatgactctgacaatattgagaaagtgttagcagttgctttggtggaaccatcaccaagtagtaatggtacaaggagcatgacaacggttgatccactagcttctagtagctgggaagaggtttcatcctctaaaacattgattacgcctgtccagtgcaagtctttgtggaggcaattcaagacagagacagagtacagtgtctctcaagccatttctgcacaggaagcaaacaagcgcaacaacaactggttaccccccccttgggcgatagctgctttggttatcctaggatttaatgaatttatgacacttctaagaaatcccttgtatttgggtgtcatctttgttggttatcttcttgctaaagccctgtgggtgcagcttgacatttcgggtgaatttcgcaacggagctcttccggcaatcatatccttgtctaccaagtttgttccaaccatcatgaaccttatgaaaaaactagcagaggagggacaaaaccatgcaactaacaatcctcagagatccccaacaaaaaacagttacaatgagactcacggcgtctcgtcgagcacgtcatctaacctgactgcattggacaacggaaccgagtatgccagtccagttaaagatgagtaggtgaagaaactcatcttgtgaaaactaaattcttgtgtaggaaaatggtgtgtggtcatgcttgtccacaaaatttgacttgtgagcattcaagacattgaaaggcattggtttttttgtgcaagtgccatatacagggggcaatgttttattgtgaggtagttcctcccccttataatagttctcttttccaattttaggtgcttcagttattggagaagttatagcttattttacacgctctttctttctttctttctttgatgcttatgcttcttttgcaatcaattttgtttgtaattttatcagtctactactactgagtgcttcttcttcttttggaaaatttattaattggattcgtgtgttgatattagatcattctaaaagagatactacagctcttgctgcttgctgcttgtaatgccaacttttttgttttatctgtgacattgttggaagacaactatcgttgttttgttccatttttggcatgtttaacaatgttcttaacaaatatacaattattctcaaaataaagtgtgtttccttgtcatcataaaa

SEQ ID NO: 1538 - DNA, 3032 bp, Cajanus cajan
ggaatcaagtatatgtgtgcgtagttatggtgatggcatggcaatggtaatgctcctgtgggtctgagatcgccctcttccttttctctctttcgatcttccctatcgcatttcccaaaccatcgtttccaatcccacgctgatggcaaatagtgatagttgttgttcaactcagcttatcgatggggatggtacattcaatgtttctgggattgaaaaattcatgaaggaggtgaaattggctgaatgcgggctttcatacgctgtagtttctataatgggtcctcaaagtagtggcaagagcacgctattaaataatttgtttggcaccaacttcagagagatggatgcttttaagggaaggtctcaaacaaccaaaggaatctggatggctagatgtaatggcatagagccttgtacacttgtgatggatttagagggtacagatggaagagaacgtggcgaggatgacactgcttttgaaaagcagagtgctctatttgctcttgctgtctcggatatagtgctaataaacatgtggtgccatgacattggccgtgagcaagctgcaaataagccacttttgaaaactgtctttcaggtcatgatgagattgtttagtccacgaaaaacaacattgttgtttgtcatacgtgataaaacaaggacaccacttgaaaatttagaacctgttttgcgagaagatattcagaagatatgggactctgttcctaaacctcaggcccacaaggaaaccccactaagtgaatttttcaacgttgaagttgttgctctttctagttttgaagaaaaggaagagcaatttagagagcaggttgctagcttgcgacaacgattccatcattctattgctcctggtgggcttgcaggggatcggcgtggagtagttcctgcttctggcttttcttttagctctgagcaaatatggaaagtcattaaggagaacaaagatctcgaccttcctgcacataaggttatggttgctactgtacgttgtgaagaaattgccaatgagaaatatgcctcttttgttgcaaatgaggattggtgtcaattggaagaggctgtgcaatctggccctattcctggatttgggaaaaagctcaattcactccttgatacttatttatcggagtatgatgctgaagccacctattttgatgaaggtgtgagatcatccaaacaaaagcaactacaagaaaaattgttccaacttgtccaaccagcattccaatctgcgctgggacatgtaagatctggaactttggataaattcaaggaggcatttgacaaggctttgaatagaggggaagggttttctgtggctgctaataattgcattgagtcttgtatggctcaatttgatgaagcttgtgcagatgttgttattgaacaaacaaactgggataccactaaagtacgagaaaaactgcggcgtgatgttgatgcacatgttgcaactgtacgtgcaaccatgatttctgaacttacttcaaaatatgaggaaaaacttaaaacagctttgtctggacctgtcgaagctcttttggatggagctaatagtgaaacttggccatcaataaggaaccttcttagacgtgaggctcaatcagctgtttcagagttctctgctgctcttgatgggtttgatatggacgaagaaacacggcagaaaatgattttgagtttagaggatcatgcaaggggtctagtagaaggaaaggccaaggaagaagctggaagagttctaatccgcatgaaggacaggtttacgacgttgtttagccatgattctgattcaatgcctcgtgtttggacgggaaaggaagatattcgagccatcaccaagactgctcgctctgcttctttgaagttgctagctgttatggctgcagttcgtttggatgatgatgacactgacaatattgaaaaagtattatcagttgcattggtggattcaccatcaggcagtgctgctacaaagagcatcacaatggttgatccactagcttctagcagctgggaacaggtttcatcctctaaaacactgattacacctgtccagtgcaagtctttgtggaggcagttcaagacagagacagagtacagtgtgtctcaggccatttctgcacaggaggccagcaagcgcaacaacaattggttacctcccccatgggcaatagttgctctggttgtccttggatttaatgaatttatgacacttctaagaaatcccttgtatttgggtgtcatctttgttggctatcttctcattaaagccctatgggtgcagcttgatgtttcgggcgaattccgcaatggagctcttcctggaatcatatccttgtctagcaagtttcttccaactatcatgaacattatgaaaaaactagcagaggagggacagaacactacagttaacaatcctcagagaaccccatcaaaaaacagttacaatgacggtcgtcgagctgcgccatctagcgcatcatctaacctgacctcattggacaacggtgctgagcaggagagtccattgaaagatgactaggtgaagaaactgatcttaccgttagaagatggtggtgtgctggtggcatcatgttgtccacaacattcatgacttgtgagcattgaaaggcattggtttttttgtgcaagtgccatatacagtgggggcagtgttttgttgccaggtagtcccccttaagatagttctcttttccaatttaggtgttatgtaagtaggacaagttatagcttatttttcaagctctttcatggttatgcaatcaattttgtttgtaactttatcacttcaccgagtgttttttctggaaaatttattaattggattcgtgtgtttatattagattttttctaatgaaatactagagcccatcgtgctccttgcttgtaatgcaaactattgtttcacgtgtaacgtggtgctggaacatgggatattcatattctattctatttctgggaaaatgtttttgattaatata

SEQ ID NO: 1539 - DNA, 3454 bp, Lupinus angustifolius
atgttttggaagtaaccatttgtgtgttatcaaaaaggcacagccgaaagtgttgaaatgctcttttgctaatatgcgcctttgagtcttcgatcgcatcttcattcaatttttcccttttctctatttggatccccattttttccattttccattttcaattccacgttcttaatggcgagtagtgatagtagttgctcgactcagcttcttgatggggatggtgtattcaatgttgctgggatcgaaactttcatgaaagaagtgaagttggctgaatgtgggctttcgtatgctgtagtttctattatgggtccacaaagtagtggcaagagcacgctattaaatcatttatttggtaccaacttcagagagatggatgcttttaagggaaggtctcaaacaaccaaaggaatctggatggctagatgtgctggcatagagccttgtacactggtgatggatttggagggtacagatggaagagaacgtggagaggatgatactgcattcgaaaagcagagtgctttatttgctcttgctgtctcagatatagtgctaataaacatgtggtgccatgacattggccgtgagcaagctgcaaataagccgcttttgaaaactgtctttcaggttatgatgagattgtttagtccacggaaaacaacaatgttgtttgtcatacgtgataaaacaagggtgtacaccacttgaaaatttagaacctgttttgcgagaagatattcagaagatatgggactctgttcctaaaccacaggctcacatggaaaccccacttagtgaatttttcaatgttgaagttgtcgctctttctagttatgaagaaaaggaagaacaatttaaagaacaggtggccagcttgaggcaacgattccatcattccattgctcccggtgggcttgctggggatcgtcgtggagtagttcctgcttctggcttttcatttagttctcaggagatatggagagtcatcaaggagaacaaagacctcgatcttcctgctcataaggttatggttgctactgtacgatgtgaagaaattgctaatgaaaaatatgccgcttttgctgcaaacgaggaatggtgtcaattggaagaagctgtgcaatctggccaaattacgggatttgggaaaaagctcaattcactacttgatgtgtatttgtcagagtatgatgctgaagcgatttattttgatgaaggtgttagatctgcaaaacaaaagcaacttcaagacaaattgttgcaacttgttcaacctgcattccaatctgcactaggacatgtaaggtctggaactttggataaattcaaggagacatttgagaaggctttaaaaggaggggaagggttttccgaagctgctaataattgcatcgggtcttgtatggctcaatttgataaagcatgtgcagatgttgttattgaacaagcaaactgggatgcatctaaagtaagggagaaactgcagcgtgatattgatgcacatgttgcatctgtacgtgcagaaaaaatttcggaacttacttcaacatatgaggaaaaactgaaagaatccttgtctggacctgttgaagctcttttggatggagctagtagtgaaacttggccatcaataaggaaccttctaaggcgtgagactgaatcagctgtttcggggttctctagtgcactttctgggtttgatatggatgaagacactagacataaaatgattttgagtatagaggattatgcaaggggtgtggtagaaggaaaggctagggaagaggctggaagagttctaatccgtatgaaagacaggtttacaatgttgtttagccatgattctgattcaatgcctcgtgtttggacggggaaagaagatattcgagccatcaccaagactgctcgctcagcttctttgaagttgctatctgttatggctgcaattcgtttggacgatgacgctgatagtattgagaaaacattagtagttgcattggttgattcatcaaacaatgctgctaataggggcatcacactggttgacccgctagcttctagcagctgggaacaggttccatcctctaatacattgatcacacctgtccagtgcaaatctttgtggagacaattcaagaccgagacagagtacagtgtctcacaggccatttctgcacaggaggccaacaagcgtaataacaattggttacctcctccatgggcaatagctgctttggttattctcggatttaatgaatttatgacacttctaagaaatcccctgtatttgggtgtcatctttgttgggtatcttctcgttaaagccctatggatgcagcttgacatttcgggtgaattccgcaatggagctcttcctggaatcatatccttgtctagcaaatttattccaactatcatgaaccttatcaaaagactagccgaagaaggacagaaccctgcaaataacaatcctccaagaaaccaatcgaaaaataatcataacgctcttacagatggtgctgcttcgactagtgcttcatctaatgtaacttcattggacaatgaaagggaatatactagcccatcaaaacatgagtagatgaacagattcatcttattgaagagcaaattcttctgttggaacatgctgggtttttgtttgtccataaatttatgactttgtgagcattcaacaaattcaaaggcattggtttttttgtgaaagtgccatatacagggagcaatggtttatttcctaggtagcccccttaaaatagttattttctctattttaggtgcttcaatgagttgaagttaagcctattttcttcaggatctttgatggttatgtttctttttgtgatcagttttggttgtatttatcagtgttatggttgtatctttgtgaaaaattattaatctgaattatgtatttatattagactttaagatttgccacatgcctttgatgtttgctacttgtaatgggaactggttcatgtgtaacatggtgttgaaaggtgttcgtttctatttcttagttgtttggttttctttaaaaggtgctgaaaatgctactaagttttggatcttttattttgatgaacaatggtaataaatgactatcacggttagtttgggagttggactttagaggggaaagaagggaaaaaaggcttaaaagccataaaatatacttgtgatatgactcaaaagttttccattttcctttattccccttcaaaatttaacttgtagacaaactcttagagtttgagattgttgtggatagcatcatgtattaaaatagattttttattatctattctactaaaaactgctcatgagaactctcattgatcattaaaggatagtttgagagtcagattttagaggggaagggaaaaagaaagcgttggattttggaggggaaataatggaaataaaa

SEQ ID NO: 1540 - DNA, 3271 bp, Cicer arietinum
gtaaaattaatttatacttcaaatttttattttcatgcatagaatcagataaaggaaatagcattcacaaaattatttatgctaaaactttcaattctcattccacatgaaatggaaaaaaaaaacacacaaaatcaataaataaaaagagaagaaaaaagaaagtgaaaaaaacaaagtatacgtgtgatggtaatggtaatggctttgtgagatcgcccctttcttttctctctttcgatcttcttcaccgcatttctaattctcaacaacaataatcatccttcccaattccacgctctaatggagaatagtgagacttgttgttcaactcagcttattgatggagatggcatattcaatgctactggaattgacaagtttatgaaggaggtgaaattgggtgaatgtggactttcatatgctgtagtttctattatggggccacagagtagtggcaagagtacactattaaacaatttgtttagtactaatttcagagagatggatgcttttaagggaaggtctcaaacaaccaaaggaatctggatggctagatgtgcgggcattgagccttgtacacttgtgatggatttggagggtacagacggaagagaacgtggagaggatgatactgcattcgaaaagcagagtgctctgttcgctcttgctgtctcagatattgtgctaataaacatgtggtgccatgacattggccgtgagcaagctgcaaataagcctcttttgaaaactgtgtttcaggttatgatgagattgtttagtccacgcaaaacaacaatgttgtttgtcatacgtgataaaacaaggacaccacttgaaaatttagaacctgttttgcgagaagatattcagaagatatgggactctgttcctaaaccacaggcccacaaggaaactccactaagtgaatttttcaacgttgaagttgttgcgctttctagttatgaagaaaaggaagagcaattcagggagcaggttgccagcttgaggcagcgtttccatcattccattgctcctggtggacttgccggggatcggcgtggagtagttccagcttctggcttttcttttagtgctcagcaaatatggaaagtcattaaggaaaacaaagatctcgaccttcctgcacataaggttatggttgcaactgtacgatgtgaagaaattgccaatgagaaatatgcttcttttgttgcaaatgaggaatggtgtcaattggaagaggctgtgcaatctggtcctattcctggatttgggaaaaagatcaattcactccttcgagcttgtttgtcagagtatgatgctgaggccacttatttcgatgaaggtgtaagatcttcaaaacaaaagcaacttcaagataaattgttgcaacttgtccaaccagcgttccaatctgcgctgggacatattagatctgtaactttggacaaattcaaggagacatttgaaaaggctttgaaaggaggggaaaggttttctccagctgctaatacttgcattgagtcttgtatggctcaatttgatgaagcaagtgcagatgttgttattgaacaagcaaattgggatgcatctaaagtacgagagaaactgttgcgtgatattgatgctcatgttgcatctgtgcgcgaagctaagatttctgaacttacttcttcatatgaggacaaactgaaaatagctttgtctggacccgtcgaagctcttttagatggagctaatagtgatacttggccatcaataaggaaccttcttaagcgtgagattgaatcatcagttttagggttttctgctgcgcttaatgggtttgatatggatgaagaaacaagacaaaacatgattttgagtttaaaggattatgcaaggggtgtggtagaaggaaaggctaaggaagaagctggaagggttctgatccgtatgaaggacaggtttacaatgttatttagccatgattctgattcaatgcctcgtgtttggacggggaaggaagatattcgagtcatcactaaaactgctcgctctgcttctttgaagttgctatctgttatggctgcaattcgtttggatgatggtgatacagatgatattgagaaaacattagcagttgcattgttggatccatcaagcaattctgttaaagataggagtatcacagcagttgatcggttagcttctagtagttgggaaaaggttccatcaactaagacattgattacacctgtccagtgcaaatctttgtggagacaattcaagatggagactgagtacagtgtttctcaagccatttcggctcaggaggccaataagcgtaataacaactggttacctcccccatgggcaatacttgctttggttgttcttggattcaatgaatttatgacccttctaaaaaaccccttgtatctgggtgtcatctttgttgtttttcttctccttaaagccctgtgggtgcaacttaacattgccggtgaatttcgccatggaattcttccaggactcatttccttgtctaccaagtttgttccaactatcatgaaccttatcaaaagactagcagaggagggacagaaccctacagctaacaatcctcaaagaacctcatccaaaaacaacacctccaatgctgttcctgttggtagttctgcatcatctagtgcttcatctaacttaacatcgttggataacggaaacagatataccggttcgtcaaaagacgagtaagtgaagaaagtcaatcattacaaaagtagaaatttcttttgttggaagatggcggtgtctgctggctgcattatgagtttttgttttgatatatatatatggatttttaacttgtgagctttcaagacattattcaaaggcattgtttttttgtgctagtgccatatacagggaggggttagtgttttgttttgaaggtatagtccccccctttgaaataggtctcttttacaatttgggtgcttcaattagttatagaagttagcttattttatatggcctttttatggatatatgctggttttgcaatcaattttgtttgtaatttcatcaatttgtgtttgtgagtttattttattttatttttgaaaattattatttggactcgtgtgtttatattttgatttatgagattaaatgttttatatggtggttacgtgtaagatcatgttaacttctagttcttactttaatacaagtttcaaactaggtggcttcagctacaagtttcaaatatatgaaaaatatc

SEQ ID NO: 1541 - DNA, 3757 bp, Medicago truncatula
aagcaatggtaatggctttgtgattcttctttcttctctcgatcatcccttacttttctctctttcaatcaatcacatttctcaacaacaacaacatcaacaatcaccatcatcatttccattaccacgctctactctaatgggtatgtacgcttttcaatttcgatcccatttcccgatccaattcacacttttttttcttctgcaaacacaatttttttcatcaaagttttaatcttttatagaaatagtttctgggtattaattgaaattatcagttacacttgcatccgttttgtttttatgcattttaaaaaaaactaactgttgttttttatttataattattattattgtttcagttttgattgaaattctgtttggatttttggatattaattatgtgacaacttgatccataatttgtgttttcattgattgattgatggatccaatgttaaggtttaggttgttaatataattgaaatgaggaagatgagttaaaaaatagaatgttaattagaaggtggattaattaattaatcaattttattgttctatggtattgagattagtaattttgcaacctctttgagatggaagtattgatgaatggtgtgtggaaccagcaacagctatgaagcattgacacatacaaggacacgtcgacacctgtagtaattttagaaaatgacataatcgagtgaaatcatgtgtgttggtgtcggacaccgatacatgttggacaccagacacgcgtttgatcagaagtttcaaggcaacaagtttagaattttttttttctatttttctgaggactaaaatatttttttactggagctggatggtcatgtagagtttagattgttctgattaagtgtgtttctcactattaatatgtcatagtatagtgctgcaagtgcaaatgcaaatgcaatcatatcctatggtttttattttgctgttggatttcaatgagtgctatacttgaaattcgtgcaacaaatagtgagacttgttgttcaactcagcttattgatggagatggattattcaatgcttctgggattgaaaagtttatgaaggaagtgaaattgggtgaatgtgggctttcatatgctgtagtttctattatggggccacagagtagtggcaagagcacactattaaataatttgtttcatacaaatttcagagagatggatgcctttaagggaaggtctcaaacaaccaaaggtatctggatggccagatgtgctggcatagagccttgtacccttgtgatggatttggagggtacagatggaagggaacgtggagaggatgatactgcattcgaaaagcagagtgctctgtttgctcttgctgtctcagatatagtgctaataaacatgtggtgccatgacattggccgtgagcaagctgcaaataagccgcttttgaaaactgtctttcaggttatgatgagattgtttagtccacgcaaaacaacactgttgtttgtcatacgtgataaaacaaggacaccacttgaaaatctagaacctgttttgagagaagatattcagaagatatgggactctgttcctaaaccacaggcccacaaggataccccactgagtgaatttttcaacgttgaagttgttgcgctttctagttatgaagaaaaggaagagcaatttagagagcaggttgccagcttgaggcaacgtttcaatcagtctattgctcctggtggacttgcaggggatcggcgtggagtagttcctgcttctggattttcttttagtgctcaggaaatatggaaagtcattaaggaaaacaaagatcttgaccttcctgcacacaaggttatggttgcaactgtacgatgtgaagaaattgccaatgagaaatatgccgcttttgtcgcaaatgaggaatggtgtcaattggaagagactgtgcaatctgatcctattcctggatttgggaaaaaaatcaattcacttcttcatgcttgtttgtcggagtatgatgctgaggccacttatttcgatgaaggtgttagaactgcaaaacaaaagcaacttcaagaaaaattgttgcaacttgtccaaccagcttaccaatctgcactgggacatatgagatctgtaactttggagaaattcaaggagacatttgaaaaggctttgaaaggcggggaaaggttttctgcagctgctaataattgcattgagtcttgtgtggatcaatttgataaagcatgtgcagatgttgttattgaactaacaaattgggatacatctaaagtacgagagaaactgctgcgtgatattgatgcacatgttgcatctgtgcgtgaagctaagatttctgaacttacttcttcatatgaggaaaaactgaaagtatctttgtctggacctgtcgaagctcttttagatggagctaatagtgatacttggccatcagtaaggagccttcttaagcgtgagattcaatcatctgttttagggttttctgctgcgcttaatgggtttgatatggatgaagaaacaagacaaaacatgattttgagtttagaggattatgcaaggggtgtggtagaaggaaaggctagggaagaagctggaagggtattgatccgtatgaaggacaggtttacaatgttatttagccatgattctgattcaatgcctcgtgtttggacggggaatgaagatattcgagccatcactaaaactgcccgctctgcttctttgaagttgctatctgttatggcagcacttcgtttggatgatggtgataaagatgatatagagaaaacattgaaagttgcattgctggattcatcaagcagtgctaatataagtaggagcatcacagcggttgatccgctagctactagcagttgggaacagattccatcatctaagacattaattacacctgtccagtgcaaaactttgtggaggcaattcaagatggagacagagtacagtgtttctcaagccatttctgcacaggaggccaacaagcgtcataacaactggttacctcccccatgggcaatacttgctttggttattctgggattcaatgaatttatgacccttttaaaaaatcccttgtatttgggtgtcatctttgttggttttcttctcattaaagccctgtgggtgcaacttaacattgccggtgaatttcgtcatggagtacttcccggagtcatttccttggctaccaagtttgttccaactatcatgaaccttatgaaaagactagcagaagagggaaataaccctgcggctaacaatcctcaaagacacacatcacgaaacaacaccaatgctgttcctgttggcagttctgtttcatctagttcttcatctaacataaccgcactggaaaatggaaatcgatataccagttcatcaaaagatgaataagcgaagaaattcaatcttcaacaaatagcgatttttttcttttgaaagatggtggtggtttctgctggctgcatgacgattttttggtttgatatgagttttataagttgtgagctttcaagacattcaaaggcatagtttttttttttttgtttgcaaaagtgccatatacaggggcagtgtttttttcaaggtatagtcccccccttgaattaggtttcttaaaatttgggtgcttcaattagttactgaagctagcttatttttatatggtcttttatgaatatattctggttttgcaatcaattttgtttgtaatttca

SEQ ID NO: 1542 - DNA, 2792 bp, Trigonella foenum-graecum
tcatcatttccatttccacgctctaatctaatggcaaatagtgagacttgttgttcaactcagcttattgatggagatggaggattcaatgcttctgggattgaaaagtttatgaaggaagtgaaattgagtgaatgtgggctttcatatgctgtggtttctattatggggccacagagtagtggtaagagtacgctattaaataatttgtttcgtaccaatttcagagagatggatgcttttaagggaaggtctcaaacaaccaaaggaatctggatggctagatgtgctggcatagagccttgtacgcttgtgatggatttggagggcacagatggaagagaacgtggagaggatgatactgcattcgaaaaacagagtgccctgtttgctcttgctgtctcagatatagtgctaataaacatgtggtgccatgacattggccgtgagcaagctgcgaataagcctcttttgaaaactgtctttcaggttatgatgaggttgtttagtccacgcaaaacaacactgttgtttgtcatacgtgataaaacaaggacaccacttgaaaatttagaacctgttttgcgagaagatattcagaagatatgggactctgtccctaaaccacaggcccacaaggaaaccccactaagtgaatttttcaacgttgaagttgttgcactttctagttatgaagaaaaggaagatcaatttagagagcaggttgccagcttgagggaacgttttcatcagtctattgctcctggtggacttgcaggggatcggcgtggagtagttcctgcttctggattttcttttagtgctcaggaaatatggaaagtcattaaggaaaacaaagatctcgaccttcctgcacacaaggttatggttgcaactgtacgatgtgaagaaattgccaatgagaaatatgccgctttgttgcaaatgaggaatggtgtcaattggaagagactgtgcaatctgatcctattcctggatttgggaacaaaatcaattcacttcttcatgcttctttgtcagagtatgatgctgaggccacttatttcgatgaaggtgttagaactgtaaacaaaagcaacttcaagaaaaattgttgcaacttgtccaaccagcttaccaatctgcactgggacatattagatctgtaactttggaaaaattcaaggagacatttgaaaggctttgaaggagggaaggtttctgcagctgctaataattgtattgagtcttgtgtggctcaatttgataaagcatgtgcagatgttgttattgaactaacaaattgggatacatctaaagtacgagagaaactgctgcgtgatattgatgcacatgttgcatctgtgtgtgaagctaagatttctgaacttacttcttcatatgaggaaaaactgaaagtatctttgtctggacctgtcgaagctcttttagatggagctaatactgatacttggccatcagtaaggagccttcttaagcgtgagattcaatcagcagttttagggttttctgctgcgcttaatgggtttgatatggatgaagaaacaagaaaaaacatgattgtgagtttagagtattatgcaaggggtgtggtagaaggaaaggctagggaagaagctggaagggttttgatccgtatgaaggacaggtttacgatgttatttagccatgattctgattcaatgcctcgtgtttggacgggggtgaagatattcgagccatcactaaaactgctcgctctgcttctttgaagttgctatctgttatggccgcacttcgtttggatgatggtgataaagatgatattgagaaaacattagcagttgcattgctggattcatcaagcagtgctaataaaaataggagtatcacaggcggtgatccgctagctactagcaattgggaacagattccaccatctaagacattgattacacctgtccagtgcaaatctttgtggaggcaattcaagatggagactgagtacagtgtttctcaagccatttctgcacaggaggccaacaagcgtaataacaactggttacctcctccatgggcaatacttgctttggttattctgggattcaatgaatttatgaccctactaaaaaatcccttgtatttgtgtgtcatctttgttggttttcttctcattaaagccctgtgggtgcaacttaacattgccggtgaatttcgtcatggagtgcttcccggactcatttccttgtctaccaagttagttccaactatcatgaaccttatgaaaagactagcagaagaggggaataaccctgtagctaacaatcctcagagaaacacatcacaaaacaacaccgctgttcctgttggcagttctgtttcatctagttcttcatctaacataacctcatcggataatggtaatcgatataccagttcatcaaaagatgagtaagcgaagaaatccaatcttcaacatatagcgattttcttctgttggaagatggtgtctgcttggctgcatgatgatttttttggtttgatatgagttttataagttgtgagctttcaagacattcaaaggcattgtttttttgttgttgtgcaaaagtgccatatacatggggcagtgttttgtttttaaggtatagttacagaagcttcaattaggtgcttcaattagttacagaagctagcttatttttatatggtcttttatgaatatatatattctggttttgcaatcaattttgtttgtaatttcatcaatgttatgagtgtattttatttta

SEQ ID NO: 1543 - DNA, 3168 bp, Prunus mume
gaaaagcagcatacctattaaaagaaaatgatataagcacaagaatgaccaaaaagtaattggaggtgaaaaaaagagaatcacgcccactttttgagaacaacaaaagaaaatcaatctctcctttgagatcggtctctctctctctctctctctctttctttctctgctcctaaccgatctctctctctgtctcacgcatttcgaagccccatcatcacaagctcttcgaagccaatctcgcccgaaaatggcgaacagtgaggagtgctgctctactcagcttattgatggggatggtacattcaatgccactggaattgaccgtttaatcaaggaggttaaattgggcgaatgtggactttcctatgccattgtctccattatgggtccacaaagtagtggaaagagcacactgttaaataatctatttgcgaccaattttagagagatggacgcttttagaggaaggtctcaaacaacaaaaggtatttggttggcaaaatgtgccggtattgagccttgtactcttgtcatggatttagagggtacagatggaagagaacgaggagaggatgatacagcattcgagaagcagagtgccctctttgctcttgctgtttcagatattgtgctcataaacatgtggtgtcatgatattggccgtgagcaagctgcaaataagcctctcctaaagactgttttccaagtgatgatgcgattgtttagtccacgtaaaacaactctgatgtttgtaatccgtgataagacaaggacgccattggagaatttagaaccagtgcttagagaagacattcagaagatatgggactctgttcctaagcctgaagcccacaaggaaactccattaagtgaatttttcaatgttgaggttgttgctctttcaagttatgaagaaaaggaagaacaatttaaagagcaggttgctagcttgaggcagagattctttcattctattgcacctggcggtcttgctggtgaccgacggggagtagttcctgcttcagggttttctttcagtgcacaacagatatggaaagtcatcaaagaaaacaaagatcttgatcttccggctcacaaggtcatggtggctactgtacgttgtgaagagattgccaatgagaagtatgctgatttttcaggaaatgaggagtggagtcagttggaagaggctgttcaatctggtcctatctctggcttcgggaagaagctcagttcaatccttgatacttgtctatcagagtatgatgcagaggctacatattttgatgaaggtgtcagaactgggaaacgcagtcagcttgaagaaaaattgctgcaacttgtccaacctgcgttccaagctttgctgggacatataagatctggttctctggataagttcaaggaagcatttgataaggccttgaatggtggggaggcattttcagtggctgcttgcaattgctctgagtcatttatggctctatttgatgaaggatgtgcacatgctgttatcacacaagcaaactgggacacgtctaaagtaagggacaaacttaaacgcgatatagaagcccatattgcttcagttcgtgctgccaagctagctgaacttactgcactttatgaggcaaaattgaaggaggccttatcaggaccggtggaagcccttctagatggagctaatagtgaaacctggcctgcaataagaaaacttttccggcatgagacagaatcagccgtctctgggctctctagtgcactttcgggttttgatatggatgaacaatccaggggaaaattactttcaagtctggaggcatatgcaagaggtgtggtagaagctaaaacaaaggaagaggctggaagggttttgatccgtatgaaggacaggtttacaacattatttagccatgattctgattcaatgccacgtgtttggactgggaaggaagatattagatcaatcaccaaaactgcccgttcttcatccttaaaattgctctctgttatggctgcaatccgtttggatgatggtgatgctgataatattgagaatactttatcccttgccttggtggattccacaaatgttgctgctaaagataggagtatcacaacagctgatccactggcttcaagcacttggcaagaggtttcctcctctaaaacattgatcacacccgtccaatgcaaatctttgtggaggcaattcaaggcagagactgagtacagtgtttctcaggctatttctgcacaggaagctaacaagcgtaataacaactggttaccacctccttgggcaattgttgccttgattgtcctgggattcaatgaatttatgacacttttaagaaatcctttgtatctgggtgtcatctttgttggctttttactcattaaagccctatgggtgcagctagatgtcgcgggtgaattccgcaatggtgctcttcccgggcttatttctttgtccagcaaacttgttccaactatcatgaacatgattaaaagactagccgacgaaggggcaaatgctgcagctaatgatcctcatcggaaccctccactagcatcaaaaaactttacgaatgaaggtaatgctagcagtgaaatgtcatccagtgcctcatctggactgacagaatctgactactccagcccctcaaaacaagactagtttaaaataagctctcttgatcaaagaccattttttatgtttgaagattctctggtgtactgcgcacttattgtaatggtgttactcgcatatcatcttcgtatattaggtctgtgagcttgtacgtcactgttgcaagcacgtaatggtaatatttttgtaggcatcatttttgagcaagtgccaacatacaaggggctgtttgttgttgtgaggaagcccccattgagtagtaattattttttgggtctaggtgttttttcgtttgttggacaagctacaaaaggatccattcagtgctcgatattgatattgaagttagttgattatgatgatgatttgcatcagttttgtattgctacaattgtaaccttgtttggttgtattttactgaaaattttcagagaccaattcttatttgatatggtttccgcggggacatattcatttcccaaatagacggagtgggccgatcattgtcttta

SEQ ID NO: 1544 - DNA, 3124 bp, Theobroma cacao
tctctttctctctctctctctctctttttctgtctttcattgaaatcgatctcctcatattttgagccatcaatttcaaagaagattcaatggcaaagagtgaggaatgctgttctactcaacttattgatggagatggtatattcaatgatactggaattgaccaatttatcaaggaagtaaaacttggagaatgcgggctatcatatgccgtggtttctatcatgggaccacaaagcagcggtaaaagcacactcttaaataatttgtttggtaccaatttcagggaaatggatgcatttaaaggaaggtcgcaaaccactaaaggtatttggctggcaaactgtgctggtatagagccttgcactctagtaatggatttggagggtaccgatggaagagaacgtggggaggatgacacagcatttgaaaaacaaagtgcactttttgcattggcggtttcagatatagtactcataaacatgtggtgccatgatattggtcgtgagcaagctgcaaataagcctcttctgaagactgtgttccaggtcatgatgcgattgtttagtccccgcaaaacgactttgatgtttgtcatacgtgataaaacaaggacaccactggaaaatttagagcctgttctaagagaagatattcagaagatatgggactcagtacctaagccacaagcgcataaggaaactccattaagtgaatttttcaatgttgaggttgttgcactttctagttatgaagaaaaggaagagcaatttaaagagcaggttgctaatttgagacaacgattcttccactctattgcaccgggtgggcttgctggagatcggaggggagcggtacctgcttcagggttttcttttagtgcacaacagatctggaaagtcattaaggagaataaggaccttgaccttccagcccataaggtcatggtggctacagtacgctgtgaagaaatagccaacgaaaagtatgttagtttcatggcaaatgagaattggtgtctgttagaagaagctgtacagtctggtccaattgctggctttgggaagaagttgaattcaattctctacacttttctatcagagtatgaggcagaagccacatattttgatgaaggtgtcagatctgcaaagcggaagcagcttgaagaaaaactgctccaacttgtccaaccagcataccaatccatgctaggacatttgaggtctggaactcttcaaaaattcaaggaagcatttgagaaggctttgaatggaggggaggggttttctatggctgctcgcaactgcactgaatcctatatggctttgtttgatgaaggatgtgcagatgctgttgttgaattagcaaactgggattcctctaaagtgagagataagctacatcgtgatattgatgcacatgttgcttctgtccgagctgccaagctttcagagcttacttcatcatacgaggcaaagctgaatgaggcattatcaggacccgttgaagcacttttagatggagcaagtaatgagacctggccagcaataaggaaacttctccagcgtgaaactgaatcagctatctctggactgtccggtgccctctctggttttgacatggatgaacaaaccaaggacaagatgctaacaagtttagaagattatgcaagaggtgtggttgaagcaaaagcaagagaagaagctggaagggtactgatccgtatgaaggacaggttttcaacattgtttagtcatgattctgattcaatgccacgggtttggacggggaaggaagatattcgagccatcactaaaactgctcgctctgcatccttgaaattgctatctgttatggctgcaattcggttggatgataatgctgataatattgagaatacattatcttctgcgttggtggacaccaaaaataatgctgctgttactgataggagcattacagcatttgatccactagcctcaagcacttgggagcaggttccacctgccaagactttgatcacacctgtccagtgcaagtctttgtggcggcaattcagggcagagacagagtacagtgtcactcaggccatttctgctcaggaagccaacaagcgtaacaacaactggttgccacctccatgggcaattgttgcattgattgtcttgggatttaatgaatttatgactcttctaagaaatcctttatatctgggtgtcatctttgtgggttttctaattatgaaggccctatgggtgcagcttgacatttcgggtgaattccgcaatggcgctcttcccgggcttctctccttatctaccaagttccttcccactgttatgaaccttctcagaaagttagcagaggaggggcaaatacctgcaaataacaatcctcagagaaacccagctgtagcatctaagggcttccaaaatggaagcaccagcagtgatttgtcatcgagtgcttcatctgaagtaacttcatcagggaatgggaccgagtactccagccccacaaaagaagactgaggaactcattagaatagaatacgttcattgtgttttggagatgcctgtgttgtgctcgctttcacgatggggtgatttttatgttttattatggtccatgaaaaatatataactcttccaagaaagtgagagttacgtatctggaaaaggcatttatttttgtgcaagtgccgcatacaaaggggccacgcttgcttgcgatagaggcccattaaataggtttttttctttttgccctttattcttcacgctaggctttaatcttatatttattgtttgttggctaagctgtaaggcctttttttttttattattttaaattatacttcgatggcttttggttatgcttgttttcacccaattttgtcttatgagtatttgtaatgtcattttcgtttgtatgcaactgaaaaaattgttcacggcctctttcagctgtcgtacatttattccttaccttcagtgatggttgtggcccgtgggtgggtaatgagttttctcacacactttcctccgccaagcaaagtgctctgagctttgaggagtagaggcaaggcaatgcctatttgctaaaatcattaatgatcttcgac

SEQ ID NO: 1545 - DNA, 2780 bp, Prunus persica
catattctcatccagcgaacagtgaggagggctgctctactcagcttattgatggggatggtacattcaatgccactggaattgaccgtttaatcaaggaggttaaattgggcgaatgtggactttcctatgccattgtctccattatgggtccacaaagtagtggaaagagcacactgttaaacaatctatttgcgaccaattttagagagatggacgcttttcgaggaaggcaagtctcaaacaacaaaaggtatttggttggcaaaatgtgccggtattgagccttgtactcttgtcatggatttagagggtacagatggaagagaacgaggagaggatgatacagcattcgagaagcagagtgccctctttgctcttgctgtttcagatattgtgctcataaacatgtggtgtcatgatattggccgtgagcaagctgcaaataagcctctcctaaagactgttttccaagtgatgatgcgattgtttagtccacgtaaaacaactctgatgtttgtaatccgtgataagacaaggacgccattggagaatttagaaccagtgcttagagaagacattcagaagatatgggactctgttcctaagcctgaatcccacaaggaaactccattaagtgaatttttcaatgttgaggttgttgctctttcaagttatgaagaaaaggaagaacaatttaaagagcaggttgctagcttgaggcagagattctttcattctattgcacccggcggtcttgctggtgaccgacggggagtagttcctgcttcagggttttctttcagcgcacaacagatatggaaagtcatcaaagaaaacaaagatcttgatcttccggctcacaaggtcatggtggctaccgtacgttgtgaagagattgccaatgagaagtatgctgatttttcaggaaatgaggagtggggtcagttggaagaggctgttcaatctggtcctatctctggcttcgggaagaagctcagttcaatccttgatacttgtctatcagagtatgatgcagaggctacatattttgatgaaggtgtcagaactgggaagcgcaagcagcttgaagaaaaattgctgcaacttgtccaacctgcgttccaagctttgctgggacatataagatcaggttctctggataagttcaaggaagcatttgataaggccttgaatggaggggaggcattttcagtggctgcttgcaattgctttgagtcatttatggctctatttgatgaaggatgtgcagacgctgttatcacacaagcaaactgggacacatctaaagtaagggataaacttaaacgcgatatggaagctcatattgcttcagttcgtgcttccaagctagctgaacttactgcactttatgaggcgaaattgaaggaggccttatcaggaccggtggaagcccttctagatggagctaatagtgaaacctggcctgcaataagaaaacttttccagcatgagacagaatcagccgtctctgggctcactagtgcactttcgggttttgatatggatgaacaatccaagggcaaattactttcaagtctggaggcatatgcaagaggtgtggtagaagctaaaacaaaggaagaggctggaagggttttgatccgtatgaaggacaggtttacaacattatttagccatgattctgattcaatgccacgtgtttggactgggaaggaagatattagagcaatcaccaaaactgctcgttcttcatccttaaagttgctctctgttatggccgcaatccgtttggatgatggtgatgctgataatattgagaatactttatcccttgccttggtggattccacaaatgttgctgctaaagataggagtatcacaacagctgatccactggcttcaagcacttggcaagaggtttcctcctcaaaaacattgatcacacctgtccaatgcaaatctttgtggaggcaattcaaggcagagactgagtacagtgtttctcaggctatttctgcacaggaagctaacaagcgtaataacaactggttaccacctccttgggcaattgttgccttgattgtcctgggattcaatgaatttatgacacttttaagaaatcctttgtatctgggtgtcatctttgttggctttttactcattaaagccctatgggtgcagctagatgtcgcgggtgaattccggaatggtgctcttcccgggcttatttctttgtccagcaaacttgttccaactatcatgaacatgattaaaagactagcagacgaaggggcaaatgctgcagctaatgatcctcatcggaaccctccactagcatcaaaaaactttacgaatgaagggaatgctagcagtgaaatgtcatccagtgcctcatctggactgacagaatctgactactccagcccctcaaaacaagactagttaaactaagctctcttgatcaaggaccattttttctgtttgaagatgctggtgttctgcgcacttattgtaatagtgttactcgcataacatcttcgtatattaggtctgtgagcttgtacgtcactgttgcaagcacgtaatggtaatatttttgtaggcatcatttttgagcaagtgccaacatacaaggggctgtttgttgttgtgaggaagcccccattgagtagtaattattttttgggtctaggtgtttgtcttttcgtttgttggacaagctacaaaaggctccattcagtgctcgatattgatattgaagttagttgattatg

SEQ ID NO: 1546 - DNA, 3093 bp, Ricinus communis
caggggaagaaatctttttaccttctttaggcatattctttttaccagaaaacctgaaatctaatttatttatttttattattattgttattaaaagagacagtcaagcctttacaacttttaaaaataaaagaaaaacaattgaaagaaaaaaaaaaagtttaaaagaattcgtattaccttttaagatctctctgctttcttcatcaatcaatcgatcttcactacccaaccttatagttcttaggtcaaattgagctctcaatcctctccactttcgatccaattcaaatggcaaatagcgaagaatcttgctctactcagctgattgatggagatggtacatttaatgccgctggactagaacactttaccaaagaggtgaggttgggggaatgtggactatcatatgctgtagtatccatcatgggcccacaaagtagcgggaaaagcactcttttaaataatttattcggcaccaactttagagagatggatgcatttagaggaagatctcaaaccactaaaggaatttggttagctagatgtgctggcattgaaccatgtactcttgttatggatttagaggggactgatggaagagaacgtggagaggatgatacagcctttgagaagcagagtgctctgtttgcccttgctgtctcagatatagtactgattaacatgtggtgccatgatattggccgtgagcaagctgcaaataaacctcttttgaagactgtattccaggtcatgatgcgattgtttagtccacgcaaaacaacgttgatgttcgttatacgtgataaaacaaggacacccctggagaatttagaacctgttctaagggaagatattcagaagatttgggatgctgttcccaagccacaagaacacaaggaaacaccattaagtgaattttttaatgttgaagttgttgcactttcgagttatgaagaaaaggaagagcaattcaaagagcaggttgctagcttgaggcaacgcttcttccattctattgcacctggtgggcttgctggagatcgaaggggtgtggttcctgcttccggcttttcttttagtgctcagcaaatgtggaaggttatcaaggaaaacaaggatttggacctcccagcccacaaggtcatggttgctactgtacgttgtgaagaaattgctaacgagaagtatgctaatttcactacaaacgaggagtggcatcaaatagaagaggctgtacaatctggtccagtctctggctttggcaagaaacttagttcgactctaagtacttctttttcagagtatgatgcagaagctatttactttgatgaaggagtcagatctgcaaagcgaaagcagcttgaagaaaaattgctgcaacttgtccaaccggcgcaccaatccatgttgggacatattcggtcaggaactcttgacaaatttaaggaagcatttgataaggctctggctgcaggggaaggattttcctcggctgcttattcttgtactcagtattatatgactgtctttgacgaaggatgtacagatgctattattgaacaagcaagttgggacacttctaaagtgagggataagcttcgacgtgatatagatgcgcatgttgcttctgtccgtgctgctaaactttctgaacttacttcatcatttgaggcaaaactcaatgaggcattgtcaggacctgttgaagctcttttagatggtgctactagtgagacttggccagcaataaggaagcttctgcaacgcgagtcggaatcagctgttagtggtctatctagtgcacttgctggctttgacatggataaacaaagtaaggataagatgcttagtagcttggagacttatgcaagaggtgtagttgaagcaaaagcaaaggaagaagctggacgagtcttgatccgtatgaaagacaggttttcaatgttgtttagccacgattctgattcaatgccacgagtttggactggaaaggaagatattcgagctattaccaaaactgcccgctctgcatccttgaagttgttatctgtaatggttgcgatccgtttggatgatgaagttgataatgttgaaagtaccctatcatctgttttcttggataccaagaacaatgctgctgttacagagagaagcatcacgaaaactgatccactggcctcaagcacgtgggatgaggttccctcatcaaagacattgatcacacctgtccaatgtaaatctttgtggaggcaattcaaggcagagacggagtatagtgtcactcaggccatttctgctcaggaagccaacaaacgcaataacaactggttaccaccaccatgggcaattgttgcgttggttgtgctgggatttaatgaatttatgacacttctgagaaatcccttgtatctgggtttcatctttgtagtttttctacttgttaaagccttatgggtgcaactggatgtgtctggcgaattccgcaatggcgctcttcctgggctaatttcattgtcaacaaagttccttcctactattatgaaccttatcaaaaaactagctgaggaagggcagaagcctgctactaatgatcctcaaagaaacccagcactagcagcaaagagtttccgtaatggagtaggcagcagcgatgatatgtcaactgcttcgtcaggggtaacttccacagaaaatggtactgaattctcgagtgcctcgaaagatgactagggaaagaattatcctatcagaaaacacttctattactgtttcaagatgtcagtattctgctcaaaattgtcacgtctgtaagcatgcaagagaaacagattttgaaggcattaattttagagcatgtgccgcatacagggggctatttgattttgagaaagccccattcgatagtgttcttatggtttagtataggtgttaaattttttttttttttttaatatttttccttttcgtctcaaatcctttttctatttatatttcggtaccttattatatggggcaggctggtggctctttgtctaaacataaatagaggttgattttgctggtttgaattcaattttgtcttgtgacaag

SEQ ID NO: 1547 - DNA, 3080 bp, Glycine max
aaaaaaaaaagtgttgtgttgtatggcagaaacaaggggaggcaaatgtatttcattaggcagagacagtttgaaggatagtttatcacgaaaacgaaatggcaatgatccctgtaagatgagagatcgcaccttctcttaaccttttttcgtgcttcaaatccaaatcgcgatacattcaaatggcgaacaatgagaaatgttgttccactcaacttattgatggagatggtgccttcaatgttgccgggattgaaaacttcatgaaagaggttaaattaagtgagtgtgggctttcctatgccgtggtttctattatgggtccacaaagtagtggcaagagcacgctcttaaatagtttgttttgtactaacttcacagagatggatgcatttaagggaaggtctcaaacaaccagaggaatttggatggctagatgtgttgggatagagccttgtacacttgtgatggatttggagggtactgatggaagagaacgtggagaggatgatactacatttgaaaagcagagtgctttatttgctttggctatttctgatatagtgctaataaacatgtgctgtcatgacattggtcgcgaacaagctgcaaataagccgcttttaaaaactgtgtttcaggtcatgatgagattgtttagtccacgcaaaacaacaatgttgtttgtcatacgtgataagacaaagacaccacttgaaaatttagaacctgttttgagagaagatattcagaagatatgggattctgttcctaaaccagatgctcacaaagaaaccccattaagtgaatttttcattgttgaagttgttgctctttctagtttcgaagaaaaggaagaacaatttaaggagcaggttgccaacttgaggcaacgattctatcattctattgctccaggtgggcttgcaggggatcggcgtggagtagttcctgcttcaggcttttcttttagtgctcaagaaatctggaaaatcattaaagagaacaaggatctcgaccttcctgcacacaaggtaatggtagctactgtacgatgtgaagaaattgctaacgagaaatatgacctttttgctacaaataaggattggtgtgagttggaagaggctgtgcaatctggccctatttctgaatttgggaaaaagctcaattcactccttattgcttgtctttctgagtatgatgctgaagccaactattttgacgaaggtgtgagatctgcaaaacaaaagcaacttcaagaaaaactgtttcaacttgtccaaccaacattccaaattgtgctgggacatatgaggtccggaattttggataagtttaaggaagcatttgacaaggcattgaatggaggggaagggttttcttctgctgccaataagtgcatagagatttatatggctcagtttgacgaaggatgtgcagatgttgttattgaaatagcaaactgggatacatctaaagtaagggagaagctacagcgtgatattgatgcacatgttgcatctgtacgagcttctaagatgtcagaacttgtttcatcatatgaggaaaaactgaaagaggccttgtctgcacctgttgaaactctattggatgcagctaatagtgatacttggccatcaataaggaaacttcttaatcatgagactcaatcagctgtttctgggttctgtgttgaacttatcagatttgatgtggatgaacaaacaaaaaagagcatgattgtgagtttagatgattatgcaaagggtgtgatagaagccaaggctagggaagaagctggcagagttctaatccgtatgaaggacaggtttttgacattgtttagtcatgattctgattcaatgcctcgtatttggacgggaaaagaagatgttcgagcaatcaccaagtctgcccgctcttcgtgcttgaagttgctgtctgtaatggctgtaattcgcttggatgatggtgatgacatttataatattgagaaaacattaatagttgcattagcagattcatcaagcagttctgctaaagataagagcatgacggcagttaagccactagcttcaagcacttgggatcaggtaccgccctctaaaacattgatcacacccgtccagtgtaaatccttgtggaggcaattcaagatggagacagaatattgtgtctctcaggccatttctgcacaggaagccaacaatcgtagcagcaactggttacctcctccatgggcgattgtggctttgattattcttggatttaatgaatttatgacacttttaagaaatcccttgtatttaggtgtcatcttcgttggctatcttctcattaaagccctatgggcgcagcttgacattacgggtgaatttcgcaatggagctcttccaggaatcatctccttgtctagcaagtttgttccaactatcatgagaattatcagaaaactagcagaggagggacagggccatgcaaataacgatcctaggagaagtccatcaaaaaacaatcaaagtgctattcctgctggtagagttacctcatctagtgcttcatctagtgtaacttcaccgggcaatggagccgagtatacgagttcatcaaaacatgagtaggtaaaggtagtcatatatatcttacttaaaagcaaactattctgttagaagatggtggtttctgcagggtttttgctaatccacgaagttttttactcgtgatcattttttaagacattcaaaggtattaatttttatgcgagtgctgcacacgagggctgcgttttgtttagagatatctcggttcgagttgggttctttagttaattggagaacttaggttattctacatgattttgtgtgtaagagttgaatgtgttctgaaagtttaaatgttggagtcgtgtgtttatattagattcttaagattttgactgatgcaactgcgtgtaagatcatgtttgctacttgtaatgctaacaaggttgaaagtaaagatagactgcttgcttcaattagcttgtttgactttggacactaaacaatgttttgtattgtttagaattttaggatgatatt

SEQ ID NO: 1548 - DNA, 2527 bp, Ricinus communis
cttatagttcttaggtcaaattgagctctcaatcctctccactttcgatccaattcaaatggcaaatagtgaagaatcttgctctactcagctgattgatggagatggtacatttaatgccgctggactagaacactttaccaaagaggtgaggttgggggaatgtggactatcatatgctgtagtatccatcatgggcccacaaagtagcgggaaaagcactcttttaaataatttattcggcaccaactttagagagatggatgcatttagaggaagatctcaaaccactaaaggaatttggttagctagatgtgctggcattgaaccatgtactcttgttatggatttagagggtactgatggaagagaacgtggagaggatgatacagcctttgagaagcagagtgctctgtttgcccttgctgtctcagatatagtactgattaacatgtggtgccatgatattggccgtgagcaagctgcaaataaacctcttttgaagactgtattccaggtcatgatgcgattgtttagtccacgcaaaacaacgttgatgttcgttatacgtgataaaacaaggacacccctggagaatttagaacctgttctaagggaagatattcagaagatttgggatgctgttcccaagccacaagaacacaaggaaacaccattaagtgaattttttaatgttgaagttgttgcactttcgagttatgaagaaaaggaagagcaattcaaagagcaggttgctagcttgaggcaacgcttcttccattctattgcacctggtgggcttgctggagatcgaaggggtgtggttcctgcttccggcttttcttttagtgctcagcaaatgtggaaggttatcaaggaaaacaaggatttggacctcccagcccacaaggtcatggttgctactgtacgttgtgaagaaattgctaacgagaagtatgctaatttcactacaaacgaggagtggcatcaaatagaagaggctgtacaatctggtccagtctctggctttggcaagaaacttagttcgactctaagtacttctttttcagagtatgatgcagaagctatttactttgatgaaggagtcagatctgcaaagcgaaagcagcttgaagaaaaattgctgcaacttgtccaaccggcgcaccaatccatgttgggacatattcggtcaggaactcttgacaaatttaaggaagcatttgataaggctctggctgcaggggaaggattttcctcggctgcttattcttgtactcagtattatatgactgtctttgacgaaggatgtacagatgctattattgaacaagcaagttgggacacttctaaagtgagggataagcttcgacgtgatatagatgcgcatgttgcttctgtccgtgctgctaaactttctgaacttacttcatcatttgaggcaaaactcaatgaggcattgtcaggacctgttgaagctcttttagatggtgctactagtgagacttggccagcaataaggaagcttctgcaacgcgagtcggaatcagctgttagtggtctatctagtgcacttgctggctttgacatggataaacaaagtaaggataagatgcttagtagcttggagacttatgcaagaggtgtagttgaagcaaaagcaaaggaagaagctggacgagtcttgatccgtatgaaagacaggttttcaatgttgtttagccacgattctgattcaatgccacgagtttggactggaaaggaagatattcgagctattaccaaaactgcccgctctgcatccttgaagttgttatctgtaatggttgcgatccgtttggatgatgaagttgataatgttgaaagtaccctatcatctgttttcttggataccaagaacaatgctgctgttacagagagaagcatcacgaaaactgatccactggcctcaagcacgtgggatgaggttccctcatcaaagacattgatcacacctgtccaatgtaaatctttgtggaggcaattcaaggcagagacggagtatagtgtcactcaggccatttctgctcaggaagccaacaaacgcaataacaactggttaccaccaccatgggcaattgttgcgttggttgtgctgggatttaatgaatttatgacacttctgagaaatcccttgtatctgggtttcatctttgtagtttttctacttgttaaagccttatgggtgcaactggatgtgtctggcgaattccgcaatggcgctcttcctgggctaatttcattgtcaacaaagttccttcctactattatgaaccttatcaaaaaactagctgaggaagggcagaagcctgctactaatgatccccaaataaacccagcactagcagcaaagagtttccgtaatggagtaggcagcagcgatgatatgtcaactgcttcgtcaggggtaacttccacagaaaatggtactgaattctcgagtgcctcgaaagatgactagggaaagaattatcctatcagaaaacac

SEQ ID NO: 1549 - DNA, 3145 bp, Populus trichocarpa
ccaaagagcataaaacgagagaagggaggaaagctagagacacacacacacattgctctctgagatccctttgccttctttcccaatcgaacaggcatccgttttaggtgaaattgagctgtcttttcgatccaattcaaatggaaaagagcgatggttgctgttctactcaccttattgatggagatggtatgtttaatgatactggattagaacaattaatcaaggaagtgagattgggggaatgtggattgtcatatgctatagtctccattatgggcccacaaagtagtgggaagagcactttgttgaatcatttgtttggtaccagctttagagagatggatgcttttaaaggaaggtctcaaaccactaagggaatttggttggcaagatgtgctggtattgaaccctgtactcttgtaatggatttggagggaactgatggaagagaacgtggagaggatgatacagcatttgagaaacagagtgccctttttgcccttgctgtctcagatatagtattgattaacatgtggtgtcacgatattggtcgtgagcaagctgcaaataagcctcttttaaagactgtatttcaggtcatgatgcgattattcagtccacgcaaaacaactttgatgtttgtcatacgtgacaaaacaaggacaccattggagaatttagaacctgttctaagagaggacattcagaagatatgggactctgttcccaagccagaagctcacaaggaaactcgattgagtgaattctttaatgttgaagttgttgctctttctagttatgaagaaaaagaagagcaattcaaggagcaggttgctagtttgagacagcgatttttccattctattgcacctggtgggctcgctggagatcgtaggggtgtagttcctgcttcaggtttctctttcagtgcacaggaaatctggaaagttattaaggaaaataaggaccttgaccttcctgcccacaaggttatggttgctactgtacgctgtgaagaaattgccaacgaaaaatatggtagttttgttgcaaatgagaagtggtgtcaaatggaagaggctgtagaatctggtccagtctctggctttggaaagaagcttagtgcaattctaaatattagtttgtctgagtatgatgccgaagctatttattttgacgaaggagtaagatctgcaaagcgaaagcagcttgaggaaaaattgctccaacttgtccaaccagcacatcaatccatgttgggtcatataaggtctggaactcttgaaaaattcaaggaagcatttgataaagctttgaatgcaggagaagggttctctttggctgctcaaacttgcactcagtcttacatggctcaatttgatgaatggtgtgcagatgctgtcattgaacaagcaaactgggacacatctaaagtgcgggataagctacgtcgtgatatagatgcacatattgcttctgtccatgctgccaaactctctgaacttacttcgtcattcgaggcaaaactaaatgcggcattatcagggcctgttgaagctcttttagatggagctaatagtgagacatggtcagctataaagaaacttctgctacgtgagacagaatcagctgttgctgggttctgtaatgcaatctttggttttgacatggatgaacaatctaaggacaaattaattgcaagtctggagaattatggaagaggtgtcgttgaggcaaaagcaagagaagaatctggaagggtcctgatccgtatgaaagacaggttttcaatgttgtttagccatgactctgattcaatgccacgaatttggaccggaaaggaagacattcgagcaattaccaaaactgctcgctctgcatctttgaagttgttatctgtaatggctgcaatccgtctggatgatgatgttgacaatattgagactacattatcgtctgctttgatggatgcaaagaacaatgctgctgttaaagacagaagtatcataccatttgacccactggcctcaaactcttgggaaaagattccatcctcaaggacattgatcacacctgtccagtgcaaatctttgtggaggcaattcaagacagagacagagtacactgttacccaggccatttctgcacaggaagcccacaaacgtaataacaactggttaccacccccatgggcaatcctcgccttggttgtgttaggatttaatgagtttatgacacttttgagaaatcctttgtatttgggtgtcatctttgtaggttttctactcattaaagccctatgggtgcagttagacatttcaggcgaattccgcaatggtgctcttcctgggcttctttccttatcttcaaagttcgttcccactatcatgaatcttctcaaaagactagcagaagaggggcagaaacctgcgactgcagatcctcagagaaatgcaacaaaaagttttcagaatggatcaagctcttttagtgattcctcatcaagcgcttcctctggtgttacgtcaccaaaacaagggaccgagtactcgaacaccttgaaagatgactaggtggtgggaacagctgtcttgttggaaaagcattttagtttctctgtttgaagatgccagcattctgctcgcattgtggtgggttgcatgtgtatggtccacgattttgaactcttgcaagcatgtgagaagaacagattttgaaggcattaatttttgtgtaagtgccgcatacaggagggtgctggtttattgtgagaaagcccccattgaatagttcttcatgtatcaaccctaggtgttccttttgtttgtttatttttcggggacaagctacatcttatctaaacattggtcgtggttgattctactggctcgtattcaatcttgtctttgtgagaattgtgacgctgtttctgtttggcttgtatcttttgcactctgtgtttctttttcgctctatttcaaaggggggaaaaagaaagaaagaagggcattgggttttggaacaggaaatgcaattgatgatgattgcttttattttatttcttggttgtcaaagggcttaataatatatcaatggcggatgcagggcatgaggtttggaggggcaggatgtgatatatata

SEQ ID NO: 1550 - DNA, 613 bp, Arachis hypogaea
tgatagagcgagtggtatcaacgcagagtacggggggtgaagcgctgagggtataagcttgtctcgtgtcgtgcgccatcaacgttctttggttttgcgattcggacccaaccctaatcccccttttgcatctcaaccatgtcgaccaagcaaggtggaaaggctaagcctttgaagaaacctaagtctgacaagaaagactacgatgaggttgacatggccaacatccaaaagaaaaaagaagaggagaaggcgctaaaggaattgaaagccaaggcgcaacagaaaggttcatttggaggttctgggctcaagaagagtggaaagaaatgagggctctcagccatgatacttaacattagtatacttccatcattaagctctgtaattacaattatcatgagcacatctcttattgtgacctacttttgttgttagtgttggtaatgaacctaggcatgtcatgatgtgtactcccaataagttactgatttgtatttctactgtgtgcccttcttgggtcctgactgctgataattccatcttttccttttcttggatttcgtacaaaaaaaagaaaaaaaacaaaagtactctgcgttgataccactgc

SEQ ID NO: 1551 - DNA, 576 bp, Arachis hypogaea
cgctgagggtataaccttgtctcgtgtcgtgcgccatcaacgttctttggttttgcgattcggacccaaccctaatcccccttttgcatctcaaccatgtcgaccaagcaaggtggaaaggctaagcctttgaagaaacctaagtctgacaagaaagactacgatgaggttgacatggccaacatccaaaagaaaaaagaagaggagaaggcgctaaaggaattgaaagccaaggcgcaacagaaaggttcatttggaggttctgggctcaagaagagtggaaagaaatgagggctctcagccatgaaacttaaattagtatacttccatcattaagctctgtaattacaattattatgagcacatctcttattgtgacctacttttgttgttagtgttggtaatgaacctaggcatgtcatgatgtactcccaataagttactgatttgtatttctactgtgtgcccttcttgggtcctgacagctgataattccatcttttccttttcttggatttcataacaaaaaaaaaaaaaaaaaaaaaaaaaacaaaagtactctgcgttgataccact

SEQ ID NO: 1552 - DNA, 665 bp, Arachis hypogaea
gcagtggtatcaacgcagagtacggggggtgaagcgctgagggtataaccttgtctcgtgtcgtgcgccatcaacgttctttggttttgcgattcggacccaaccctaatcccccttttgcatctcaaccatgtcgaccaagcaaggtggaaaggctaagcctttgaagaaacctaagtctgacaagaaagactacgatgaggttgacatggccaacatccaaaagaaaaaagaagaggagaaggcgctaaaggaattgaaagccaaggcgcaacagaaaggttcatttggaggttctgggctcaagaagagtggaaagaaatgagggctctcagccatgaaacttaaattagtatacttccatcattaagctctgtaattacaattatcatgagcacatctcttattgtgacctacttttgttgttagtgttggtaatgaacctaggcatgtcatgatgtactcccaataagttactgatttgtatttctactgtgtgcccttcttgggtcctgactgctgataattccatctttttctttcttggatttcataaaaaaaaaaaaaaaaaaaaaaacgcctcggccactctgcgttgataccactgcttgggtggaaccactctgcgttgataccactgcttgggtggaaccactctgcgttga

SEQ ID NO: 1553 - DNA, 602 bp, Arachis hypogaea
gcagtggtatcaacgcagagtacggggggtctcgtgtcgtgcgccatcaacgttctttggttttgcgattcggacccaaccctaatcccccttttgcatctcaaccatgtcgaccaagcaaggtggaaaggctaagcctttgaagaaacctaagtctgacaagaaagactacgatgaggttgacatggccaacatccaaaagaaaaaagaagaggagaaggcgctaaaggaattgaaagccaaggcgcaacagaaaggttcatttggaggttctgggctcaagaagagtggaaagaaatgagggctctcagccatgaaacttaaattagtatacttccatcattaagctctgtaattacaattattatgagcacatctcttattgtgacctacttttgttgttagtgttggtaatgaacctaggcatgtcatgatgtactcccaataagttactgatttgtatttctactgtgtgcccttcttgggtcctgacagctgataattccatcttttccttttcttggatttcatacaaaaaaaaaaaaaaaaaacttagtactgtagttagatattgtgctgcccaagttaatggtttaactgtg

SEQ ID NO: 1554 - DNA, 566 bp, Vigna unguiculata
gaggcgagggtaaggtcgcgtagtttcgtgttttgttccttttcattgtcgtttttgtgtccagacctaaccctaactccgcaacgcaaccatgtcgaccaagcaaggtggaaaagctaagcctttgaagaagcccaagtctgataagaaggattacgacgaggttgacatggccaacattcagaagaaaaaggaagaggagaaggcgctaaaggagttgaaagccaaggcgcaacagaagggaagttttggaggttctgggctcaagaaaagtggaaagaaataaggtgtttttataattattgcatgcatgcaatattgagctctgtaattacagttgctaccataagaacttctctcttattgtggcctactttattgctaatgttagtaccgtatgaactgacgtatgtctgatgtaagctgcaacaaattacttgttggtggctaacttaattgtcttcgtgggttctgattgttacatccatttcttagtgttgtgggtttggcatatacttgtttgagttataataatggcatggcattcaacttttaattagagaaaa

SEQ ID NO: 1555 - DNA, 351 bp, Arachis hypogaea
cctatacccctgtgtgccttggcagtctcagaagcagtggtatcaacgcagagtggaaagaaatgagggctctcagccatgaaacttaaattagtatacttccatcattaagctctgtaattacaattattatgagcacatctcttattgtgacctacttttgttgttagtgttggtaatgaacctaggcatgtcatgatgtactcccaataagttactgatttgtatttctactgtgtgcccttcttgggtcctgacagctgataattccatcttttccttttcttggatttcataacaaaaaaaaaaaaaaaaaaaaaaaaaacaaaagtactctgcgttgataccact

SEQ ID NO: 1556 - DNA, 406 bp, Arachis hypogaea
aagcagtggtatcaacgcagagtggtccaccaagcagtggtatcaacgcagagtggaaagaaatgagggctctcagccatgaaacttaaattagtatacttccatcattaagctctgtaattacaattatcatgagcacatctcttattgtgacctacttttgttgttagtgttggtaatgaacctaggcatgtcatgatgtactcccaataagttactgatttgtatttctactgtgtgcccttcttgggtcctgactgctgataattccatctttttctttcttggatttcataaaaaaaaaaaaaaaaaaaaaaacgcctcggccactctgcgttgataccactgcttgggtggaaccactctgcgttgataccactgcttgggtggaaccactctgcgttga

SEQ ID NO: 1557 - DNA, 528 bp, Arachis hypogaea
agtggtatcaacgcagagtacggggggggtgaagcgctgagggtataagcttgtctcgtgtcgtgcgccatcaacgttctttggttttgcgattcggacccaaccctaatcccccttttgcatctcaaccatgtcgaccaagcaaggtggaaaggctaagcctttgaagaaacctaagtctgacaagaaagactacgatgaggttgacatggccaacatccaaaagaaaaaagagaggagaaggcgctaaaggaattgaaagccaaggcgcaacagaaaggttcatttggaggttctgggctcaagaagagtggaaagaaatgagggctctcagccatgatacttaacattagtatacttccatcattaagctctgtaattacaattatcatgagcacatctcttattgtgacctacttttgttgttagtgttggtaatgaacctaggcatgtcatgatgtgtactcccaataagttactgatttgtatttctactgtgtgcccttcttgggtcctgactgctgataa

SEQ ID NO: 1558 - DNA, 636 bp, Trifolium pratense
tacatggggagtgagggtaaggtctttctttgtcgtgtgctgttattttctctgtcgtttttgtattcagaccgaaaccctaactcttcatcgcaaccatgtcgaccaagcaaggtggaaaagctaagcctttgaagaaaccaaagtctgataaaaaggattatgatgaggttgacatggctaacatccaaaagaaaaaggatgaggagaaggccctaaaggagttgaaagctaaggcacaacagaagggatcttttggaggatctggactcaagaaaagtggaaagaaatagaagggctctttgtcatgatttgatacttccattattgagctctgtaattacaattatgaccatgagaacatctcttattgtgtggcctttttaattactgatgttagtactgaactaaggcatatcatgatgatgtaaaagaaataagtaacttgtttgctgcttcattgtgtctccttttggggttatgataattacatctgtttagtgttgtgccttttgcgcagacttttcgtactactgatggcttggtatatgaaatttcaattatcaaattctattacgctctcaagtctaacagtaacagcttaaagttgcgagagatatgagatccgagttgaaa

SEQ ID NO: 1559 - DNA, 625 bp, Trifolium pratense
gggagtgagggtaaggtctttcattgtcgtttgctgttattttcgttgtcgtttttgtattcagaccgaaaccctaactcttcatcgcaaccatgtcgaccaagcaaggtggaaaagctaagcctttgaagaaaccaaagtctgataaaaaggattacgatgaggttgacatggctaacatccaaaagaaaaaggatgaggagaaggccctaaaggagttgaaagctaaggcacaacagaagggatcttttggaggatctggactcaagaaaagtggaaagaaatagaagggctctttgttatgatttgatacttccattattgagctctgtaattacaattatgaccatgagaacatctcttattgtgtggcctttttaattgctgatgttagtactgaaccaaggcatatcatgatgatgtaaaagcaataagtaactttgtttgcagcttcattgtgtctcccttttggggttatgataattgcatctgtttagtgttgtggcttttgtgtagacttttcggagtactaattggcttggtatattaaatttcaattatcaaattcttttatgctatcaagtctcacctcatagtaacagcttaaagttgtgagagatacgag

SEQ ID NO: 1560 - DNA, 592 bp, Arachis hypogaea
tggttttgcgattcggacccaaccctaatcccccttttgcatctcaaccatgtcgaccaagcaaggtggaaaggctaagcctttgaagaaacctaagtctgacaagaaagactacgatgaggttgacatggccaacatccaaaaagaaaaagaagaggagaaggcgctaaaggaattgaaagccaaggcgcaacagaaaggttcatttggaggttctgggctcaagaagagtggaaagaaatgagggctctcagccatgaaacttaaattagtatacttccatcattaagctctgtaattacaattatcatgagcacatctcttattgtgacctacttttgttgttagtgttggtaatgaacctaggcatgtcatgatgtactcccaataagttactgatttgtatttctactgtgtgcccttcttgggtcctgactgctgataattccatctttttctttcttaggaaaaaaaaaaaaaaaaaaaaaaaaaaaaaaaaaaaaaaaaaagacgcccgacactctgtgtctacacactcccgtgagactacgacgaacgacacacgaggagtagcgccccccccccccccccc

SEQ ID NO: 1561 - DNA, 383 bp, Arachis hypogaea
aagcagtggtatcaacgcagagtggaaagaaatgagggctctcagccatgaaacttaaattagtatacttccatcattaagctctgtaattacaattatcatgagcacatctcttattgtgacctacttttgttgttagtgttggtaatgaacctaggcatgtcatgatgtactcccaataagttactgatttgtatttctactgtgtgcccttcttgggtcctgactgctgataattccatctttttctttcttaggaaaaaaaaaaaaaaaaaaaaaaaaaaaaaaaaaaaaaaaaaagacgcccgacactctgtgtctacacactcccgtgagactacgacgaacgacacacgaggagtagcgccccccccccccccccc

SEQ ID NO: 1562 - DNA, 475 bp, Vicia sativa
agttcgggtaaggtctttctttgtcgcgtgttgttattttctctctcgttttcgttttcagaccgaaaccctaactctgcaccgtaaccatgtcgaccaagcaaggtggaaaagctaagcctttgaagaaaccaaagtctgataagaaggattatgatgaggttgacatggctaacatccagaagaaaaaggatgaggagaaggcactaaaggagttgaaagctaaggcctcacagaagggatcttttggaggatctggcctcaagaaaagtggaaagaaatagaaggggctcttttatcatgatttcatattttcattattgagctctgtaattacgattatgatcatgaaaacttctcttattgtgtgacctgttttaatgctgatgttagttctaaatcaaagcatgttatgatgatgtaaacgcaataagttactgcattgtagctctattgtgtctccctttagggttat

SEQ ID NO: 1563 - DNA, 359 bp, Cicer arietinum
attttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagtactga

SEQ ID NO: 1564 - DNA, 430 bp, Lupinus angustifolius
attcaataggtcgtattgtgttgcgtgcggtgagtttctttgtcgtttcgtgattcagaccaaaccctaacgcaaccatgtcaaccaagcaaggtggaaaagctaagcctttgaagaaacccaagtctgataagaaagattacgacgagattgatatggctaacattcagaagaaaaaggaggaggagaaggcgctgaaggaattgaaagccaaggcatcacagaagggaagtttcggaggttccgggctcaagaagagtggaaagaaatgaagactccatcattgaactctgttaccatgaagagatctatctcttactgtgttctactttatctctggtattgaacttaggtgtgtcattatgtaaagcgcaataagttacttgtttgttttctgtgttgaatgacacattgatttcacagatattgc

SEQ ID NO: 1565 - DNA, 297 bp, Medicago truncatula
gtctttttgttcgcgtgctactttttttcttcgtcgttttcgtattcagacccaaaccctaactcttcaaccaaaaccatgtcgaccaagcaaggtggaaaagctaagcctttgaagaagccaaagtctgataagaaggattacgatgaggttgacatggctaacatccagaagaaaaaggatgaggagaaggcgctaaaggagctgaaggctaaggcctcacagaagggatcttttggaggatctggactcaagaaaagtggaaagaaatagaagggctctctgtcatgatttcat

SEQ ID NO: 1566 - DNA, 574 bp, Glycine max
gggaggaagaataattgtgaggcgagggtaaggtcgcgttgtgttgcgtcgtgtcgtgcgctgttcctctgtttctcgtttttgtgttcagaccgaaccctagctccgcatcgcaaccatgtcgaccaagcaaggtggaaaagctaagcctttgaagaaacccaagtctgataagaaggattacgacgagattgatgtggctaacattcagaagaaaaaggaagaggagaaggcgctaaaggagttgaaagccaaggcgcaacagaagggaagctttggaggttctgggctcaagaaaagtggaaagaaataagggctctttatcatgattgtatgcattcaatattgagccctgtaattacagttgctaccatgataacttctcttattattgtggcctactttattgctaatgtgtactgaactgaggtatgtcgtgatgtaagctgcaataagttaattgtctgtagctttattgtatccccttcatggggttctgataattacatccttttagtagtgttgtggatttggcatagacttgttcaagtaaataatggcatggcttgcgaaa

SEQ ID NO: 1567 - DNA, 558 bp, Phaseolus vulgaris
gattgttgaggcgagggtaaggtcgcgtcgtttcgtttcgtgctttgtttctttcattgtcgtttttgtgtccagacctaaccctagctccgcaacgcaaccatgtcgaccaagcaaggtggaaaagctaagcctttgaagaagcccaagtctgataagaaggattacgacgacgttgacatggccaaccttcagaagaaaaaagaggaggagaaggctttaaaggagttgaaggccaaggcgcaacagaagggaagttttggaggttctgggctcaagaaaagtggaaagaaataagggatttttataattactgcatacatgcaatattgagctctgtaattacagttgctaccataagaacttctcttttattgctaatgttagtactgtatgaactgacgtatgtctgatgtaagctgcaacaagttacttgttggctgctaacctactgtgtctttgtggggtttgattattacacccatttattagtgttgtgggtttggcatagacttgttcgagttataataatggcttggctttcaaattttaattatt

SEQ ID NO: 1568 - DNA, 760 bp, Cicer arietinum
tacgcgagagaataacttggtgagggtaaggtctttctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagtactgaaccaaggcatgttatgatgtaaaacacaataagttacttgtttgtacctttattgtgtctccctttggagttatgataattacatctgtttagtgttttggctgtgataataacattcttgacacggtttaattttaaattatgtgtttggttcaactttaaggagggggaggacagcaaaatcacttttcaagtggtttttattctcccagcattttaggagatttggatgggaggggagagaatcaacataattaaaaaaatcaatcatctccttctctcctgtttttgaactaaacatctatttactttcactcctctccttctgttgaatcaatcag

SEQ ID NO: 1569 - DNA, 542 bp, Vigna unguiculata
ggtcgggtagtttcgtgttttgttccttttcattgtcgtttttgtgtccagacctaaccctaattccgcaacgcaaccatgttgaccaagcaaggtggaaaagctaagcctttgaagaagcccaagtttgataagaaggattacgacgaggttgacatggccaacattcagaagaaaaaggaagaggagaaggcgctaaaggagttgaaagccaaggcgcaacagaagggaagttttggaggttttgggctcaagaaaagtggaaagaaataaggtgtttttataattattgcatgcatgcaatattgagctttgtaattacagttgctaccataagaactttttttttattgtggcctactttattgttaatgttagtaccgtatgaactgacgtatgtttgatgtaagctgcaacaaattacttgttgggggctaacttaattgttttcgggggttttgattgttacatccattttttagtgttgtgggtttggcatatacttgtttgagttataataatggcatggcattcaacttttt

SEQ ID NO: 1570 - DNA, 452 bp, Lupinus angustifolius
atcaacgcagagtacatgggggtgaggcgatagggtaacgtcgtatcgtgttttgttctataactttctttgtcgtttcttgattcagaccaaaccctaacgcaaccatgtcgtccaaacaaggtggaaaagctaagcctttgaagaaacccaagtctgataagaaagattacgatgagattgacatggctaacatccagaagaaaaaggaagaagagaaggcactaaaggagttgaaagcgaaggcatcacagaaaggaagtttcggaggttccggcctgaagaaaagcggaaagaaatgaagacttaatcacgattataactgtagaaacatctcatttcttatattgtggtgtaatttatttctggtttggaacctaggcgtgtcatgatgtaaagcacattaagttagtttgttttctgtgtattttgacccacttggattctgataa

SEQ ID NO: 1571 - DNA, 424 bp, Glycine max
aaagttatgaagagaagtacaacaagcgtgaagactcaagccgccagattttgattttgaagcagcaaaacattgtcgaaaaacacaaaatagaagcatccaggtaattttcaacatatacgtgtctgtcgtttttatgttcagaccaaaccctagctccgcatcgcaaccatgtcgaccaagcaaggtggaaaagctaagcctttgaagaaacccaagtctgataagaaggattacgacgaggttgacatggctaacattcagaagaataaggaagaggagaaggcgctaaaggagttgaaagccaaggcgcaacataaaggaagctttggaggttttgggctcaagaaaagtggaaagaaataagggctctttatcatgattgtatacatccaatattgtgcaggatttgaaaggtgaattc

SEQ ID NO: 1572 - DNA, 1036 bp, Cyamopsis tetragonoloba
cacgaggaaggaacctatattgacaagaagtgcccgttcactggcaatgtttccattcgaggccgtatcttagctggtacttgtcacagtgctaagatgacaaggactataattgttaggaggaattatcttcattttattaagaagtatcagagatatgagaagaggcattcaaatattcctgctcatatctcaccttgcttccgcgtgaaggaaggggaccatgttattattggccagtgcaggccaatctcaaaaactgtgaggtttaatgtgttgaaagtgatcccagctggatcttctagtggtgcaaagaaggcttttactggaatgtgagatttgattttcagttttattcaaaggaagcgttttcttgttagttattagatatgatttctgggaagtgacaaatataaagatctgatcaattttggtttgctttcaaggttgttatgagtgacctcccgtactaatagcaattattttgtctgttttatctctgcttttgaaatatatcggaattgatagtaaatattttgcaagcaaagtaattgttactagaccaagtcacaacaataccaagtagatgtaatttatcaggcccttgcataattatagggcacacaataaagctacaaacaagtaacttattggacttgcatcatggtaagtctcggttcagtactaacaccaacggtaaaaaaagccacaatacgacatgttctcgtcataacaacggaaattacagagcttagtaatggatgtataaaatcatgataaagaacccttatttctttccacttttcttgagcccagcaccacccaaacctcctttctgttgtgccttggctttcaactcctttagcgccttctcttcttctttcttcttctgaatattggccatgtcaacctcgtcgtattccttcttatcagacttaggtttcttcaagggcttagcttttccaccttgcttggtcgacatggttgcgatgtggagctagggtttggtcagaacgcagaaacgacgaagaaagag

SEQ ID NO: 1573 - DNA, 316 bp, Arachis hypogaea
aagcagtggtatcaacgcagagtacggggggtgaagcgctgagggtataagcttgtctcgtgtcgtgcgccatcaacgttctttggttttgcgattcggacccaaccctaatcccccttttgcatctcaaccatgtcgaccaagcaaggtggaaaggctaagcctttgaagaaacctaagtctgacaagaaagactacgatgaaggttgacatggccaacattccaaaagaaaaaagaagaggagaaggcgctaaaggaattgaaagccaaggcgcaacagaaaggttcatttggaggttctgggctcaagaagag

SEQ ID NO: 1574 - DNA, 369 bp, Lupinus angustifolius
gcacttgtataaatataaccgagtaagcggaagggtaaggtcgtatcgtgttgctttcgtcgtcgtttcgttattcagacgaaaccctaacgcaaccatgtcttccaagcaaggtggaaaagctaagcctttgaagaaacccaagtctgataagaaagattacgacgagattgacattgctaacattcagaagaaaaaggacgaggagaaggcactaaaggaattgaaagccaaggcttcacagaagggaagttttggaggttctgggctcaagaaaagtgggaaaaaatgaagactctcatggttataactgtaccatccatcattgagctctataattacaattgttaccatgaagacatctcttat

SEQ ID NO: 1575 - DNA, 483 bp, Theobroma cacao
tagggttagggcttttatttcttctgtgactccccaatttttccgatctcttcgaatttcggacgcaaaccctaaccctagactcccaaccatgtcgtccaagcaaggtggcaaattgaagcctttgaagcaacccaaatctgataagaaagaatacgacgagcacgatatggcaaacattcagaaaaagaaggaagaagagaaggcacttaaagagctgagagcaaaggcacaacaaaaggggtcatttggtggttctgggctgaagaagagtgggaagaaatgagggtctagaacccaaactgaaatagataatattgagtcttgtgttatgattccaacttacattatgatggcatatcgtttgtttttgtgtgatgtctagagatctattgggatgatttgatggtctagtttcatgctgaatttgctacaaaaccttgtgttcaatgtcattatgtcaagcttaaataaatttaagtt

SEQ ID NO: 1576 - DNA, 663 bp, Cucumis melo
ccctgttgcgtgtctcaggtcgcgaatcgagcagtccctctttgtgttcttcttcgactcgggccaaaccctagcgatatctcagccatgtcgtccaagcaaggagggaaagcaaagcctctgaagcaacccaaggttgataagaaggattacgacgaggttgatatggccaatattcaaaagaagaaggaagaggaaaaggcgctcaaggagcttagagcaaaggctcaacagaaggggacctttggaggtgccgggctcaagaagagtgggaagaaatgagggttctgacttcccacacaaattcatggaggtagatttacttcacgacctgaaattgcagacatttaatggcttttgaatcagttgattgtcctcgtgtgttctctgtaaaaccctgaaaagaagatgatatgttgttgaatgattatatagaagttgaatgcttctcaatatcctaaactttctttagctaaatattctaaactttcctctcgtcttttgttcttttttaataaatataattgggaaaatatattctaaattatctctagacttgaagctaaacgaagtctcaagattttagtattggaattgctttgttgtggttgggaattttctattgcagcattactgaaacgggcagtccattctttctactag

SEQ ID NO: 1577 - DNA, 481 bp, Triphysaria pusilla
tatctaaagctccgtgattgggttaggtcatcgtcatttttcccgtccaaagcttatcttgcaatcacatcgaaccctaaccctagaaataatcatgtcttccaagcaaggtggaaaagcgaagccgttgaagcaaccgaaggcggataagaaagaatacgatgagattgacatggctaatattcaaaagaaaaaggatgaagaaaaggctcttaaggagctcaaggcaaaggctcagcagaagggatcctttggaggctctggtctgaagaaaagtggcaaaaaatgagcctctactgagactagttcttgtattattatgttattgtgttttcttgttcacaacttaaacaatgttatgcttccgttattgatggcttgtggttatcaagcctgccagagatttcgatatcggattatataaatggcattttagtattatgtatggtattttctaatggttgaatttactgtttgttgc

SEQ ID NO: 1578 - DNA, 433 bp, Triphysaria pusilla
aagcttgtcttgcaatcgcagcgaatcctaaccctagaactaatcatgtcttccaagcaaggaggaaaagcgaagccgttgaagcaaccgaaggcggataagaaagaatacgacgagattgacatggctaatattcaaaagaaaaaggacgaagaaaaggctcttaaggagctcaaggcgaaggctcagcagaagggatcctttggaggctctggtctgaagaaaagtggcaaaaaatgagcctctactgagactagttcttgtattattatgttattgtgttttcttgttcacaacttaaacaatgttatgcttccgttattgatggcttggagttatcaagcctgccagagattttgatatcggattatataaatggcattttagtattatgtatggtattttctaatggttgtaatttactgtttgttgc

SEQ ID NO: 1579 - DNA, 469 bp, Triphysaria pusilla
aaagttccgtgattgggttagggcatcgtcattttccccgtccaaagcttgtcttgcaatcgcagcaaatcctaaccctagaactaatcatgtcttccaagcaaggaggaaaagcgaagccgttgaagcaaccgaaggcggataagaaagaatatgacgagattgacatggctaatattcaaaagaaaaaggatgaagaaaaggctcttaaggagctcaaggcaaaggctcagcagaagggatcctttggaggctctggtctgaagaaaagtggcaaaaaatgagcctctaactgagactagttcttgtattattatgttattgtgttttcttgtgcccaacttaaacaatgttatgcttccgttattgatggcttgtggttatcaagcctgccagagattttgatatcggattttataaatggcattttagtatcatgtatggtattttctaattgttgtaatttaac

SEQ ID NO: 1580 - DNA, 582 bp, Triphysaria pusilla
gttcagaatcagattctcagctggtgggcaaaatcgtcattcagcagctttattccgatataaagatgctctaaaaatcaaagcaaaaagcatccatataaagttccgtgattgggttagggcatcgtcattttccccgtccaaagcttgtcttgcaatcgcagcgaatcctaaccctagaactaatcatgtcttccaagcaaggaggaaaagcgaagcccttgaagcaaccgaaggctgataagaaagaatacgacgagattgacatggctaatattcaaaagaaaaaggacgaagaaaaggctcttaaggagctcaaggcgaaggctcagcagaagggatcctttggaggctctggtctgaagaaaagtggcaaaaaatgagcctctaactgagactagttcttgtattattatgttattgtattttcttgttcacaacttaaacaatgttatgcttccattattgatggcttgcagttatcaagcctgccagagattttgatatcggattatttaaatggcattttagtattatgtatggtattttctaatggttgtaatttactgttagttgcctttt

SEQ ID NO: 1581 - DNA, 840 bp, Mimulus guttatus
gcccctgaattaaagtgtagaaattcctcccctttaaatccgcgatttgtgtgaattgtgacattcttcttcatcgatttctaccttgcgctatttggtgattgcagctaaaccctaaccctagaatctaatccaaccatgtcaagcaaacaaggaggaaaagcaaagcctttgaagcaacccaaggccgccagtaaagaatacgacgaggttgacatggctaatattcaaaagaagaaggaagaagaaaaggcgctgaaggagctcaaggctaaagctcagcagaagggatcgtttggaggttcgggtttgaagaaaagtggcaaaaaatgagccctgctaaaagaaaacctattggctcaatgcaaatgtttttcggcattgtgttgtattttaacctctattatcgaatctttcgaacctattagcttgttcttatttgatggctgatgactgtcaaacttttttcgggtgcttttctatgcaaaatatgtattccattttaatggaccaatgatattttccttacctgaaatattttatcttgctgtgcgattgaaggttgagtttttcctgacttttagtaagtttatttatggtttggagaagcctatggcaggtcagtgtcgaagcactgagtgatatattaactagaaatggctccttgatgatgtttttattttattttttgatcaaagatttagggtcgaaatctagcagatttcgacagagttgaagtaatttttcacttgagaaaatgctaattcctatttgtctggtttcgaccctaaatattgaccaaaaaataaaaccgagaatcggaaattggattgaaaaaaa

SEQ ID NO: 1582 - DNA, 421 bp, Lippia dulcis
aatttccgatctcgcgcatctttttcccaatcacagcgagccctaaccctagaattcgaccatgtctagcaagcaaggaggtaaagcgaagccgctgaagcaacctaaggccgataagaaggaatacgacgagacggacatggctaacattcaaaagaagaaggaagaggagaaggctcttaaggagctaagggcaaaggctcagcagaaaggatcatttggaggttctggcttgaagaaaagtggcaagaaatgagacccaattttgggtcaacacactcctttttcgtgttgtggtatgcttgcttgatttggatttgtacgtttcaaacgtgccatcttttttctgattgatgtttggtaacctgcaaacttagcaggattcttttatgtggaattgatttgcatatgacaaaaagaa

SEQ ID NO: 1583 - DNA, 368 bp, Brassica oleracea
ctgaaactttactttcttccgcaaattctcagacgagcagcatcaaaccctagctccagaaaccagtcatgtcgtccaagcaaggaggaaaggcgaaacctttgaagcagcccaaagctgataagaaggaatacgacgagcacgatatggctaacattcagaagaagaaagaagaggaaaaggcacttaaagaactaagagccaaggcatcgcagaagggatcctttggaggctctggacttaagaaaagcggcaagaaatgattcctgtgttttatccatgtagcctgtctgttgacagtgcaaatttatcacctttaaaaaacaaaacaagataatcatgtgttgtgtaacttctctatcatgttc

SEQ ID NO: 1584 - DNA, 424 bp, Triphysaria pusilla
tctaagcaaggaggaaaagcgaagcctctgaaacaaccaaagtctgacaagaaagaatacgacgagtttgacatggctaatattcaaaagaagaaggaagatgaaaaggcactaaaggagctcaaggcaaaggctcagcagaagggttcgtttggaggttccggtttgaagaaaagtggcaaaaaatgatgattttttaattatttaaacatgtgaaaaagtagttttattggggtttaaaacttcgtttgtcattctgttattgcttggatttctggtatcgtttagctggcttttagtgtgtgtttttctgatcatattttccagtaaattgtctccattttaggaacttttttggagtgattttattcagaaatgtcttattatcaaatcatattaaactattagtttgctatatttaggt

SEQ ID NO: 1585 - DNA, 582 bp, Eutrema halophilum
cgttattacgaactcaatatatagaacagcaaccagggattctatcgaatacaggtcattccgcattcgtctgaaactctcagctcctttttcccaaaattctcagatcagcgacgaaccctagctctacaaaccagtcatgtcttccaagcaaggaggaaaggcgaaacctttgaagcagccaaaagctgataagaaggaatacgacgagcacgacatggctaacattcagaagaagaaagaggaggaaaaggcacttaaagaactaagagccaaggcatcgcagaagggatcctttggaggctctggacttaagaaaagcggcaagaaatgatctgttttatccatgaagcctgtttgacagttcaaatttatcaattaaaacagttaaatcgtgtgtttatgtaactttaatcataattgtaggagagtaactttgcgtctccttacatatgtttgctttcgccactttttcatgaaaaaaatgataaatggtttctaccctaatatttcaacatctccggattcagaattcagtaggttgactctcatatttctctttctcgggatccagttttagaa

SEQ ID NO: 1586 - DNA, 1819 bp, Glycine max
ttaccatgtgtgcacacccagggctaagttggacacacagaacaagccaaaagaaagaattggaaagggcttgacgttcaaccttctctctctcacacacacactctctcttagaagatcctctttcgtaatctcgcgccgcttcttcaccgttctcgcctccgtcgagctgcttcctcgtaggttccccgccgacaggtacgatgtctcctgcgatggatcccaaaccattcacacgaagcccagaccgttgaattttcgagcgtcgttggttccgcgcgatgcagtccgtcgtcgagcgcgattactctaactacaaggaggttagcggcgcaaacaatgatgaaggactagcgatcgcgaatctcaggattgctctgcagatcatagatgctctggccaagaaagggattgcggagctcttccccattcaggtaacgtgtatttgttgtgttcattagtttttgtttggaaaaattgtgacttcttttttgttaataagttttctgctgttaattaatgttgcgaggttcattaatatttgtctgacaagaagccagaagaaattcccactgtaaggcctattaattttttaatagataacacaagtacattacaccattaagatgagcagaacatacaagataaccaagagggaagttatgaagagaagtacaacaagcatgaagactcaagccgccagattttgattttgaagcagcaaaacattgttgaaacacaaaatagaaccatccaggtaattttcaacatatacgtgtctgtcgtttttgtgttcagaccaaaccctagctccgcatcacaaccatgtcgaccaagcaaggtggaaaagctaagcctttgaagaaacccaagtctgataagaaggattacgatgaggttgacatggctaacattcagaagaaaaaggaagaggcgaaggtcagatattgtattgcgctaaaggagttgaaagccaaggcgcaacagaagggaagctttgaggttttgggctcaagaaaagtggaaagaaataagggctctttatcatgattgtatacatccaatattgtgcaggatttgaaagttaaaagtaggcgcaacccaacattttattttgattgatgggacatggagcaattcagcaacaatgtttaggcgccttgaggttacttatagcaattgttggggacataactccattggatggaggttctaaagcagaaaagaatcaacgagaacaggcaacactagatcatatgtgtaaagtacttggaggaggatgtacaagtactttcttttcactatacatgagtttgttaatgagataataatgaaaattcacaactcttggtctttaaaagcgatagtcagttttacttgtgccttgaggaggaggaggagtaattttataccaagttgttcagtatcttatctaaagtttgttgagtttgctttggatgaaaccaaacgtcacactcacttgatcccttcgcctttacaggaaaagttcagtttcatgaattccaaggatgttaaagggagtcttagtatgctatcatttgaagctacaaaaattaggcttctacgaagattgatcattgagacagaaacaatgcaagtggtttttttaatgcccatcaattatcaaattgatatatggttggtatctactagtgtcttaacaaaatatgcctttgtgtagtaccttgtaatctattacaacaataacaatttcaaaatttgactttgtatttatttgtgccaatctcacttttctttttcctttaccaataaaggatccttcatctaaaacaatgca

SEQ ID NO: 1587 - DNA, 405 bp, Brassica juncea
ccccaattctcagatcagcatcagaccctagctctacaaatccgtcatgtcgtccaagcaaggaggaaaggcgaaacctttgaagcagccaaaagctgataagaaggaatacgatgagcacgatatggccaacattcagaagaagaaagacgaggaaaaggcacttaaagaactaagagccaaggcatcgcagaaaggatcgtttggaggctctggtcttaagaagagcggcaagaaatgatcccgtttaatatccatgagaaagcccgtctttgaccagtgcttatttatcaacttttaatgttgtgtaactttctatcatggctgtatgagagtgactttgcctatctatcccataacatatgtttgcttcaaaaaaaaaaaatgtatttaaacttcctcagg

SEQ ID NO: 1588 - DNA, 686 bp, Vaccinium corymbosum
aattagctgtcgggttagggctgtctacgtttcttgttctttgcgtccaaattcgaaccctaaccctagaaaagcaaagatgtcgtccaagcaaggtggaaaagcaaagcctttgaagcaacccaaggctgataagaaggaatacgacgagcatgatttggctaaccttcagaagaagaaggacgaggaaaaggctctcaaggagcttaaagccaaggctcaacagaaggggtcatttggaggctccgggctcaagaaaagtgggaagaaatgagggattcaaacctcaatgcgaacctctaaattatcgtactatgagtgctaatgctcttttcatgtctttgggtagatttgattgctctactatgtgctctgctaaacagtttgactgttcccatgcttttcccgtaagattatgttgaagatcggtcgttatgtattattgtgtaccaatctctactatgtccgtgattggattgcttggaaatgactagacctactttattcaatcttctttttccatctggtgttgtggtgtatgctgaattgctgatcaggcaaatttgtcatttggggcaaggcctgatcgtaattggcttgatcagtgagatggactctgattattacaatagatgcccgaagtggttcacttgctcgtttgtgatgaaatatttgatgttaatagt

SEQ ID NO: 1589 - DNA, 563 bp, Vaccinium corymbosum
caagtaggtaatacaaacgacaagaagtaggacctaattaacggaccgggggaaggaccaatcacaattagctgtcgggttagggctgtctacgtttctggttcttttcgtccaaattcgaaccctaaccctagaacaccaacgatgtcgtccaagcaaggtggaaaagcaaagcctttgaagcaacccaaggctgataagaaggaatacgacgagcatgatttggctaaccttcagaagaagaaggacgaggaaaaggctctcaaggagcttaaagccaaggctcaacagaaggggtcatttggaggctccgggctcaagaaaagtgggaagaaatgagggattcaaaccccaatgcgaacctctaaattatcgtactatgagtgctaatgctcttttcatgtctttgggtagatttgattgctctactatgtgctctgctaaacagtttgactgttcccatgcttttcccgtaagattatgttgaagatcggtcgttatgtattattgtgtaccaatctatactatgtccgtgattggattgcttggaaatgactagacct

SEQ ID NO: 1590 - DNA, 506 bp, Vaccinium corymbosum
aggccatcacaattagctgtcgggttagggctgtctgcgtttctggttcttttcgtccaaattcgaaccctaaccctagaaaagcaaagatgtcgtccaagcaaggtggaaaagcaaagcctttgaagcaacccaaggctgataagaaggaatacgacgagcatgatttggctaaccttcagaagaagaaggacgaggaaaaggctctcaaggagcttaaagccaaggctcaacagaaggggtcatttggaggctccgggctcaagaaaagtgggaagaaatgagggattcaaacctcaatgcgaacctctaaattatcgtactatgagtgctaatgctcttttcatgtctttgggtagatttgattgctctactatgtgctctgctaaacagtttgactgttcccatgcttttcccgtaagattatgttgaagatcggtcgttatgtattattgtgtaccaatctctactatgtccgtgattggattgcttggaaatgactagac

SEQ ID NO: 1591 - DNA, 594 bp, Cucumis sativus
gagaagccgtcaattgtcgcgaatcgagtaatccctctttgtgttcttcttcgactcgggccaaaccctagcgatatctcagccatgtcgtccaagcaaggagggaaggcaaagcctctgaagcaacccaaggttgataagaaagactacgacgaggttgatatggccaatatgcaaaagaagaaggatgaggaaaaggcgctcaaggagcttagagcaaaggctcaacagaaggggacctttggaggtgctgggctcaagaagagtgggaagaaatgaggggttcccacttcccacacaaattcatggaggtagatttacttcacgacctgaaattgcagacatttaatggcttttgaatcagttgattgtccttgtgtgttttatgtaaaaccctgaaaagaagatgatatgctgttgaatgattatatagaagttgaatgcttctcaatatcctaaactttctttagctaaatattcttaactttcctctcgtcttttgttctttttttattttaataaatataattagcaaaaacatattctaaattatctctagacttgaaactaaacgaggttaagaatttagtattg

SEQ ID NO: 1592 - DNA, 518 bp, Carica papaya
aataaacgataggttattgtgttttggtcagggttccttcttcctcgtcttcccaatcagtctcccccgagtttcagaccaaaccctaaccctagaattcggccatgtcgtctaagcaaggagggaaaataaagcctctgaagcaaccaaaatctgacaagaaggactacgatgagcatgacttggccaacctgcagaaaaagaaggaggaggagaaggcactcaaagagcttaaggccaaggcacaacagaaggggtcatttggaggtactgggatgaagaagagtgggaagaaatgagggtttttagacccaaattgaattatagaatttcaagttgtacttgttgcaatatggtaatcggtttcaatttgcattaacgataaagatctttatgatatcttttggtctatgtgatgatctagtttcttgctaaaagtgttacctaaactttgagtttttatctcatcatgttgaattgaataacattagttccatgtttgtgtttatggtgtgcta

SEQ ID NO: 1593 - DNA, 482 bp, Arachis hypogaea
accctaatcccccttttgcatctcaaccatgtcgaccaagcaaggtggaaaggctaagcctttgaagaaacctaagtctgacaagaaagactacgatgaggttgacatggccaacatccaaaagaaaaaagaagaggagaaggcgctaaaggaattgaaagccaaggcgaggttctgggctcaagaagagtggaaagaaatgagggctctcagccatgatacttaacattagtatacttccatcattaagctctgtaattacaattatcatgagcacatctcttattgtgacctacttttgttgttagtgttggtaatgaacctaggcatgtcatgatgtgtactcccaataagttactgatttgtatttctactgtgtgcccttcttgggtcctgactgctgataattccatcttttccttttcttggatttcgtacaaaaaaaagaaaaaaacaaaagtactctgcgttgataccactgc

SEQ ID NO: 1594 - DNA, 437 bp, Triphysaria pusilla
ccatctaaagttccgtgattggggtctgggcatcgtcttttcatccttgaaactcagttttccgatcacagcgaacctaagtacctaaccctagaaactaaccatgtcttccaagcaaggaggaaaagcgaagcctttgaagcagcccaaggctgaaaagaaagaatacgacgagattgacaaggctaatattcaaaagaaaaaggatgaagaaaaggctcttaaggagctcaaggcgaaggctcaacagaagggatcgtttggaggctctggtttgaagaagagtggcaaaaaatgatcctctgctgagattcgttcttgggttattatgttatagtgttgtttgtgtacaacatgaacaatgttatgctttcgttattgatggtttgtaatttactgtatgttttctcatatggtatacaaatgacattttagta

SEQ ID NO: 1595 - DNA, 501 bp, Triphysaria pusilla
ctttattccgatatataaaaatcaaaaagattctgaaaatcatttttattaaagcagcaagcatccatctaaagttccgtgattggggtctgggcatcgtctttttatccttcaaactcagttttccgatcacagcgaacctaagtacctaaccctagaaactaaccatgtcttccaagcaaggaggaaaagcgaagcccttgaagcaacccaagaccgaaaagaaagaatacgacgagattgacaaggctaatattcaaaagaaaaaggatgaagaaaaggctcttaaggagctcaaggcgaaggctcaacagaagggatcgtttggaggctctggtctgaagaagagtggcaaaaaatgatcctctgctgagattcgttcttgggttattatgttattgtgttgtttgtgtacaacataaacaatgttatgcttttgttattgatggtttgtaatttactgtatgctttctcatatggtatacaactgacattttagta

SEQ ID NO: 1596 - DNA, 558 bp, Bruguiera gymnorhiza
gaaaatcaaggagcagcctccaataaactgcgtaaaattagggttaggcttttctccacccaaaccctcccaatttcctcttctccttttctttttccctttccctttctcgcttataataatcacaactcctaaccctaaatctgcattttcagccatgtcttccaagcaaggtggaaaggccaagcctttgaagcagcccaaggccgacaagaaagagttagatgaggtagataaggctaaccttcagaaaaagaaggaagaggaaaaggcgcttaaggagctcaaggccaaggcacaacaaaagggggcttttggaggatctggtcttaagaaaagtggaaagaaatgaggatttccaaggcaaatcaacgcagaatgcacgaatcctagcaatatgattacaaattttaccattgatgcttttatgccactttctgtgtaatgcaacagttctttgtgctaaatgctactaaaccttgagtcaacgtgattgtattgataaatattgcatgttttgttgcttaacattgatgatcgaataatttggtccctgca

SEQ ID NO: 1597 - DNA, 473 bp, Ocimum basilicum
cgattcccatctcgcgttccgtatcaattttctgtgttctgattgcaccgaataccaaccctagaattcagccatgtctagcaagcaaggaggaaaggcaaagccgctgaagcaacctaaggcggagaagaaggaatacgacgagatggacaaggctaacattcaaaagaagaaggaagaagaaaaggccctgaaggagctgaaagcaaaggctcagcagaagggagcgtttggaggttctggattgaagaaaagtgggaagaaatgagaccaccaattgatgtgtgcttgatttttagtttgtgatttggacatgttagcttgcgcttattgatgtttggaaacatttgaacttcccgaggagactttctatgcataattgcgtgcataattgtcatcttacatttcacttccttgttttctaacactgaatgatcatgtcatatatgaacaccctatgcctcgactttgct

SEQ ID NO: 1598 - DNA, 296 bp, Allium cepa
cctcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaatatgatggcatgttcagtaaaacaatttattttcacgtttatctaatccacatgttgtttatgtg

SEQ ID NO: 1599 - DNA, 1465 bp, Brassica juncea
cgacgtgaaacatgttggaaacactatatttaacccaaaaaagatgaaatgcaaaaattaagaattcccaaaaggagtttcgtaatctgacaaatcatgccgacctctcgaccgagttaacgacgtgcttgtaggatcctttataatattcttcactcatcacacggaccaaactcgccacgtcaacacacaccctactccaaaaagcagacgataactaccatttttcttgaaatcccaagtcaaatctattaatagtcggacagatcagatctctctctagttccatacatttaatatctccaacgatggctcgccgtgacgttctttttctctccgtcctcctcatcctcgccaccgtcttctccatctcatcagccgacgatgaacctgattgtgtctacacattctacctccgaaccggttccatttggaaagccggcactgagtcgatcataagcgctaggatctacgacaagtacggagactacatagggatccgaaacctagaggcatggggtgggttaatgggaccaggttacaaatactacgagaggggtaatctcgacattttcagtgggagagcaccgtgtcttccgagcccagtctgttcgttgaatctgacctcagacggctccggcgaccaccacggttggtatgttaactacgtggaggtcacgacggctggagttcacgctacgtgctctcagcaaagcttcgaagttgagcaatggcttgcgactgatacgtcgccttatgagctcactgctgtaaggaataactgcccggtgtcgcttagggagagtgtcggtcgggtcgggtctgagatccggaagactctctcttggatcgtatgaaagcaatgaatgaataaatgttgtgtgtcttggcgacgtgttctatgtcgtcttgtgaacgtgtgatgctaataaagaaaagcgattgatcgaataaaaattcattttttcggttctatgatttaatcaattgatgacaatctaaactgaatccagagtgacatcatttgattttaggatagaaaccatttttcttttatgatgaaaaagtggcgaaagcaaaacatatgcaagggagaagtaaagtcactctcctacggacatgatacacacgataatcttgtttttaagttgataaatttgcactgtcaaagacaggctacatggataagaacggaatcatttcttgccgctcttcttaagtccagagcctccaaaggatcccttctgcgatgccttggctcttagttctttaagtgccttttcctcgtctttcttcttctgaaggttggccatatcgtgctcgtcgtattccttcttatcagcttttggctgcttcaaaggtttcgcctttcctccttgcttggacgacatgactagtttctggagctagggtttgatgctgcttgtctgagaatttgcggaagaaagtaaagtttcagacgacg

SEQ ID NO: 1600 - DNA, 389 bp, Brassica oleracea
gttgctttttccccaattctcagatcagcatctagccctagctcgacaaatccgtcatgtcgtccaagcaaggaggaaaggcgaaacctttgaagcagccaaaagctgataagaaggaatacgatgagcacgatatggccaaccttcagaagaagaaagacgaggaaaaggcacttaaagaattaagagccaaggcatcgcagaagggatcttttggaggctccggtcttaagaagagtggcaagaaatgatcccttattatccatgaagcctgtttttgacagtgcttatttatcaagttataacagatactcgtgtgttgtgtaacttgtctgtaggagagtgactttgcgtctctcccataacatatgtttgctttcgacactatt

SEQ ID NO: 1601 - DNA, 794 bp, Brassica oleracea
ttcgcatcaagccctagctcaacagactagtcatgtcgtccaagcaaggaggaaaggcgaaacctttgaagcagccaaaggctgataagaaggagtacgatgagcatgacatggccaacctgcagaagaagaaagacgaggaaaaggcacttaaggaactaagagccaaggcgtcgcagaagggatcctttggaggctctggacttaagaagagcggcaagaaatgatccgttttaatcatgtatttgacaagtgcaaatttatcaacttaataacagataatcgtgtgtttgtgtaacttgtatcatgtttctaggagagtgactttgcgtcttcgctttcgccactttttcataatattgataaatggtttctatcctgatgttgtcgtagttctcctgattcaggattctgtctaagactatcatgtttctgcatctcagggtccagttttaaacatatgttgctgttaggtaactgagagggacatgtgtgttttaccaaagatgaatgtgaaatatatgtgagaagggcaacagctatttatgtacacatacctactctaaacgaaatagcttccccctgcctctcaaagcgtcgctgaccgagagggtcttagagactgaaagagcctgcttttcttcttgaaccgttgacactggaagaagtgcgcagatcagagaactcatagtacatgtcagtgaagaaattgtcaacaatgtcaaggtacacagggcttcttatgcttgaatagcatcggagcgcttcatgtacatctgatgcatgctccacgt

SEQ ID NO: 1602 - DNA, 514 bp, Allium cepa
tgcgcgccgaagcagtataaccttccctggttgcatacttcccaagctaatatattgagacagcccaccacgcttttcctttgattctttctctaaatttgtttcttcatttttcacctttcccaaatcaatcatgtcttcaaagcaaggtggaaaggcgaagcctttgaagcagcccaagtctgacaagaaggaatacgatgagactgatctagcaaaccttcaaaagaagaaagacgaagaaaaggctctgaaggaattaaaggcgaaagcgtcgcagaagggatcgtttggcggtgcaggcctgaagaagagtggcaaaaaataattacggcatgtttagtataaatatttgtatccacgtttctgtaatccacatgttgattatgtggttaaaccttgctttgtgatttgactctattttgctacatctgatacagatgctgctgcctttaagataattgttcctcgtgaaatttggtagctgtttactgttgcgcttccctgctcttcc

SEQ ID NO: 1603 - DNA, 482 bp, Allium cepa
tttctctctattttttcctcgagggttttcactttctcctttcccaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagcaaaacaatttattttcacgtttatctaatccacatgttgtttatgtggctaaacctctctttgtgatttcaacgttattttgctacatctgatagccttgttgctaccattaagatacatatgcatcttgaaatcaatggtattatcagtatgaacttaacagtagtttgctgcggtgattcccaaaaacacacacaaaggccgcctccggcccac

SEQ ID NO: 1604 - DNA, 549 bp, Allium cepa
taacctttcccagttggatacgtcctcaaccaatatagcgacaaactgtcacacgttcccttaattttctctctattttttcctcgagggttttcactttctcctttcccaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagtaaaacaatttattttcacgtatatctaatccacatgttgtttatgtggctaaacctctctttgtgatttcaacgttattttgctacatctgatagccttgttgctaccattaagatacataagcatcttgaaatcaatggtaatatcaatttgaactcaacggttgtatgctgcggtgattccctgctattgtttcttttcaattggtattctttttt

SEQ ID NO: 1605 - DNA, 558 bp, Allium cepa
taacctttcccagttggatacgtcctcaaccaatatagcgacaaactgtcacacgttcccttaattttctctctattttttcctcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagtaaaacaatttattttcacgtttatctaatccacatgttgtttatgtggctaaacctctctttgtgatttcaacgttattttgctacatctgatagccttgttgctaccattaagatacataagcatcttgaaatcaatggtaatatcaatttgaactcaacggttgtatgctgcggtgattccctgctattgtttcttttcaattggtattcttttttgtttggtcg

SEQ ID NO: 1606 - DNA, 297 bp, Allium cepa
tcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagtaaaacaatttattttcacgtttatctaatccacatgttgtttatgtggctaaacctctctttgtgatttcaacgttattt

SEQ ID NO: 1607 - DNA, 803 bp, Petroselinum crispum
caggggaccataatagaccctggaggctggcctcatttctaagctattactccaccttattgttcttcccaagattctccaagaaaaccccaaaaagcaaccatgtcatccaagcaaggtggaaaagctaagcctttgaaggctcccaaggttgacaaaaaggaatatgatgaggatgatttggctaagctccagaagaagaaggaagaggaaaaggcactcaaggagctcaaagccaaggctcaacagaaaggcgcttttggaggttctgggctaaagaaaagtgggaagaaatgaggccctgaagcctttgtgacctgatcaagtgtttctattctataactatgttttggttgcaaaaccttaatttgtaatttgtgctaaactcgagcagtaccagtaataagattgtaagcttattgttcgcccaaagaatgtgtgtttttgtagttctgacttctgacttctgagtatgatttatgtgtttgtcagcttatctctatctagtctttgactattcaacagtaatacaaatggaaattgtgtggtttaatttcataaagatgcactgtaagcatgtctaaagggtcttgaccgtatatactccttgtgatattttaaccatataagaagtttatcttcttcgagctacgataggaagacacacatactggtcttacagcccccaatcttgacaaggtgtctggtctctcgccatattttcgagggttaggcttgagcaaaacaatcacagaaccatgtacagcgaatgaacacattccccaacttggaacatctagatt

SEQ ID NO: 1608 - DNA, 353 bp, Arabidopsis thaliana
ctctcagctactttttccccaattttgagctcaacatcgaaccctagctcaacgaaccaatcatgtcttccaagcaaggaggaaaggcgaaacctttgaagcagcctaaagctgataagaaggaatacgacgagactgacttagctaacattcagaagaagaaagatgaggaaaaggcccttaaagagcttagagccaaggcatcgcagaagggatcctttggaggttctggacttaagaagagtggcaagaaatgatccgttttatccatgaagtgtgttttaaaatgcaaatttatcaagtgaaaaaaacagataatcctgtgttgatgtaactttttatcataattcgag

SEQ ID NO: 1609 - DNA, 463 bp, Brassica juncea
tcgtgactacgaagtcaatatatataattttatcgaacacaaagagatccgtcatctgaaactcaagagttgctttttccccaattctcagatcagcatctagccctagctcgacaaatccgtcatgtcgtccaagcaaggaggaaaggcgaaacctttgaagcagccaaaagctgataagaaggaatacgatgagcacgatatggccaaccttcagaagaagaaagatgaggaaaaggcacttaaagagttaagagccaaggcatcgcagaagggatcttttggaggctctggtcttaagaagagtggcaagaaatgatcccttataatccatgaagcctgtttttgacagtgcttatttatcaagttataacagatacttgtgtaacttgtctgtaagagagttactttgcgtctctcccataacatatgtttgcgttcgacactatttcattttataaag

SEQ ID NO: 1610 - DNA, 391 bp, Cucurbita pepo
gccatgtcgtccaaacaaggagggaaagcaaagcctctgaagcaacccaagatcgagaagaaagattacgatgaggttgatatggcaaatattcaaaagaagaaggacgaggaaaaggcgctcagagagcttagagcaaaggcccaacagaagggagcgtttggaggagctgggctgaagaagagcgggaagaaatgagcgctcccacgcaatgcatgtacgtacacattacttcacgacctgaaattgcaaacatctaatggcttctgtttaatcaattgagtctctttctgttctgtgtaaaagcctgggaagaagatgatcaatgctcttctcctgctttctttatttctggaatggaatggataaacttctcatagtttaatttaat

SEQ ID NO: 1611 - DNA, 460 bp, Cucurbita pepo
tcggccgatccctgacggtatctcagccatgtcgtccaaacaaggagggaaagcaaagcctctgaagcaacccaagatcgagaagaaagattacgacgaggttgatatggcaaatattcaaaagaagaaggacgaggaaaaggcgctcagagagcttagagcaaaggcccaacagaagggagcgtttggaggagctgggctgaagaagagcgggaagaaatgagggctcccacgcaatgcatgtaaacatctaatggctgctgtttaatcaattgattgtctttctgttctgtgtaaagcctgggaagaagatgatcaatgctcttctcctggtttctttatttctggaatggaatggataaaattctcatagtttaattaattaattttgcaattatcaacgttaaatttttgggttgtgtgggtttgtttattcttaatttgtttttaataaagtatg

SEQ ID NO: 1612 - DNA, 359 bp, Cucurbita pepo
tctcagccatgtcgtccaaacaaggagggaaagcaaagcctctgaagcaacccaagatcgagaagaaagattacgatgaggttgatatggcaaatattcaaaagaagaaggacgaggaaaaggcgctcagagagcttagagcaaaggcccaacagaagggagcgtttggaggagctgggctgaagaagagcgggaagaaatgagcgctcccacgcaatgcatgtacgtacacattacttcacgacctgaaattgcaaacatctaatggcttctgtttaatcaattgagtctctttctgttctgtgtaaaagcctgggaagagatgatcaatgctcttctccggctttctttatttctgg

SEQ ID NO: 1613 - DNA, 519 bp, Gossypium raimondii
gctcaataattgtgtttttagggttagggctctttattttctctgttcatcagtttctttttatctcttcgaattttcattacagaccctgatcctaaactctcaatcatgtcttccaagcaaggtggcaaagcaaagcctttgaagcaacccaaatctgagaagaaagaatacgacgagcatgatttggctaacattcagaaaaagaaagaagaagagaaggcccttagagagctgagagcaaaggcatcacaaaagggatcatttggtggttctggtcttaagaagagtggcaagaaatgaggttcttaaaaacctgagctaaaccgaacttattgagtcatgtcttgggattaaaacatctattatgctgatgtctcttgtttcaattgtgatagttgggatgatttgatgctctagtttcattctgagtttgctataaaaaacatttgtgtgtaatttcgtgacgtataacttaataaattcaagttctacgtttgtgttttttgtctatacatt

SEQ ID NO: 1614 - DNA, 459 bp, Momordica charantia
cgatccctctttgttctattcgactcgggccaaaccctagcaagatctcagccatgtcgtccaagcaaggagggaaagcaaagcctctgaagcaacccaaggttgataagaaggagtacgacgaggttgacatggccaacattcaaaagaagaaggatgaggaaaaggctctcagggagctaagagctaaggcccaacagaaggggacctttggaggtgctgggctcaagaagagtgggaagaaatgagggttcccacacaacatatgtagattacttgagctgaaattgcagacatctgatgtcgttttaatcaaatgattgtgtgacatgttatcctctgcatgaaccgaataaaaacgcttttctactctctcgttatgttctgtgtaaaaacctagaagaatatttgtgatggaaatatgtgatgatccttgtttctggaatgatatcatagaag

SEQ ID NO: 1615 - DNA, 568 bp, Allium cepa
aaacggtataacctttcccagttggatacgtcctcaaccaatatagcgacaaactgtcacacgttcccttaattttctctctattttttcctcgagggttttcactttctcctttcccaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagcaaaacaatttattttcacgtttatctaatccacatgttgtttatgtggctaaacctctctttgtgatttcaacgttattttgctacatctgatagccttgttgctaccattaagatacatatgcatcttgaaatcaatggtattatcagtatgaacttaacagtagtttgctgcggtgattccccgctattgtttctttcaattggtatttttatgtttggtcgtgctt

SEQ ID NO: 1616 - DNA, 586 bp, Allium cepa
cccgtaagagtacgggggaccggaaaaccggttactaaacctttacccagttggatacgtcctcaaccaatatagcgacaaactgtcacacgttcccttaattttctctctattttttcctcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagtaaaacaatttattttcacgtttatctaatccacatgttgtttatgtggctaaacctctctttgtgatttcaacgttattttgctacatctgatagccttgttgctaccattaagatacataagcatcttgaaatcaatggtaatatcaatttgaactcaacggttgtatgctgcggtgattccctgctattgtttcttttcaattggtattctttttt

SEQ ID NO: 1617 - DNA, 531 bp, Allium cepa
gaagcatggtagtcaacgcagatacggggggaaccgaatataagcgacaaactgtcacacgttcccttaattttctctctatttttccttcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagtaaaacaatttattttcacgtttatctaatccacatgttgtttatgtggctaaacctctctttgtgatttcaacgttattttgctacatctgatagccttgttgctaccattaagatacataagcatcttgaaatcaatggtaatatcaatttgaactcaacggttgtatgctgcggtgattccctgctattgtt

SEQ ID NO: 1618 - DNA, 523 bp, Allium cepa
ttcccagttggatacgtcctcaaccaatatagcgacaaactgtcacacgttcccttaatttctctctattttttcctcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagtaaaacaatttattttcacgtttatctaatccacatgttgtttatgtggctaaacctctctttgtgatttcaacgttattttgctacatctgatagccttgttgctaccattaagatacataagcatcttgaaatcaatggtaatatcaatttgaactcaacggttgtatgctgcggtgattccctgctattgtttcttt

SEQ ID NO: 1619 - DNA, 522 bp, Allium cepa
ttcccagttggatacgtcctcaaccaatatagcgacaaactgtcacacgttcccttaattttctctctatttttcctcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaaagcatctcagaagggatcattcggtggtgcaggcctgaagaagagtggcaaaaaataatgatggcatgttcagtaaaacatttattttcacgtttatctaatccacatgttgtttatgtggctaaacctctctttgtgatttcaacgttattttgctacatctgatagccttgttgctaccattaagatacataagcatcttgaaatcaatggtaatatcaatttgaactcaacggttgtatgctgcggtgattccctgctattgtttcttt

SEQ ID NO: 1620 - DNA, 507 bp, Platanus occidentalis
ctctctgcaactctttcttcccgtcacgaccgaaccaatctaaccatgtcgtccaagcaaggtggaaaggcgaagcctttgaagcaaccgaaatcagaaaagaaggattacgacgaggttgatatgatgaatatccagaagaagaaagatgaggaaaaggcactcaaggagctgagggccaaagcaacacaaaaggggacgtttggaggtacaggtctgaagaaaagtgggaagaaatgagtgtttctgtggacatgttctcgctactgtgttttagtgtgatcccttgttcatttctgataacaatcgtcctttgaagcatgtgacgactctaaatctctgataaatcgactactaaaggtcctttaccttcctatgcagacaaaaaacctatttgagttatttgcatatatagaactttgagctgggacaagcttttttttatgaaatacgttggtttgttgtgttatattatggaactaatctctccatcaatctatgcatctc

SEQ ID NO: 1621 - DNA, 663 bp, Prunus mume
tataaagagatgatttgtaaaccggtcatggcaaggctgtgcgtattattgcagtagggttgtcctgggaatttctccttcctctcagattcgacccaagcctgccctagatcgcagccatgtcttccaagcaaggtggaaaggcaaagcctttgaagcaacccaagtccgagaagaaagactacgatgagtctgatttggctaaccttcagaagaaaaaggatgaggaaaaggcactgaaggaacttagagccaaggcacaacagaagggatcctttggaggtgctgggctcaagaaaagtgggaagaaatgagagggttattagaaccctctagttggggtgcaatatatctttcttgggctgtaattataaacactattatgttgaagtctttcaatttatgtggtggtctagtttctaatgtgctgctagacgcatgagcgactttcagtgtgtaacagtatgactatgtctaaataagttagttggagtttgcctatcttgagccttcctgcgttttctttcttaagctttctttgcagcattatctttgtttgctctgaatttgttgtctcatgtgtcaggcgagggaggttggtttttatattttataaataaataaaaattattgcagtcctctcgctccaaattttagagtggt

SEQ ID NO: 1622 - DNA, 539 bp, Eutrema parvulum
tcgtctgaaacttttacttcatttatccccaattctcagatcagcatcaaaccctagctcctcgaaccagtcatgtcgtctaagcaaggaggaaaggcgaaacctttgaagcagccaaaggctgacaagaaggaatacgacgagcacgatatggctaaccttcagaagaagaaagacgaggaaaaggcacttaaagaactaagagccaaggcatcgcagaaggggtcctttggaggctctggacttaagaagagcggcaagaaatgatccattttatccatgaagcctgtgtttgacagtgcaaatttatcaacttaaaacagataatcatgtgttgtgtaacttctatcttgttttctaggagagtgactttgtgtctcccatacatatgtttgctttctccactttttcatgaaaaagaaaaaatggttactatcataaaatcaaatactgtcattctccttctctccgggttcaggattcaatagtagactgccatatttctctatctcaggatccactactagaagctgttattt

SEQ ID NO: 1623 - DNA, 515 bp, Citrullus lanatus
aatagtagccggttgtgttactttgggagccgtcaattgccgcccgcgggcgatccctctttgtgctcttcgacttaggccaaaccctcttgatatctagccatgtcgtccaagcaaggagggaaagcaaagcctctgaagcaacccaaggttgacaagaaagattatgacgaggttgatctcgccaatattcaaaagaagaaggaagaggaaaaggctctcagagatcttagagcaaaggctcaacagaaggggacctttggaggtgctgggctaaaaaagagtgggaaaaaatgagttcccacgcaatatatatagagattacttgagctgaaattgcatacatctgatgtgtttctagtcagttgattgtatgacatgttatcctctgcataaaattgaataacgtgacgcagtatgctttcagactttcttgtttggttgtgtgtaaaagcgtggaagataatgttatgtggcccttgtttctggaatggatattgaatgattatagaagt

SEQ ID NO: 1624 - DNA, 455 bp, Arabidopsis lyrata
attcgatgccgtctgcaactctcagctactttttccccaaattctgagctcaacatcgaaccctagctcaacgaaccaatcaatcatgtcttccaagcaaggaggaaaggcgaaacctttgaagcagccaaaagctgataagaaggaatacgacgagaccgacttagctaacattcagaaaaagaaagatgaggaaaaggctcttaaagagcttagagccaaggcatcgcagaagggatcctttggaggttctggacttaagaagagtggcaagaaatgatccgttttatccatgaagggtgttaaaatgcaaatttatcaagttaaaaaacagataatcgtgtgatgatgtaactttttatcataattcgagagaagagtaacttcgcttctccttacagataatcgtgttgcttctctatttttcatgaaaaggaaaaatggtatctacctta

SEQ ID NO: 1625 - DNA, 463 bp, Raphanus sativus
gatcgaatacacaaagtccgtcgtctgaaagtctacttttccgcaaattctcagacaagcagcatcaaaccctagctccagaaaccggtcatgtcgtccaagcaaggaggaaaggcgaaacctttgaagcagccgaaagctgataagaaggaatacgacgagcacgatatggctaaccttcagaagaagaaagacgaggaaaaggcacttaaagaactgagagccaaggcatcacagaagggatcttttggaggctctggacttaagaagagcggcaagaaatgatttccgttcttatccatgtagcctgtctttgacagtgcatatttatcaacaacttggaaaacaaaataaatcgtttgttgtgtaacttctatcatgttcctaggagagtaactttgcgtctcccccatacatatgtttgcttcttatattatgataaaagaaaaatggtttttatcca

SEQ ID NO: 1626 - DNA, 449 bp, Raphanus sativus
acacactgcaagtccatcgtctgaaacttaaattttccccaattctcagatcagcatcaaaccctagagctcgaggaaccagccatgtcgtccaagcaaggagggaaggcgaaacctttgaagcagccaaaagctgataagaaggaatacgatgagcacgatatggccaaccttcagaagaagaaagacgaggaaaaggcacttaaagaactaagagccaaggcatcgcagaagggatcttttggaggctctggtcttaagaagagtggcaagaaataatcccgctttgtatccatgaagcgtgtctttgacagagtgcttatttatcaacttataatgtttgtgtaacttcctatcatgtctgtaggggagtgactcttcctatcccataacatatgtttgctttcgccacaatttcatttcaaaagaaaagaaagatggtttctatc

SEQ ID NO: 1627 - DNA, 700 bp, Sesamum indicum
atatgaatcaatatccagagctatcatacgcgcatctatcaaagacatattccgctattgggttagggctctctcctttttccatcgttcgaagcctctctttgcgatcaccgcgaaaccctaaccctagaattcgacaatgtctagcaagcaaggagggaaagcgaagcctttgaagcaacctaaggccgaaaagaaagagtacgacgagattgacaaggctaatattcaaaagaaaaaggatgaagaaaaggctctgaaggagctcaaggcaaaggctcagcagaagggagcatttggtggttctggtctgaagaaaagcggcaaaaaatgagactttctgaaaagcaaatggtctcgattgctccattcttgtcattgtggtgttgtgttattgtgtcctcgagttcctagcatacaacttaaatgtgttagcttgttattgtctggttatcaagcttccaaaagcttttcgataaaagattttcagctttttctaatagatgcatgatgcctttattctgcctgtaatttacaatatgtacccctttctgaaacgtcaatgggtggtttccatgtgttcctggtagtgaattatcttcaaaagttgatcttttatgaaaagatgatcttgtcaatgtgaatccaattactaccaaacagatttctggtcgatatcagaattgaactttgaagcgcg

SEQ ID NO: 1628 - DNA, 588 bp, Raphanus sativus
gttaaactagatattttaattgggccaaaatatctttgagcacattcatgggttgcgttgttactacgaactcaatataataaatgagcagctaagctagagattcattcgcaaacacacagcaggtccatcgtctgaaacttaaattttccccaattctcagatcagcatcaaaccctagagctcgaggaaccagccatgtcgtccaagcaaggaggaaaggcgaaacctttgaagcagccaaaaactgataagaaggaatacgatgagcacgatatggccaaccttcagaagaagaaagacgaggaaaaggcacttaaagaactaagagccaaggcatcgcagaagggatcttttggaggctctggtcttaagaagagtggcaagaaataatcccgctttgtatccatgaagcgtgtctttgacagtgcttatttatcaacttaaaatgttgtgtaacttcctatcatgtctgtaggggagtgactcttatcccataacatatgtttgctttcgccactttttcatttcaaaagaaaagaaagatggtttctatcttaaagccaagtcctgccatagttctccatc

SEQ ID NO: 1629 - DNA, 768 bp, Populus trichocarpa
gcacgtcagacctttcagtccacatgtatatatagggctccaacccactaagcagccccatataattgctttgaattagggttaggtttctcccagtttcgttcctccttcgaatcgtagaaaatcaaaccctaacccaaagcttcaatcatgtcttccaagctaggtggaaaagctaagcctttgaaggcaccaaagtctgagaagaaggaatacgacgagactgatttggccaacattcaaaagaaaaaggatgaagaaaaggcacttaaggagctcagagccaaggcacagcagaaagggagctttggaggttctgggctgaagaaaagtgggaagaaatgaagatttcaaacccagatagacatggtttcctttagtgtattctgaactatattatgatgatatctcgtgtttagtgtgatggtcgctgatgtcctatgcttgatgtgttggtcttcatcttgagccagaattacgtaaaactttataaattgtgtgcatctgtcctctatccatgtgccaacaatgtatttgctggcattgttggaaactttgttcgatgtaactcgttcgcaatttgttgattgcgcttagtaataatggtatcctgggtaattgatttcctaaggatgtttttcccttttaaattgcattaatgtgaaaattgccctcgctgaggatgatggaaaagattgggataaattgtgttattagcacaaaaagcaaaataaatggtgaagtaacacaagatgtgaaataggatgt

SEQ ID NO: 1630 - DNA, 610 bp, Castanea mollissima
ggggggtctccgttgttactttctttttcaggtttgggaattccagtttgaaccctaaccctagatcgcagccagccatgtcgtccaagcaaggtggaaaagcaaagcctttgaagcaacccaaggctgagaagaaagactacgacgaggttgacatggccaatattcaaaagaagaaggaagaggaaaaggcactcaaggagcttagggcaaaggcacagaaaggtcccattggtggtgctgggctgaagaaaagtgggaagaaatgaggggttttatgccccaataggactgtgtgtacaagcattattatgatgattgcctttgattaaagtgattatctagcttcttgctaagtgtgtactaaactttgggagtcatctatgtaagactaaatcttcaatttgcatgttagtgatattttcttgttcctaaaatgaccccattgcattatgtgaggggatggttatgattctgatgcttagcttctgctactgctttttaatggtaaaatttgttgaggggctagtggttgattgtactatgatttgtattttgtccaataaataacttcgctactaatgatgaataagtgcagcccaaagctttt

SEQ ID NO: 1631 - DNA, 547 bp, Daucus carota
tctctctcggaccagagaaaccctaaccctagaaaaatcaagccatgtcgtccaagcaaggtggaaaagcaaagcctttgaaagcacccaaggccgaaaagaaagaatacgatgaggatgatttggctaaactccaaaagaagaaagaagaggaaaaggcacttaaggagctcaaagctaaagctcaacagaaaggtgcatttggaggttctggtctgaagaaaagtgggaaaaaatgaaagcttcaagatcaatgaaattgaagctcttaaacttatctaaagttctcctgctatatactatgattcaggaaaaaattggtctttgtgctttgtactatgttcatgctgaaccttcactacattatcctatatagtgtaataagattgaatgtttgatgttttctgagaaaacttgtgttctcacatattatcctctagttatgtgagtacgatttgtacacccaccttaattacagaggattggttactgccatggtaaaattaagttatgcgtaggtgttttatgcatttgtcatgagtccaag

SEQ ID NO: 1632 - DNA, 422 bp, Daucus carota
ttcttacactgtcagcttattgttctttttcaagaaatcccaaccctagaaatcagcaaccatgtcatccaagcaaggtggaaaagcaaagcctttgaaagcacccaaggccgaaaagaaagaatacgatgaggatgatttggctaaactccaaaagaagaaagaagaggaaaaggcacttaaggagctcaaagctaaagctcaacagaaaggtgcatttggaggttctggtctgaagaaaagcgggaaaaaatgaagcttcaagatcaatgatattgaggctcttaaacttatctaaagttctcctgctatatactatgattcagggaaaaattggtctgtgtgctttgtactatgttcgtgttgaacctttatttacattaatctatatattataataagattgaatgcttgatgttttc

SEQ ID NO: 1633 - DNA, 531 bp, Daucus carota
atttccatttcacgcatccccaccctatttccccctttctctctcggaccagagaaaccctaatcctagaaaaatcaagccatgtcgtccaagcaaggggggaaagcaaagcctttgaaagcacccaaggccgaaaagaaagaatacgatgaggatgatttggctaaactccaaaagaagaaagaagaggaaaaggcactcaaggagctcaaagctaaagctcaacagaaaggtgcatttggaggttctggtctgaagaaaagcgggaaaaaatgaagcttcaagatcaatgaaattgaagctcttaaacttatctaaagttctcctgctatatactatgattcaggataaaattggtctttgtgctttgtactatgttcatgttgaacctttattgcattatcctatatagtataataagattgaatgcttgatgttttcggagaaaacttgtgttctcacattttatgctatagttatgtgagtacgatttgtacacccaccttaattacagaggattggttactgcca

SEQ ID NO: 1634 - DNA, 473 bp, Daucus carota
aagctagattgaggggctgctctcatttcttacactgtcagcttattgttctttttcaagaaatcccaaccctagaaatcagcaaccatgtcatccaagcaaggtggaaaagctaagcctttgaaagcacccaaggctgagaagaaggaatatgatgaggatgatttggctaagctccagaagaagaaggaagaggaaaaggcactgaaggagctcaaagccaaggctcaacagaaaggcgcttttggaggttccgggctaaagaaaagcggaaagaaatgaagcttcattacagctaaagcggacgctctatgtctaagatacatagcgtccctgttatataatatgatgatttggttgaaaaatgatttgaattgtactttgtgctaaactcggtgacctttattaccttaacctatgcagcaccattaataagattgtaagcttcttgtcttcccaaagcatttgttttt

SEQ ID NO: 1635 - DNA, 656 bp, Daucus carota
aagctagattgaaaggctgctctcatttcttacactgtcagcttattgttctttttcaagaaatcccaaccctagaaatcagcaaccatgtcatccaagcaaggtggaaaagctaagcctttgaaagcacccaaggctgagaagaaggaatatgatgaggatgatttggctaagctccagaagaagaaggaagaggaaaaggcactgaaggagctcaaagccaaggctcaacagaaaggcgcttttggaggttccgggctaaagaaaagcggaaagaaatgaagcttcattacagctaaagcggacgctctatgtctaagatacatagcgtccctgttatataatatgatgatttggttgaaaaatgatttgaattgtactttgtgctaaactcggtgacctttattaccttaacctatgtagcactgttaataagattgtaagcttcttgtcttcccaaagcatttgtttttcatgtgttaaacattatcatggcttgagtcatgatctgtgctggctgtctaggttatcaacaaattcatatctactcggcatctaacaataatagtcacaaatgtgtgctttgatttcgtacagttttgccattactcattaggagtcttgaacatgttgcttggtggaaagttaaagagttc

SEQ ID NO: 1636 - DNA, 531 bp, Daucus carota
ctatttccccctttctctctcggaccagagaaaccctaaccctagaaaaatcaagccatgtcgtccaagcaaggggggaaagcaaagcctttgaaagcacccaaggccgaaaagaaagaatacgatgaggatgatttggctaaactccaaaagaagaaagaagaggaaaaggcacttaaggagctcaaagctaaagctcaacagaaaggtgcatttggaggttctggtctgaagaaaagcgggaaaaaatgaagcttcaagatcaatgaaattgaagctcttaaacttatttaaagttctcctgctatatactatgattcaggataaaattggtctttgtgctttgtactatgttcatgttgaacctttattgcattatcctatatagtataataagattgaatgcttgatgttttcggagaaaacttgtgttctcacattttatgctatagttatgtgagtacgatttgtacacccacataaattacagaggaatggttactgtcatggtaaaattaagttatgtgttgg

SEQ ID NO: 1637 - DNA, 465 bp, Daucus carota
cccctttctctctcggaccagagaaaccctaaccctagaaaaatcaagccatgtcgtccaagcaaggtggaaaagcaaagcctttgaaagcacccaaggccgaaaagaaagaatacgatgaggatgatttggctaaactccaaaagaagaaagaagaggaaaaggcacttaaggagctcaaagctaaagctcaacagaaaggtgcatttggaggttctggtctgaagaaaagcgggaaaaaatgaagcttcaagatcaatgaaattgaagctcttaaacttatctaaagttctcctgctatatactatgattcaggataaaattggtctttgtgctttgtactatgttcatgctgaaccttcactacattatcctatatagtgtaataagattgaatgtttgatgttttctgagaaaacttgtgttctcacattttatgctatagttatgtgagtacgatttgta

SEQ ID NO: 1638 - DNA, 560 bp, Daucus carota
aaaacattgtaagctagattgaaaggctgctctcatttcttacactgtcagcttattgttctttttcaagaaatcccaaccctagaaatcagcaaccatgtcatccaagcaaggtggaaaagctaagcctttgaaagcacccaaggctgagaagaaggaatatgatgaggatgatttggctaagctccagaagaagaaggaagaggaaaaggcactgaaggagctcaaagccaaggctcaacagaaaggcgcttttggaggttccgggctaaagaaaagtggaaagaaatgaagcttcaacgcagctgaagcggatggccggacgctctatgaatacatagctgtctctgttatataatacgatgatttggttggaaaaatgattttaattgtactatgtgctaaactcggtgacctttattaccttaacctatgcagcaccattaataagattgtaagcttgttgtcttcccaaagaaattgttttttatgcgataatacgtcatcatggtttgagtagtgattgtgctggctgtctgaattatcagcaattttaatct

SEQ ID NO: 1639 - DNA, 469 bp, Allium cepa
ttcgtttatttctccaccatcattcggttaggttttcgatttcacgttctcccaaatcaattatgtcttccaaacaaggtggaaaggcgaagcccttgaagcagcctaaggctgacaagaaggagtacgatgagatcgatcgagcaaaccttcagaaaaagaaagacgaggaaaaggcattgaaagaattgaaggcaaaagcagctcagaaggggtcttttggcggtgcagggctaaagaagagtggcaaaaaataataaatggcgtgttcttttcaatctattaatatattttctaaaagaaactaaatttagtttaatatatgatgaaaccttgagttgctgatttggatggttatattttctttggggagaaacaatgctgcgacctatttactgaaaaatggtcatcttaattttatgacgctatgcttttctactggttcccttgtgctattttcaaatcagat

SEQ ID NO: 1640 - DNA, 612 bp, Petroselinum crispum
gtctactagtatgtactatgtagtatcgcttccgctttacagtttccagccccttttgttccccattttctgagaaaaccctaaccctagaaaaaaccaatcaagccatgtcgtccaagcaaggtggaaaagctaagcctttgaaagcacccaaggctgagaagaaagaatacgacgaggatgatttggctaaacttcagaagaagaaggaagaggagaaggcactgaaggagctcaaagctaaagctcaacagaaaggtgcatttggagggtctgggctaaagaaaagcgggaaaaagtgaagcttcaagatcattgatactgaagctctgcagcttgtctacaatgtttctattatctcttctatgatttggttggaaaaacgtcggtctgatttgtactgtgtactaaattcatgttgaacttttatcacattatcctatatagtataataagattgtaagttgatgttttctcagtagatatgtcttttacgtcttaatacctcaataatggtcaagaataatttgtacaaccacctgaaatctgaattaccaaaaggttcaaatctggtacagtgggatagttatatctttggtaaaatgtgataaa

SEQ ID NO: 1641 - DNA, 495 bp, Cucurbita pepo
ataaataatagccggttgtgctcttcgactcgggcgatccctcttctttgttctcttcgactcggccgatccctcttctttgttctcttcgactcggccgatccctgacagtatctcagccatgtcgtccaaacaaggagggaaagcaaagcctctgaagcaacccaagatcgagaagaaagattacgacgaggttgatatggcaaatattcaaaagaaggacgaggaaaaggcgctcagagagcttagagcaaaggcccaacagaagggggcgtttggaggagctgggctgaagaagagcgggaagaaatgagggctcccacgcaatgcatgtacgtacacattacttcacgacctgaaattgcaaacatctaatggctgctgtttaatcaattgattgtctttctgttctgtgtaaagcctgggaagagatgatcaatgctcttctcctggtttctttatttctggaatggaatggataaacttctcatagtt

SEQ ID NO: 1642 - DNA, 1305 bp, Panax ginseng
aagggctatcttattaattcaagtttctcttcgtatcagagaaaaccctaaccctaaaaatcagccatgtcgtccaagcaaggtggaaaagcaaagcctttaaagcaacccaaggctgaaaagaaagaatacgacgaggatgatttggctaaacttcagaagaaaaaggaagaggaaaaggcactcaaggagctcaaagccaaagctcaacagaagggggcgttcggaggttctgggctaaagaaaagtgggaagaaatgagtccccccatatcaatgtacatgtacgatttgtgccattactaggaaatgcttgtatgctatattctgtggattggacgtcattagttccggctgaacctttgtgacttatcctatatttaaattaaatgatattatcaaataaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaacaaaaaaaacaaaaaacaaaaacaaaacaaataaataataataactaactaactaactaactaactaactaactaacaactaacaactaactaactaactaactaacttaacgttaacgtaacgtaactaacgtaacgtaacgtaacgtaacgtaacgtaacgtaacgtaaccgtaaccgtaaacgtaaacgtaaaccgtaaccgtaaaccgtaaaccgtaaccgtaaacgtaaacgtaaacgtaaacgtaaacgtaaacgtaaacgttaaacgttaaaaccgtaaaccgtaaaaccgttaaaccgttaaaccgttaaaccgttaaaccgttaaaccgtaaccgtaaccggtaaccggtaaccggtaaccgttaaccggtaacggttaacgttaacgttaacgttaacgtaacgtaacgtaacgtaacgtaacgtacgtacgtacggtacggtaccggtaccggtaccggaccggtaccggtaaccgtaaccgtaacgtaacgtaacgtaacgtaacgtaacgtacgtaccgtacgttacgttacgttacgtaccgtaccgtaaccgtaaccgtaccgtaaccgtaaccgtaaccgtaaccgtaaccgtaaccgtaccgtaacgtacgtacgtacgtacggtacggtacgtacgtacgtacgtacgtacgtacgtacgtacgtacgtacgtacgtacgtacgtacggttacggttacgttacggttaacggttaaccgtaacgtaacgtaaccgtaaccgtaaccgtaaccgtaaccgtaaccgtaaccgtaaccg

SEQ ID NO: 1643 - DNA, 347 bp, Mimulus guttatus
ttccggcaaccatcttttcgtaaattccacgcgattgggttaggggttgtcttctctttttctcctctgttcaaaggtgaattccacaatcacagcgaaaccctagccctagaattcaatcatgtctaccaagcaaggaggaaaagccaagcctttgaagcaacctaaagccgagaagaaagagtacgacgagattgacaaggctaatattcaaaagaagaaggacgaagaaaaggctattaaggagctaaaggcaaaggctcagcagaagggagcgtttggcggtgccggtttgaagaaaagtggcaaaaaatgaatccagcttttttaatgaacattgacgcagt

SEQ ID NO: 1644 - DNA, 594 bp, Tropaeolum majus
cggccgggggttattatacatatatatatatataaaagatacatacaacgggaccattaattactgcgttagggctaggctactactatcgtctctattttcccccaattctgtgttcgaagatcataccgaaccctaaccctagaattctgccatgtcgtccaagcaaggaggtaaagctaagcctttgaagcaacccaaggttgataagaaagattacgatgagcatgatttggccaacatgcagaaaaagaaggatgaggagaaggcacttcgagaccttagagccaaagcgcaacagaagggttcgtttggaggatctggactcaagaagagtgggaagaaataaaagccttccaccctaaaccgatgagtcatagacttatagtttttacaacatgattacatatttcaattaagatgcgggttaatcgcagtgtttgcagtatcttttgttaagagattgatgatcttgttgcgtgggtatgctatatagctaatgctgtcacttgatctttaataaatctaaattgcatgcgatagaactaaaaaaaaaaaaaaaaggaaccgtactgtagactgaccgaagcaacg

SEQ ID NO: 1645 - DNA, 501 bp, Allium cepa
ttcgtttatttctccaccatcattcggttaggttttcgatttcacgttctcccaaatcaattatgtcttccaaacaaggtggaaaggcgaagcccttgaagcagcctaaggctgacaagaaggagtacgatgagatcgatcgagcaaaccttcagaaaaagaaagacgaggaaaaggcattgaaagaattgaaggcaaaagcagctcagaaggggtcttttggcggtgcagggctaaagaagagtggcaaaaaataataaatggcgtgttcttttcaatctattaatatattttctaaaagaaactaaatttagtttaatatatgatgaaaccttgagttgctgatttggatggttatattttctttggggagaaacaatgctgcgacctatttactgaaaaatggtcatcttaattttatgacgctatgcttttctactggttcccttgtgctattttcaaatcagatgctcacatttgcatcaatagctgtatggttta

SEQ ID NO: 1646 - DNA, 554 bp, Panax ginseng
aagcagtggtatcaacgcagagtacatggggggccaataacaaatccgacctgggttagggccgccttgtcttccatattccgggtcttctttctagatcagaaaaaaccctaaccctaaaaatcaacaatgtcgtcaaagcaaggtgggaaagcaaagcctttgaagcagcccaaggctgaaaaaaaagaatatgatgaggatgatttggctaaacttcagaagaagaaggaagaggaaaaggcactcaaggagctcaaagccaaagctcaacagaagggtgcttttggaggttctgggctaaagaaaagcgggaagaaatgagtcttcaatatcaataaacacggatgcttttgtgtcatgcttctatgatgtattttgtaatttggttggacatcattggtttcatttgtaccaagtttaccgcgtgacttatcctatgcaaaaccataaataaaattatcaacctttaatgttttctgagaaaaaaaaaaaaaaaaaaaaaaaaaaaaaaaaaaaaaaaaaaaaaaaaaaaaaaaaaaaaaaaaaaaaaa

SEQ ID NO: 1647 - DNA, 485 bp, Ocimum basilicum
tagcatagagaatttcggaggagctgggttagggctagggcatcttattgatccccgtttattcgcacctcaattttccgatctcatcaaatttccaagcgcataattcaaccatgtcgagcaaggcaggaggaaaagccaagcctttgaagcaacctaaggtggccaagaaggagtacgatgaggatgaccttgctaatcttcaaaagaagaaagaagaagagaaggctctcaaggaacttaaggcgaaggcccagcagaaaggagcatttggaggttctgggttgaagaaaagtggcaaaaaatgagtcctgaaatgggaattattgaaatagctcattgattgccatgtttgtcaatttctgcatatgctatttcaacatgttagatgttcctagtaatcgagtctgcaaaagctttgcagatataagattgtatcccaacatttgaatctatgatatggtattatcgtacttttcgatttg

SEQ ID NO: 1648 - DNA, 534 bp, Allium cepa
acaaactgtcacacgttcccttaattttctctctatttttcctcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggacaaaagcatctcagaagggatcattcggtggtgcaggcctgaagaagagtggcaaaaaataatgatggcatgttcagtaaaacaatttattttcacgtttatctaatccacatgttgtttatgtggctaaacctctctttgtgatttcaacgttattttgctacatctgatagccttgttgctaccattaagatacataagcatcttgaaatcaatggtaatatcagtatgaacttaacagtagtttgctgcggtgattccctgctattgtttcttttcaattggtattttttatgtttggtcgtgcttaaaaacacacac

SEQ ID NO: 1649 - DNA, 345 bp, Panax ginseng
aagcagtggtatcaacgcagagtacatggggagaatataaaaaggtattcatacaatttccgaaggccaaaagtaatccgatttgggattaagggctatcttattaattcaatttctcttcgtatcagagaaaaccctaaaatcagccatgtcgtccaagcaaggtggaaaagcaaagcctttaaagcaacccaaggctgaaaagaagaatacgacgaggatgatttggctaaacttcagaagaaaaaggaagaggaaaaggcactcaaggagctcaaagccaaagctcaacagaagggggcgttcggaggttctgggctaaagaaaagtgggaagaaatgagtc

SEQ ID NO: 1650 - DNA, 521 bp, Panax ginseng
agtggtatcaacgcagagtacatggggaggccaataacaaatccgacctgggttagggccgccttgtcttccatattccgggtcttctttctagatcagaaaaaaccctaaccctaaaaatcaacaatgtcgtcaaagcaaggtgggaaagcaaagcctttgaagcagcccaaggctgaaaaaaagaatatgatgaggatgatttggctaaacttcagaagaagaaggaagaggaaaaggcactcaaggagctcaaagccaaagctcaacagaagggtgcttttggaggttctgggctaaagaaaagcgggaagaaatgagtcttcaatatcaataaacacggatgcttttgtgtcatgcttctatgatgtattttgtaatttggttggacatcattggtttcatttgtaccaagtttaccgcgtgacttatcctatgcaaaaccataaataaaattatcaacctttaatgttttctgaaaaaaaaaaaaaaaaaaaaaaaaaaaaaaaaaaaaaaaaaaa

SEQ ID NO: 1651 - DNA, 356 bp, Allium cepa
tttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaaggcaaagcatctcagaagggatcattcggtggtgcaggcctgaagaagagtggcaaaaataatgatggcatgttcagtaaacaattatttcacgtttatctaatccacatgttgtttatgtggctaaacctctctttgtgatttcacgttatttgctacatctgatagccttgttgctaccattaagatacataagcatctt

SEQ ID NO: 1652 - DNA, 422 bp, Euphorbia esula
gatcgggcaatccctctttgtattcttcttcgactcgggccaaaccctaacgatatctccgccatgtcgtccaagcaaggagggaaagcaaagcctctgaagcaacccaaggttgataagaaagagtacgacgaggttgatctggccaatatgcaaaagaagaaggaggaggagaaggcgatcagggagcttagagcaaaagcccaacagaaggggacctttggaggtgctgggctcaagaaaagtgggaagaaatgagggttcccacgcaaattcatggaggtagattacttgacgacctgaatttgcagacatttaattgctattgaatcagttgattgtctttgtgttccttgtaaaacccttgaaagaagataatatggtgtggaattattatggaagttgaatgcttctcaataaac

SEQ ID NO: 1653 - DNA, 341 bp, Musa acuminata
ctcgcctgttcctctcaccgatcgtcgccttcccgccgcaccagacgatcatgtcgtccaaacaaggtgggaagttgaagcccctgaagcagccaaaggctgacaagaaggagtacgacgagatggacaaagcaaatattcagaagaagaaagatgaggaaaaggcgctaaaggaattaagggctaaggcatctcagaagggatcatttggaggcactggtcttaagaagagcggaaaaaaataacgtctctgttgcatatgtttaaaaaaaaaaggaactaccgctctgaatgtagtaagcatattctgagtgtgctttgtcttatcaggttgatgaaag

SEQ ID NO: 1654 - DNA, 289 bp, Ricinus communis
ctcaaattctctctcgattcttcaaattcaagcactaaccctaaccctaactaccagccatgtcttccaagcaaggtggaaaagccaagccattgaagcaaccaaaggctggcaagaaggaatacgacgagactgatttggccaacattcagaaaaagaaggacgaggaaaaggcactcaaggagctcaaagccaaggcagcacagaaaggagctcttggaggttccggtctcaagaagagcggaaaaaaatgagggttctgaaaacccaaatcagaatagaatatatg

SEQ ID NO: 1655 - DNA, 356 bp, Cyclamen graecum
ctccaatcaatttcgagtgcctctctctctaacaaagttccaattatcgtaattggggccaaaccctaaccctagttttcagccatgtcgaccaagcaaggcggaaaagcaaagcctttgaaggcacccaaggccgagaagaaggattacgatgaggttgataaggcaaacttgcagaagaaaaaggatgaggaaaaggcactcaaggagcttagggccaaggcgcagaagggggcacttggaggtactggactcaagaagagtggaaagaaatgagtagttgtaataccagggtttttaccctttattcttgtattattacttaaatgcaagcacgatgacttcttgtactgcgg

SEQ ID NO: 1656 - DNA, 356 bp, Echinochloa colona
cccgcccgccatgtcgaagcaaggagggaaggccaagccgctgaaggcgcccaaggtcgacaagaaggattacgacgagactgatcttgcgtatctgcagaagaagaaagatgaggaaaaggcgctgaaggaactgaaggccaaggcacagaagggtgccattgggggctctggcctgaagaaaagtgggaagaaatgaggatgattgggaaatgatgaaccttctgccgatgtgtaccgtgtttcgctatatgtgattgtaacaaaactatctttaagtggttcatgttactaatgttgcagttggttgcttgatccgaagatgatattggagtcgtggtgtggtcggcgtctct

SEQ ID NO: 1657 - DNA, 367 bp, Allium cepa
ctttctccgtcagccggttaggtttttgatctctcggtctcccaaatcaattatgtcttccaagcaaggcggaaaggcaaagcctttgaagcaacctaaggctaacaagaaggagtacgatgagaatgatctggccctccttcagaagaagaaagaggaggaaaaggcattgaaagagttgaaggcaaaagcagctcagaagggatcttttggtggtgcagggctaaagaagagtggcaaaaaatgagcagtgggactatactttcaatctattattatcatattttgtgtttccagaagaaatcaaaattagtttaatatgatgagaccttgagttgtggattggattgttatattttctttgggg

SEQ ID NO: 1658 - DNA, 310 bp, Ananas comosus
aacaaagttccaattatcgtaattggggccaaaccctaaccctagttttcagccatgtcgaccaagcaaggcggaaaagcaaagcctttgaaggcacccaaggccgagaagaaggattacgatgaggttgataaggcaaacttgcagaagaaaaaggatgaggaaaaggcactcaaggagcttagggccaaggcgcagaagggggcacttggaggtactggactcaagaagagtggaaagaaatgagtagttgtaataccagggtttttaccctttattcttgtattattacttaaatgcaagcacgatg

SEQ ID NO: 1659 - DNA, 644 bp, Cycas rumphii
tgcattcaaagaattcggcagaggggagctcttccggattttgccgagacaggttaaggccttgagctgcaacaatgtctagcaagcaaggtggaaaagcgaaacccctgaaacagccaaagcaggaaaaaaaggagtatgacgaggctgatatggctcacattcagaagaaaaaggatgaggaaaaggcattaaaggaattgaaatctaaggcatcccagaaagggtcatttggtggtgcagggttgaagaagagtggtaaaaaatagattgcaaaagagtagtttctgcagttagggtgcattctaattaggacattcatgtgagggtaatattactgaacgtggatggctccacatggcctgacatagttgaactgtcatttctgcaaactgttgtgatattaagataattatttatagcatgtttcaataagtgatgcatgtttggggtcaaagaagagtggtacaaagtagattgcaaaagagtagtttctgcagctagggtgcatgctaattattacattcatatgggggtattattactaaacatggatggctctacatggccggacatagctgaactgtcatctgtgcagactgttatattaagataattattttcagtgttctaaaaaaaaaaaa

SEQ ID NO: 1660 - DNA, 545 bp, Echinacea purpurea
ctcccaaaattgtccaagttagcgttgtttgaagtcaccgatttcttccgttttccggatcagagcaaatcctaaccctagatttcgataatgtcgtccaaacaaggtggaaaagcgaagccgttaaagcaaccaaaggctgaaaagaaagaatacgatgagatagataaagccaacattcaaaagaagaaggaagaggaaaaggccctcaaggagctaagagccaaagctcaaaagggagctttgggaggtagtggtctcaagaagagtggcaagaaatgaggtttcaaatggtaaagttaaatcttctaaattacttaggaatgtgcacttactgcatttatggttacatggtttgctattatatgtatcaagcctcttgtgattgttcttgtgtagctctcaagaggaacgatcgctctgacatttgattttgttaatctaccgggtgtaatgatttattgaagttatgatgatttttggtctggttgggtcgggtcggcagtggcggttcttaaacattaaatgagatatggccggaaatc

SEQ ID NO: 1661 - DNA, 680 bp, Eschscholzia californica
cctgaaatcgaatggcggtaggaaggtgcttatttgtctaccggtctttctctccttgttcactcgcttgtatccttcgttccttcttcctcaactcacccagccatgtcgtccaagcaaggaggtaaggcgaagcctttgaaacaacctaaggttgaaaagaaagaatatgatgaggatgatctagcaaagattcagaagaagaaagaggaggaaaaggcattgaaggagctgagggcaaaggcatcacagaaggggtcatttggtggtgctggactgaagaaaagtggaaagaaatgagtgccaagcattctcgatgcatcttatccgcttttcgttaaatggcattctctcctgttggattggcttagtacttgttatattttactgcaaactctagtctggcgtgcccattagaccaagttaaaaacataaatgcgccgtccttcttcctttccgcatattctgttataatttccatgtggttgaaagggattactggatttatcatatatgtttaatggtcttcttgtgtgaagcttttccttctttctggtcctctaaagtgtttgtaatttggtggtcacactaaattttatttttgaagttctaaaagtgttttaactgcaatggatggaccgattaaaactagagaacgtatagttggtctgctagatttg

SEQ ID NO: 1662 - DNA, 452 bp, Eschscholzia californica
gttctatctacgcaactctccttcctaattttcaacttcacatcaagacatgtcttccaagcaaggtggaaaggcgaaacctttgaagcaacccaaggttgacaagaaagaatacgacgaggatgatttagcaaagattcagaagaagagagaagaggagaaggcactaaaagagctgagggctaaggcctcacagaagggctcatttggtggtgctggactgaagaaaagtgggaagaaataaactattatgctatataaaatgtagtatatatgtctatgaaagtcattccaggttgggtagattatcgatgtaaactgttaatcttgtctatccgcaaactgttggaaactgctacttaactattactcctatcttttataagcacgtgttatgttcgattactgaaactcagatgcttatcggacaaattgcaatctgttatcagcag

SEQ ID NO: 1663 - DNA, 596 bp, Panax ginseng
aagcagtggtatcaacgcagagtacatggggagaatataaaaaaggtattcatacaatttccgaaggccaaaaagtaatccgatttgggattaagggctatcttattaattcaattttctcttcgtatcagagaaaaccctagaaatcagctatgtcgtccaagcaaggtggaaaagcaaagcctttaaagcaacccaaggctgaaaagaaagaatacgacgaggatgatttggctaaacttcagaagaaaaaggaagaggaaaaggcactcaaggagctcaaaaccaaagctcaacagaagggggcatttggaggttctgggctaaagaaaagtgggaagaaatgagtccccccatatcaatgtacacggacgatttgtgccatgactaggaaatgcttgtatgctatattctgtggattggacgtcattagttcccgctgaacgtttgtgacttatcctatatttaaatgaatgatattatcaactcctattttcgcccataaaatttgtgctattgttgccttactaaccttaataatggtttgaggtgaaacaatataattgtttttgcgtaaatggaacataagatttaga

SEQ ID NO: 1664 - DNA, 617 bp, Panax ginseng
aaaaaaaaaaagaaaaaaaaaaaaaaaaaaaaaaaaaaaaaaaaaaaaaaaaagtaaaatccgatttgggattaagggctatcttattaattcaagtttctcttcgtatcagagaaaaccctaaccctagaaatcagccatgtcgtccaagcaaggtggaaaagcaaagcctttaaagcaacccaaggctgaaaagaaagaatacgacgaggatgatttggctaaacttcagaagaaaaaggaagaggaaaaggcactcaaggagctcaaaaccaaagctcaacagaagggggcatttggaggttctgggctaaagaaaagtgggaagaaatgagtccccccatatcaatgtacatggacgatttgtgccatgactaggaaatgcttgtatgctatattctgtggattggacgtcattagttcccgctgaacgtttgtgacttatcttatatttaaatgaatgatattatcaactcctattttcgcccaaaaaaaaaaaaaaaaaaaaagaaaaaaaagaaaaaaaagaaaaaaaagaaaaaaagaaaaaaagaaaaaagaaaaagaaagaagagagagagagagagagagagaggggggggggggggggggggggg

SEQ ID NO: 1665 - DNA, 572 bp, Elaeis guineensis
gggactcccctccctcttccccttcccccggccctatataaagaacggcggtgggagaaaaggtaaaggcgctgcgtgtcggtcgccccttccttgctctcggttgacgtacagggttgggcttgttcccttctcctccgatccagcaaccaaccatgtcgtcgaagcaaggtggaaaggcgaagcctttgaagcagccaaaggtcgagaagaaggaatacgacgagacggatcatgcaaatattcagaagaagaaagaggaggaaaaggcactgaaggaattgagggctaaggcatctcagaagggaacatttggaggcgcaggtctcaagaagagcggaaagaaataagatctgttctcttatcgtgtaatatgccacaatgctgaacgatctcgataacgtagtacccaattatcttctctaggatgtgtgtgcagctatgtggctgatactagttgtgagcaggtgactcgtgtttctatggaatattcgcaataacattaaattctagagattggctttgtctgatatataatattgaggagaccgtactattaacaaaaaaaaaaa

SEQ ID NO: 1666 - DNA, 478 bp, Citrullus lanatus
aagccgccaattattgcgatcgggcaatccctctttgtattcttcttcgactcgggccaaaccctaacgatatctccgccatgtcgtccaagcaaggagggaaagcaaagcctctgaagcaacccaaggttgataagaaagagtacgacgaggttgatctggccaatatgcaaaagaagaaggaggaggagaaggcgatcagggagcttagagcaaaagcccaacagaaggggacctttggaggtgctgggctcaagaaaagtgggaagaaatgagggttcccacgcaaattcatggaggtagattacttgacgacctgaatttgcagacatttaattgctattgaatcagttgattgtctttgtgttccttgtaaaacccttgaaagaagataatatggtgtggaattattatggaagttgaatgcttctcaatattctgaactttctttagctttgatattctaaacaccaacccc

SEQ ID NO: 1667 - DNA, 453 bp, Juglans hindsii x Juglans regia
gggggatcatttcgtctttcatactgttagggctctctctttcggattctgcttttgctttcgaatccgcaccagactgtagccctagatcgcagccatgtcgtcaaagcaaggtggaaaggcaaagcctttgaagcaacccaaggctgacaagaaagaatacgacgaggttgataaggccaatattcagaagaaaaaggatgaggaaaaggcacttaaggagctgagggctaaggcacagaagggacccattggaggtgctgggcttaagaaaagcgggaagaaatgaggggtttaagaccgaaattggggactcctattaaattttccagcttgtaacaatcattaccatgatgattatatccatgatgtgtgtgatctcgctgctttcttaatttgttactgtactttcggagtcttctttatatgatactaagttttcgtgtttgtgat

SEQ ID NO: 1668 - DNA, 575 bp, Musa acuminata
ctttcgatttggtattggacatcaaaaattggggttcgctttcccttccggttcgaagcagccatgtcgtcgaagcaaggtggaaagttgaagcccctgaagcaacctaaatccgataagaaggattacgatgagacggatttagcaaacctccagaagaaaaaagatgaggagaaggcaatgaaggagctcagggccaaggcatcccagaagggatcatttgggggtacaggtctcaagaagagtgggaagaaataatgttcttcctactgtactgctaatataatgtttgtccaccgtttcttggattctgattcctatgtggtgataactagtacttaagatgctctatcagattccgaagcaagtcatgatatgagattgtactgtttgagtctcagctaggccttgtcctatgtatcattttaaattatatattccccatccatgaagttgttgctgccaatgcgctcctctttttgcatttaacccgatggtattgtcaaaaggatattgatctgaatctgaaaaagaaactgatctactttctaatctctagtaattttcatcatttg

SEQ ID NO: 1669 - DNA, 505 bp, Lactuca sativa
tatcctcgtataaatagccacaactttacctttcgaaaacaatcaaagatttcttccgcttcccgcatttctacggatcagagcaaaccctaaccctagattcgataatgtcgtccaagcaaggtggaaaagcgaagccattaaagcaaccaaagtctgaaaagaaggaatatgatgaggttgataaggccaacattcaaaagaagaaagatgaggaaaaggcacttaaggagcttagagccaaagctcaaaagggagctttgggaggtactggtctcaagaagagtggaaagaaatgataccaagtgattgttatgtgcactgatttctgtatcaagttttctgtgattgttcttgtagaaatttaagaggaacaatattggtggtattcttgttttctggttctacttgtttgtgttcaatatgcaacttttcttttctttgttttcaatttgaaagatctagcaagtttaaatgggttgatccagattatgattgatgcata

SEQ ID NO: 1670 - DNA, 464 bp, Tamarix hispida
gggggtgtttggaaaagggttacgtcgttgtcgttcttccgaacatcagaggaatttccacggtaagataataaccgatccttactaccacccagcagcagccatgccttccaagcaaggtggaaaagcgaagcccttgaagcaacccaagtccgataaggagtacgatgagattgacagggctaacctgcagaagaagaaggaagaggagaaggcattgaaggagcttagagcaaaagctcagaaaggttcactgggtggttctggattgaagaagagtggaaagaagtgaggcttcctgaacgcaagaaaggacagaaccatgagaagatatgttgggggtgtgtcacatttgtttttgtgatttccgtcaattatcattgtaattgtgatgtcgtgctaatgaacttggctgtaggcgtctcatatgtaatcaatgaaaacttgaaaggtattggtcacaa

SEQ ID NO: 1671 - DNA, 651 bp, Musa acuminata
catcacacctgcttctgtcgtcgtccatctatttagggattaatgaggacgaacggagcccggagagccatctcgcctgttcctctcaccgatcgtcgccttcccgccgcaccagacgatcatgtcgtccaaacaaggtgggaagttgaagcccctgaagcagccaaaggctgacaagaaggagtacgacgagatggacaaagcaaatattcagaagaagaaagatgaggaaaaggcgctaaaggaattaagggctaaggcatctcagaagggatcatttggaggcactggtcttaagaagagcggaaaaaaataacgtatctgttgcatatgtttaaaaaaaaaaggaactgccactctgaatgtagtaagcatattctgagtgtgctttgtcttatcaggttgatgaaagctgtctttaagtgaatgctttgaatgctataatgtactaaacaagtatttcatggatgtgcttcgatttatcgggttgataaaagtcgttttggagtttcaatgctttgaacacttaatgcgtgtttagtgacctggtgctcttgtgaacaggttgaagtataattttatgatcgactgtgttatagagaggatatacttttgctgggttcagaaacaatgaaaatagatattcacctt

SEQ ID NO: 1672 - DNA, 604 bp, Olea europaea
ttgggttagggcaccttttcatttttctagcgatttcgtgatcagagcgaaaccctaaccctagatatcaaccatgtcttccaagcaaggtgggaaagcaaagcctttgaagcaaccaaaggctgacaagaaagagtacgacgaggatgacaaggcttttattcagaagaagaaggaagaggagaaggccctgaaggagcttaaagcaaaggctcagaagggagcacttggaggtgctgggctgaagaaaagtggaaagaaataaaacttaaaaagtactacaagaaacaaaaactcctttgttgtcaattgtatcgcgatattaccatttggtttaaaccattttagcatgatgttcttgcttatgctagactattgagcaactttctacgaagtttcattgtgtagaactatttgtttggagcaataaacgtgtggttttgcatgtctgagaggctttgatcctttctggaagcctttttgttgattgtctaagttttcgtgcttcagtttctaatttgtctgagtcgtttgaattggctatatgtcttatcgtagtttaggttaaaaagggaaggggactttagtacgtaaattttaaacg

SEQ ID NO: 1673 - DNA, 748 bp, Lactuca sativa
gtcgaggggttttcgaacgcatcagaagttagcgttcaggttaggttatttcatttcccattctgcgtgtttctttacagcatcaaaccctaaacgatcatgtcgtccaagcaaggaggaaaagcaaagccattgaagcaacccaagtctgagaagaaagaatacgacgaggtagataaggccaacattcaaaagaagaaggacgaggaaaaggcacttaaggagcttagagccaaagctcagaagggagcactgggaggtactggtctgaagaaaagtgggaagaaatgagctgaagttgctgcatatactactactattactactatgttgtgatttgtgaatcctgcttctaatatcttagctgaatgtgtttggtaaattcagtataaacctttgcagtttgcttgtaataatcatggtgatatttggtctagatgttgtttaggctgtatgttgactctgtcataatctggaacgggttatgttttgtttttggtaatgagttctaaatttttaaaaaaggcaggcttttgggtgaaggttaaaaagttaagttcttttaaaactcaatcccatggttaaacctaactggaattgtgttgtcttcatgtgtaaatcatgagaacatcatttccaggtgttagaatgtccatctaaagtgtttattgtatgctgtagtcacaatgaggaaaacatcatgtttttggtgttagaacaagaattatgtatctaaagtgtttattat

SEQ ID NO: 1674 - DNA, 1215 bp, Cocos nucifera
acaattactaggataagaatgggttgcttgaagcctctactccttgctattcttatcatctcttcctttgctttgcttgcagagagccgggtctccaggatggaacttgacttgggcctgggacttggtgttggcgttggggttggcataggaggtggcggcggcggctccggctccggttctggttctggttctggttccggctccggctccggctcgggatctggttccggagctagttcgtctgcagggtcgggagccagctcttctgcagggtccggctcgggatctggtgccggttcttccgcaggttcgggtgccagttcttctgcaggttcgggcgggaactcggggtccggaggaggctatggcgaaggccacggatatggttctggtggtggtggaaatggcaactaagattgtagaactacgtacttgtgctgtaccaacttataatgccattatctagagaaataaggagatggtggataagaatgctcatgttttgatatacagttttttccccttcagccgcttttctttagtattaccaaggccgagaagaaaataatggatcatgtattggaatttcgaatttgcaactcacaaataagctggccaaataattattgcttcggagacgcaagcgctcttccccttccccttctccttcccctggcccttcataaagagaggcggtgggagtaaaggtaaaggcgcttgcgtctcgatcgccctttccttgctctcggttgacgtacgttagggttgggcttgttcccttctcctccgatccagcaaaccatgtcgtcgaagcaaggtggaaaggcgaagcctttgaagcatccaaagaccgagaagaaggaatacgacgagacggatcttgcaaatattcagaagaagaaagaggaggaaaaggcactgaaggaattgaggtctaaggcaactcagaagggaacatttggaggtgcaggtctcaagaagagcggaaagaaataagatccgttccctcataatgtaatatgcaacaaatgctgaacgatctcgataacgtagtatccaattatcttttctaagatgtgtgtggagctatgtggctcatgctagttgtgatgtggtgactagtgttcctatggaatatttgcaataacattaaattctaaagattggctttgtctgatatataatatcgaggagaccgtactattacaaaaa

SEQ ID NO: 1675 - DNA, 529 bp, Humulus lupulus
aagggtgcgtattattgaggctttagggttgtgtttctctctttcagcggagcttccctttgccttccgattccgatcacaaaccctagctacaaccatgtcttccaagcaaggtggaaaagctaagcctttgaagcaacccaagaaggaccagaaagattacgacgagactgacttggccaacattcagaagaagaaggaagaggaaaaggctctgagggaactcaaagccaaggcacaacagaagggagcttttggaggttctggactcagaaagtggaagaataaagggggtcttgtaccttgattcgaatgggaaatagtattctgcattcgtgagctgatgtattaatagaatcgttgtcagtaatcacgatgacgtccttcgaatttacttatcatttatgtgatggtctatgtctttaatgaatttgctgcttaactttgtgctagtgacaaatgtgtaacatcaaataaatggtttgcctttttcactgcaaaaaaaaaaaagaactccgggccgcccggc

SEQ ID NO: 1676 - DNA, 451 bp, Allium cepa
cgacaaactgtcacacgttcccttaattttctctctattttttcctcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaggactctgaaggaattaaaggacaaaagcatctcagaagggatcattcggtggtgcaggcctgaagaagagtggcaaaaaataatgatggcatgttcagtaaaacaatttattttcacgtttatctaatccacatgttgtttatgtggctaaacctctctttgtgatttcaacgtttattttgctacatctgatagccttgttgctaccattaagatacataagcatcttgaaatcaatggtaatatcaatttgaac

SEQ ID NO: 1677 - DNA, 441 bp, Allium cepa
ttcccagttggatacgtcctcaaccaatatagcgacaaactgtcacacgttcccttaattttctctctattttccctcgaggtttttcactttctcctttcacaaaatcaatcatgtcttcaaagcaaggtggaaaggcgaagcctttgaagcagcccaagtctgacaagaaggaatatgatgagaccgatctagcaaaccttcaaaagaagagagaggaggaaaaggctctgaaggaattaaggcaaagcatctcagaagggatcattcggtggtgcaggcctgaagaagtgtggcaaaaaatatgatggcatgttcagtaaacatttatttcacgtttatctaatccacatgttgtttatgtgctaactctcttgtgtatttcaacgtttatttgcttacatctgatagccttgttgctacattaagatacataagcat

SEQ ID NO: 1678 - DNA, 430 bp, Sarracenia psittacina
attcgcagtagggttcgggctctgtattctgggatccgagctcgggccaaactctaaccctaaaaatcaacaatatgtcgtcgaagcaaggaggaaaagcaaagcctttgaagcaacccaaggttgataagaaggattacgacgagaatgatttagctaaccttcagaagaagaaggaagaggaaaaggcactcaaggatcttagagccaaggctcaacagaaaggagcatttggaggttctggactcaagaaagtgggaagaaatgaggagcgtttccaagtcaaatgtaccttaatctgtgctatgatattacaaatgcacagatgatgtcttggtagctatgattgctgagcttatgatagttgctaacttcatgaatgtgtgtaaactcttaaataacttgaatcgtagaacttgactttcaaggc

SEQ ID NO: 1679 - DNA, 520 bp, Chrysanthemum coronarium
aggtcatattttccacccccaattcaattaatcaaaccctaattccaaaaaaatcaatcatgtcgtcaaagatgggaggaaaagctaagcccttgaaggcaccaaaatctgagaagaaggagtacgatgaggttgacaaggccaacattcaaaagaagaaggatgaggaaaaggcacttaaggagctcagagcaaaagctcaaaagggtgccttgggaggtgctggtttgaagaagagcgggaagaagtgagctgggtctttcggaagtgaagttgcttaatgtgctatggtgttattagtaaatgttctcctaatatgtctgaatatgtcttgactgaattcagtattaaaaccgttgacaatttattagtgcatttgaatttcggataataatcatgttctaatattgtcttgatgctgttttgggtatgctgatttggtgtttgtcgtttgtttcaataattcaattacacatgtgcaaacttgtacacacagaaacacattgcttatgaaccgtgg

SEQ ID NO: 1680 - DNA, 750 bp, Cichorium intybus
taatgtgggaaatcgtgtcggtcttgcctataaataaagtcggggggtttttcgtaaccatcagaagttcgcgttcgggttaggttatatttcatttccaagtctgcgtatttgtttgtagcatcaaaccctaatataaattccaattatgtcgtccaagcaaggaggaaaagcaaagccattgaagcaacccaaggctgagaagaaagaatacgacgaggtagataaggccaacattcaaaagaagaaggacgaagaaaaggcactcaaggagctaagagccaaagctcagaagggagcactgggaggtaccggtctcaagaaaagtggaaagaaatgagattagcagatctgaagttgcttcatatactaccatgttgtgatatgtgaatcttgcatttaatatccatggttatttaactaaatgtatttgctaaattcagtataaaccttttgcagtttgcctgtaataatcagttaatcatggtgatatttggtctagatattgtttacgctgtgctgatcccgtcacagtctggaactggttatattttgtttggctccgggttcttgattttttaaaaaaggaggctttagggtgttggttgtcggttcaaaatttaaaaaagtaggttggttctttgtttggttcaaacttattttatatttcaagcttgaaaattgaaatgtcgttttgagtttgtgttttcaaatgcaaattaaacccaactttgttaggttttcaatttc

SEQ ID NO: 1681 - DNA, 759 bp, Cocos nucifera
gcctggattgcaacatgtgatcctcaggagcatgactagtggttggttcatcaaaaaagttaaaatccacacgctggagttgcatcagcgatgttaccacgactccggatgcagcccaacgtgacaaaggcctgttagctcagccatcgcgcacgtcgccacaagaatcatccgtcgccaagtgggactcctcctcttccccttccccttctccttcccctggcccttcataaagagaggcggtgggagtaaaggtaaaggcgcttgcgtctcgatcgccctttccttgctctcggttgacgtacgttagggttgggcttgttcccttctcctccgatccagcaaaccatgtcgtcgaagcaaggtggaaaggcgaagcctttgaagcatccaaagaccgagaagaaggaatacgacgagacggatcttgcaaatattcagaagaagaaagaggaggaaaaggcactgaaggaattgaggtctaaggcaactcagaagggaacatttggaggtgcaggtctcaagaagagcggaaagaaataagatccgttccctcataatgtaatatgcaacaaatgctgaacgatctcgataacgtagtatccaattatcttttctaagatgtgtgtggagctatgtggctcatgctagttgtgatgtggtgactagtgttcctatggaatatttgcaataacattaaattctaaagattggctttgtctgatatataatatcgaggagaccgtactattacaaaaa

SEQ ID NO: 1682 - DNA, 851 bp, Cocos nucifera
ttgggcttgttcccttctcctccgatcgaacgaccatgtcgtcgaagcaaggtggaaaggcgaagcctttgaagcaagcaaaggtccagaagaaggaatacgatgagacggatcttgcaaatcttcagaagaagaaagaggaggaaaaggcactgaaggaattgaaggctaaggcgtcccagaagggaacatttgggggcgctggtcttaagaagagcggaaagaaataaatcccctgtttcttcatgtaatgctcatgttaaaccagccaacaatgctaaaacaatgtagtacctaacgatcatctccgagatatgcatggatttgtctgtggctaatatgagtcgcgaggcagtgactcttgctgaacgaaacgaatggaaaatctactgctgcattaaactctaaaggttggtttcttctgataaaatgttgcactggaaactggactaccatcaactcttttgtttttgttagcagatgaaatggatattcgtacaggttgtggaacatggtgtttgttcatggagatccacaagtgcaaggcacttgatgcaatgttgtatgtttcatgcagcacaagtgggatacggttcgtggacatgagtacctgagatgctatttctttaaacaaacttatggtcgccatcaaattgacctccgatgcttttccttgataaagaaatttatctaaactttgtaaactgataacagttgcgtggggtgccgtcaaagcagcataaacatgctaatttgctttccggtggttaaacaagctgctcctttttattgcaaatccgtgaattctttgtcagatattgacttcaatggttgcgttgaatagaatggct

SEQ ID NO: 1683 - DNA, 372 bp, Echinochloa colona
cccgctcgccgatccgccccgcccgccatgtcgaagcaaggagggaaggccaagccgctgaaggcgcccaaggccgacaagaaggagtacgacgagactgatcttgcgtatctgcagaagaagaaagatgaggaaaaggcactgaaggaactgaaggccaaggcacagaagggtgccattggaggctctggcctgaagaaaagtgggaagaaatgagcgttacctgtggtaattgggaaatgatgaaccttctgccgatgtgtgctgtgtttcgctatgtgtgattgtaacaaaactatcttcaagtggttcatgttactaatgttgcagttggttgcttgatccgaaaatgatattggctatgatgcagat

SEQ ID NO: 1684 - DNA, 482 bp, Echinochloa colona
ctcccgcactctcgcttgcctttccccacccacctcgccgcggcgctcgcaagctagggtttcgccccccgctcgccgatccgccccgtccaccatgtcgaagcaaggagggaaggccaagccgctgaaggcgcccaaggccgacaagaaggagtacgacgagactgatcttgcgtatctgcagaagaagaaagatgaggaaaaggcactgaaggaactgaaggccaaggcacagaagggtgccattggaggctctggcctgaagaaaagtgggaagaaatgagcgttacctgtggtaattgggaaatgatgaaccttctgccgatgtgtgctgtgtttcgctatgtgtgattgtaacaaaactataagtggttcatgttactaatgttgcagttggttgcttgatccgaaaatggtattggctatgatgcagatggttttatgataataacatgacattctaagatgtcttcgaattgttt

SEQ ID NO: 1685 - DNA, 385 bp, Setaria italica
gccagctagggtttcgtgccccgctcgccgatccgccccgtccgccatgtcgaaacaaggagggaaggccaagccgttgaaggcgcccaaggtcgacaagaaggagtacgacgagtctgatcttgcgtatctgcagaagaagaaagatgaggaaaaggcgctgaaagaactgaaggccaaggcacagaagggtgcgattggcggctctggcctgaagaaaagtgggaagaaatgagtctgttacttgggaaatgataaatcttctgcctatatgtgctgtggttcaccaaatgtgattgtaacaaaactattttaagtgggttctgtgttagtaatgttgcagtcagttgcttgatccgaagatgatgttggctatgatgcagat

SEQ ID NO: 1686 - DNA, 783 bp, Arabidopsis thaliana
atctgaaactcgaagaaacagaggttcctcttgtgttttttttttgggattaaggaagctatttctgttctcttcgagtttcaggtctagccctaaccctaaaattcagccatgtcttccaagcaaggagggaaattgaagcctttgaagcagcccaagtctggtaagaaggagtacgatgagcacgatatggagttaatgcagaaaaagaaggatgaagagaaggcacttaaagaactcagggccaaggcttcacaaaaaggatcattcggaggctcaggacttaagaaaagtgggaagaaataagactaaatctgcctcaatgtaatcctatatcaccttatatatgtttgtcaatgtaccatgactagtttataagttataaccattaaaatcatgttgcgatgttgtagaagtaaatataaatctaagacttgtacctccttcaaaaattctgcaacttttcattgaggttttagttgttgcaagtttcgattaaaccaaacggatcatatgcaccagcattaacaaaaaacaaccgatattttgagactcaaaaccaaaaaagattacgactttagaagtcccaaaaagtttgcagcttcgaaccttttcatcaaacactgccttggccaaagtcttgaatcctgtcaccacgaacatttaagctctccattgcattctccaatccagaactcatctcagccaacacatgaggatcattgtaatgttgaacagcttgaacaatgctcctaagtttcttaaacggatcaggaccatcaa

SEQ ID NO: 1687 - DNA, 531 bp, Echinacea purpurea
tcgagtcgtttgggcaccccagtcactagtggtatcccaacgcatctgaataccgcgttaaatttaggttatcatctcatccctaaatcacatcgtatctgtgcatcacaacaccaaaaccctagattccgatcatgtcttccaagcaaggaggaaaagcaaagccgttgaagcaacctaaggccgagaaaaaagattacgatgagatagacaaagccaaccttcaaaagaagaaggaagaggagaaggctcttaaggaacttagagcaaaagctcaaaagggagcacttgggggtactggtctgaagaaaagtggaaagaaatgaagcttgatttatcgccaaactgaagttgcttatgttgtgatttgtggaatgttgcttaaaatatgtttcgttaattagctgaatatgtttgctagatctacgtggaatcttggataataattatgccgatatctgatgttgatgttataatttttgcttgtttaacatgttaatcgttggaatatacgaaaatggcatctgaata

SEQ ID NO: 1688 - DNA, 422 bp, Euphorbia peplus
gatcgggcaatccctctttgtattcttcttcgactcgggccaaaccctaacgatatctccgccatgtcgtccaagcaaggagggaaagcaaagcctctgaagcaacccaaggttgataagaaagagtacgacgaggttgatctggccaatatgcaaaagaagaaggaggaggagaaggcgatcagggagcttagagcaaaagcccaacagaaggagacctttggaggtgctgggctcaagaaaagtgggaagaaatgagggttcccacgcaaattcatggaggtagattacttgacgacctgaatttgcagacatttaattgctattgaatcagttgattgtctttgtgttccttgtaaaacccttgaaagaagataatatggtgtggaattattatggaagttgaatgcttctcaataaac

SEQ ID NO: 1689 - DNA, 626 bp, Panax ginseng
ccccccccccccccccccccccccctatcccctgtgtgccttgcctcccacgactgggaatataaaaaaggtgcccatacaatttcctaatcctaaggccgataaaaaatccgacctgggttagggccgccttgtcttccatactccgggtcttctttctagatcagaaaaaaccctaaccctagatatcaacaatgtcgtcaaagcaaggtgggaaagcaaagcctttgaagcagcccaaggctgaaaaaaaagaatatgatgaggatgatttggctaaactccagaagaagaaggaagaggaaaagtcactcaaggatctcaaagccaaagctcaacagaagggtgcttttggaggttctgggctaaagaaaagcgggaagaaatgagtcttcaatatcaatagacacggaggcttttgtgtcatgcttctatgatgtattttgtaatttggttggacatcattggtttcatttgtaccaagtttaccgcgtgacttatcctatgcaaaaccataaataaaattatcaacctttaatgtttttagaagaaaaaaaaaaaaaaaaaaaaaaaaaaaaaaaaaaaaaaaaaaaaaaaaaaaaaaaaaaaaaaaaaaaaaaaaaaaa

SEQ ID NO: 1690 - DNA, 518 bp, Vitis vinifera
agacgacgcttcttatcgtggcattagggtgagggcttctacttcgcgattccctctttctgtgatcacaccacaaaccctaaccctagagacaagccatgtcgtccaaagccgggggaaagctgaagcctttgaagcaacccaaggccgacaagaaagaatacgacgaggatgatctggccaaacttcaaaagaaaaaagaggaggaaaaggcactgaaggagcttaaggccaaggctgcacaaaagggcgcatttggaggttctggactcaagaagagtgggaagaaatgaaaacctgagtcataatgcaatatctacttaatatatgcatatgtggtgaatatccttcggtggatgcaattggtctatcgagatgctacattaacttctgaacattttcttatccccagtaaaactgagttgcactgtcatgttctggatattgtactagtaattgatgctgcttgaatctgcttgtggttgctttgagattgatctatgatatcaagtgttatt

SEQ ID NO: 1691 - DNA, 315 bp, Hevea brasiliensis
atctcttcttctttgtcccaatttctctttcgattattcaaatcaagctctaaccctagttaccagccatgtcttctaagcaaggtgggaaagcaaagcccttgaaacaagccaaggttgagaagaaggaatacgatgagactgataaggtcaacattcagaagaaaaaggacgaggagaaggcacttaaggagcttagagccaaggcggcacagaaaggatctttcggaggttctgggctcaagaagagcggaaagaaatgagggttttcaaaccaatatcagaatagaatatatgactcatggcttgtgatta

SEQ ID NO: 1692 - DNA, 572 bp, Zea mays
cgccgctcgcatctcgccagcgcgaacgcagcctccgtgcatatcaccagcctcctcgcgcacccggtcccgcttgcctttccccacctactcgccgtcgcggtgccgtgcgccggtgctgttcagtctagggtttcggccctcgcccgccgatccgtccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgtggctgtgagacaatgttgcctcttgtattccgtgtttcgcggtgttccagttggtttgcttgatccgaagatgtttcagcctctcatctgctagctttgatacacgagttatttgctattatga

SEQ ID NO: 1693 - DNA, 517 bp, Olea europaea
ttttcattgttcaagcgatttcgtgatcacagcgaagcgaaaccctaaccctagatttcagacatgtcttcaaagcaaggtgggaaagcgaagcctttgaaggcgccaaagagtgagaagaaagagtacgacgagaatgacaaggcttttatccagaagaagaaggaagaggagaaggctctgaaggagcttaaatcgaaggctcaaaagggagcacttggaggtgcagggctaaagaaaagtggaaagaaatgaaaatttatgaagaactactagccctttgttgtcattgtaatgcgatctttctatttggtttaaatcaattcagcactacgttcttgcttagattaactatcgagcaacttcttatgaagtttgtgtaaaactatttgtttgggccaataaacgtgcgtggttttgtatatctgagaggctttgatcctgctcttttgtgggttgtcttagtttcatgcttcagtttcaaatgcgtactctgtcgttgactaccactgtctta

SEQ ID NO: 1694 - DNA, 461 bp, Olea europaea
tagggtaaccttttctattgttcaagcgatttcgtgatcacagcgaagcgaaaccctaacccttgatttcagacatgtcttccaagcaaggtgggaaagcgaagcctttgaaggcgccaaagagtgagaagaaagagtacgacgagaatgacaaggcttttatccagaagaagaaggaagaggagaaggctctgaaggagcttaaatcgaaggctcaaaagggagcacttggaggtgcagggctcaagaaaagtggaaagaaatgaaaatttatgaagaactactagccctttgttgtgattgtaatgcgatctttctatttggtttaaatcaattcagcactacgttcttgcttagataaactatcgagcaacttctcataaagtttgtgtaaaactatttgtttgggccaataaacgtgcgtggttttgtatatctgagaggctttgatcctgctcttt

SEQ ID NO: 1695 - DNA, 549 bp, Olea europaea
aattgggctagggtaaccttttcatagttcaagcgatttcgtgatcacagcgaagcgaaaccctaaccctagatttcagacatgtcttccaagcaaggtgggaaagcgaagcctttgaaggcgccaaagagtgagaagaaagagtacgacgagaatgacaaggcttttatccagaagaagaaggaagaggagaaggctctgaaggagcttaaatcgaaggctcaaaagggagcacttggaggtgcagggctaaagaaaagtggaaagaaatgaaaatttatgaagaactactagccctttgttgtcattgtaatgcgatgtttctatttggtttaaatcagttcagcactacgttcttgcgtagataaactatcgagcaacttcttataaagtttgtgtaaaactatttgtttgggccaataaacgtgcgtggttttgtatatctgagaggctttgatcctgctcttttgtgggttgtcttagttttcatgcttcagtttcaatttgttttgcctgaattagcatagattttaaggaggacaaggggtc

SEQ ID NO: 1696 - DNA, 404 bp, Olea europaea
cgatttcgtgatcagagcgaaaccctaaccctagatttcaaccatgtcttccaagcaaggtgggaaagcaaagcctttgaagcaaccaaaggctgacaagaaagagtacgacgaggatgacaaggcttttcttcagaagaagaaggaagaggagaaggctctgaaggagcttaaagcaaaggctcaaaagggagcacttggaggtgctgggctgaagaaaagtggaaagaaatgaaacttaaggaacaaaaaactcctttgttgtcaattgtaacgcgatattaccatttggtttaaaccattttagcatcatgttcttgcttatgctaaactattgagcaacttcctacgaagtttcattgtgtagaactatttgtttggagcaataaacgtgtggttttgta

SEQ ID NO: 1697 - DNA, 556 bp, Olea europaea
ggcaccttttcatttttctaacgatttcgtgatcagagcgaaaccctaacccttagatttcaaccatgtcttccaagcaaggtgggaaagcaaagcctttgaagcaaccaaaggctgacaagaaagagtacgacgaggatgacaaggcttttcttcagaagaagaaggaagaggagaaggctctgaaggagcttaaagcaaaggctcaaaagggagcacttggaggtgctgggctgaagaaaagtggaaagaaatgaaacttaagaagtactacaagaaacaaaaaacgcctttgttgtcaattgtatcgtgatattaccatttactttaaaccagtttagcatgatgttcttgcttatgctaaaccattgagcaactttctacgaagtttcattgtgtagaactatttgtttggagcaataaacgtgtggttttgtatgactgagaggctttgatcctttctggaagccctttttgttgattgtctaagttttcgtgcttcagtttcaatttgttgtgagcgtttgaattagcatatgccttatgctttgttgtt

SEQ ID NO: 1698 - DNA, 515 bp, Zea mays
gtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtga

SEQ ID NO: 1699 - DNA, 648 bp, Setaria italica
gcggccgcctgcacgcaacctttcggtccgtctatctataaacgccgttcgctcgcccacctcgcccgtctccagccgcagtctcgcttgcctttccccacctcccccgtcgccgcggcacccgccagctagggtttcgtgccccgctcgccgatccgccccgtccgccatgtcgaaacaaggagggaaggccaagccgttgaaggcgcccaaggtcgacaagaaggagtacgacgagtctgatcttgcgtatctgcagaagaagaaagatgaggaaaaggcgctgaaagaactgaaggccaaggcacagaagggtgcgattggcggctctggcctgaagaaaagtgggaagaaatgagtctgttacttgggaaatgataaatcttctgcctatatgtgctgtggttcaccaaatgtgattgtaacaaaactattttaagtgggttctgtgttagtaatgttgcagtcagttgcttgatccgaagatgatgttggctatgatgcagatggttctatgataataacatggcattctaagatgttgtcttcttaatttatttgtgctgatttttcttttccatttacatcccttcctcagtaagcaggctatttgctccatccgtttttatgtgaacctatctggcccca

SEQ ID NO: 1700 - DNA, 758 bp, Eragrostis curvula
ggcccccccggtgtcggcagcactcgtgtatttaacgccgttctctcgcgcaccttggccgtcttgtctcgtctcgctctcgcttcgcctttcccctcgcctcgtcgccgcggcgctctaccactagggtttcgttcctccgccgatccaccccgtccgccatgtcgaagcaaggagggaaggccaagccgctgaaggcgcccaagaccgataagaaggagtacgacgagagtgaccttgcgtacttgcagaagaagaaagatgaggaaaaggcactgaaggagctgaaggccaaggcccagaagggtgcgattggaggctctggtctcaagaagagtggcaagaaatgagtcttgctacccatcaataactacctagaaaattattatctaagctgcctatctgtattgggctttgcatatgtgactgtaacaatgccaccttgagtgctttctgtgcttagcaaatgttgcagctggttgtttgatctaagatgtttcagcctctctgctagctatgatacagatggtttcgtgatgataataatctggcattctatgatggaagcatgaaaactgttttccaacgaaaaaaaaaaaaaaaaaaaaaaaaaaaagtactcggggttgaaacccgggtttaaccccaagggaattccgggcccccggggggtcaaccattggggaaaccccccaccgcgtgggaggcatagctggaatattcaatagggcccccaaaatagttgggcgaaaccgggg

SEQ ID NO: 1701 - DNA, 1418 bp, Sorghum bicolor
gcccacgcgcacccgattcccccgcttgcctttccccacctgtcgcggcgctcgccagtctagggtttcgccccccttcgcccgccgatccgcccccgccggccatgtcgaagcaaggagggaaggccaagccgctgaaggcgcccaaggtcgacaagaaggagtacgacgagagtgatcttgcttatttgcagaagaagaaagatgaggaaaaggcactgaaggagctgaaggccaaggcacagaagggcgcaattggaggctcgggtctcaagaaaagtggaaagaaatgagcctggtcacctgtctctaatacttagagaatgataaggtggctgcttatctgtgttgcgcttcactatatgtgattgtaaccgtgctacctattgtgttctgtgttttgcaaattgcaatgttgcagttggttgcttgatccgaaaatgtttcagcctcgcatctgctatctatgaaactgatggttccctgataataatgatgacattatgtgatggatgccacaagcctacaacacaagtttttttcttttagatatttcagtttctgggtagttttatcttgatcccaactaggaatgggaagtcactctttggcctggcctgcactcgagtgagaatcaattttctgtgtggtagtgccgaagaatacatacaccagcaggggcaagataaattcggtgctctatctataacatcttcactttacacaacaatttctttctgatagtgaccgtcccaattgtgtatctatttactctagtgattgtaggcgatgttaaacaaagtatacacatccttgttcgtttggctgataagtcgtggcagaaagtactattgactgatttattatgagaaaaaaaacactgctaaatagctgtcagattcgactgataagcctatacgaacaaggcaatcacttgcttgcatccctggcagtctggcacagatgtttgcatctggatctttgaatccttttgtggtagttttacagctgcttggtctacttctgttcgtgtttacctaataatcctaacaaggtgtttccgtttgctatatactactctgcagatgaagcacgtctttcagggctagtgtacaaagaagagagtagtgatgaaaaagacatcatatagggccttgtttagttccgaaatttttttggttttcgggactgtaacactttcgtttttatttgactaacattgttcaatcatgtaataactaggcttaaaagattcatctcgcgatttacaagaaaactgtgcaattagtttttattttcgtttatatttagtgctccatgtatgacccgtaagattcgatgtgacggagaatctcgaaaagttttttgtttttggtgtgaactaaacaaggcttagtactagtgaaagcagacgttag

SEQ ID NO: 1702 - DNA, 596 bp, Panicum virgatum
ggtccgcgatcttatacgccgttcgctcgcccacctcgccccgtctcctcccgcagtctcgctcgctcgcctttccccacacagctagggtttcgtcgccccgcgcgccgatccgccccccgcccgccatgtcgaagcaaggagggaaggccaagccgctcaaggcgcccaaggccgacaagaaggagtacgacgagagtgatcttgcatatctgcagaagaagaaagaggaggaaaaggcactgaaggatctgaaggccaaggcacagaagggtgcgatcggaggctctggcttgaagaaaagcgggaagaaatgagtctgtcatgcgtatctgggaaatgataaaccccctgccttatgtgctgtgtttggccatatgtgattgtaacaaactagtggttctgtgttagtaatgctgcagttggttgcttgatccgaaaagatgatgttggctatgatccgaaaacatggcattctaagatgttatctcaaattttctgtgctgattttgttttcattgccatttcgtcctaacctgacttattcgctccttgaagttttaagtaaactgatctggcatctgtgttaaattttc

SEQ ID NO: 1703 - DNA, 809 bp, Panicum virgatum
acgataaacctggataagtatgcggtcacatgatccgtgctcaagttcaactttgggcttattatcaaaaaaaaatcacctttgggctttggatgggcacacggctcgaaatactgacaaatacagcccagagagtgatgggccgacggattccatggtaagagaatctcagcccatttgggtacattacacgccagaggaaagcccggcccgagctccgtgccaaggttcccaatttcccatgcggtcggcccctcgcggatggcgtctcgtgcacgcgaccttgcggtccgtcgatctatatacgccgttcgctcgccccgtcccgtctccagcagtctcgctcgctcgctcgcctttccccacctcccccctcgtcgccgcggcgcccgccagctagggtttcgtgcccccgcgccccgatccgccatgtcgaagcaaggagggaaggccaagccgctcaaggcgcccaaggtagacaagaaagagtacgacgagtctgatcttgcgtatctgcagaagaagaaagaggaggaaaaggcactgaaggatctgaaggccaaggcacagaagggtgcaatcggaggctctggcttgaagaaaagcgggaagaaatgagtctgttatgtgtatctgtgatacttgggaaatgataaacctcctgccaatatgtgctgtcttttggccatatgtgattgtgacaaaactagtggttctgtgttagtaatgctgcagttggttgcttgatccgaaaagatgatgttggctatgatgcaggtggttctatgataataacaaggcattctaag

SEQ ID NO: 1704 - DNA, 665 bp, Zostera marina
tcgggctcgattttcaatgtatggtgtcggatttaatatttgggtcgaagatcgcctatttttctatttaatctcttgaaagttcaagcaataccaaaaatttacgttatcgcgactttactcatttcagattagggtttcattttttcccctccctctctcaagcgatcatgtcttccaagcaaggtggtaaagcgaaacctttgaagcagcccaaggcaaaaggaaaggagtacgacgagactgatcttgccaatcttcagaaaaagaaagatgaagaaaaggcattgaaggagctgaaggcaaaggcatcgcagaagggttcttttggtggagctggtcttaagaagagtggaaagaaataagcgtgcttcctcttatttattgtattgtattaataatcccatataaatcataaacgccacatttatgatttagcaaatataaatcctcaagtcctgaacgttgtctgtctgctttttgttctttaaaatttcgtacatatcagtatatgactattattttttagtagttttgttttataatgttggtacctacctagtttataagtgttcgtcttttatttttgtttggcaattattttgtttgtaattctgaaggttaatatttttgtattccagttttaagttttatgagtagttgac

SEQ ID NO: 1705 - DNA, 558 bp, Euphorbia esula
ggcgaattagggttagctctatcttcgtctcttctccagtttctctgaattcttcgaatcaaactcttaaccctaagcagtagccatgtcttctaagcaaggtggaaaagcaaagcctttgaaggcacccaaggctgcaaagaaggaatacgacgaggatgatttggccaacattcagaaaaagaaggaagaggagaaggcacttaaggagcttagagccaaagcacagaaaggacctattggaggtgctggccttaagaagagtggaaagaaatgagggttttcaaaacccataatcaaatatagctatcgattggcttgttataatagattattttgaccatattttcctctgtttaacatgaatgattgggtaccgacaatgtggaattgtatgagtttgagttaatgtgatcctcaataatattgtactgtctccatgtgtgtgttcttgtgctctttcgaaattttaatcatttgcattttgtggttagacttggtgatggttcagtctaagattgatcttagcttataaatagatctaagtttgtggttatc

SEQ ID NO: 1706 - DNA, 655 bp, Cichorium intybus
taatttttcttgttttggttctgtcaaagtcctttcccgaaacacaaccggggtaatgtgggaaatcgtgtctgtcttgcctataaataaggtcgggggttttttggaacaatcagaagttcgcgttcgggttaggttatatttcatttccaagtctgcgtatttgtttctagcatcaaaccctaatataaattccaattatgtcgtccaagcaaggaggaaaagcaaagccattgaagcaacccaaggctgagaagaaagaatacgacgaggtagataaggccaacattcaaaagaagaaggacgaagaaaaggcactcaaggagctaagagccaaagctcagaagggagcattgggaggtactggtctgaagaaaagtggaaagaaatgagaagttgcttcatatactactatgttgtgatatgtgaatcttgcatttaatatccatggttatttaactaaatgtatttgctaaattcagtataaaccttttgcagtttgcctgtaataatcagttaatcatggtgatatttggtctagatattgtttaggctgtgctgatcccgtcataatctggaactggttatattttgtttggctctgggttcttgattttttaaaaaaggaggctttagggtgttggttgtcggttca

SEQ ID NO: 1707 - DNA, 431 bp, Musa acuminata
atcggacatcaaaaattggggttcgctttcccttcctgttcgaagcagccatgtcgtcgaagcaaggtggaaagttgaagcccctgaagcaacctaaatccgataagaaggagtacgatgagacggatttagcaaacctccagaagaaaaaagatgaggagaaggcaatgaaggagctcagggccaaggcatcccagaagggatcatttgggggtacaggtctcaagaagagtgggaagaaataatgttcttcctactgtactgctaatataatgtttgtccaccttttcttggattctgattcctatgtggtgataagtagtacttaagatgctctatcagattccgaagcaagtcatgatatgagattgtactgtttgagtctcagctaggccttgtcctatgcatcattttaaattatatattcccca

SEQ ID NO: 1708 - DNA, 869 bp, Ananas comosus
aggcctgcacctccaaagcttcccttctgcgaagccttggccccttttcctctcgcccttttcctcgtctttgtgcgattagggtttgcttcgtctcttcgtcctcctcgtgcatccgcttcttcgtcaaccatgtcgtccaagcaaggtggaaagttgaagcccttgaagcaagctaaggctgataagaaggaatacgatgagacggatctagcaaacatccagaagaagaaagatgaggagaaggctttgaaggagctgagggccaaggcttcgcagaagggaagctttggaggtgcaggccttaagaagagtgggaagaaataagaaagacaagcgtactccctctctctctctctctctctctctttcgcgcactctctatctcttgtaatagtaaatcaatgacttagatctggggtttatcatcgctattgcatgttagctctatgattggaaaacaactactggcatcgctggtgtgatcattttctgtatctgcctgttttcaggagttggtacactccctatctattaagtttctggtatatcctgtggtctctttgtttcttccatttaagcgtgtttgtttcaaagcgaaataattgcctcatgtagcgtcatctcgacatgagccgtactaatagttggtgattattactttcttgtttgtggatggtaaggttgctgttaattcgagcttgttgttactccctactttgcatctcttttcttaaccttctaacttcctggggcgttttaggatgggtttgtagattggatggaataagtcaagagagcaatgtctgggtaaggaatttttatcgatttcgtcctcttttgacttttgatgtctctgagttgctctg

SEQ ID NO: 1709 - DNA, 581 bp, Cichorium intybus
aaaccgcgtagatcaaaagtcgtaatttaccctaaaaaatgttatcaaaacaaagcaatcccaagcaataaataagccaaccttactttcccaaaaccagcaaagatttcttcccgtcgcgcatctctacggatcagagcaaaccctaaccctagatccgatcatgtcgtccaagcaaggtggaaaagcgaagccattgaagcaaccaaaggctgaaaagaaagaatacgatgaggtcgataaggccaacattcaaaagaagaaggatgaggaaaaggcacttaaggagcttagagctaaagctcaaaagggagctttggggggtactggtctcaagaagagtgggaagaaatgaggcatgcagaagtgaaggaattatgtcttttatatgactaatgatatgctaagttctgtatcaagtcttctgtgactgttcttgtgtagaattcaagatttggtattgttgttttctacttgtacttgtttatggaggtattgttgatttgcatggaattctattgaaacacacatttgcaccaaataaccaaaggccgttcatgggtagggtcttgatctgtgcc

SEQ ID NO: 1710 - DNA, 2001 bp, Glycine max
aggtgtgtggagttagggctttacagtgtttctcttccttcttcttcttcttcttcttcttcttcgttgaatcgcgattgttctgtgcgagagaaagaagagagagatcgaaaatggcgttggctttcgacgagttcggaaggccgttcataatcctgaaggagcaggagcagaagagcagactccgaggattggacgctcagaaagccaacatctccgccggcaaagccgtggctcgcatcctccgaacctccctcggccccaaaggcatggacaagatgctccagagccccgacggcgacgtcaccatcacgaacgatggagccacgatccttgaccagatggacgtggacaaccaaatcgcgaagctgatggtggagctctcgcggagccaggactacgaaatcggcgacggaaccaccggcgtcgtcgtcatggccggcgcgcttctcgagaaggccgagcgcctcctcgagcggggaattcaccccatcaggatcgccgagggttacgaaatggcgtccaggatcgccgtcgagcatctcgagcgcgtcgccaacaagttcgagttcgacgagtctaatttggagcccctcattcaaacttgcatgaccacactctcctccaaaattgtgaatcgctgcaagcgtagcttggctgagattgctgttaaggctgttcttgctgttgctgatctggcgaggaaggatgttaatttggatctgattaaagtggaagggaaagttgggggtaaattggaggataccgagttgatctatggaattgttgtggacaaggatatgagtcatcctcaaatgcctaagcaaattgaggatgctaaaattgctatcctcacttgcccctttgagcctcccaagccaaagaccaagcataaggttgatattgatacagtggagaagtttcagacgttgaggttgcaggaacagaagtattttgatgacatggttcagaaatgcaaggatgtgggtgcaacccttgtcatttgccaatggggttttgacgatgaagcaaatcatctcttaatgcacaggaacttgcccgctgtcagatgggttggtggtgtagagttggaattgatagctatagcaactggtggaagaattgttcctaggttccaggagttatctccagaaaagttgggaaaggctggtatggttcgagaaaagtcctttggtacaacaaaagaccgaatgctgtacattgaacattgtgcaaattcaagggctgtaaccatattcattcgtggaggtaacaaaatgatcatagaggagacaaagcgcagccttcacgatgccttgtgcgtggctaggaatcttatccgcaacaattctattgtatatggtggtggttcagctgagatttcttgctctatagccgtggaggcagctgctgatagataccctggagtagaacagtatgctattagagcatttggggatgctttggaggccatcccaatggcccttgctgaaaatagtgggctgcaaccaattgaaacattatctgctgttaagtctcagcaaataaaggataataaccctcactttggcattgattgtaatgatgttggcactaatgacatgcgtgagcaaaatgtcttcgaaactttgatcggaaagcagcaacagctcttacttgctactcaagttgtcaagatgatactgaaaatcgatgatgtcatttccccatatgagtactgatatttttaaactcagtcatgttatacgtcaagatgctaattggtgatagtattttgtttcaattggtttgtttgtagtcagtccgtacgctcacttgaaatgtaagattttggcccggtttgtatcggaattgggtgtttttgttttgttgcaattgctatgcttttgatattgatcattatggattagttgtttttgtagatgttttaatctttgtttgtaggcggaatgaaaatttgtcttagttcgtagtcttattttgggctctgtaaaatggttg

SEQ ID NO: 1711 - DNA, 2004 bp, Phaseolus vulgaris
atagtagaaggttggggttagggcttaagagtgtttttgctctttcttattcttcttccatttcttcttcttcttcttcgcgatcgttcgttctctgcaagagataaagaagagatcgatcgatcgaaatggcgttggctttcgacgagttcggaaggccgttcataatcctgaaggagcaggagcagaagagcagactccgaggtttggacgctcagaaatcgaacatatccgccggcaaagccgtcgcgcggatcctccgcacctccctcggcccgaaaggcatggacaagatgctccagagccccgacggcgacgtcaccatcaccaacgacggcgccaccatcctcgagcagatggacgtggacaaccaaatcgcgaagctcatggtggagctttcgaggagtcaggactacgaaatcggcgacggcaccaccggtgtcgtcgtcatggccggcgcgcttctcgagaaggcggagcgcctactggagcggggaattcaccccatcaggatcgccgagggttacgaaacggcgtctagaatctcggtcgagcatctcgatcgcgtggccaacaagttcgagttcggcgagtccaatttggagcctctcattcaaacctgcatgaccacactctcctccaagattgttaatcggtgcaagcgtagcctggctgagatcgctgttaaggctgttcttgccgttgctgatctggagaggaaggatgttaatttggatctgattaaggtggaagggaaagttgggggtaaattggaggacactgagttgatctatgggatagttgttgataaggatatgagccatcctcaaatgcctaagcaaatcgaggatgctaatattgctatcctgacttgcccgtttgagcctcccaagccaaagactaaacataaggttgacattgacacagtggagaagttccagacgttgagggtgcaggaacagaagtattttgatgaaatggttcaaaaatgcaaggatgttggtgcaacccttgtcatttgtcaatggggttttgacgatgaagcaaatcatctcttaatgcacaggaacttgccagctgtcagatgggttggtggtgtagagttggaattgatagctatagcaactggtggaagaattgttcccaggttccaggagttaactacagaaaagttgggaaaggctggcattgttcgtgaaaagtcttttggtacaacaaaagaccgaatgctgtacattgaacattgtgcaaactcaagggctgtaacaatattcatccgtggaggtaacaaaatgatcatagaggaaacaaagcgcagccttcatgatgccttgtgcgtggctaggaatcttatccgtaacaattctattgtatatggtggtggctcagctgagatttcctgctctatagctgtcgatgctgctgctgatagataccctggagtggaacagtatgctattagagcatttggggatgctttggaggccatcccaatggccctcgctgaaaatagtggcctccaaccaattgaaacattatccgctgttaagtctcagcaaataaaggataataaccctcactttggaattgattgtaatgatgttggcactaatgacatgcgtgagcaaaatgtctttgaaactttgatcggaaagcaacaacaaatcttactcgctactcaagttgtcaagatgatattgaaaattgacgatgtcatttccccatctgattactgatattagtcagtcacgttctacatcaagattctgaattttgcttgtattttgtttgatcggtttgattgtagtcacagtccgtatgtgcacttgaaatgtaagattttagcccggtttgtatcggagttggactgctgtttttgtttatttaaagcaattgttttcttttgatctttagaacattatggattagttgtttttgtttatagacattttaacagttgtttttaggccgactaaaattttgtgatctcagtcttatttttgg

SEQ ID NO: 1712 - DNA, 1940 bp, Arachis hypogaea
gagggttagggctttttttcctccaaaaacggagagagaaacacaagaaccaccaaaagcaacttcacacacacacacacagagtaaccttctgcactgttcgcgtctcttcactctctccgccaaatctcgaagattcaaagaagatcgtgtgagagagagagagagagttgagaaatggcgctggctttcgacgagttcgggaggccgttcattatactgaaggagcaagaacagaagagcagactgagaggactcgatgcacagaaggccaacatctccgccggcaaagccgtcgcccgcatccttcgcacctcccttggccctaaaggcatggacaagatgctccagagccccgacggcgacgtcatcatcacgaatgatggagcaacaatcttggagcagatggatgttgacaaccagattgctaaactgatggttgagctgtcccggagtcaggattatgaaattggggatggaactactggagttgttgttatggctggagctcttctggagcaagctgagcggctcttggaacgtggaattcatccaattagggttgccgagggctatgaaatggcatcgaggattgctgttgaccacctggagaatattgctaaaaagtttgaatttgggcctacggatttggagcctttgattcaaacttgtatgactactttgtcctctaaaattgtgaatcggtgcaagcgcagcttggctgagattgctgtcaaagctgttcttgctgttgctgatctagaaaggaaagatgttaacttagatctaattaaagtagaagggaaagttggtggtaaattggaggatactgagttaatatatggaattgttgttgacaaggatatgagccatccacaaatgccaaagcgaattgaagatgctaaaattgcaatcttgacttgcccctttgagcctccaaagccaaagactaagcataaggtggacattgataccgttgagaagttccagacattaaggaaacaagaacaacagtattttgatgacatggttcaaaaatgcaaggatgttggtgcaaccctggttatctgccagtggggctttgacgatgaagcaaatcatctcttaatgcacaggaacttgcctgctgtcagatgggttggtggtgtagagttggaattgatcgcaattgcaacaggtggaagaattgtgcctaggttccaagagttgagtcctgaaaagctgggaaaggctggtgtggttcgagaaaaatcctttggtacaacaaaagaccggatgctgtacattgagcattgtgcaaactcgagggctgtgacaatattcactcgtggaggtaacaaaatgatcatagaggagacaaagcgcagtcttcatgatgccttgtgtgtagctaggaatctcatccgcaacaattctatagtatatggtggtggttctgctgaaatttcctgctctattgctgtggaagctgctgctgatagataccctggagtagagcagtatgctatcagagcatttggagatgcattggaggccattccgatggcccttgctgaaaatagcggccttcaacctattgaaacgttatctgctgtgaagtcccagcaaataaaggacaataatcctaactttggcatcgactgcaatgatgttggcaccaatgacatgcgtgagcaaaacgtatttgaaactttgattggaaagcagcaacagatcttgcttgctactcaagttgtcaagatgattttgaaaattgatgatgttatttccccatcagagttctgaaactaaagttttcaactgatgttttccacatcaagatcatggattgctgatagttttgttttttatttggtttttgtcagagttggtatgttcacagtttacctgttaaaaatttatgtaagaatttgacatgattttatattcgagttgagtga

SEQ ID NO: 1713 - DNA, 1793 bp, Arachis hypogaea
gggggaggggtttaggggcttttttttcctccaaaaacggagagagaaacacaagaaccaccaaaagcaacttcacacacacacacacagagtaaccttctgcactgtttgcgtctcttcactctctccgccaaatctcgaagattcaaagaagatcgtgagagagagagatagttgagaaatggcgctggctttcgacgagttcgggaggccgttcattatactgaaggagcaagaacagaagagcagactgagaggactcgatgcacagaaggccaacatctccgccggcaaagccgtcgcccgcatccttcgcacctcccttggccctaaaggcatggacaagatgctccagagccccgacggcgacgtcatcatcacgaatgatggagcaacaatcttggagcagatggacgttgacaaccagattgctaaactgatggttgagctgtcccggagtcaggattatgaaattggggatggaactactggagttgttgttatggctggagctcttctggagcaagctgagcggctcttggaacgtggaattcatccaattagggttgccgagggctatgaaatggcatcgaggattgctgttgaccacctggagaatattgctaaaaagtttgaatttgggcctacggatttggagcctttgattcaaacttgtatgactactttgtcctctaaaattgtgaatcggtgcaagcgcagcttggctgagattgctgtcaaagcagttcttgctgttgctgatctagaaaggaaagatgttaacttagatctaattaaagtagaagggaaagttggtggtaaattggaggatactgagttaatatatggaattgttgttgacaaggatatgagccatccacaaatgccaaagcgaattgaagatgctaaaattgcaatcttgacttgcccctttgagcctccaaagccaaagactaagcataaggtggacattgataccgttgagaagttccagacattaaggaaacaagagcaacagtattttgatgacatggttcaaaaatgcaaggatgttggtgcaaccctggttatctgccagtggggctttgacgatgaagcaaatcatctcttaatgcacaggaacttgcctgctgtcagatgggttggtggtgtagagttggaattgatcgcaattgcaacaggtggaagaattgtgcctaggttccaagagttgagtcctgaaaagctgggaaaggctggtgtggttcgtgaaaatcctttggtacaacaaaagaccggatgctgtacattgagcattgtgcaaactcgagggctgtgacaatattcactcgtggaggtaacaaatgatcatagaggagacaaagcgcagtcttcatgatgccttgtgtgtagctaggaatctcatccgcaacaattctatagtatatggtggtggttctgctgaaatttcctgctctattgctgtggaagctgctgctgatagataccctggagtagagcagtatgctatcagagcatttggagatgcattggaggccattccgatggcccttgctgaaaatagcggccttcaacctattgaaacgttatctgctgtgaagtcccagcaaataaaggacaataatcctaactttggcatcgactgcaatgatgttggcaccaatgacatgcgtgagcaaaacgtatttgaaactttgattggaaagcagcaacagatcttgcttgctactcaagttgtcaagatgattttgaaaattgatgatgttatttccccatcagagttctgaaactaa

SEQ ID NO: 1714 - DNA, 1946 bp, Trifolium pratense
ccataaagaagaagttagaagctatagcaaatagcaacttcactctcagtctctttctctgtttttagggttctacacttttctcattttcccgatcccattttctgagatttttcaatcggaaacaacaccataaggtttccgatcttgatcgtgtaaccacaatggcgttggctttcgacgagttcggaagacctttcataattctcagagaacaagaaaacaaaaataggcttcgtggtctcgatgctcagaaagctaacatctccgccggtaaagccgtcgctcgtattctccgtacatctctcggtcctaaaggcatggataaaatgcttcaaagccccgacggtgacgtcatcatctcaaatgatggagcaacgatattggaacagatggatgtagacaatcagattgcgaagctgatggtggagttgtcgaggagtcaggactatgaaattggtgatggtactactggagttgttgttttggctggatctcttcttgagcaagctgagagacttttggaacgtggaattcatcctattaggattgctgagggatatgaaatggcttcaaggattgctgttgagaatctcgaacggattgctaataagtttgaatttggggagactattttggagcctttgattcagacttgtatgactacgttgtcatcgaagattgtgaatcggtgcaagcgtagcttggctgagattgctgtcaaagctgttcttgctgttgctgatctagagaggaaagatgttaacctggatctaattaaagtagaagggaaagttggtggaaagttagaagatactgagttggtatatggaatcattgttgacaaggatatgagccatcctcaaatgccaaagcaaatcgaagatgctaaaattgctatcctgacttgcccatttgagcccccgaagccaaaaaccaagcataaggttgatattgatacagtggagaagtttcaaacattgaggaaacaagaacagaaatattttgatgacatggttcaacaatgcaaggatgttggtgcaacccttgttatttgccaatggggttttgatgacgaagcaaatcatctcttgatgcacaggaacttacctgctgttagatgggttggtggtgttgagttggaattgattgccatagcaacaggtggaagaatcgtacctaggttccaggagttaactgcagaaaagttgggaaaggctggtattgttagagaaaaagcatttggaacaactaaagaccgaatgctgtacattgagcattgtgcaaactcaagggctgttacaattttcattcgtggaggtaacaaaatgatcattgaggagacaaagcgcagtatacacgatgcattgtgtgtggccaggaatcttattcgcaacaattcaatcgtgtatggtggtggttcagctgagattgcgtgctctattgccgtggaggccgcagctgataaataccctggagtagaacagtatgccattagagcttttggggatgctttggagtctatccctatggcccttgctgaaaatagtggcctccaaccaattgaaacgttatctgctgtgaagtctcaacaaataaaggacaataatcctcactttggcattgattgcaatgatgttggcaccaatgacatgcgggagcaaaatgtctttgaaactttgattggaaagcagcaacagatcttgctcgctacccaagttgtcaagatgattttgaaaattgatgatgttatttccccatccgagtactgatatatctatttttgaactcatgttgcatgtcaaaatgtagaattgctgatggtattttgttctgttggtatgattttaggcatagtttgtattttaacttgaagtatttacattaagattttggcacgattttgtatcggagttgagtgactgttcctttttcccgacaaagga

SEQ ID NO: 1715 - DNA, 2069 bp, Trifolium pratense
aagctatagcaaatagcaacttactcactcactcactcacagtctgtttcatagtttttagggttctacacatttctcatttttccgatcgcagtttctgagatttatcgaccgaaaaacaacaccataaggtttccgatcgtgatcgtgtaaccacaatggcgttggctttcgatgagttcggaagacctttcataatcctcagagaacaagaaaacaaaaataggcttcgtggtctcgatgctcagaaagctaacatctccgccggtaaagccgtcgctcgtattctccgtacatctctcggtcctaaaggcatggataaaatgcttcaaagccccgacggtgacgtcatcatctcaaatgatggagcaacgatattggaacagatggatgtagacaatcagattgcgaagctgatggtggagttgtcgaggagtcaggactatgaaattggtgatggtactactggagttgttgttttggctggatctcttcttgagcaagctgagagacttttggaacgtggaattcatcctattaggattgctgaagggtatgaaatggcttcaaggattgctgttgagaatctcgaacggattgcgaataagtttgagttcggggagactattttggagcctttgattcagacttgtatgactacgttgtcatcgaagattgtgaatcggtgcaagcgtagcttggctgagattgctgtcaaagctgttcttgctgttgctgatctagagaggaaagatgttaacctggatctaattaaagtagaagggaaagttggtggaaagttagaagatactgagttggtatatggtatcattgttgacaaggatatgagccatcctcaaatgccaaagcaaatcgaagatgctaaaattgctatcctgacttgcccatttgagcccccgaagccaaaaaccaagcataaggttgatattgatacagtggagaagtttcaaacattgaggaaacaagaacagaaatattttgatgacatggttcaacaatgcaaggatgttggtgcaacccttgttatttgccaatggggttttgatgacgaagcaaatcatctcttgatgcacaggaacttacctgctgttagatgggttggtggtgttgagttggaattgattgccatagcaacaggtggaagaatcgtacctaggttccaggagttaactgcagaaaagttgggaaaggctggtattgttagagaaaaagcatttggaacaactaaagaccgaatgctgtacattgagcattgtgcaaactcaagggctgttacaattttcattcgtggaggtaacaaaatgatcattgaggagacaaagcgcagtatacacgatgcattgtgtgtggccaggaatcttatccgcaacaattcaatcgtgtatggtggtggttcagctgagattgcgtgctctattgccgtggaggccgcagctgataaataccctggagtagaacagtatgccattagagcttttggggatgctttggagtctatccctatggcccttgctgaaaatagtggcctccaaccaattgaaacgttatctgctgtgaagtctcaacaaataaaggacaataatcctcactttggcattgattgcaatgatgttggcaccaatgacatgcgggagcaaaatgtctttgaaactttgattggaaagcagcaacagatcttgctcgctacccaagttgtcaagatgattttgaaaattgatgatgttatttccccatccgagtactgatatatctatttttgaactcatgttgcatgtcaaaatgtagaattgctgatggtattttgttctgtcggtatgattttaggcatagtttgtattttagcttgaagtatttacattaagattttggcacggttttgtatcggagttgagtgactgttcctttttcccgacaaaggccgactgctcttttgattgatgctttattttttgttcaatttgaatattatgaattccttttattatgtcaatattgagtagcatcacaggatcatgttcattcaggatctcaccacatggtgagatcag

SEQ ID NO: 1716 - DNA, 2302 bp, Trifolium pratense
ccataaagaagaagttagaagctatagcaaatagcaacttcactctcagtctctttctctgtttttagggttctacacttttctcattttcccgatcccattttctgagatttttcaatcggaaacaacaccataaggtttccgatcttgatcgtgtaaccacaatggcgttggctttcgacgagttcggaagacctttcataattctcagagaacaagaaaacaaaaataggcttcgtggtctcgatgctcagaaagctaatatctccgccggtaaagccgtcgctcgtattctccgaacatctctcggtcctaaaggcatggataaaatgcttcaaagccccgacggtgacgtcatcatctcaaatgatggagcaacgatattggaacagatggatgttgacaaccagattgcgaagctgatggtggagttgtcgaggagtcaggactatgaaattggtgatggtactactggagttgttgtgttggctggatctcttcttgagcaagctgagagactgttggaacgtggaattcatcctattaggattgctgaagggtatgaaatggcttcgaggattgctgttgagaatctcgaacggattgccaataagtttgaatttggagagactattttggagcctttgattcagacttgtatgactactttgtcatcgaagattgtgaatcgatgcaagcgtagcttggctgagattgctgtcaaagctgttcttgctgttgctgatctagagaggaaagatgttaacctggatctaattaaagtagaagggaaagttggtggaaagttagaagatactgagttggtatatggaatcattgttgacaaggatatgagccatcctcaaatgccaaagcaaatcgaagatgctaaaattgctatactgacttgcccatttgagcccccgaagccaaaaaccaagcataaggttgatattgatacagtggagaagtttcagacattgaggaaacaagaacagaaatattttgatgacatggttcaacaatgcaaggatgttggtgcaacccttgttatttgtcagtggggttttgatgacgaagcaaaccatctcttgatgcacaggaacttacctgctgttagatgggttggtggtgttgagttggaattgattgccatagcaacaggtggaagaatagtacctaggttccaggagttaactgcagaaaaattgggaaaggctggtatcgttagagaaaaagcatttggaacaactaaagaccgaatgctgtacattgagcattgtgcaaactcaagggctgtaacaattttcatccgtggaggtaacaaaatgatcattgaggagacaaagcgcagtatacacgatgcattgtgtgttgccaggaatcttattcgcaacaattcaatcgtgtatggtggtggttcagctgagattgcgtgctctattgccgtggaggctgcagctgataaataccctggagtagaacagtatgccattagagcatttggagatgctttggagtctatccctatggcccttgctgaaaatagtggtctccaaccaattgaaacgttatctgctgtgaaatctcaacaaataaaggataataatcctcactttggcattgattgcaatgatgttggcaccaatgacatgcgggagcaaaatgtcttcgaaactctgatcggaaagcagcaacagatcttgctggctacccaagttgtcaagatgatattgaaaattgatgatgttatttccccatctgagtactgatatatctatttttgaactcatgttgcatgtcaagatgtagaattgccgatggtattttgttctgttggtatgattttaggcatagtttgtattttaacttgaagtatttacattaagattttggcacgacgtttttgtattggagttgagtgactgttccttttttctgacaaagggcgactgctcttttgattgatgctttattttttgtttaatttgaatattatgaattccttttatcatgtcaattttgagttgtattgcaggatcatgtttgttctggatctcaccacctggtgagatcagagtggttcgtgaggaaaaccatacaattgcttcatggtttgagcttgcagatgttaagtttgatattaaaggatatttttgtttgtatgtagtattttgatattgcacgtctaattaagtcttacaaattacatgtatcatgtatgtattctagaaaacagtacggtaagatacataaatggagtgtaataatttaactcatcaacagaagttcattattagtt

SEQ ID NO: 1717 - DNA, 2022 bp, Lupinus angustifolius
acttgaaaactcagaaaaaggtgggaaccataagactctgtgttccaaaatctgagtatacttttctccttccttcagtaaccttatttctacactcttcttcttcagcaacatcaccatcattttctttcccattggttccttcatcgccatcatcacaaaatggcgttggctttcgacgaatacggaaggcccttcattattttaaaggaacaggaacagaagagtaggctaagaggtctcgatgctcagaaatctaacatctccgctggcaaagccgttgctcgcattctcagaacctcgcttggccctaaaggaatggacaaaatgctttctagtcccgacggtgacgtcaccatatcaaatgatggtgcaacaatcttggagcagatggatgttgacaatcaaattgcaaagctgatggttgagctgtctaggagtcaggactatgaaatcggtgatggcaccacaggagttgttgtgctggctggagctcttcttgagcaagctgagaagcttttagaacgaggaattcatccaattagggtcgctgagggctatgaaacagcatccagaattgctgttgaacatctagaacatgtagctaacaagtttgaatttggagtgacggatttggagcctctgattcaaacttgtatgactactttgtcttcaaaaattgtgaatcggtgcaaacgtagcttggctgaaattgcagtcaaagctgttcttgctgttgctgatctagagagaaaagatgttaacttagatttaattaaagtagaaggaaaagttggtggtaaattggaagatactgagttaatatatggaattgttgttgacaaggatatgagccatccccaaatgcctaagcaaattgaagatgctcaaattgctatcttaacttgcccctttgagcctccaaagccaaagactaagcataaggttgatattgatacagtggagaagttccagacattaaggaagcaagaacaacagtattttgatgacatggttcaaaaatgcaaggatgtgggtgcaaccttggttatctgccaatggggttttgatgatgaagcgaatcatctcctaatgaacaggaacttgccagctgtcagatgggttggtggtgttgagttggaattgatagctatagcaacaggtggaagaatagtgcctaggttccaggagttaactccagaaaagttgggaaaggctggtctggttcgagagaaatcctttggtacaaccaaagaccgaatgctgtacattgagcattgtgcaaattcaagggctgtaacaatattcattcgtggaggtaacaaaatgatcatagaggagactaagcgcagtatacatgatgccttgtgtgtggctaggaatctcatccgcaacaattctattgtatatggtggtggttcagctgaaatttcctgctctattgctgtggaggcagctgctgataaacaccctggagtggaacagtatgctatcagggcattcagagatgctttagagtatatccctatggcccttgcagaaaatagtggcctccaaccaattgaaacgttatctgctgtgaagtctcagcaaataaaggataattatcctcattttggtattgattgcaatgatgttggcactaatgacatgcgtgagcaaaatgtttttgaaactttgattggaaagcagcaacagatcttgctcgcaactcaggttgtcaagatgatactgaagatcgatgatgttatttccccatctgagtattgatatttttagttatttccccatctgagtattgatatttttagtttttaactcttgtatttcttgctcactcgtgttttcattgggtcggttttgtttcggatctattggccagtgtatgatcacgtggtgcaaatttatgtaagattttggtatggatttatattgtagttggttgattgtgtctttgtttgatgcatttgttactttattaatactgattattatgaatatagattagttcgttttagttta

SEQ ID NO: 1718 - DNA, 1991 bp, Solanum lycopersicum
aagggtttatcgcagacagcatgctagggttttgaagtgttctagattcataaaacaactctctctgtcactgtcgccggagattattatttaccgatctgatcggaagcaggtcacagggaacaatggcgttagctttcgatgaattcggaaggccgtttataatactaagggagcaagaacaaaaaaccagattaagaggcctcgatgctcagaaggccaacatttccgccggaaaagctgttgcacgtattttacgtacctcacttggtcctaaaggcatggataagatgcttcagagccctgacggcgatgtcaccatcacaaatgatggtgccaccattttggagcagatggatgttgacaatcagattgggaagttaatggttgagttgtcacgaagtcaggattatgaaatcggtgatggaaccactggagttgttgtcatggctggggcactcctagaacaagctgagaagttgttagaacgtggcattcatcctattcggattgcagaagggtatgaaatggcttcaaggattgcagttgagcatttggagcgtgtagctcataagttcgaatttggtcagaatgatgttgagcctttggttcaaacttgcatgactactttgtcatctaagattgtgaatagatgcaaacgtagcatggctgaaattgctgttaaagctgtgttagcagttgctgatttagagaggaaggatgtaaacctggacttaatcaaagttgaagggaaagttggtgggaagttagaggacacagagctaatttatggtattatagttgacaaagatatgagtcatccacagatgccaaagcaaattgaggatgcaaaaattgcaattttgacatgtccctttgagcctcctaagccaaagactaagcataaggttgacattgatactgtggagaagtttcaaactttacgcctacaggagcagaagtactttgatgacatggtccagaagtgcaaggatgttggtgccaccttagttatctgccagtggggctttgatgatgaagctaatcacttattaatgcatagaaatttgcctgctgttagatgggtaggtggtgtggaattggagctgatagcaattgccacaggtgggagaatagtaccaaggtttcaagagttgacacccgaaaaacttggcaaggccggtattgttcgggagaaatctttcggtacaacaaaggatagaatgatctacattgagcattgtgcaaattcaagagcagtaactatatttatccgtggtggaaacaagatgatgatagaggagacaaaacgtagtatccatgatgctttatgtgttgctagaaatcttattcgcaacaattcaattgtatatggtggtggttcagcagagatttcttgctcaattgctgttgaagcggctgctgataaacatccaggagttgaacagtatgcaatcagggcatttgcagatgctttggatgctgtcccaatggcacttgctgagaacagtggtctccagcctattgaaactctatctgctgttaagtctcaacaaattaaggagaataatccatgctgtggaatagattgtaatgatgttggcacaaatgacatgcgtgaacaaaatgtctttgagactctaattggtaagcaacaacagattttgcttgcaactcaggtcgtcaagatgatcctaaagattgatgatgtgattactccatccgagtattgattttaaatatggagatgcacacttttcttcgtcttagagaacatgaatgttttccttctggctatgcaaaccagaagttttgttgggtgaaactttcacgattttatgctttggcttctatgttgtctatttgaatagaattttggtggttgatgaatttcacctgattggtgaccaatttctgtcaacagtaatttccatcgaaatattatttatgaagattttactaatttatctgctagaactagaattctcaaa

SEQ ID NO: 1719 - DNA, 1839 bp, Medicago truncatula
ctttagggttctacatttctcttacacaccactctcatttttccgatcgcagtttcgaaccaaaacaccgccatagggttttggatcgtgaccgtgtaaaccaatatggcgctggctttcgacgagtacggaaggcctttcattattctcagagaacaagaatcgaagaaccgtcttcgtggtctcgatgctcagaaagctaacatctctgccggtaaagccgtcgctcgtattctccgtacctccctcggtccgaagggtatggataagatgcttcaaagccccgacggtgacgtcatcatctcaaatgatggagcaacgatattggagcagatggatgtagataaccagattgcgaagctgatggtggagttgtcgaggagtcaggactatgaaatcggtgatggaactactggagttgttgtgttggctggatctcttcttgagcaagccgagaggcttttggaacgtggtattcatccgattaggattgctgaagggtatgaaatggcgtcgagaattgctgttgagaatctggagaagattgctaataagtttgagtttggtgaaactattttggagccgttgattcagacttgtatgactactttgtcatccaaaattgtgaatcgctgcaagcgtagcttagctgagattgctgtgaaagctgttcttgctgttgcggatctagagaggaaagacgttaatttggatcttattaaagtagaaggaaaggttggtgggaaattggaagatactgagttggtatatggaatcattgttgacaaggatatgagccatcctcaaatgccgaagcaaattgaagatgctaaaattgctattctgacttgcccatttgagcccccgaagccaaaaaccaagcataaggttgatattgatacagtggagaagtttcagacattgaggaaacaagaacagaaatattttgatgacatggttcaacaatgcaaggatgtaggtgcaacccttgttatttgccaatggggttttgacgatgaagcaaatcatctcttgatgcacaggaacttgccagctgttagatgggttggtggtgttgagttggaattgattgccatagcaactggtggaagaattgttcctaggttccaggagttaactgcagaaaagttgggaaaggctggcatcgttagggaaaaagcatttggaacaactaaagaccgaatgctgtacattgagcattgtgcaaactcaagggctgtaacaatattcattcgtggaggtaacaaaatgatcattgaggagacaaagcgcagtattcatgatgcattgtgtgtggctaggaatcttattcgcaataattcaattgtgtatggtggcggttcagctgagattgcatgctctattgccgtggaggcagctgcggatagataccctggtgtagaacagtatgcaattagagcatttggggatgctttggagtcgattcccatggcccttgctgaaaatagtggtctccaaccaattgaaacattatcttctgtgaagtctcagcaaataacggagaaaaatcctcactttggcattgattgcaatgatgttggcaccaatgacatgagggagcaaaacgtctttgaaactttgatcggaaagcagcaacagatcttgcttgctactcaagttgtcaagatgatattaaaaattgatgatgttatttccccatctgagtactaatatatcttttcttgaactcatgttgcatgtcaagatgcagaattgctgatggaattttgtttgatttgtatgattttagtcagagtttgtattttaacttgaagtatatttatgttaagattttgg

SEQ ID NO: 1720 - DNA, 2050 bp, Lupinus angustifolius
gaaaattcagaaaaacttggaacaagcataaacacaaacacaagagcttcaatgttgagaactttctgttcaaaaatcatactatagtagttactactatcccttcattcatttcaataacactcttcttattcttgttgatcttgaatattatcgatattgttaagcaatggcgttagctttcgatgaatatggaagaccattcataattataaaggaacaagatcagaaaactaggttaagaggtcttgatgctcagaaatcaaatatctccgccgcgaaagccgtcgctcggatcctcagaacttctcttggccctaaaggaatggataagatgctttctagtcccgacggcgatgttaccatatcaaatgatggagcaacaatcttggagcagatggatgttgataatcaaattgcaaagctgatggttgagctgtccaggagtcaggattatgaaatcggtgatggcaccacaggagttgttgtgctagccggagctcttcttgagcaagctgagaggctcttggaacgaggaattcatccaattagggttgccgagggctatgaaacagcatccagaatttctgttgaacatctagaacgcgtagctaacaagtttgaatttggagtcacagatttggagcctctgattcaaacttgtatgactactttgtcctccaaaattgtgaatcggtgcaaacgtagcttggctgagattgctgtcaaagctgttcttgctgttgctgatctggagagaaaagatgttaacttagatctgattaaagtagaaggaaaagttggtggtaaattggaagataccgagttaatatatggaattgttgttgacaaggatatgagtcatccccaaatgccaaagcaaattgaagatgctaaaattgctatcttgacttgcccctttgagcccccgaaaccaaagactaagcataagattgatattgatacagtggagaagttccaaacattaaggaaacaagaagaacaatattttgatgacatggttaaaaaatgcaaggatgttggtgcgaccttggttatctgccaatggggttttgatgatgaagcaaaccatctcttaatgaataggaacttgccagctgttagatgggttggtggtgttgagttggaattgatagctatagcaacaggtggaagaatagttcctaggttccaggagttaactccggaaaagctgggaaaggctggcctggttcgagagaaatcctttggtacaaccaaagaccgaatgctgtacattgagcattgtgcaaattcaagggctgtaacaatattcattcgtggaggtaacaaaatgatcgtagaggagacaaagcgcagtatacacgatgccttgtgtgtcgctaggaatctcatccgcaacaactctattgtatatggtggtggttcagctgaaatttcctgctctattgccgtagaggcagctgctgataggtatcctggagtggaacagtatgctgtccgggcatttgcggatgctttagagtatatccctatggcccttgcagaaaatagcggcctccaaccaattgaaacattatcagctgtgaagtctcagcaaataaaggataattatcctcactttggcattgattgcaatgatgttggcactaatgacatgcgtgagcaaaatgtcttcgaaactttgattggaaagcagcaacagatcttgctcgcaacgcaagtcgtcaagatgatactgaagattgatgatgttatttccccatctgagtattgatgtttttagttttgcactcctgtatttcttgctcgctagtatttcatgggggctcgtttggtttatgatcttttggccagtttctgtatgttcacctggtgaaactatgtaagattttggtatgatttcatattgtaggtggttgattgtttctttggctgatgcatttgttacttttattaatattgatcattatgatatagattatagttcattttagtttagagcttgtgactgttttctggcttagggaaatttatgagcttgttctta

SEQ ID NO: 1721 - DNA, 1873 bp, Theobroma cacao
gaaacattgaagaagagaagaagaagaagaagaatagatccgcgacgaaacagtaagaccaggagaaaatggcgttggcattcgacgagttcggtaggcccttcattataataaaagagcaagagcagaaaacaaggctgagagggatcgaagcccaaaaagccaacatttccgctggcaaggcggtggctcggatcctcagaacctctctcggacccaagggcatggataagatgctccaaagccccgacggcgatgtcaccatcacaaatgatggggctacaatattggagcagatggatgttgacaatcaaattgctaaattgatggttgaactgtctcggagccaggattatgaaattggtgatggaacaactggtgttgttgtcatggctggagcacttctagagcaggcagagcggctattagagcgtgggattcatcccattcgggttgcagagggctatgaactggcttcgagaatagctgttgagcatttggagcatatagctcagaagtttgattttggaccaacaaatatagagcctttggttcaaacttgcatgaccactctgtcctcgaaaattgtgaatcgatgcaagcgccctttggctgagatttctgttaaagcagttctttctgttgctgatctagagaggaaagatgtcaatttagatttgattaaggttgagggaaaagttggggggaaactggaagatactgagctaatatacggaatcactgttgacaaggacatgagtcatccacagatgccaaagcaaattgaagatgcaaaaattgctatattaacttgcccatttgagccacctaagccaaagactaaacataaggtggacattgatacagtggaaaagtttcagactttgcgtctgcaagagcaaaagtattttgatgacatggtccaaaagtgcaaggatgttggtgccaccttggttatctgtcaatggggttttgatgatgaggcaaatcatttattaatgcaccggaacttgcctgctgtgagatgggttggtggtgtggagttggagctcatagcaatagctacaggtggaaggattgtgccaaggttccaagagttgaccccagaaaagctgggaagggctggtttggtcagagagaagtcttttggaaccacaaaagataaaatgttgtacattgaacactgtgcaaattcaagagctgtaaccatatttattcgtggaggaaacaagatgatgatagaggagaccaagcgcagtatccatgatgcattgtgcgtggccaggaatctaatccgcaacaattctatagtctatggtggtggctcagctgagatttcttgctcaattgctgtagaggcagctgcagataaatatccaggagttgagcagtatgcaatcagggcatttgcagatgctttagatgcagtccccatggcactggctgagaatagtgggctccaacccattgagacactatcagcagtgaaatctgagcaaattaaggagaataatcctcactttggaattgactgcaatgatgttgggactaatgatatgcgcgagcaaaacgtatttgagacactgattgggaagcagcagcagatcttgctggcaacacaagttgttaagatgattttgaagatcgatgatgtcatttctccatcagactactgaggtctaatgtgatggatgggtttgtatggttcagctgagagaaacatgttgttggcttataatttttggactgccactcccttggttgatggaatgatatcactgttcttgctgatgtggttgcttgtttcttttctctagttactttcagtcacctatggattacccctgctggatgtaaaatttctagttaatgt

SEQ ID NO: 1722 - DNA, 1963 bp, Capsicum annuum
aactgatcggaagaaggtagttagaaagaatggcgttagctttcgatgaattcggaaggccgtttataatactaagagagcaagaacagaaaaccagattaagaggcctcgatgctcagaaggccaacatttctgccggtaaagctgttgcacgaattttgcgtacctcacttggtcctaacggcatggataagatgcttcagagccctgacggcgatgtcaccatcacaaatgacggtgccaccattttggagcagatggatgttgacaatcagattggaaagttgatggttgagttgtcacgaagtcaagattatgaaattggcgatggaaccacgggagttgttgtcatggctggggcacttctagaacaagctgagaagttgttagaacgtggtattcatcctattcggattgcagaagggtatgaaatggcttcaaggattgcggttgagcatttggagcgtgtagcacataagtttgaattcggtctgaatgatgttgagcctttggttcaaacttgcatgactactttgtcatctaagattgtgaatagatgcaagcgtagcatggctgaaattgctgttaaagcagttttagcagttgctgacttggagaggaaggatataaacctggacttaatcaaagttgaaggaaaagttggtggaaagttagaggacacggagctaatttatggtattatagttgacaaagatatgagtcatccacagatgccaaagcaaattgaggatgccaaaattgcaattttgacttgtccttttgagcctcctaagccaaagactaagcataaggttgacattgatactgtggagaagtttcaaactttacgcaaacaggagcagaagtattttgatgacatggttcagaaatgcaaggatgttggtgccaccttagttatctgccagtggggttttgatgatgaagctaatcacttattaatgcatagaaatttgcctgctgttagatgggtaggtggtgtggaattggagctgatagcaattgccacaggtgggagaatagtaccaaggtttcaagagttgacacctgaaaaactgggcagggctggtatggttcgggagaaatctttcggtacgacaaaggatagaatgatttacattgagcattgtgcaaattcaagagcagtaactatatttatccgtggtggcaacaagatgatgatagaggagacgaaacgtagtatccatgatgctttatgcgttgctagaaatcttattcgcaacaattcaattgtatatggtggtggttcagctgagatttcttgctcaattgctgtggaagcagctgctgataaacatccaggagttgaacagtacgcaatcagggcatttgcagatgctttggattctgtcccaatggcacttgctgagaacagtggtcttcagccaattgaaactctgtctgctgttaaggctcagcaaattaaggagaataatccctgctgtggaatagattgtcatgatgttggcacaaatgacatgcgtgagcaaaatgtcttcgagactctaattgggaagcaacaacagattttgcttgcaactcaggttgtcaagatgatcctaaagattgatgatgtgattactccgtccgagtattgatgttgagtatggaaatacaaaattttctctgtgttagagaagatggacgttttacttctggttctgcaaatcaaaagtcttgttgggtgaaacttccgcaatcttatgctttgggttctatattttcctatttgactacagtttggttggttgatgaatgtcctgtcggtatgctccatgaaaacattatttgctattcagatttaaccaatgtatctctgctagaactagaaagctcaaaaactgatgtttctgcgtgcgctcttatctgaatttagcacctttatggtgtacgtactttagttttatgcgcagcggtttagcaa

SEQ ID NO: 1723 - DNA, 1931 bp, Gossypium raimondii
acggaaaagccgaaaagcgagcttacattttaccctctttctcactctcaactcttcaaagaagcagcagcaactaaagctttgaggaaatggcgttggctttcgatgagtacgggagacccttcattatactcaaagagcaagaccagaaaaccaggctgagagggatcgatgcccaaaaagccaacatttccgctggcaaagccgttgcccggatcctccgaacctctctcggacccaagggcatggataagattctccaaagccccgatggcgatgttaccatcacaaatgacggggcaacaatattggagcagatggatgttgacaaccaaattgctaagttgatggttgaactgtctcggagtcaggattacgaaattggtgatggaacaactggtgttgttgtcatggctggagcacttctagagcaggcagagcggttattggaacgtgggattcatcccatacgaattgcagaggggtacgaaatggcttcaagaatcgccgttgagcatttggagcacatatctcagaagtttgattttggagcatcaaatatagagcctttggttcaaacatgcatgaccactttgtcctcaaaaattgtgaaccgatgcaagcgccatttggctgagatttctgttaaagcagttctttctgttgctgatctagagaggaaagatgtcaatttagatatgattaaggttgaggggaaagttgggggaaaattggaggatactgagctaatatatggaatcactgttgataaggacatgagtcatccacagatgccaaagcaaattgaagatgcaaaaattgccatattaacttgcccatttgagccccctaagccaaagaccaaacataaggtagacattgatacggtggagaagtttcaaactttgcgtctgcaagagcaaaagtattttgatgacatggttcagaagtgcaaggatgttggtgccaccttggttatctgtcaatgggggtttgatgatgaggcaaatcatttattaatgcaccggaacttgcctgctgtcagatgggttggtggtgtggagttggagctcatagcaatagctacgggtggaaggattgtaccaaggttccaggagttgaccccagaaaagttgggaagggctggtttggtcagagagaagtcttttggcaccacaaaagataaaatgttgtacattgaacattgtgcaaattccagggctgtaaccatatttattcgtggaggaaacaagatgatgatagaagagacaaagcgcagtatccatgatgcattgtgtgtggccaggaatctcattcgcaacaattctattgtctatggtggtggctcagctgagatttcttgctcaattgctgtggaggcagctgcagataaatatccaggagttgagcagtatgcaatccgggcatttgctgatgctttagactcagtccccatggccctggctgagaatagcggactccaacccattgagacactatcagcagtgaaatctcagcaaattaaggacaataatccacactatggaatagactgcaatgatgttgggactaatgatatgcgggagcaagacgtctttgaaacactgatcgggaagcagcaacagatcttattggcaacgcaagttgtaaagatgattttgaaaattgatgatgtcatttctccatcggactactgaggtataatttctgtactgcctcactctgaaggttaccctgttttgattgttttgtatggttcactccagaacaattgttcacttgtgaggaacatgttttgcttatgtatttttcaactgccaagctctttgttggttggaaatagaatgataaacccttcgtattgacaacggttgtttatgttttttttaatctttagtttctactttcaatcattcaatgcattttctttt

SEQ ID NO: 1724 - DNA, 1846 bp, Castanea mollissima
ctagtctctctctctgtcactcatttgctgctttgcattttttggtttgagagagatctggtaaaaccgtgaagtgaaggccaaaaatggcgctcgctttcgacgagttcgggaggccattcataatcatcaaagagcaagagcagaagacgaggctgagaggactcgaagctcagaaggccaacatttccgccggaaaagccatcgctcgcatcctcaaaacctcgcttggtcccaaaggcatggacaagatgctccagagccccgacggcgacgtcaccatcaccaacgatggtgcaacaatcttggagcagatggatgttgacaatcaaattgcaaagctgatggttgagttgtcccggagtcaggattatgagattggtgatggcaccactggagttgttgtcatggccggtgcacttttagagcaggctgagctgctcttagaacgtggtattcatcccattcggattgcagagggttatgaaatggcctctaggatagcttttgagcatatggagaagatagctcagaagtttgattatggtgtgtcaaattttgagcctttggttcaaacttgcatgactactttatcctcgaagattgtcaatcgatgcaagcgcaatttggctgagattgctgtcaaagcagttcttgctgtggccgatttagagaggaaggatgttaacttagatttgataaaagttgaggggaaagtaggggggaagttggaggatactgagctaatttacggaatcttggttgacaaggatatgagccatccacagatgccaaagcaaatagaagatgcaaaaattgctatcttgacttgcccctttgagccaccaaagccaaagactaaacataaggttgacattgacacggtagaaaagttccagaatttacggcagcaagaacacaagtattttgatgatatggttcaacaatgcaaggatgttggtgctaccttggttatctgccaatggggttttgatgatgaagcgaatcatttattgatgcacaggaacttgcctgctgtcagatgggttggtggtgtggagttagaactgatagcaatagccacgggtggaagaattgtgccaaggttccaagagttgactcctgaaaagttaggaaaggctggtttggttcgagaaaaagcgtttggtacaacaaaagatcggatgctatacattgaacattgtgcaaactcaagggctgtaaccatatttattcgtgggggtaacaaaatgatgatagaggagacaaagcgcagtatccatgatgccttgtgtgttgctaggaatctcattcgcaacaatagaattgtgtatggtggtggctcagctgagatttcttgctcaattgctgtggaggcagctgcagatagatacccaggagttgagcagtatgccatcagagcatttgcggatgctttggatgctgtacccatggcacttgcagagaatagtggcctccaacccattgaaacgctatctgctgtgaagtcgcagcaaatcaaggagaacaatccctactgtgggatagattgcaatgatgttggcactaacgacatgcgtgagcaaaatgtgtttgagactctgattgggaagcagcagcagctcctgctggcaactcaagttgtcaagatgatattgaaaattgacgatgtcatctcaccttctgaatattgatatgtccgtgactgagatctatagttctgcttcacttgggctcatagtattttgttagcttgattttgtgtattgagtgactccggagaccatatgagcactgtggcttataaattttggagtgcctttgattgatattgtagtatgatttc

SEQ ID NO: 1725 - DNA, 2084 bp, Vitis vinifera
ctcatcgtttgctcgtagcacgaactgatattgaagtgcttggaatctcccaccaaaaccctaaccctagaaaaagggtttggtaaattaagaagaaaatggccttagcattcgatgagttcggaaggccattcataatactgagggggcaagagcaaaagagcagattgagaggtttggatgctcagaaagccaacatttctgccggaaaagcggtggctcggatcctccgcacctcccttggccccaagggaatggacaagatacttcagagccccgacggtgatgtcaccattacgaatgatggtgcaacaatattggagcagatggatgttgacaatcaaattgcgaagctgatggttgagctatctcgaagccaagattatgaaattggtgatggcacaacaggagttgtagttttggctggtgcacttctagagcaggctgaggggctacttgaacgtgggattcatcctattcgggttgcagagggctatgaaatggcttgtaggatagctgttgaacatttggaacacattgctcaaaagtttgagtttggagtaacaaatatagaacctttagttcaaacttgcatgaccactctatcatccaagattgtgaatcgatgcaagcgcagtttggctgaaattgctgttaaagcagttatggcagttgcagatttggagaggagggatgttaacttagatttaattaaagtagaggggaaagtaggtggaaaactggaagatactgagttaatacatggaattgttgttgacaaggatatgagccatccacaaatgcccaagcatattgaagatgcaaaaattgctattttgacatgcccctttgagccacctaagccaaaaactaagcataaggttgatattgatacagtggaaaaattccagactttacgtctccaagagcagaaatactttgatgacatggttcaaaaatgcaaggatgttggtgctaccttggttatctgccaatgggggtttgatgatgaagcaaatcatttattaatgcacaggaatttgcctgctgtccggtgggttggaggtgtggagttagagctgatagcaatagccacaggtggaagaattgtgccaaggttccaagaattgacaccagaaaagctgggcaaggctggtttggttcgagaaaaatcatttggtaccactaaagaccgaatgctgtatattgaacgctgtgcaaattcaagggctgtaaccatatttgttcgtggtggtaacaaaatgataatagaggagacaaagcgtagcatccatgacgcactgtgtgtggctaggaatatcattcgcaataattctattgtgtatggtggaggctcagctgagatttcttgctctattgctgtagaggcagctgctgataaatatccaggagttgagcagtatgctatcagggcatttggagatgctttggattcaattcccatggcacttgcagagaatagtggcctccaacccatcgaaaccctatctgcagtgaaatctcagcaaattaaggataacaatgcctactgtgggattgactgcaatgatgttggcacatatgatatgcgtgagcaaaatgtctttgagactctcatagggaagcagcagcaaatcttgctggcaacacaagttgtcaagatgattttaaagatcgatgatgtcatctcccctactgattactgagatatgggtacatcattcaaagttttgcttcacctagatgtgtgtgctcacggtaccaatggtggcttgggatggcatctcaatcacaagggatgatatggccactggacgcagactttcttatttattttggactctgtttttggttttgtactatcgtcatcgtttttggttaatatcttgttgattttgttgtttctttttgaaaggtttcatggtttacttgatggccatgacccatttccttatccttgtgcacatggaaacaagaaaatgagcaaaaattgttgtatgaaagtatttttccatctgacattttaggtttgagtttattcaaatcatatcatacatctaatgaccaaactcagttgaaatgga

SEQ ID NO: 1726 - DNA, 1765 bp, Ricinus communis
gtggaaaagcaagagtagaatctgtagaaatggcgttagcgttcgatgaatacgggaggccatttataatactcaaagaacaagaggcaaagagtcgattgaggggtcttgatgctcaaaaagctaacatttctgctggtaaagccgttgctcgtattctccgtacatctctcggccctaaaggcatggacaaaatgcttcaaagccctgacggtgacgtcactataacaaatgatggagctacaatattggagcagatggatgtggacaatcagattgcgaagctaatggttgagctttcacggagtcaggattatgaaattggtgatggaacaactggtgttgtcgtaatggctggatcacttttggagcaggctgagaagttattagaacgtggaattcaccctattcgtgtggctgagggttatgagatggcttctaaaatagctgtggagcacttggagcatatatccgagaagtttgactttgggctgaatgatatagagcctttggttcaaacttgcatgaccactctgtcatcgaagattgtgaatcgatgcaagcgcagtttggctgagatttctgttaaagcagttcttgctgttgcagatttagagaggaaggatgttaatttggacttgataaaagttgagggaaaagtaggaggcaagttggaagatactgaactgatatatggaatagtagttgataaggatatgagccatccgcagatgccaaaacatattgaagatgctaaaattgctatcttgacttgcccctttgaaccaccaaagccaaagactaaacataaggtggatattgatagcgtcgaaaagtttcagactctacgtaagcaagagcagcagtattttgatgacatggttcagaaatgcaaggatgctggtgctaccttggtcatctgtcagtgggggttcgatgatgaggcaaatcatttgttgatgcacaggaatctgcctgcagttagatgggttggtggtgtagagttagagctgattgcaatagccacaggtggaagaatagtaccgcgattccaggagttgacgcctgaaaagctcggaaaggctggtatggttcgagaaaagtcttttgggacaacaaaagatagaatgctgtacattgaacactgtgcaaattcaagggctgttaccatatttattcgtggaggtaataaaatgatgatagaagagacaaagcgtagcatccatgattcgctctgtgtggccaggaatctcattcgcaacaattctatagtatatggtggtggctcagctgagatttcttgctcaattgccgtggaggctgctgctgataaatatcctggagttgaacagtatgccataagggcatttgctgattctttagatgccattccgatggcgcttgcagaaaatagtgggctccaacccattgagacactatctgctgttaaatctcaacaaattaaggagaacaatccacactgtggaatagattgtaatgatgctggtacaaatgacatgcgcgaacaatatgtcttcgagactctgatagggaagcaacaacagatcttgctcgcaacacaagttgtcaaaatgatactaaaaattgacgatgtcatctctccttctgagtattgatgtgtggtgtttgttctattgctgcttaaccaacaacgaaactttgaaatacattgttgggccaatttggcatgacgaggccgtttgtttcgtgatagcttgtttagcttacaaattttggattggcg

SEQ ID NO: 1727 - DNA, 1781 bp, Panax ginseng
aggcagatcttccgacgatctatcctatccggagaaatggcgttagccttcgatgagtttgggaggtcattcataataataaaggaacaagaacggaagagtagattgagaggactcgaggctcagaagtccaatatttccgccggaaaagctgtcgctcgcatcctccgtacttctctcggtcccaagggtatggataagatgctccagagtcccgacggcgaaatcaccatcacaaatgacggtgcaacaatcttggagcagatggacgtggacaatcaaattggaaagttgatggtcgaattatcccggagtcaggactatgaaattggtgatggaacaactggagtagttgttatggctggtgcacttttggaacaagctgagcggctattagaacatggtattcatcccatacggattgccgagggatttgagatggcgtcaaggattgctgttgaacatttggagcgtgtatcacataagtttgattttgatgcaacaaacatcgagcctttggttcaaacttgcatgactactttatcctccaagattgtgaatagatgcaaacgcagtttggcagagattgctgtaaaagcagttatggccgttgcagatttaggtaggaaggatgttaacttggacctgatcaaagttgagggaaaagtaggtgggaagttggaggatacagagctaatttatggaatactggttgacaaagatatgagtcatccacagatgccaaagcagattgaagatgcaaagatagccattttgacttgcccctttgagcctcctaagccaaaaaccaagcataaggttgacattgatactgtggaaaaattccaaactctacgtcagcaagagcagaagtacttcgatgacatggttcagaaatgcaaggatgttggtgctaccttggttatctgccaatgggggtttgatgacgaggcaaatcacttactgatgcacaggaatttgcctgctgtccgatgggttggtggtgtagagttagagctgatagctatagccactggtgggagaattgtgcctaggtttcaagagttgacaccagaaaaactaggaaaggccggtttggttcgagaaaaatcgtttggtaccacaaaagatcggatgctctacattgaacattgttcaaattcaagggctgtgaccgtattcattcgtggtggtaacaagatgatgatagaggagacaaaacgaagcatccatgatgcattgtgtgtggctaggaatcttattcgcaacaattctattgtatatggtggtggttcggctgagatttcgtgttcaattgctgtggaggctgctgctgatagatgtccaggagttgagcagtatgccatcagggcattcgctgatgctttggattctgtccccatggcacttgctgagaatagtggtctccagcccattgaaacactatctgctgtgaaatcccagcaaattaaggagaataatcattgctgtgggatagactgtaatgatgttggcacgaatgatatgcgtgagcaaaatgttttcgagactcttattgggaagcagcagcagctcttacttgcgacacaagttgttaagatgatcttgaagattgacgatgttatctcaccttctgattattgatgagtcaaatatctttcctgccaagctctgctgcctccttgaacaacacctgcattctatggttgtatcagatgatgacattagttactcatgtccctattttcttgaatggaaaactttagacacatgattttctt

SEQ ID NO: 1728 - DNA, 1881 bp, Ocimum basilicum
cacaccactctccttccctccactcaccatttccatttccgattggatccgtctaaagatccgatccgtttctctgaacacgcaaaatggcgttggcgttcgatgaattcggccgccctttcatcattctgcgggagcaggagcagaaaaccaggttgcgcggcctcgatgcgcagaaggcgaacatcgccgccggccaagcggtggcgcggatcctccgcacttctctcggacccaaaggcatggacaagattctccagagccccgacggcgaggtcaccataacgaatgatggtgcgacgatattggagcagatggatgtggacaatcagattgctaagcttatggttgaattgtcgcgtagccaagactatgaaattggcgacgggacgactggagttgtcgttttggccggttcacttttggaacaagctcagaagctgttggagcgcgggattcatcctattcggattgcggaaggatatgaactggcttcccgtattgccactgagcatttggagcgtatagcaaataaatttgaatttagctctgagaatacggagcctttgatccagacctgtatgactactttatcctccaagatagtgaatcgatgcaaacgtaatttggctgagattgcggtcaaggcagtgcttgcagttgcagatttggagaggaaggatgttaatctcgacctaattaaagtagaggggaaagttggtgggaagctagaggatacagagctaatatatgggattgttgttgacaaagatatgagtcatccccagatgccaaagcagattgaggacgcaaagattgcaattttgacttgcccctttgagcctccgaagccgaagactaagcataaggtcgatattgatactgtggagaagttccaaactttacgtcaacaagagcagaagtacttcgatgatatggttcaaaaatgcaaggatgttggggctacacttgtgatctgccagtggggtttcgatgatgaggcaaaccacttactgatgcataggaatttgcctgctgtccgatgggttggtggtgtggaattggagctgatagccatagccacaggggggagaattgtgcccagatttcaggagttgacacctgagaaattaggaaacgctggcatggttcgagaaaaaggttttggaaccaccaaggatcgaatgatatatattgagcactgtgcgaattcgagggctgttaccatatttatacgtggtggtaacaagatgatgattgaggaaacgaaacgcagtcttcatgatgccttatgtgttgctcggaatcttattcgcaacaactctatcgtatatggtggtggctctgctgaagttgcctgttcaattgccgtggaagcagccgctgataaataccctggagttgagcagtatgcaatcagggggttcgcagaggcattagatgcgatcccaatggcattggcagagaatagtggcttgcaacctatagaaaccctatctgctgtcaaatctcagcaaatcaaggagaacaactcttattgtggcatcgactgtaacgatgttggcacgaacgacatgcgtgagcagaacgtgttcgagactttgattgggaaacagcagcaaattctgcttgcaactcaagttgtgaagatgattttgaagattgatgatgttatctcaccctcccagtattgattttttttctaaattgatactaaaagttttgctggtcggacactgtggacggtcgtggatctgttttaagtttagccaccggagtgggacttaggttcgtgtctttgtgattttgcaacgattttcttgtgtggttttcctgttccctcttcttcctgcagtttaatctgaaacttgattgctagtc

SEQ ID NO: 1729 - DNA, 1885 bp, Panax ginseng
ccccctatcccctgtgtgccttggcagtctcagaagcagtggtatcaacgcagagtacatggggatagctactcttttttttcactttctaaagtgaaaaaacaggcagatcttccgacgatctatcctatccggagaaatggcgttagccttcgatgagtttgggaggtcattcataataataaaggaacaagaacggaagagtagattgagaggactcgaggctcagaagtccaatatttccgccggaaaagctgtcgctcgcatcctccgtacttctctcggtcccaagggtatggataagatgctccagagccccgacggcgaaatcaccatcacaaatgacggtgcaacaatcttggagcagatggacgtggacaatcaaattggaaagttgatggtcgaattatcccggagtcaggactatgaaattggtgatggaacaactggagtagttgttatggctggtgcacttttggaacaagctgagcggctattagaacatggtattcatcccatacggattgccgagggatttgagatggcgtcaaggattgctgttgaacatttggagcgtgtatcacataagtttgattttgatgcaacaaacatcgagcctttggttcaaacttgcatgactactttatcctccaagattgtgaatagatgcaaacgcagtttggcagagattgctgtaaaagcagttatggccgttgcagatttaggtaggaaggatgttaacttggacctgatcaaagttgagggaaaagtaggtgggaagttggaggatacagagctaatttatggaatactggttgacaaagatatgagtcatccacagatgccaaagcagattgaagatgcaaagatagccattttgacttgcccctttgagcctcctaagccaaaaaccaagcataaggttgacattgatactgtggaaaaattccaaactctacgtcagcaagagcagaagtacttcgatgacatggttcagaaatgcaaggatgttggtgctaccttggttatctgccaatgggggtttgatgacgaggcaaatcacttactgatgcacaggaatttgcctgctgtccgatgggttggtggtgtagagttagagctgatagctatagccactggtgggagaattgtgcctaggtttcaagagttgacaccagaaaaactaggaaaggccggtttggttcgagaaaaatcgtttggtaccacaaaagatcggatgctctacattgaacattgttcaaattcaagggctgtgaccgtattcattcgtggtggtaacaagatgatgatagaggagacaaaacgaagcatccatgatgcattgtgtgtggctaggaatcttattcgcaacaattctattgtatatggtggtggttcggctgagatttcgtgttcaattgctgtggaggctgctgctgatagatgtccaggagttgagcagtatgccatcagggcattcgctgatgctttggattctgtccccatggcacttgctgagaatagtggtctccagcccattgaaacactatctgctgtgaaatcccagcaaattaaggagaaaaatcattgctgtgggatagactgtaatgatgttggcacgaatgatatgcgtgagcaaaatgttttcgagactcttattgggaagcagcagcagctcttacttgcgacacaagttgttaagatgatcttgaagattgacgatgttatctcaccttctgattattgatgagtcaaatatctttcctgccaagctctgctgcctccttgaacaacacctgcattctatggttgtatcagatgatgacattagttactcatgtccctattttcttgaatggaaaactttagacacatgattttcttg

SEQ ID NO: 1730 - DNA, 1985 bp, Panax ginseng
ccccccctatcccctgtgtgccttggcagtctcagaagcagtggtatcaacgcagagtacgcggggatagctactctttttttcactttctaaagtgaaaaaacaggcagatcttccgacgatcaatccggagaaatggcgttggccttcgatgagtttgggaggccattcatattaataaaggaacaagaacagaagagtagattgagaggactcgatgctcagaagtccaatatttccgccggaaaagctgtcgctcgcatcctccgtacttctctcggtcccaagggtatggataagatgctccagagccccgacggcgaaatcaccatcacaaatgacggtgcaacaatcttggagcagatggacgtggacaatcaaattggaaagttgatggttgaattatcccggagtcaggactatgaaattggtgatggaacaactggagtagttgttatggctggtgcacttttggaacaagctgagcggctattagaacatggtattcatcccatacggattgcagagggatttgagatggcatcaaggattgctgttgaacatttggagcgtgtatcacataagtttgatttcgatgcaacaaacatcgagcctttggttcaaacttgcatgactactttatcctccaagattgtgaatagatgcaaacgcagtttggcagagattgctgtaaaagcagttatggccgttgcagatttagataggaaggatgttaacttggacctgatcaaagttgagggaaaagtaggtgggaagttggaggatacagagctaatttatggaatactggttgacaaagatatgagtcatccacagatgccaaagcagattgaagatgcaaagatagccattttgacttgcccctttgagcctcctaagccaaaaaccaagcataaggttgacattgatactgtggaaaaattccaaactctacgtcagcaagagcagaagtacttcgatgacatggttcagaaatgcaaggatgttggtgctaccttggttatctgccaatgggggtttgatgacgaggcaaatcacttactgatgcacaggaatttgcctgctgtccgatgggttggtggtgtagagttagagctgatagctatagccactggtgggagaattgtgcctaggtttcaagagttgacaccagaaaaactaggaaaggctggtctggttcgagaaaaatcatttggtaccacaaaagatcgtatgctctacattgaacattgttcaaattcaagggctgtgaccgtattcattcgtggtggtaacaagatgatgatagaggagacaaaacgaagcatccatgatgcattgtgtgtggctaggaatcttattcgcaataattctattgtatatggtggtggttcggctgagatttcttcttcaattgctgtggaggctgctgctgatagatgtccaggagttgagcagtatgccatcagggcattcgctgatgctttggattctgtacccatggcacttgctgagaatagtggtctccagcccattgaaacattatctgctgtaaaatcccagcaaattaaggagagtaatcattgctgtgggatagactgtaatgatgctggcacgaatgatatgcgtgagcaaaatgttttcgagactcttattgggaagcagcagcagctcttacttgcgacacaagttgttaagatgatcttgaagattgacgatgttatctcaccttctgattattgatgagtcaaatatctttcctgccaagctctactgctccttgaacaacacctgcattctatggttgtatcagatgatcacattagttattcatgtccctattttcttgattggaaaactttagacacatgattttcttgctttgtcttgattgcatttttgattcggtgctcgccttatccctagcatttatggattacttgatgtttgtctcaatattggtctcatgagaaaaatatagaatt

SEQ ID NO: 1731 - DNA, 1986 bp, Liriodendron tulipifera
acctccttccttctcctctccctctctccagcgatggcgctggcctttgatgattttgggaggccgttcataataataaaggaacaggagcagaagagcaggctgaggggattggatgctcagaaagccaacatctcagctggaaaggccgtcgctcgcattctacgcacctccctcggccctaagggcatggacaagatgctccagagccccgacggtgaagtcaccatcacaaatgatggggcaacaatcttggagcagatggatgttgataatcaaattgcgaagttgatggtcgaattatctcggagtcaggactatgaaattggcgatggcaccactggagttgttgttgtggctggtgcacttttagagcaggctgaacgactattagaacgtggcattcatcccattcggattgcagagggctatgaaacggcttcaaggatagctgtagaacacttggagcatatttctcagaagttcgattttagtctgtcaaatatagaatctctagtgcagacctgcatgaccaccttatcttcaaagattgtgaatcgatgcaagcgcaccttagctgagattgctgttaaagcagtcatggctgttgcagatttagaacggaaggatgttaatttggatttgattaaagttgaaggaaaggtaggaggcaaattggaagatactgagctaatctatggaatagttgtcgacaaggatatgagccatccgcagatgccaaagagaattgaagatgcaaagattgctattttgacttgtccatttgagccacctaaaccaaagacaaagcataaggtggatattgacacagtggagaagttccagactttacggcagcaagagcagaaatactttgatgacatggttcaaaaatgcaaggatgttggtgcaaccctggttatctgtcaatggggttttgacgatgaagcaaatcatctattaatgcaccggaacttgcctgctgttcggtgggtcggtggtgtggagctggagcttattgcaattgctacaggtggaaggattgtgccaaggttccaagaattgacaccagagaagctggggaaggctgggctagttagagaaaaatcatttggaaccacgaaggaccggatgctgtatatcgagcagtgtgcgaattcaagggctgtaactatattcattcgtggtggaaacaaaatgataatagaggaaacaaagcgcagcatccatgatgccttatgtgttgcaaggaatctcatccggaacaattctatcgtatatggtggcgggtctgctgaaatatcttgctccattgctgttgagactgctgccgatagatatcctggagttgagcagtacgctatcagggcctttgcagatgctttggacgccattccactggccctcgcagagaacagcggtctccaacctattgatacattgactgcagtcaaggctcagcaaatcaaggagagcaacccacattgtggcatagactgcaatgatgtcggaacgaatgacatgcgagagcagaatgtcttcgagaccctgatagggaagcagcagcagatgtcgctagcgacgcaggtcgtcaagatgatactgaagattgatgacgtaattgccccgtcagattattgatcgattcatggcatgaattgaaaattttgccttgacagaatcaacatggttattatgttcactagtagtagcattgccatgttattctgatgaagacgtgcctttactttgtcatcgttgtgttttcctgtttgataatagactaatttggttgagaattcttgtcgctttgctttcttgaatgactgttatcctactaaaatccttgtgattttatgtggcaatttgtgttgagtaatgatatgtaaccagtggactttttcctgcttgatgtagactctgttcatgaatgctaccacatcattcattattcttgaatgctacatcacttgtcattcaaaaatg

SEQ ID NO: 1732 - DNA, 2008 bp, Gossypium raimondii
attagggctttgaaaaccttccacactcttctcatttccaaagggctgagcactgaagaagaaaaagtagcatagatcggcaacgtaacagtgaaactcgggggaaatggcgttggcgttcgacgagtacggtaggccattcattatacttaaagaacaagagcagaaaacgaggctgagcgggctcgaagctcaaaaagccaacatttccgcaggcagagcggtctctcggatcctccgaacctctctaggacccaaaggcatggataagatgctccaaagccccgacggcgatgtcaccatcacaaacgatggggcaacaatattggagcagatggatgttgacaatcaaattgctaagttgatggttgagctgtctcggagtcaggattatgaaattggggatggaacgactggtgttgttgtcatggctggagcacttctagagcaggcagagcggctattggaacgtgggattcatcccatccgtattgcagagggttatgaaatggcttctagaatagctgttgagcatttggagcgtatagcccagaagtttgattttggaccaacaaatatagagcctttggttcaaacatgcatgaccactctatcctcaaaaattgtgaaccgatgcaagcgtgctttggctgaaatttctgttaaagcagttctttctgttgctgatctagagaggaaagatgtcaatttagatctgattaaggttgagggaaaagttggaggaaaattggaagacactgagctaatatatggaattactgttgataaagacatgagtcatcctcagatgccaaagcaaattgaagatgcaaaaattgccatattaacttgtccatttgagccacctaagccaaagactaaacataaagtagacattgatacggtggaaaagtttcagactctacgtcagcaagaacaaaagtattttgatgacatggttcagaaatgcaaggatgttggtgccacattggttatatgtcaatggggatttgatgatgaggcaaatcatttattaatgcaccagaacttgcctgccgtcagatgggtaggtggtgtggaattggaattgatagcaatagctacaggtggaaggattgtgcctaggttccaggagttgaccccagaaaagttgggaagggctggtttggtcagagagaagtcttttggcactacaaaagataaaatgttatacattgagcactgtgcgaattcaagggctgtaaccatatttattcgtggaggaaacaagatgatgatagaggagacaaagcgcagtatccatgatgcactttgtgtggccaggaatctaattcgcaacaattttatcgtctatggtggtggtgcagctgagatttcttgctcaattgctgttgaggcagcagcagataaatatccaggagttgagcagtatgcaatccgagcattcgcggatgctttagatgctgtccccgtggctctggccgaaaatagtgggctccaacccattgagacgctatcagcagtgaaatctcaacaaattaaggagaataatcctcactttggaatcgactgcaatgatgttgggactaatgatatgtgtgagcaaaatgtctttgaaacgctgattgggaagcagcagcagatcttgcttgcaacacaagttgttaagatgattttgaagattgatgatgtcatttccccatctgactactgagcttcacggtcagctggaggttagcctaatttgatggttttgtattttcttggaaccatgtgttcactttagactttggagagaacatgttttgcttctaatttttgaactgccagtcccttggttggaattatcacactcttattgttaaatgtggttgcttgttccctttttgagtcactggaattacctacggatcattggtactagttcttcccctgtatgtaaaaatgctgcacaagaaaaaactgcaatttaatgtgcaattttaattttggttgtttctctctaaca

SEQ ID NO: 1733 - DNA, 2041 bp, Gossypium raimondii
gaaacactgtgaaaaacgaaaacatttacctcacaatcttccacattcttcctctcagtctcacttaactctagaaagcccaggacatgaaacactagacaacaagcaagcaagcaagaagcgtagatcgtgtgaggaaacagtaaaggccagagaaaatggcgttggcattcgacgagtatgggaggccgttcattatactaaaagagcaagagcagaaaaccaggctgagagggatcgaagctcaaaaagccaacatttccgccggaaaagctgtcgcccggattctccgcacctccctcggacctaaaggcatggataagatgctccaaagtcccgacggcgatgtcaccatcacaaatgatggggcaacgatattggagcagatggatgttgacaatcaaattgctaagttgatggttgaactgtcccggagtcaagattatgaaataggtgatggaacgactggtgttgttgtcatggctggagcacttcttgagcaggcagagcggctattagaacgtgggatacatcccattcggattgctgagggttatgaaatggcttctagaatagctgttgagcatttggatcatatagctcagaagtttgattttggaccaacaaatatagaacctctggttcaaacttgcatgaccactctgtcctccaaaattgtgaaccgatgcaagcgccctttggctgagattgctgttaaagcagttctctctgttgctgatctagagaggaaggatgtcaatctagatctgattaaggtagaggggaaagttggggggaaattggaagatactgagcttgtatatggaatcactgtcgacaaggacatgagtcatccacagatgccaaagaaaattgacgatgcaaaaattgccatactaacttgcccatttgagccacctaagccgaagactaaacataaggtagacattgacacagtggaaaagtttcagactttgcgtcagcaagagcaaaagtattttgatgacatggttcagaagtgcaaggatgttggtgccaccttggttatttgtcaatgggggtttgacgacgaggctaatcatttattaatgcaccgtaacttgcctgctgtcagatgggttggtggtgtggagttggagctcatagcaatagctacaggtggaaggattgtgccaaggttccaagagttgaccccagaaaagctgggaagggctggtttggtcagagagaagtcttttggcaccacaaaagataaaatgttgtacattgaacactgtgcaaattcaagggctgtaactatatttattcgcggagggaacaagatgatgatagaggagacaaagcggagtatccatgatgcactgtgtgtggccaggaatctcattcgcaacaattctattgtctatggtggtggatcagccgagatttcttgctcaattgctgtagaggctgctgcagataaatatcccggcgttgagcagtatgcaatccgggcatttgctgatgctttagattctgtctccatcgccctggccgagaatagcggccttcaacctattgagacactatcagcagtgaaatctcagcaaattaaggagaataaccctcactttggaatagattgcaatgatgtcggaactaatgacatgcgcgagcaaaacgtgttcgagacgctgatcgggaagcagcagcagatcttactggcaacacaggttgttaagatgattttgaaaattgatgatgttatttccccatccgacttctgaggtttaatataaactggttcatcgagaggttaacccattttcatggttttgatatggttcaatctggagagggaaaaaaaggagaatttatttgcttataaatttttgaactgccactccgtttgatttgtagaatgatcaccactttttgttgatgtggatttttttatcattatatattttttaagttctcgaaaaacatatcaaaaggctaaatacctttttttttaatgttacaatttttagttaatttcctatacttttaattagcattt

SEQ ID NO: 1734 - DNA, 2452 bp, Cocos nucifera
tcaccaaccccagcgcggtttattttcagctccgtggggccgaggctcctcgacgagaaaatataataaactctcctcctttctggaacttaccactgtttccgccctctctcttctcccttgcggcggtcggtcttcctcttctccgttccaggttagaggaggaggaggagaatggcgttggcgttcgacgagtatgggaggccgttcatcatcctcaaggagcaggagcagaagagccggctgaggggcttggaggcccagaaggccaacatctcggccgggaaggccgtagctcggatcctccgcacctccctcgggcctaagggcatggacaagatgcttcagagccgcgacggcgatgtcactatcacaaatgatggggcaacaatcttggagcagatggacgttgacaaccagattgcaaagttgatggtggaattgtcccggagtcaggactatgaaattggtgatggtaccacaggagttgttgttatggctggtgcacttctagaacaggctgagaagcttcttgaacgtggcattcatcctattaggattgcagagggttatgagatggcctctaggatagctgtggagcatctggagcgaatatctcaaaaatttgaatttagtgttagtaatattgaacctttggtgcagacctgcatgaccacattgtcttcaaagattgttaatcgatgcaagcgtatgctagctgagattgctgttaaggcggttctggcagttgcagatctcgaaaggaaggatgtgaaccttgatttgattaagatagaaggaaaggttggaggtaagttggaagataccgagctcatctatggaataactgttgacaaggagatgagccaccctcagatgccaaagagaattgaagatgcgaaaattgccattctgacttgcccatttgaaccaccgaagccaaagacaaagcataaggttgacattgatactgtggagaaatttcaaaccttacgtcagcaagagcagaagtactttgatgatatggttaaaaaatgcaaggatgttggagcaaccctagttatttgtcaatggggttttgatgatgaagcaaatcatcttttgatgcatcggaatttgcctgctgtcagatgggttggtggtgttgagttggaattgattgccattgctacaggtggaagaatagttcccagattccaagaactgacacctgaaaagctgggaagggctggactagttagagaaaaatcatttggaacaacaaaggattggatgttgtatattgaacaatgtgcaaactcaagggctgtgaccatattcattcgtggtggtaacaaaatgattatagaggaaactaagcgtagtcttcatgacgcgctatgtgtggcaaggaatctgatccgtaacaattccattgtttatggtggtggttcagctgagatagcttgctcgattggtgtagaagccgctgcagatagataccctggagttgagcaatatgctatcaggtcctttgctgaagctttagattctataccaatggctctggcagagaacagtggtctccaacctattgatactctcactgcagtcaaatctcagcaaatcaaggacaacaatccatattgtggcatagattgtaatgatgttgggacgaataacatgaaagagcaaaatgtatttgagacgctgatcggcaagcagcagcagatcttgcttgcaacacaggtggtgaaaatgattttgaaaattgatgacgtgatcaccccttctgattattgattgtatttgagaggccaaaatttgcaggcagggttctgcgctcatgagaatccatttagctacgtggaaaggaatgttacagttagatgagtttggtgtctgaaactgttattcttttttgttttgggtgcaacttttgtgctagggttatgatttgtagattgagtcgtgacttaaaatttttcttttgcgtttttggtggtttaacagctgatgttaaagccatctttcttttctactcagattctcttatgaacttatcatgggattgtttgtagccacgaactggacgaagatatatatgcatggcaagtagtatttaaattgacaatcatcaggttagccttgttgtccatcaggggagagtgctatattctgtttcttgggtgcttgaaggctaccattttcaatcttaaatctgtttcttaattgaaaagcattcatgtttggatggcattttcaatcaggtcaggtcgtactgtaatcaagagttcaattcgagtcatcgtggtgttggcaaaacctgggatctggtggccggtaatctcatgttcttcagcgtttcttgcgtttgaactgcaagtctaagagcgtgccctgtcttctgcgatctgcgtttggtgttttgtacctctgtccatcggccccatttcacaaaaaataccgtagc

SEQ ID NO: 1735 - DNA, 2640 bp, Lupinus angustifolius
aaccctgtttcctctttcttcttcctcctccttcttcaacatcatcgattcgattcattttctgttgattttttttcatcgccatctttcaaaaatggcgttggctttcgacgaatatggaaggccatttataattataaaggatcaagatcagaaattcaggttaagaggtctcgatgctcagaaatcgaatatcgccgccgcaaaagccgtcgctcaaatcctcagaacttctcttggccctaaaggaatggataagattctttctagccccgacggcgacgttaccatttcaaatgatggagcaacaatcttggagcagatggatgttgacaatcaaattgcaaagctgatggtagagctgtctaggagtcaagattatgaaatcggagatggcaccacaggagttgttgtgctggctggagctcttcttgagcaagctgagcggctcttggaacgaggaatccatccaattagggttgctgagggctatgaaacagcatccagaatttctgttgaacatctagaacatgtagctaacaagtttgaatttggagtggcagatttggagcctctgattcaaacttgtatgaccactttgtcctcaaaaattgttaatcgatgcaaacgtagcttggctgagattgcagtgaaagctgttgttgctgttgctgatctagagagaaaagatgttaacttagatttaattaaagttgaaggaaaagttggtggtaaattggaagataccgagttagtatatggagttattgtagacaaggatatgagtcatccccaaatgcctaagcaaattgaagatgctaaaattgctatcttgacttgcccctttgagcctccaaagccaaagactaagcataaggttgatattgacacagtggagaagttccagacattaaggaagcaagaacaacagtattttgatgacatggttgaaaaatgcaaggatgtgggtgcaacattggttatctgtcaatggggttttgatgatgaagcaaatcatctcttaatgcacaggaacttgccagctgttagatgggttggtggtgttgagttggaattgatagctatagcaacaggaggaagaatagtgcctaggttccaggagttaactccagagaagttgggaaaggctggtctggttcgagagaaatcctttggtacaaccaaagaccgaatgctgtacattgagcattgtgcaaattcaaaggctgtaacaatattcattcgtggaggtaacaaaatgatcgtagaggagacaaagcgcagcatacatgatgccttgtgtgtggctaggaatctcatccgtaacaattctattgtatatggtggtggttctgctgaaatttcatgctctattgctgtggaggcagctgctgataaataccctggagtggaacagtatgctatcagggcattcggggatgctttagagtatatccctatggcccttgcagaaaatagtggcctccaaccaattgaaacgttatcttctgtcaaatctcagcaaattaaggacaattatcctcactatggcattgattgcaatgatgttggcactaacgacatgcgtgagcaaaatgtcttcgaaactttgattggaaagcagcaacagattttgctcgcaacacaagttgtcaagatgatactgaagattgatgatgttatttccccatctgagtattgatatttttagtttcgaactcctatatttcttgcttgctagtatttcattgggttggtttggtttggtttcagatcttatggccagtgtctgtatgttcaccaggtgaaaaattacttaagattttgctatgattttatatcgtagttggttgattggttctttatttgatgcatttgttactttctaaaatactgatcattatgaatatagattagttcgtttgagtgtagaccctgtaacctttgttggcattgagggaaggaaattcgtgagcttgttcttattttgttggctttgatgggagttctcaggaggtgtgtaagggttatgagcttggcatgtctgaggccttcatttgaatttgattgctgttcaaagtttcgattcatgtgagcagcatttgttgggagcagtagctacgcatcccgaaaaggaatagtttgggatacccttggttacacacaaaaaaaattgatagctgctggtgctttcattttaggcacgtgcattttatggtaaatttggtcaaaactgagaacattttccaccaaggaaagatatgaaagttcctgcagaacaagaaaatgagattggaaaaagaatcagatataggaaatgtctcaaggtgataaagacagacaaatcagtgaagcaaaagggacccaaagatactcaatagagccttctgtaatgctagctgaacaacttgttttcatgatgccctggtgtgtaccctaccttttataaaacttagaccacaacaaccctccattttcattacaccacttgaatttcaggggtctgggaaattttctcgtgtttatctcatggttgttaaactaacccacctttctttccatcttagacagatagttgtattgtatagctttatagttctcatcattcttgaaggacaatattagaagagtagaatgaag

SEQ ID NO: 1736 - DNA, 2112 bp, Daucus carota
caggggaatgatatttagggcaaagcagagagggggagtacagttataaaacttgttaaacccctcttttacctctcactcctctgctcctctctctttcacagtctctctgtagaagaagaatagtagatccatggcgttagcgttcgatgagtacgggaggccttttataatattaagagaacaagatcagaagagtagattgagaggcatcgatgctcagaaatctaacatttccgccgccaaagctgtggctcgcatcctccgtacatctctcggtcccaagggcatggacaagatgctccagagccccgacggcgaaatcaccatcacaaatgatggtgcaacaatcttggagcagatggatgttgacaatcaaattggaaagctgatggtagagttatctcgtagccaggactatgaaattggtgatgggacaactggagtagttgttatggcgggtgcacttctcgaacaagccgaacgtctgttagaacgtggtattcatcccattcgaattgcggagggttttgagatggcatcgaagattgctgttgagcatttggagagcgtgtccaataaatttgagtttagcgcatcaaatattgagcctttggttcaaacttgcatgactactctatcatccaaaattgtcaacagatgcaaacgagacttggctgaaattgctgtaaaagcagttatggctgttgcagatctggataggaaagatgttaacctggaccttattaaagtggagggcaaagtaggtgggaagttggaggataccgaactcatttatggaatactcgtcgacaaagatatgagtcatcctcagatgccaaagcagattgtagatgcaaacatagccatcttaacttgccccttcgaacctcccaagccaaagaccaagcataaggttgacattgataccgtggaaaaatttcaaactttacgtcagcaggagcagaaatactttgatgacatggttcagaagtgcaaggatgttggtgctaccttggttatctgccaatggggttttgatgatgaggcaaatcacttgttgatgcacaggaatctgcctgctgttcgatgggttggtggagtagagttagagttgatagctatagccacagggggtagaattgttccaaggttccaggagttgacaccagaaaagttgggcaaggctggtttggttcgtgaaaagtcatttggcaccacaaaagatcgaatgctctacatcgaacattgtgcaaattcaaaggctgtaaccatatttattcgtggtggtaacaagatgatgatagaggagacgaaacgaagcatccatgatgctttgtgtgttgccaggaatcttattcgcaacaactcaattgtgtatggtggcggttcagctgagatttcttgctcacttgctgtagaggctgctgctgataaatatccaggagttgagcagtatgcaatcagggcattcgccgatgctttggactctgtccccatggctcttgcagaaaatagtggtctccagcccattgaaacactatctgcggtgaaatcacagcaaaccaaggacaagtattcttggtatggtgtagactgtaatgatgttggcacaaatgacatgcgtgagcagaatgtctttgagacactaatcgggaagcagcagcaactcttacttgcaacacaggttgttaagatgatcttaaagattgatgatgtcatttcgccttctgaatattgattggctgaatatcctgagaagttttgctcatcctgcaagagatcctgggtattattatggttgtgaaagatgtctcaaattattattgttaatctactatagacatctgtgagtgaccttttatttttgtagctttattttattttccaggttgaatggatgttatattgtcgacctcctttaagcatattttggattttagtaatcgtggtctttctgtctcagttttgttctcatgaatatggcaatgcctgtttgaaatgcacctgattggtgataatatgtttgtatttaatgtgagtctgtggcttagtggttgtactagactactagttgtatgaatttctccccttgtattacttggagcaagt

SEQ ID NO: 1737 - DNA, 3426 bp, Ananas comosus
ctagccaccctgtggttctcctcctgccggatcgggtagtgatgccgacgaccgacccgtttttgaccaaactcatactctattgatcttctttcccccatccctgtcgttcgcccgatgccctagatcctcccccgtgtcctccgctgcttctcttcctcctcccagtcccagttactgcacaatggcgttggcgttcgacgagttcgggaggcccttcatcatcctcaaggagcaggagcagaagacgcggctgcgggggttggacgcgcagagggccaacatctccgcggggcgcgctgtggctcgcatcctccgcacctcgctcggccctaagggcatggacaagatgctccagagccccgacggggacgtcatcatcacaaatgatggggcaacaatcttggagcaaatggatgtcgacaatcagattgcaaagctgatggtggaattatctcgtagtcaggactatgaaattggtgatggtacaactggagttgttgttatggctggtgctcttttagaacaggccgaaaagctactcgaacgtggcatccatcctattaggattgctgagggttatgagatggcctccaggattgcttttgagcatcttgagcgtatctctcaaaagtttgaattcagtgcgactgatatagagcctttggttcagacgtgcatgacaactttgtcctcgaaaattgttaaccgctgtaagcgtatgttagctgagattgctgttaaggcagttctagcagttgctgatttagacaggaaagatgtgaacttagacttaattaaagttgaaggaaaggttggagggaagctggaagacactgagctcatctatggtattgttgttgacaaggacatgagccatccgcagatgccaaaaagaattgaaaatgcgaagattgctattttgacttgcccatttgagccaccgaagccgaagactaagcataaggttgacattgacactgtagagaagtttcaaactttgcgtcagcaagaacagcagtactttgatgatatggttcagaaatgcaaggatgttggcgcaactctagttatttgtcaatggggcttcgacgatgaagcaaatcatctgttaatgcataggaatctgccagctgtcagatgggttggcggtgttgaactggaattgattgcaatagctacaggtggaagaatagttcccagattccaagagttgacaccagaaaagttggggaaggccggattggtgagagagaagtctttcggaacaacaaaagatcgtatgctgtacattgaacagtgtgcaaattccagggctgtaaccattttcattcgtggtggcaacaagatgatgattgaggagacaaaacgtagtcttcacgatgctctttgcgttgcaaggaatctgattcgtaacaattccatagtttatggtggtggctcagctgagatctcttgctctattgctgttgatgctgctgcagatcgatatcctggagttgagcagtatgctatcaggtcatttgctgaagctttagattcaataccattggctctagcggagaacagtggcctgcaacctattaatactctgactgcagtcaaatctcagcaagtcaaggaaaacaatccgttctgtggcatcgattgcaacgatgtcgggacaaatgacatgaaagagcagaatgtattcgagactttgatcggaaaacagcagcaaatcttgctggcaacacaggtggtgaaaatgatccttaagattgacgatgtgatcgcaccatccgattattgatgttgcttgagaagcatttgcgaagttttgcgttctggacagtttaactatcgtccgaaactgaaactggtctaaaaggccaagtcgttatgtggtgtttggaaatgtttgttgagcctgataactgtgctttaagatctgatttacatctcgctgtgactgcttatattgtgccttgttaatgtattggagagtgaagaacttttggacaaactgacaacgaggatagcagtaaatgtttttgtcgattattttatttatcaacgacagtgaagatttgaggtatttctttgaagaattttcttttctgataaattcttatgtcgcttagggttctgttctgaagctttattatcataaatataatagcattgaaaagtagcgtaaatagtgtagcagtgcttctgtcattaggggatgattgcttctgtcatttgtcttatggctgagtggctgtcatgcaggcgaacgaggaagaaggaagaagtcctctctttgaactgatattccttttgctacctgcatgtactatggtgattgtgatttcaggatgtgatgcgaaggagtagagtagtttgattcctgtattatgagtctagagtatgttgggtgttaatattgttagatggaatatctgttacacagaatattcttaggggaagagggaaattatggtagagagagagatggatgctgtaagtgctcgtattcaaaactcgctaataaccaactaaaagttgttgcggataggcggtttaaggcggaaatcgacagactgaagctcgggctgctgcggagttctacatgctgggcaactcctgcatccgagctctcgcaagactatgagctcatctgatacgacctccagggtcattctcctcccatcgcttcaatgtcaatcaaattaaacactcagaggaatccgaacaaactcatagttgatttaaaatagtgtgtcaatccatggtttcttcctcagttcctagtaattttgcatcataataaaatatgattgagtaggtaattgaaacattgtttctgttgccatttctaattaagaattagacggaacgtgcgattacttgctttagttgcgtatgaaccaagcagctattttcatacatcattgtgtttactgttagaaagttaaggttcaataaggcaacaaactaaagttgtctgataatgtaagaactgtcgctttgtttcatttctgttttatgatgctccattctctgtgaattgttgtcttcttgttcattttcggcaagagcagtaaaatgtagtgtttaaagagatctttctagctatctaaaacgtctatggagtgatatagttttgtgagttctttcttttgttgttctaatggctatgcttgttttgttggtcttcttgtgaagattatttagaaggaacaaatttaacagtttgctgtattgtgatcacaattccacctcgtaagggttttcttcctggttgattacttggattgatcactttagtttgctgacctaggatccagctcgaaatataaggtctagtttcctctagttgtttgagttgtgatagttcctaatctgattttcctcccttgcacatcacgattttcgcgactgatttatcatctcgtaggc

SEQ ID NO: 1738 - DNA, 2506 bp, Ananas comosus
cgatctactggcccgatgccctagatcctcccccgtgtcctccgctgcttctcttcctcctcccagtcccagttactgcacaatggcgttggcgttcgacgagttcgggaggcccttcatcatcctcaaggagcaggagcagaagacgcggctgcgggggttggacgcgcagagggccaacatctccgcggggcgcgctgtggctcgcatcctccgcacctcgctcggccctaagggcatggacaagatgctccagagccccgacggggacgtcatcatcacaaatgatggggcaacaatcttggagcaaatggatgtcgacaatcagattgcaaagctgatggtggaattatctcgtagtcaggactatgaaattggtgatggtacaactggagttgttgttatggctggtgctcttttagaacaggccgaaaagctactcgaacgtggcatccatcctattaggattgctgagggttatgagatggcctccaggattgcttttgagcatcttgagcgtatctctcaaaagtttgaattcagtgcgactgatatagagcctttggttcagacgtgcatgacaactttgtcctcgaaaattgttaaccgctgtaagcgtatgttagctgagattgctgttaaggcagttctagcagttgctgatttagataggaaagatgtgaacttggacttaattaaagttgaaggaaaggttggagggaagctggaagacactgagctcatctatggtattgttgttgacaaggacatgagccatccgcagatgccaaaaagaattgaaaatgcgaagattgctattttgacttgcccatttgagccaccgaagccgaagactaagcataaggttgacattgacactgtagagaagtttcaaactttgcgtcagcaagaacagcagtactttgatgatatggttcagaaatgcaaggatgttggcgcaactctagttatttgtcaatggggctttgacgatgaagcaaatcatctgttaatgcataggaatctgccagctgtcagatgggttggcggtgttgaactggaattgattgcaatagctacaggtggaagaatagttcccagattccaagagttgacaccagaaaagttggggaaggccggattggtgagagagaagtctttcggaacaacaaaagatcgtatgctgtacattgaacagtgtgcaaattccagggctgtaaccattttcattcgtggtggcaacaagatgatgattgaggagacaaaacgtagtcttcacgatgctctttgcgttgcaaggaatcttattcgtaacaattccatagtttatggtggtggctcagctgagatctcttgctctattgctgttgatgctgctgcagatcgatatcctggagttgagcagtatgctatcaggtcatttgctgaagctttagattcaataccattggctctagcggagaacagtggcctgcaacctattaatactctgactgcagtcaaatctcagcaagtcaaggaaaacaatccgttctgtggcatcgattgcaacgatgtcgggacaaatgacatgaaagagcagaatgtattcgagactttgatcggaaaacagcagcaaatcttgctggcaacacaggtggtgaaaatgatccttaagattgacgatgtgatcgcaccatccgattattgatgttgtttgagagagaagcatttgccaagttttgcgttctggacagtttaactatcgtccgaaactgaaactggtctaaaaggccaagtcgttatgtggtgtttggaaatgtttgttgagcctgataactgtgctttaagatctgatttacatctcgctgtgactgcttatattgtgccttgttaatgtattggagagtgaagaacttttggacaaactgacaaagaggatagcagtaaatgttttgtcaattatttatgtatcaacgacggtgaagatttaaggtgaggaaatcgatgtgccgaatcaagcatgtcttgaccgagagagcaattgccgagcctgatcctaggaggtctgcggagatgaagaggatgattaatgcgctttgatatccttcgggaacccaacccactttaaatcttaacttagattcagatatgtcttctgttgtttgtacatttgcctgaagttaacgactactctcgtgaatcgcatgtgtttgggactcagaatatatttttggaaatgcttgttatggaaaatttgaaccaaaataaactcgacgccttctcagatatctgttctatctacttttagcagtctagcaccaaaataaatcgacgcttccgaatcgacgatctacaccgttaaatgttatctagagcatttaaaacgtttaaaaattaaattttataattttttgacatcatttaccttacgatcaaaaagtcacaaaattgacaatttttaatggccggtatgggatatttgctagtttaacggtgtaaaagaatcggaataggttgaattttt

SEQ ID NO: 1739 - DNA, 1837 bp, Centaurea maculosa
ctgagagcttgattcaactgtaaggatctgtaacaatggcgttggcgttcgatgaatacgggcggccgttcataatcctaagggaacaggaaagtaaaagtaggttaagaggtatagatgctcagaaggccaacatctccgccggcgtggccgtcgctcgcatcctgaggacctctcttggtcctaaaggcatggacaagatgcttcagagccccgacggcgacatcaccataacaaatgatggtgcaacaatcttggagcagatggatgttgacaatcaaattggtaaattgatggtggagctttcaaggagtcaggactatgagattggtgatggaacaacaggagttgttgttatggctggtgcgctgctagaacaggctgagcggttattggaacgtggtattcatccaatccgtgttgcagagggctatgagatagcttcaaagattgctgttgatcatttgcaacaaatagctcacaagtttgagttcactgctacacatatagaacctctggttcaaacttgcatgactaccttatcctctaagattgtgaatcgttgcaagcgcagtttggccgagattgctgtgaaggcagtcatggcagttgcagatttggagaggaaggatgtaaacctagacctcattaaagtggagggtaaagtaggtgggaaattggaggataccgagcttatttatgggattcttgttgacaaagatatgagtcacccacagatgccaaagcaaattgaggatgcgaaaattgccattttgacttgcccctttgagccaccaaagccaaagaccaagcataaggttgacattgataccgtcgagaagttccaaacattgcgccaacaagagcagaagtactttgatgacatggttcagcaatgcaaggatgttggagctacgctggtgatttgccaatggggttttgatgatgaagcaaatcacttgttgatgcacagaaatttacctgctgtcagatgggttggtggtgttgaattagagcttatagcaatagccactggtggaagaattgttcccaggttccaggaattaacacctgaaaagctaggcaaggctggccttgttagagagaaggcatttggtaccactaaagatcggatgctatatattgagcattgtgcaaattcaagagctgtaactattttcattcgtgggggtaacaagatgatgattgaagagaccaagcgcagcctccatgatgcattatgcgttgcaagaaatcttatccgcaataacaacatcgtctatggtggcggtgcagcggaaatttcatgctcaattgctgttgaagcagctgctgataaatacccaggagttgagcagtatgccgtcagggcttttgcggatgcgttggattctgtccccatggctcttgccgagaatagtggcctacaacccattgaaactctatctgcagtgaaatctcaacaaataaaggacaacaaccccttctgtggcatagactgcaatgatgctggcacaaacgacatgcgtgaacaaaacgtattcgagacacttatcggaaagcaacaacagctgttgcttgccacacaagtcgtcaagatgatcttgaagatcgatgatgtcatctctccaaccgagtattaagtttgtcaggtacttgacttccatgtttcttttcgtgttgaaaaaacatttttgtagtgtgttttcagctttaaatatttccgtgtttggattattattattcgagtaagattgtcgaaaagtgctcatttttgtgttgtgctagcccttgaaaccatagaacagcagaatattatttgtatttctatttgcaa

SEQ ID NO: 1740 - DNA, 1846 bp, Centaurea maculosa
caatggcgttggcgttcgatgaatacgggcggccgttcataatcctaagggaacaggaaagtaaaagtaggttaagaggtatagatgctcagaaggccaacatctccgccggcgtggccgtcgctcgcatcctgaggacctctcttggtcctaaaggcatggacaagatgcttcagagccccgacggcgatatcaccataacaaatgatggtgcaacaatcttggagcagatggacgttgacaatcaaattggtaaattgatggtggagctttcaaggagtcaggactatgagattggtgatggaacaacaggagttgttgttatggctggtgcgctgctagaacaggctgagcggttattggaacgtggtattcatccaatccgtgttgcggagggctatgagatagcttcaaagattgctgttgatcatttgcaacaaatagctcacaagtttgagttcactgctacacatatagaacctctggttcaaacttgcatgactaccttatcctctaagattgtgaatcgttgcaagcgcagtttggcggagattgctgtgaaggcagtcatggcagttgcagatttggagaggaaggatgtaaacttagacctcattaaagtggagggcaaagtaggtgggaaattggaggatacagagcttatttatgggattcttgttgacaaagatatgagtcacccacagatgccaaagcaaatcgaggatgcgaaaattgccattttgacttgcccctttgagccgccaaagccgaagaccaagcataaggttgacattgatacggttgagaagttccaaacattgcgccaacaagagcaaaagtactttgatgacatggttcagcaatgcaaggatgttggagctacgctggtgatttgccaatggggttttgatgatgaagcaaatcacttgttgatgcacagaaatttgcctgctgtcagatgggttggtggtgttgaattagagcttatagccatagccacaggtggaagaattgttcccaggttccaggaattaacacctgaaaagctaggcaaggctggcttggttagagagaaggcgtttgggaccacaaaagatcggatgctatatattgagcattgtgcaaattcaagagctgtaactattttcattcgtgggggtaacaagatgatgattgaggagaccaaacggagcctccatgatgcgttatgtgttgcaagaaatctcatccgcaataacaacattgtctatggtggcggtgcagcggaaatttcatgctcaattgccgttgaagcagctgctgataaatacccaggagttgagcagtatgccgtcagggcttttgcggatgcgttggattctgtccccatggctcttgccgagaatagtggcctacagcccattgaaacactatctgcagtgaaatctcaacaaataaaggacaacaaccctttttgtggcatcgactgcaatgatgctggcacaaacgacatgcgtgaacaaaacgtattcgagacacttatcggaaagcaacaacagctgttgcttgccacacaagtcgtcaagatgatcttgaagattgacgacgtcatctctccaaccgagtattaagtttctcaggtacttgacttccatgtttcttttcgtgttaaaaaaacgtttttgtagtgtgttttctgcctagacatttccgtttttggattattattattcgagtaagattgtcgaaaagtgctcatttttgtgttgtgctagcctttgaaaccgtcgagcagcagaatattatttgtatttctatttgcaaaggtgaaagggatttgctatctttctcaaaaaaaaaaaaaaag

SEQ ID NO: 1741 - DNA, 1970 bp, Petroselinum crispum
gctcacctctctctttatgcttctatttttggtctttcgtctctccctctctctaatagctcctccgcacatattggagacgggcaacaattatatacactcctctctgtctctctgtttcttcatttatacaaacacgaacacatcagagtagatctgggaaatggcgttagcgttcgatgagtacgggaggccatttattatactgagagaacaagatcagaagagtcgattgagaggtctcgatgctcagaaatctaacatctccgccgccaaagctgtggctcgtattcttcgtacttctctcggtcctaaaggcatggacaagatgcttcagagccccgatggcgaaatcaccatcacaaatgatggcgcaacaatcttggagcagatggatgttgacaatcaaattggaaagctgatggttgagttatctcgtagccaggactatgagattggtgatggaacaactggagttgttgtcatggctggtgcacttctcgaacaggctgagcggctattagaacgtggcattcatcccattcgaattgcagagggttttgagatggcatcaaagattgctgttgagcatttggagcaagtgtccaataaatttgactttagtgcatcaaacattgagcctctggttcaaacttgcatgactactttatcatccaaaattgtcaatagatgcaaacgtgatttggctgaaattgctgtaaaagcagttatggcagttgcagatttggaaaggaaagatgttaacctcgatcttattaaagttgagggcaaagtaggtgggaagttggaggatacagagctcatttatggaattctcgttgacaaagatatgagtcatcctcagatgccaaagcagattgtagatgcaaatatagccatcttaacgtgcccattcgaacctcctaagccaaagaccaagcataaggttgacattgataccgtggaaaaattccaaactttacgtcatcaggagcagaaatactttgatgacatggttcagaagtgcaaggatgttggtgctaccctggttatctgccagtggggttttgatgatgaggcaaatcacttgttgatgcacaggaatctgcctgctgttcgatgggttggtggagtagagttagagttgattgctatagccacaggggggagaattgttccaaggtttcaggagttgacacccgaaaagttggggaaggctggttcagttcgtgaaaaatcatttggcaccacaaaagatcggatgctctatattgaacattgcgcaaattcaaaggctgtgaccatatttattcgtggtggcaacaagatgatgatagaggagacgaaacgtagcatccatgatgcgttgtgtgtggctaggaatcttattcgcaacaactctattgtatatggtggtggttcagctgagatttcttgctcaattgctgtagagtctgctgctgataaatatccaggagttgagcagtatgcaatcagggcatttgccgatgctttggactctgtccccatggcgcttgcagaaaatagtggtcttcaacccattgaaacactatctgcagtaaaattgcagcaaattaaggagaattatccttggtgtggtgtagactgtaatgatgttggcacgaacgacatgcgtcagcagaatgtctttgagacccttattgggaaacagcagcaactcttacttgcaacacaggttgttaagatgatcttgaagattgatgatgtcatttcgccttctgattattgattggctgatcatccttggtgagaagtttgggtcacactgcaagagaacctgggttttatggttgtagaagatctctcaaactattattgttaacctactatagacatctgcgagtgactttgattgtagctttatttatatttttccagttgtgaattgatgttattgtctaccccatttaagcatattttgaatccgg

SEQ ID NO: 1742 - DNA, 2110 bp, Sorghum bicolor
ccgtcatcgagtagtaggttctcgaaacaccgccacactccgcctctcttcgaccgctccacgcgagcacctcggctcctgcctgcatccgcgccgccgcttcccttgctcgcctccgccttctggagcgagcggcaccgcgctagcggcagccatggcgctcgccttcgacgagttcgggcgccccttcatcatactcagggagcaggagaagaagacgcgcctgcgcgggctcgacgcgcagaaggccaacatcgccgccggcaaggccgtggcgcggatcctccgcacctcgctcggacccaagggcatggacaagatgctccagtcccccgacggagacgtcaccatcacaaatgatggggccacgattctggagcagatggatgttgacaaccagattgcaaagctgatggtggagctgtcccgcagtcaagactatgagatcggggatggtaccactggggtggtggtcatggcaggggcacttctagagcaggctgagaaacttctggagcgtggtattcacccgatacgggttgccgaaggttatgagatggcttcaagggtagcttttgatcaccttgagcgcatctcccaaaagtttgaattcaatgcagacaatatagagccactggttcagacctgcatgacgactctgtcgtcaaagattgttcaccgttgcaagcgggcactcgcagagattgctgtcaaagcagtccttgcggttgctgatttgggcaggaaggatgttaacttggatttaatcaaagtagaaggcaaggtcggtgggaagctggaggacacagaactaatatatggaattgtcgttgacaaagatatgagccaccctcaaatgccaaagagaattgaggatgctaagatagccatcctgacctgcccatttgagcccccgaaacctaagacaaagcataaggttgacattgatactgtagagaaattccagactctgcgtgagcaagagcagaagtactttgatgaaatggttcagaaatgcaaggatgttggtgcaaccctggttatttgtcaatggggttttgatgatgaagccaatcatctattgatgcatagaaatctgccagctgtcagatgggttggtggtgttgaattggaattgattgccatcgctacaggaggacggattgttccaagatttcaagagctgagtccagaaaagcttgggaaggctggattagtcagagagaagtcatttggaacaaccaaggaccggatgctttacattgagcagtgtgccaactccagagctgtaactattttcattcgtggtggaaataaaatgatgattgaggagaccaagcgcagtcttcatgatgctctttgtgtggcaaggaatctaatccgcaataactcaattgtgtatggtggtggctcggcagagatatcttgctcaattgctgttgaaactgcagcagatcggcaccctggagttgagcagtatgctatcaggtcatttgctgatgcattggacgctgttccactggccttagctgagaacagtggtttgcctcctattgataccttaactgtggtgaaagctcaacaagtgaaggatagcaacccccattgtggcatagattgcaatgacgttggcaccaatgacatgaaagagcagaacgtctttgagaccctgattggcaagcagcaacagatcttacttgccacgcaggtggtgaagatgatcctcaagattgacgacgtgatctcgccatctgagtactgatgaagcctgggaaagaatagacagctgtgcttggtgacaattaggcgtcagagactcagaggggctggtggcttcgatttgtgaacggcgccgtggtttaaaaggcaaaaaccattccatatgctgtgcggttaatttgccgtgccaatgatggtacctaaagaagttagctgctgcagctgcgcgcacactcttagcacttagcagagcactatacagattcaatgatgcgctagctacctttgttgagtaaattctaatgtcactaaaatttataaggctttctttaatgtcttgaaaattgttcattttccacgaataccattatgtgaattttgtgattcttgc

SEQ ID NO: 1743 - DNA, 2082 bp, Setaria italica
cccgcactccacccgcgccgccgcctccccctccgatccgggcgccggccatggcgctcgccttcgacgagttcgggcgccccttcatcattctccgggagcaggagcagaagacgcgcctgcgcggcctcgacgcgcagaaggccaacatagccgccggcaaggccgtcgcgcggatcctccgcacctcgctcggacccaagggcatggacaagatgctccagtcccccgacggcgacgtcaccatcacgaatgatggggcgacgatcctggagcagatggatgttgacaaccagattgccaagctgatggtggagctgtcacgcagccaggactatgaaatcggggatggtaccacgggggttgtcgtcatggcaggggctctcctggagcaggctgagaagcttctggagcgtggtattcacccaattagggttgctgaaggctatgagatggcgtcaaggatagcgtctgagcacctagagcgcatctcccataagtatgagttcactgccgacaacattgagccactggttcagacctgcatgacaactctatcgtcaaagattgttaaccgttgcaagcgggcactggcagagattgctgtcaaagcagtccttgcggttgctgatttggagaggaaggatgttaacttagatttaattaaagtagaaggcaaggttggtgggaagctggaggacactgagcttatatatggaattgttgttgacaaagatatgagccacccacaaatgccaaagagaattgaggatgctaagattgccatcctaacgtgcccattcgagcccccgaagcctaagacaaagcataaggttgacattgacactgtagagaaattccagacgctgcgtgaacaagagcagaaatacttcgacgaaatggttcagaagtgcaaggatgctggcgcgaccctggttatttgtcaatggggtttcgatgatgaagccaatcatttgttgatgaacagaaatctgccagctgtgagatgggttggtggtgttgaattggaattgattgccattgctacaggaggacggattgttccgagattcgaggagttgagtcctgaaaagcttgggaaggctggattagtcagagagaagtccttcggaacaacaaaggaccggatgctttacattgagcagtgtgccaattccagagctgtaactattttcattcgtggtggaaacaaaatgatgattgaggagaccaagcgcagtcttcatgatgctctctgtgtggcaaggaatctaatccgcaataactcaattgtgtatggtggcggctcagcagagatatcttgttcaattgctgttgaaaccgctgcagatcggcaccctggagttgagcagtatgctatcaggtcgtttgctgatgcattagatgctgttccactagccttggctgaaaacagtggtttgccaccaattgacactttaactgcagtaaaagctcaacaagtaaaggagagcaatccccactgcggcatcgactgcaatgacgttggcacgaacgacatgaaagaacagaacgtcttcgagacactgatcggcaagcagcagcagatcctacttgccactcaggtggtgaagatgatcctcaagattgacgacgtcatctcaccatccgaatactgatgaacccgagcggcgacgggcagctatgcttgatggcaggcattgctggggtggtggtgatttgctggggtccgcttgttgcatttgatgagctgcctacctgtttttgtgtgatgcttgcgagattgtttgtattgcatgataggaccgaaggatacgcttgctattagcctacctcttcagatgtttgcagtattgtttctttgttagagttttcacggcttttgttgaagccttgtccatttcagatccttcggaaactgtctcttctggacggcgttacaatccaaaagcgcgccactatgtctaaggctaccctggctggaccctaagccaggtcggtccaacactacatggaaccctaaacataagcacgaggcagattccagtgctgacagtctaaataaaaccaattgccaatggt

SEQ ID NO: 1744 - DNA, 1894 bp, Setaria italica
ccgcctccccctccgatccgggcgccggccatggcgctcgccttcgatgagttcgggcgccccttcatcattctccgggagcaggagcagaagacgcgcctgcgcggcctcgacgcgcagaaggccaacatagccgccggcaaggccgtcgcgcggatcctccgcacctcgctcggacccaagggcatggacaagatgctccagtcccccgacggcgacgtcaccatcacgaatgatggggcgacgatcctggagcagatggatgttgacaaccagattgccaagctgatggtggagctgtcacgcagccaggactatgaaatcggggatggtaccacgggggttgtcgtcatggcaggggctctcctggagcaggctgagaagcttctggagcgtggtattcacccaattagggttgctgaaggctatgagatggcgtcaaggatagcgtctgagcacctagagcgcatctcccataagtatgagttcactgccgacaacattgagccactggttcagacctgcatgacaactctatcgtcaaagattgttaaccgttgcaagcgggcactggcagagattgctgtcaaagcagtccttgcggttgctgatttggagaggaaggatgttaacttagatttaattaaagtagaaggcaaggttggtgggaagctggaggacactgagcttatatatggaattgttgttgacaaagatatgagccacccacaaatgccaaagagaattgaggatgctaagattgccatcctaacatgcccattcgagcccccgaagcctaagacaaagcataaggttgacattgacactgtagagaaattccagacgctgcgtgaacaagagcagaaatactttgacgaaatggttcagaagtgcaaggatgctggcgcgaccctggttatttgtcaatggggcttcgatgatgaagccaatcatttgttgatgaacagaaatctgccagctgtgagatgggttggtggtgttgaattggaattgattgccattgctacaggaggacggattgttccgagattcgaggagttgagtcctgaaaagcttgggaaggctggattagtcagagagaagtccttcggaacaacgaaggaccggatgctttacattgagcagtgtgccaattccagagctgtaactattttcattcgtggtggaaacaaaatgatgattgaggagaccaagcgcagtcttcatgatgctctctgtgtggcaaggaatctaatccgcaataactcaattgtgtatggtggcggctcagcagagatatcttgttcaattgctgttgaaaccgctgcagatcggcaccctggagttgagcagtatgctatcaggtcgtttgctgatgcattagatgctgttccactagccttggctgaaaacagtggtttgccaccaattgacactttaactgcagtaaaagctcaacaagtaaaggagagcaatccccactgcggcatcgactgcaatgacgttggcacgaacgacatgaaagaacagaacgtcttcgagacactgatcggcaagcagcagcagatcctacttgccactcaggtggtgaagatgatcctcaagattgacgacgtcatctcaccatccgaatactgatgaacccgagcggcgacgggcagctatgcttgatggcagcggcattgctggggtggtggtgatttgctggggtccgcttgttgcatttgatgagctgcctacctgtttttgtgtgatgcttgcgagattgtttgtattgcatgataggaccgaaggatacgcttgctattagcctacctcttcagatgtttgcagtattgtttctttgttacagttttcacggcttttgttgaagccttgtccatttcagatcctt

SEQ ID NO: 1745 - DNA, 1924 bp, Triphysaria pusilla
ttacttagggtcaaatgtttcttaaatcttgctgaaaaaacctcacaccattttcctcccactccgtacttcgatttcaaattcgtacccataataagatccgaaccatttccaccatagcccgaagctatggcgttagccttcgatgaatatggccggccgttcattattctaagggagcaggagcagaaaaccagattgcgcggcctcgatgcgcagaagtcgaatatctccgccggcaaagccgtggctcggatcctccgaacctcactgggaccgaaaggcatggataagatgcttcagagtcctgacggtgatatcacaataacgaatgatggtgcaacaatcttggagcagatggatgttgacaatcagattggtaagctcatggtcgaattgtcacgtagtcaagactatgaaatcggtgacggtacaactggagttgttgttctggctggtgcgcttctagaacaagctgagagacttctggaacgtgggattcatcctatccggattgcagaagggtatgaagtggcctccaggattgcttttgaacatttggagaatatatcccataagtttgtatttggcgcaacagatattgagcctttgattcagacttgtatgaccactttatcctccaagattgtgaacagatgcaagcgtaatttggctgagattgcggttaaagcagtggttgctgttgcagatttggagaggaaggatgtcaatcttgatttgattaaagtggaggggaaagtaggtggaaagctggaggataccgaactaatttacgggatagtggttgacaaagatatgagccatccacagatgccaaagcaaattcaagacgccaaaattgccattctaacatgcccctttgagcctccgaagccaaagactaaacataaggttgacattgatactgtggagaaattccaaactttacgtgaacaagagcgcaagtactttgacaatatggttcaactatgcaaggatgttggggctacattggttatctgccagtggggctttgatgacgaggcgaaccacttattgatgaatagaaacttgcctgctgtgcgatgggtcggtggtgtggagttagagctgatagctattgccacaggtggtagaattgtgccaagatttcaggagttgactccagagaaactaggcaaggctggtttggttcgagaaaaagcttttggaaccactaaagatcgaatgatatatatcgagcactgtgcgaattcaagggctgtaaccatatttatacgtggaggtaacaagatgatgatagaggaaacgaaacgcagcatttacgatgctttatgtgttgctcgtaatcttatacgcaacaattccatcgtgtatggtggtggatccgctgaaattgcttgctcgattgctgtcgaagcagctgccgacaagtaccctggagttgagcagtatgcaattagggcgtttgcagatgcattagatgctatcccgatggccctggcagaaaatagtggtctccagcctattgaaacattatctgccgtcaaatctcagcaaattaaggagaacaatagctgctgtggaattgattgcaatgatgtgggcacaaacgacatgcgcgagcagaatgttttcgagactttgatcgggaaacagcagcagctgttgcttgccacacaagtcgtcaagatgattcttaaaatcgatgatgtcatctcaccatctgagtattgatttttagtttttattttaccaggtattttgttgcaagaattttggtatccagaatagttttagttttctgaatttggttttattttaatcgtttcaagcctattcgatactttttcttggtaatgcctttttttgtgtgtatttgaattgatgtatggttgatgtgtttatcatgtcacttttttag

SEQ ID NO: 1746 - DNA, 2149 bp, Cocos nucifera
ctctcctcctttctggaacttaccactgtttccgccctctctcttctcccttgcggcggtcggtcttcctcttctccgttccaggttagaggaggaggaggagaatggcgttggcgttcgacgagtatgggaggccgttcatcatcctcaaggagcaggagcagaagagccggctgaggggcttggaggcccagaaggccaacatctcggccgggaaggccgtagctcggatcctccgcacctccctcgggcctaagggcatggacaagatgcttcagagccgcgacggcgatgtcactatcacaaatgatggggcaacaatcttggagcagatggacgttgacaaccagattgcaaagttgatggtggaattgtcccggagtcaggactatgaaattggtgatggtaccacaggagttgttgttatggctggtgcacttctagaacaggctgagaagcttcttgaacgtggcattcatcctattaggattgcagagggttatgagatggcctctaggatagctgtggagcatctggagcgaatatctcaaaaatttgaatttagtgttagtaatattgaacctttggtgcagacctgcatgaccacattgtcttcaaagattgttaatcgatgcaagcgtatgctagctgagattgctgttaaggcggttctggcagttgcagatctcgaaaggaaggatgtgaaccttgatttgattaagatagaaggaaaggttggaggtaagttggaagataccgagctcatctatggaataactgttgacaaggagatgagccaccctcagatgccaaagagaattgaagatgcgaaaattgccattctgacttgcccatttgaaccaccgaagccaaagacaaagcataaggttgacattgatactgtggagaaatttcaaaccttacgtgaacaagagcggaagtactttgatgatatggttcaaaaatgcaaggatgttggtgcgacccttgttatttgccaatggggttttgatgatgaagcaaaccatcttttgatgcatcggaatttgcctgctgtcagatgggttggtggtgttgagttggaattgattgccattgctacaggtgcaagaatagttcccagattccaagaactgacacctgataagctaggaagggctggactagttagagaaaaatcatttggtactacgaaggatcggatgttgtatattgagcaatgtgcaaactcaagggcagtgacaatattcattcgtggtggtaacaaaatgatgatagaagaaaccaagcgtagtctccatgatgcactatgtgtggcaaggaatctgatccgtaacaattccattgtttatgggggtggctcagctgagatatcttgctcaattgctgctgaagctgctgcagataaataccctggagttgagcagtacgctatcaggtcatttgctgaagctttagattctataccaatggctctggcagagaacagtggcctccaacctattaatactttgactgcagtcaaatctcagcaaatcaaggagaacaatccatattgtggcatagattgtaatgatgtggggacgaataacatgcaacagcagaatgtatttgagacgctgataggcaaacagcagcagatcctgctggcaacacaggtggtgaaaatgattttgaaaattgatgacgtgatcaccccttctgactattgattttatttgagagccaaaagtttggtgggcaaaattatgcttagatgagaatccactacatggacaagaaacgatactgttgttacgtgaattggtggccaaaactgattgattttgctttgggtgcaacttttgtttgaaggttatgatttgtagattgacttgtaactttgtgggccatcatggataagaaacctgttatattttgttccttggatgcttcaatggtacagtatttcaacgtccctttctgaatttaaaaattttcatatttggacgcctatgttgtaattgaaaagctttcatatttcgatggccggtcaagagcgagttccgccgtcatctattattaaattgtagccatcatgttagctgatgtagacataacctatgatcatggctggtaacagttccagcatttgaactgttagtctaat

SEQ ID NO: 1747 - DNA, 1707 bp, Triphysaria pusilla
gtaaaacctcacatcactctcctttcccccactccgcatttcgatttcaaattcggatccataaaagatccgatccatttccaccacaaccggagctatggctttggccttcgatgagtatggtcggccttcattattctaagggagcaggagcagaaaaccaggttgcgcggcctcgatgcgcagaaatcgaatatctccgccggcaaagccgtggctcggatcctccgaacctcactgggaccgaaaggcatggataagatgcttcagagtcctgacggtgatatcacaataacgaatgatggtgcaacaatcttggagcagatggatgttgataaccagattggtaagctcatggttgaattgtctcggagtcaagactatgaaatcggtgatgggacaactggagttgttgttatggctggtgcgcttctagaacaagctgagaaacttctggaacgtgggattcatcctatccgaattgcagaaggatatgaagtggcctcaaggattgcttacgaacatttggagcatatatcacataagtttgtatttggcgcaactgatatcgagcctttgattcagacttgcatgaccactttatcctccaagattgtgaacagatgcaagcgtagtttggctgagattgcggttaaagcagtggttgctgttgcagatttggagaggaaggacgttaatctcgacttgattaaagtggagggtaaagtaggtggaaagctggaggataccgaactgatatatgggattgtggttgacaaagatatgagccatcctcagatgccgaagcaaattcaggatgcgaacattgccattctgacctgcccctttgagcctccgaaaccaaagactaaacataaggttgacatcgacaccgtggagaaattccaaaccttacgcgaacaagaacgcaagtactttgacaatatggttcaacaatgcaaggatgttggtgctacactggttatctgccagtggggctttgatgacgaggcgaaccacttattgatgaatagaaacttgcctgctgtgcgttgggtcggtggtgtggagttagagctgatagctattgccacaggtgggagaattgtgccaagatttcaggagttgacaccagagaaactaggcaaggctggtttggttcgagaaaaagcttttggaaccactaaagatcgaatgatatacattgagcactgtgcaaattcaagggccgtaaccatatttatacgtggaggtaacaagatgatgatagaggaaacaaaacgcagcattcacgatgctttatgtgttgctcgtaatcttattcgcaacaactccattgtctatggtggtgggtccgctgaaatcgcttgctcgattgctgtggaagcagctgctgacaagcaccctggagttgagcagtatgcaattagggcgtttgcagatgcattagatgctatcccaatggccctggcagaaaatagtggtctccagcctattgaaacattatctgccgtcaaatctcagcaaattaaggagaacaatagctgctgtggaatcgattgcaatgatgtgggcacaaacgacatgcgcgagcagaatgttttcgagactttgatcgggaaacagcagcagctgttgcttgccacacaagtcgtcaagatgattctgaaaatcgatgatgtcatctcaccatccgagtattgattt

SEQ ID NO: 1748 - DNA, 1864 bp, Carthamus tinctorius
cgcgggaggcataaccctttcgactctcgcaccttccatttccacaccaccaccaccaccgtcatcatcatcctcactctttctgtatcgatctcgccgtcatcttcgaccttatatgtcgatctaagaccttaatccaaccctaaggatctgcaacaatggcgttggcgttcgatgaatacgggcggccgttcataatcttaagggaacaggaaagcaagagtaggttaagaggtttggatgctcagaaggccaacatttccgccggcgtggccgtcgctcgcatccttcggacctcccttggtcctaaaggcatggacaagatgctccagagccccgatggcgatatcaccataacaaatgatggtgcaacaatcttggagcagatggatgttgacaatcaaattggtaaattgatggttgagctttcacggagtcaagactatgagattggtgatggaacaacaggagttgttgtcatggctggtgcactgctagaacaggctgagcggttattggaacgtggtattcatccaatccgtgttgcagagggctatgagatagcttcaaagattgctgttgatcatttgcaacaaatagctcacaagtttgagttcactgctacacatatagaacctctggttcaaacttgcatgactaccttatcctctaagattgtgaatcgttgcaagcgcagtttggccgagattgctgtgaaggcagtcatggcagttgcagatttggagaggaaggacgtaaacttagacctcattaaagtggaggggaaagtaggtgggaaattggaggataccgagcttatttatgggattcttgttgacaaagatatgagtcatccacagatgccaaagcaaattgaggatacgaaaattgccattttgacttgcccctttgagccgccaaagccaaagaccaagcataaggttgacattgatacagttgagaagttccaaacactacgccaacaagagcagaagtactttgatgacatggttcagcaatgcaaggatgttggagccacgctggtgatttgccaatggggttttgatgatgaagcaaatcacttgttgatgcacagaaatttacctgctgtcagatgggttggtggtgttgaattagagcttatagcaatacccactggtggaagaattgttcccaggttccaggaattaacacctgaaaagttaggcaaggctggcttggttagagagaaggcatttggtaccacaaaagatcggatgctatatattgagcattgtgcaaattcaagagctgtaactattttcattcgtgggggtaacaagatgatgattgaggagaccaaacgcagtctccatgatgcattatgtgttgcaagaaatctcatccgcaataacaacatcgtctatggtggtggtgcagcggaaatttcatgctcgattgccgttgaagcagctgctgataagtacccaggagttgagcagtatgccgtcagggctttcgcggatgcgttggattctgtccccatggctcttgccgaaaatagtggtctacaaccgattgaaacactatctgcagtgaaatctcaacaaataagggacaacaaccctttttgtggcatagactgcaatgatgctggcacaaacgacatgcgtgaacaaaacgtattcgagacacttatcggaaaacaacagcagctgttgcttgccacacaagtcgtcaagatgatcttgaagattgatgacgtcatctctccagccgagtattaagtttcaggtactttcttttttctaccgaatttgtgttgaaaaaacatttttgtagtgtgttttctgcttaaatatttcccgtattggatcattgttat

SEQ ID NO: 1749 - DNA, 1804 bp, Amaranthus tuberculatus
aattgatctgcaaaaatggcgttagccttcgacgaattcggaaggccattcattatactcagggaacaggaatctaaaacccgtttaagaggtatagatgctcaaaaagctaacatttctgcaggaaaagctgtcgctcgtattcttcgttcttctcttggtcctaaagggatggataaaatgctccaatctcccgacggtgacattactatcacaaatgatggcgctactatcttggagcagatggacgttgacaaccaaattgcaaagttgatggttgagttatctcgtagtcaagattatgaaattggtgatgggaccactggagttgttgtcatggctggttcccttttggaacaagctgaaaacctcttagatcgtggcattcatcctatcagaatagcagaaggttatgaagtggcttcaagaattgccgttgaacatttggagaaaattgcacacaagtttgaatttgatgaaacagatgtagagcctttgatccagacatgcatgactactttgtcatccaaaattgtaaatcgctgtaagcgtagtttggctgagattgcagtcaaagcagttctcgctgtagcggacttggaacggaaggatgtcaatcttgatcttattaaagtagaagggaaggtgggaggaaaactcgaagatactgaacttatttatggaattgtggttgacaaggacatgagtcacccacaaatgccaaagaaaattgaagatgctaagatagcaattttgacttgcccctttgagccacctaagccaaaaaccaaacataaggttgacattgacactgtggaaaagtttgagacattgcgtaagcaagagcagcagtattttgatgatatggttcaaaagtgtaaggatgttggtgcaaccttggttatatgtcagtggggatttgatgacgaggcaaatcatttgttaatgaataggaatttgcctgctgtcagatgggttggcggtgttgaattggagctgattgcaattgcaacaggtggaagaattgttccaaggtttcaagaactgacccctgaaaagctgggacaggctggtttggtccgtgagaaagcttttggaacaacaaaagatcggatgctgtacattgaacattgtgccaattccagggctgtaacaatatttatccgtggaggcaacaaaatgatgattgaagagacaaagagaagcatacacgatgcactttgtgtagcaaggaatcttattcgcaataattctattgtgtatgggggtggatctgctgaaattgcatgctcgcttgctgtagaggctggtgctgatcaatacccaggagttgagcagtatgctataagggcctttgcagaagctttggatgctgttcccatggcacttgcggagaacagtggtcttcagccaattgaaacactgtctgctgtgaaacatcagcaagttaaggagaacaacacatgctgtggcatagactgcaacgatgttggcacaaacgacatgcgtgagcagaacgtattcgagactttgatcgggaagcaacaacagatattgctggcaacccaggttgtgaagatgattttgaagatagatgatgtcattactccttccgaattttgatagtactatttactaagtttagcttgccttttgcaacttcaatcaacagtagatcgtaaatcgatttaatactctaaattttgtatgctgaaccttgttcttttacattgtattgtgttctaggatcgtcttttttctgcaaaatatgcttgaatatctgcttccagattttataggaatt

SEQ ID NO: 1750 - DNA, 2149 bp, Oryza sativa
gaagaagacagcagaaaaccctcaaaccctcgcaccccgcgccgccaccgccactccccccccccgcgccgccaccccaccccaccccaccccacgccgtctcctccgatcgccggagaaggaggaggaggcgtcagccatggcgctggccttcgacgagttcggccgccccttcatcatcctgcgtgagcaggagaagaagtcgcggctgcgcggcctcgacgcccagaaggccaacatcgccgccggcaaggccgtcgcccgcatcctccgcacctcgctcggccccaagggcatggacaagatgctccagtcccccgacggcgacgtcaccatcacaaatgatggcgcaacgatcctggagcaaatggatgtggacaaccaaatcgcgaagctgatggtggagctgtcctgcagtcaagactacgagattggggatggtaccactggtgttgtggtcatggctggctctctcctggagcaagccgagaaactgctggaacgcggcattcaccccataaggatcgccgaaggttatgagttggcctcaaggatagcttttgatcaccttgagcacatctcccacaagtttgagtttagtgctaccaatatagagcctctggtgcagacctgcatgacaaccctgtcatcgaaaattgttaaccgttgtaagaggactcttgctgagattgctgtgaaagcggtccttgctgtggctgatttggaaaggaaggatgtaaacttggacttgatcaaagtggaaggtaaggtaggcgggaaactagaggatactgagctagtatatggaatcattgtcgacaaagatatgagccaccctcaaatgccaaagaggattgaggatgctaagattgccatcctgacctgcccatttgagcccccgaagcctaagacaaagcataaggttgacattgatactgtagagaagttccagatgctgcgtgagcaagagcaaaaatactttgatgaaatggttcagaaatgcaaggatgttggagcaaccctagttatttgccaatggggctttgatgatgaagccaatcatctgctgatgcatagaaatttgccagctgtcagatgggttggtggtgttgaattagaattgattgccattgctacaggagggcggattgttccgaggttccaagagttgagtcctgaaaagcttgggaaggctggaatagtcagagagaaatcatttggaacaacaaaagatcgcatgctttacattgaacagtgtgccaactccagagctgtaactatcttcatacgtggtggcaacaaaatgatgattgaggagaccaagcgaagtcttcatgatgctctttgtgttgcaaggaatcttatccgtaataattcaattgtgtatggtggtggttcagcagaaatatcttgctcagttgctgttgaagctgctgcagatcggtacccaggagttgaacagtatgcaatcaggtcatttgctgatgcgttggatgctattccactagccttggccgaaaacagtggtttgtctcctattgatacactgacagcagtaaaatctcaacaagtaaaggagagcaatcctcactgtggcattgactgcaacgatgttgggacaaaccacatgaaggaacaaaatgtttttgaaacactgataggcaagcagcagcagatcttactggcaacccaggtggtgaagatgattctcaagatcgatgatgttatctcgccttctgactattgatgatgcttttgaagactatggagtttattgtgctagggccttggcgacaagcacttccagtaggctctacattttctgtcgatcggtttttgattaacatttacgccatgggtttgcttgcttgtgctatttgatgagctatctgtttgtgtgaacttaacttttggtactttgtttttcgcgcccgcactttgtatagcttgagacaatagcacaatccctttgaagctggcctagaagtttgagtagctaccatttgctcttgtgctgctcagattcgtagatgctatataggttgcgcgctgtggtagtatcgtattgtgttctgcatcgtccgcatgtactctacttttcttaatgatcattttgagccatatgaatatttacaattttcggttaaaa

SEQ ID NO: 1751 - DNA, 2223 bp, Cichorium intybus
cttgtgggatttttgatgcgtatgtcgatctaagagcttaagcaagttcaagatcaacaaaatggcgttagcgttcgatgaatatgggcggccgtttataatcttaagggaacaagaaagtaagagtaggttaagaggtatagatgctcagaaagccaacatttccgccggcaccgccgttgctcgcatccttcggacgtcacttggcccaaaaggcatggacaagatgctccagagccccgacggcgacatcaccatcacaaatgatggtgcaacaatcctggaacaaatggatgttgacaatcaaattggtaaactgatggttgaactttcaaggagtcaagactatgaaattggtgatggaacaacaggagttgtagtcatggctggtgcacttctagaacaagctgaacgactcttagaacgcggtattcatccaattcgtgttgcagaaggctatgaaattgcctcaaagattgctgttgatcatttacaacaaatctcacacaagtttgaattcaatgcttcaaatatagaacctctagtccaaacttgcatgactaccttatcctctaaaattgtgaaccgttgtaagagaagtttggctgagattgctgtgaaggcagtaatggcggttgctgatttagagagaaaggatgttaatttagatcttataaaagtggagggaaaagtaggtgggaaattggaggatactgagcttatttatgggattcttgttgataaagatatgagtcacccacaaatgccaaagcaaattgaggatgctaaaattgctattttgacttgcccttttgagccaccaaagccaaaaaccaaacataaggttgatattgatacggttgaaaagtttcaaactttacgtgagcaagaaaagaagtactttgataacatggttcaacaatgcaaggatgttggggctactttggtaatttgccaatggggttttgatgatgaagcaaatcacttgttaatgcatagaaacttacctgctgtgagatgggttggtggtgttgaattagagcttatagccatagccactggtggaagaattgtcccaaggtttcaggaattaacagctgacaaactaggcaaggctggtttggttagagagaaagcatttggtaccacaaaagatcggatgctatatattgaacattgtgcaaattcaagagctgtaacaatatttattcgtggaggtaacaaaatgatgatagaggagacaaaacgcagcatccatgatgcattatgtgttgcaagaaatctcatccgcaataattcaattgtatacggtggtggcgcagctgaaatttcatgctcaattgcagttgaagctgctgcggataaatatcccggagttgaacagtatgctgttagggcttttgcagacgcgttagattctgtccccatggctcttgctgaaaacagcggtcttcaacccattgaaacactatctgcggtcaaatctcaacaaataaaggagaacaatgcgtgctgtgggattgattgtaatgatgctggcacaaacgacatgcgtgagcaaaacgtatttgaaaccctgattggaaagcaacaacagctgttgcttgcaacgcaagtcgtgaagatgatcttgaaaattgatgacgtcatctccccatctgagtattgattgattttcttgtacttgaagttttgctctacgtgctaacattttcatgtcgttttgtttacttgagatgtttgttaggggttttttagtgtgttttctggttagattttttatgaatttctttttatgcatttttattatattggatttgatacaatcttgaaggtattatttctgtatgttttcaagtttttgcaaaacagacttctttatatgtgggattagatttgattttcgttgtgtagattttgtgacgatctttatcagttatgttgcttatttgatatttagaccgaccaatttaaatgctaggaaagagtatgaacttctcgagctttttcgatttagtttattggaaattcgactttgaattaaaagaaaattttgaataccccccccccccctttcttttatatgtttcgattttatcatgtttaagctaattatagttatttttgaaactctcaataaaatataaatggtgactggaatctctgcggtaaaattacctgtttatgttaaatggggatacccgataccccacctcctccccc

SEQ ID NO: 1752 - DNA, 1707 bp, Echinochloa colona
cggccatggcgctcgccttcgacgagttcgggcgccccttcatcatcctgcgggagcaggagaagaagacgcgcctgcgcgggctcgacgcgcagaaggccaacatcgccgcgggcaaggccgtcgcgcggatcctccgcacctcgctcgggcccaagggcatggacaagatgctccagtcccccgacggcgacgtcaccatcacaaatgatggggcaacgatcctggagcagatggatgttgacaaccagattgcaaagctgatggtggagctgtctcgcagtcaagactatgaaatcggggatgggaccaccggggtcgtcgtcatggcaggggctctcctggagcaggctgagaagcttctcgaacgtggtattcacccgattagggttgctgaaggatatgagatggcgtcgaggatagcttttgagcacctagaacacatctcccagaagtttgagttcagtgcggacaatattgagccactggttcagacctgcatgacaactctatcgtccaagattgttaaccgttgcaagcgggcactggcagagattgctgtcaaagcggtccttgcagttgctgatttggagaggaaagatgttaacttggacttaattaaagtagaaggcaaggttggtgggaagctggaggacactgagctcatatatggaattgttgttgacaaagatatgagccacccgcaaatgccaaagagaattgaggatgctaagattgccatcctgacctgcccatttgagcccccgaagcctaagacaaagcataaggttgacattgacactgtagagaaattccagacactgcgcgagcaagagcagaaatactttgatgaaatggttcagaagtgcaaggatgctggtgcgaccctggttatttgtcaatggggtttcgatgatgaagccaatcatctattgatgcacagaaatctgccagctgtccgatgggttggtggtgttgagttggaattgattgccattgctacaggaggacgtattgttccgagattccaagagttgagtgctgataagcttgggaaggctggattagtcagagagaagtccttcgggacaacaaaggaccggatgctttatattgagcagtgtgccaattccagggctgtaactattttcattcgtggtgggaacaaaatgatgattgaggagaccaagcgcagtcttcacgatgctctttgtgtggcaaggaatctaatccgcaataactcaattgtgtatggcggcggctcagcagagatatcttgttcaattgctgttgaaactgctgcagatcggcaccctggggttgagcagtatgctatcaggtcgtttgctgatgcgttagacgctgttccattagccttggctgaaaacagtggtttgccaccaattgacaccttaaccgcggtgaaagcccaacaagtaaaggagagcaacccccactgcggcatagactgcaacgaggttggcaccgacgacatgaaagaacagaacgtcttcgagactctgattggcaagcagcagcagatcttgcttgccacacaggtggtgaagatgatcctcaagatcgatgatgtgatctcgccatccgagtactgatgaagcgcctgagaaggaacgagcagctgcgtttgttgacaatctatcagtaggcggcaatgctgatgtgatggccttcgttttgattattttt

SEQ ID NO: 1753 - DNA, 2036 bp, Echinochloa colona
ccccgcgccgactagaaagaaacaccgccacactccgctgctccctccccgtccccactctccaccccgcgccgccgccgcccgatccggccttttccgggagctcgcgctccgcgccaaggggcggccatggcgctcgccttcgacgagttcgggcgccccttcatcatcctgcgggagcaggagaagaagacgcgcctgcgcggcctcgacgcgcagaaggccaacatcgccgccggcaaggccgtcgcgcggatcctccgcacctcgctcggccccaagggcatggacaagatgctccagtcccccgacggcgacgtcaccatcacaaatgatggggcaacgatcctggagcagatggatgttgacaaccagattgcaaagctgatggtggagctgtctcgcagtcaagactatgaaatcggggatgggaccaccggggtcgtcgtcatggcaggggctctcctggagcaggctgagaagcttctcgaacgtggtattcaccctattagggttgctgaaggctatgagatggcgtcaaggatagcttttgagcacctagaacacatctcccagaagtttgagttcagtgcggacaatattgagccactggttcagacctgcatgacaactctatcgtccaagattgttaaccgttgcaagcgggcactggcagagattgctgtcaaagcggtccttgcagttgccgatttggagaggaaagatgttaacttggacttaattaaagtagaaggcaaggttggtgggaagctggaggacactgagctcatatatggaattgttgttgacaaagatatgagccacccgcaaatgccaaagagaattgaggatgctaagattgccatcctgacctgcccatttgagcccccgaagcctaagacaaagcataaggttgacattgacactgtagagaaattccagacactgcgcgagcaagagcagaaatactttgatgaaatggttcagaagtgcaaggacgctggtgcgaccctggttatttgtcaatggggtttcgatgatgaagccaatcatctattgatgcacagaaatctgccagctgtccgatgggttggtggtgttgagttggaattgattgccattgctacaggaggacgtattgttccgagattccaagagttgagtgctgataagcttgggaaggctggattagtcagagagaagtccttcgggacaacaaaggaccggatgctttatattgagcagtgtgccaattccagagctgtaactattttcattcgtggtgggaacaaaatgatgattgaggagaccaagcgcagtcttcacgatgctctttgtgtggcaaggaatctaatccgcaataactcaattgtgtatggcggcggctcagcagagatatcttgttcaattgctgttgaaactgctgcagatcggcaccctggggttgagcagtatgctatcaggtcgtttgctgatgcgttagacgctgttccattagccttggctgaaaacagtggtttgccaccaattgacaccttaaccgcggtgaaagcccaacaagtaaaggagagcaacccccactgtggcatagattgcaacgaagttggcgccaacgacatgaaagaacagaacgtctttgagactctgattggcaagcagcagcagatcttgctcgccacccaggtggtgaagatgatcctcaagatcgatgacgttatctcaccgtccgagtactgatgaagcctgcaagtaatggacgtctgtcgtgttggcagcattgcttgtgtgttttattggtgtacttttcattctggcttgctctggttgcttgtcaagttgttgtattcgatgagcagcctgcctgattttgtgtgatgcttgccaaaactgtctgtattgcacgataggaccaaggatatgttggaaattagcctagacgctgtatttttcttcagatggttgcggttttgttactttgttagtatttctacgtctcgtctaaatctttgccgccttcagattcttgaaactgtggc

SEQ ID NO: 1754 - DNA, 2038 bp, Echinochloa colona
acccctccccgcctccgatccgggtccctccgggagcctccagagcgggcgccggccatggcgctcgccttcgacgagttcgggcgccccttcatcatcctgcgggagcaggagaagaagacgcgcctgcgcggcctcgacgcgcagaaggccaacatcgccgccggcaaggccgtcgcgcggatcctccgcacctcgctcgggcccaagggcatggacaagatgctccagtcccccgacggcgacgtcaccatcacaaatgatggggcaacgatcctggagcagatggatgttgacaaccagattgcaaagctgatggtggagctgtctcgcagtcaagactatgaaatcggggatgggaccaccggggtcgtcgtcatggcaggggctctcctggagcaggctgagaagcttctcgaacgtggtattcacccgattagggttgctgaaggatatgagatggcgtcgaggatagcttttgagcacctagaacacatctcccagaagtttgagttcagtgcggacaatattgagccactggttcagacctgcatgacaactctatcgtccaagattgttaaccgttgcaagcgggcactggcagagattgctgtcaaagcggtccttgcagttgctgatttggagaggaaagatgttaacttggacttaattaaagtagaaggcaaggttggtgggaagctggaggacactgagctcatatatggaattgttgttgacaaagatatgagccacccgcaaatgccaaagagaattgaggatgctaagattgccatcctgacctgcccatttgagcccccaaagcctaagacaaagcataaggttgacattgacactgtagagaaattccagacactgcgcgagcaagagcagaaatactttgatgaaatggttcagaagtgcaaggatgctggtgcgaccctggttatttgtcaatggggtttcgatgatgaagccaatcatctattgatgcacagaaatctgccagctgtccgatgggttggtggtgttgagttggaattgattgccattgctacaggaggacgtattgttccgagattccaagagttgagtgctgataagcttgggaaggctggattagtcagagagaagtccttcgggacaacaaaggaccggatgctttatattgagcagtgtgccaattccagagctgtaactattttcattcgtggtgggaacaaaatgatgattgaggagaccaagcgcagtcttcacgatgctctttgtgtggcaaggaatctaatccgcaataactcaattgtgtatggcggcggctcagcagagatatcttgttcaattgctgttgaaactgctgcagatcggcaccctggggttgagcagtatgctatcaggtcgtttgctgatgcgttagacgctgttccattagccttggctgaaaacagtggtttgccaccaattgacaccttaaccgcggtgaaagcccaacaagtaaaggagagcaacccccactgtggcatagattgcaacgaagttggcgccaacgacatgaaagaacagaacgtctttgagactctgattggcaagcagcagcagatcttgcttgccacacaggtggtgaagatgatcctcaagatcgatgatgtgatctcaccatccgagtactgatgaagcaagcctgagaaggaaaggacagctgcgcttgttgacaatctgggcggcattgctgatgtgatggccttcgttttgattaatttttgagaagtctggttagagacaggaggggcataaactgagggagggtcgccagtctgttctgcactgaggggtttgcgagtcgagttggtttgtgcagggtgcaggcttgctgagccgtgcttccgtgccgcggtccaaacagaaccattccacatgttgtacggcttattttaaatttaccctgattttttcatcgagcttgttccagacccaaatcagccttataatcgagaggttacccgaaactgatcggtatgttttggtaaatttaacgtgaacggat

SEQ ID NO: 1755 - DNA, 2036 bp, Cenchrus ciliaris
ggctcttccagcagggcgcgctccgcgccaagcgagcggccatggcgctcgccttcgacgagttcgggcgccccttcatcatcctcagggagcaggagaagaagacgcgcctgcgcggcctcgacgcgcagaaggccaacatcgcctccggcaaggccgtagcgcggatcctccgcacctcgctcgggcccaagggcatggacaagatgctccagtcccccgacggcgacgtcaccatcacaaatgatggggccacgatcctggagcagatggatgttgacaaccagattgctaagctgatggtggagctttcccgcagtcaagactatgaaatcggagatggtaccacgggggtggtcgtcatggcaggggctctcttagagcaggctgagaaacttctggaacgtggcattcacccaataagggttgccgaaggttatgagatggcatcaaggatagcttttgatcaccttgagcgcatctcccagaagtttgagttcagtgcagacaatatagaacccctggttcagacctgcatgactacgctgtcatcaaagatagttaaccgctgcaagcgggcactggcagagattgctgtcaaagcagtccttgcagttgctgatttggagaggaaagatgttaacttggatttaattaaagtagaaggcaaggttggtgaaaagctggaggacacggagctcatatatggaattgttgttgacaaagatatgagtcacccacaaatgccaaagagaattgaggatgctaagatagccatccttacttgcccatttgaacccccgaagcctaagacaaagcataaggttgacattgacactgtagagaaattccagaccctgcgcgagcaagagcagaagtactttgatgaaatggttcagaaatgcaaggatgccggtgcgaccctggttatctgtcagtggggtttcgatgatgaagcaaatcatctcttgatgaacagaaatctgccagctgtcagatgggttggtggtgttgaattggaattgattgccatcgctacaggaggccggattgttccgaggttccaagagctgagtcctgaaaagcttgggaaggctggattagtcagagagaagtcatttggaacaaccaaggacaggatgctttacattgagcagtgtgccaattccagagctgtaactattttcattcgtggtggaaacaagatgatgatcgaggagaccaagcgcagtcttcatgacgctctttgtgtggcaaggaatcttatccgcaataactcaatcgtgtatggtggtggctcagcagagatatcttgctcgattgctgttgaaactgctgcagatcgacaccctggagttgagcagtatgctatcaggtcatttgctgatgcattagacgctgttccactagccttagcggaaaatagtggtttgccacctattgatacgttaactgcggtgaaagctcaacaagtcaaggagagcaacgcccactgcggcatagactgcaatgatgttggcaccaacgacatgaaggagcaaaacgtctttgagactctgattggcaagcagcagcagatcttgcttgccacgcaggtggtgaagatgatcctcaagatcgacgacgtgatctcgccgtccgagtactgacgaaggaagcctgagaaggggcagtcgtgcttggtgacaatctatcagtaggcagtattgctgatgtgccgacacatggtgcttattttttggggaagtctagttggatacaagagggagacaagttgtgggacggcaaagacacatgcttcatgttgagacaggttggcagtccgtgttctgcgtcagagaggtgttgtgaggcgaatcaggtttgtgtgtagggtgcaggcagggcctcactgtggtgctgccgtcgaaaagaaccattccacatgctgtacgggtcgttttcaatttatgctggttttcattgagcttattccagacccaagtcggtctcgaaattctggtaggaatttatttaaagaacactagtcagaaaac

SEQ ID NO: 1756 - DNA, 2214 bp, Setaria italica
gccgtctagaaagtagaagcaccgccacactccgctgctccctccccgtcccccgcactccaccacacgccgccgccgcccgtccgatccgcgggatcttccaggagagcgcgctccgcgccaagcggcggccatggcgctcgccttcgacgagttcgggcgccccttcatcatcctcagggagcaggagaagaagacgcgcctgcgcggcctcgacgcgcagaaggccaacatcgccgcgggcaaggccgtcgcgcggatcctccgcacctcgctcgggcccaagggcatggacaagatgctccagtcccccgacggcgacgtcaccatcacaaatgatggggcgacaatcctggagcagatggatgttgacaaccagattgcgaagctgatggtggagctttcccgcagtcaagactatgaaatcggagatgggaccactggggtcgttgtcatggcaggggctctcttagagcaggctgagaaacttctggaacgtggtattcacccaataagggttgctgaaggttatgagatggcatcaaggatagcttttgatcaccttgagcacatctcccgaaagtttgagttcagtgcagacaatatagagcccctggttcagacatgcatgactacgctgtcgtcaaagattgttaaccgctgcaagcgggcactggcagagattgctgtcaaagcagtccttgcggttgctgatttggagaggaaagatgttaacttggatttgattaaagtagaaggcaaggttggtggaaagctggaggacacggagctcatacatggaattgttgtcgacaaagatatgagtcacccacaaatgccaaagagaattgaggatgctaagatagccatccttacttgcccatttgagcccccgaagcctaagacaaagcataaggttgacattgacactgtagagaaattccagaccctgcgcgagcaagagcagaagtactttgatgaaatggttcagaagtgcaaggatgctggtgcgaccctggttatttgtcagtggggttttgatgatgaagccaatcatctcttgatgcacagaaatttgccagctgtcagatgggttggtggtgttgaattggaattgattgccattgctacaggaggccggattgttccgagattccaagagctgagtcctgaaaagcttgggaaggctggattagtcagagagaagtcatttggaacaaccaaggaccggatgctttacattgagcagtgtgccaattctagagctgtaactattttcattcgtggtggaaacaagatgatgattgaggagactaagcgcagccttcatgatgctctttgtgtggcaaggaatcttatccgcaataattcaatcgtgtatggtggtggctcagcagagatatcttgctcgattgctgttgaaactgctgcagatcgacaccctggagttgagcagtatgctatcaggtcatttgctgatgcattagatgctgttccactagccttagctgaaaatagtggtttgccgcctattgatacattaactgtggtgaaagctcagcaagttaaggagagcaacccccactgcggcatagactgcaatgacgttggcaccaacgacatgaaggagcaggacgtctttgagactctgattggcaagcagcagcagatcttgcttgccacgcaggtggtgaagatgatcctcaagatcgatgatgtgatctcgccgtccgagtactgatgaaacctgagaaggggcagttgtgcttggtgacaatctatcagtaggcagcatttctgatgtgctgacaccttcatggtgcttatttttgagaagtctagttggatacaagaggggcacaagttgtgggacgtcaaagacacatgcttcatgttgagacggttgccagtccgtgttctgcgccagaggggttgtgaggcgagtcaggtttgtgtagggtgccggcagagccgcactgcggtgctgctgtccaaaagaaccattccacatgctgtaagggtcattttcaattcatgctgattttcatgagcttattccagacccaaatcagcctcaaaatcttgtaggaatttgttaaagttactagtcagaaatgatggttttgttttggtaaatttatcgtttgttggcttgttgcaataccatcatttttgttatgacgatattacaagtgtctctttcatagtactgcg

SEQ ID NO: 1757 - DNA, 2138 bp, Setaria italica
ccgctgctccctccccgtcccccgcactccaccacacgccgccgccgcccgtccgatccgcgggatcttccaggagagcgcgctccgcgccaagcggcggccatggcgctcgccttcgacgagttcgggcgccccttcatcatcctcagggagcaggagaagaagacgcgcctgcgcggcctcgacgcgcagaaggccaacatcgccgcgggcaaggccgtcgcgcggatcctccgcacctcgctcgggcccaagggcatggacaagatgctccagtcccccgacggcgacgtcaccatcacaaatgatggggcgacaatcctggagcagatggatgttgacaaccagattgcgaagctgatggtggagctttcccgcagtcaagactatgaaatcggagatgggaccactggggtcgttgtcatggcaggggctctcttagagcaggctgagaaacttctggaacgtggtattcacccaataagggttgctgaaggttatgagatggcatcaaggatagcttttgatcaccttgagcacatctcccgaaagtttgagttcagtgcagacaatatagagcccctggttcagacatgcatgactacgctgtcgtcaaagattgttaaccgctgcaagcgggcactggcagagattgctgtcaaagcagtccttgcggttgctgatttggagaggaaagatgttaacttggatttgattaaagtagaaggcaaggttggtggaaagctggaggacacggagctcatacatggaattgttgtcgacaaagatatgagtcacccacaaatgccaaagagaattgaggatgctaagatagccatccttacttgcccatttgagcccccgaagcctaagacaaagcataaggttgacattgacactgtagagaaattccagaccctgcgcgagcaagagcagaagtactttgatgaaatggttcagaagtgcaaggatgctggtgcgaccctggttatttgtcagtggggttttgatgatgaagccaatcatctcttgatgcacagaaatttgccagctgtcagatgggttggtggtgttgaattggaattgattgccattgctacaggaggccggattgttccgagattccaagagctgagtcctgaaaagcttgggaaggctggattagtcagagagaagtcatttggaacaaccaaggaccggatgctttacattgagcagtgtgccaattctagagctgtaactattttcattcgtggtggaaacaagatgatgattgaggagactaagcgcagccttcatgatgctctttgtgtggcaaggaatcttatccgcaataattcaatcgtgtatggtggtggctcagcagagatatcttgctcgattgctgttgaaactgctgcagatcgacaccctggagttgagcagtatgctatcaggtcatttgctgatgcattagatgctgttccactagccttagctgaaaatagtggtttgccgcctattgatacattaactgtggtgaaagctcagcaagttaaggagagcaacccccactgcggcatagactgcaatgacgttggcaccaacgacatgaaggagcaggacgtctttgagactctgattggcaagcagcagcagatcttgcttgccacgcaggtggtgaagatgatcctcaagatcgatgatgtgatctcgccgtccgagtactgatgaaacctgagaaggggcagttgtgcttggtgacaatctatcagtaggcagcatttctgatgtgctgacaccttcatggtgcttatttttgagaagtctagttggatacaagaggggcacaagttgtgggacgtcaaagacacatgcttcatgttgagacggttgccagtccgtgttctgcgccagaggggttgtgaggcgagtcaggtttgtgtagggtgccggcagagccgcactgcggtgctgctgtccaaaagaaccattccacatgctgtaagggtcattttcaattcatgctgattttcatgagcttattccagacccaaatcagcctcaaaatcttgtaggaatttgttaaagttactagtcagaaatgatggttttgttttggtaaatttatcgtttgttggcttgttgcaataccatca

SEQ ID NO: 1758 - DNA, 1717 bp, Cichorium intybus
caaaatggcgttagcgttcgatgaatatggtcggccgttcataatattgagggaacaagagagtaagagtaggttaaggggtttagatgctcagaaggctaatatcgccgccggcgttgctgtttctcgcatcctccgtacatctcttggacctaaaggcatggacaagatgctccagagccccgacggcgacatcaccatcacaaatgatggtgcaacaatcctggaacaaatggatgttgacaatcaaattggtaaactgatggttgaactttcaaggagtcaagactatgaaattggtgatggaacaacaggagttgtagtcatggctggggcacttctagaacaagctgaacgactcttagaacgcggtattcatccaattcgtgttgcagaaggctatgaaattgcctcaaagattgctgttgatcatttacaacaaatctcacacaagtttgaattcaatgcttcaaatatagaacctctagtccaaacttgcatgactaccttatcctctaaaattgtgaaccgttgtaagagaagtttggctgagattgctgtgaaggcagtaatggcggttgctgatttagagagaaaggatgttaatttagatcttataaaagtggagggaaaagtaggtgggaaattggaggatactgagcttatttatgggattcttgttgataaagatatgagtcacccacaaatgccaaagcaaattgaggatgctaaaattgctattttgacttgcccttttgagccaccaaagccaaaaaccaaacataaggttgatattgatacggttgaaaagtttcaaactttacgtgagcaagaaaagaagtactttgataacatggttcaacaatgcaaggatgttggggctactttggtaatttgccaatggggttttgatgatgaagcaaatcacttgttaatgcatagaaacttacctgctgtgagatgggttggtggtgttgaattagagcttatagccatagccactggtggaagaattgtcccaaggtttcaggaattaacagctgacaaactaggcaaggctggtttggttagagagaaagcatttggtaccacaaaagatcggatgctatatattgaacattgtgcaaattcaagagctgtaacaatatttattcgtggaggtaacaaaatgatgatagaggagacaaaacgcagcatccatgatgcattatgtgttgcaagaaatctcatccgcaataattcaattgtatacggtggtggcgcagctgaaatttcatgctcaattgcagttgaagctgctgcggataaatatcccggagttgaacagtatgctgttagggcttttgcagacgcgttagattctgtccccatggctcttgctgaaaacagcggtcttcaacccattgaaacactatctgcggtcaaatctcaacaaataaaggagaacaatgcgtgctgtgggattgattgtaatgatgctggcacaaacgacatgcgtgagcaaaacgtatttgaaaccctgattggaaagcaacaacagctgttgcttgcaacgcaagtcgtgaagatgatcttgaaaattgatgacgtcatctccccatctgagtattgattgattttcttgtacttgaagttttgctctacgtgctaacattttcatgtcgttttgtttacttgagatgtttgttaggggttttttagtgtgttttctgattag

SEQ ID NO: 1759 - DNA, 1796 bp, Brassica oleracea
gtgagagagaggaaagcgaagatctgtacttggatcggatcgagaaaagctaagactcgaaaatggcgctggcgttcgatgagttcgggcgaccgttcattatactaagggagcaggatcaaaagacgcgtcttagaggcatcgatgctcagaaagccaatatcgccgccggcaaagcggtggctcggatcctccgttcctcactcggacctaaggggatggataagatgctccagggacctgacggagacgtcaccatctcaaacgacggtgcgaccatcttggagcaaatggatgttgacaaccagattgcaaagcttatggtcgaactgtcgcgtagtcaggattatgaaattggtgacggcacaacaggtgttgttgtcatggctggtgcacttctggagcaagctgaacgtcagttagatagaggaattcaccctatccgtattgctgaaggatatgagacggcttctagagtagctgttgaacatttggagcgtatagctcagaagtttgaattcgacgttaataactacgagccattggttcagacatgcatgactactctatcctcgaagattgtgaatcgatgcaagcgcagcttagctgagattgctgtgaaagcagttcttgctgttgctgatttagagagaagggacgttaacttagatttgataaaagttgagggcaaggtcgggggaaagttggaggacactgagcttatatatggaatactggttgacaaagacatgagccatccacagatgccaaagcagattgaagatgcccacattgccattctgacttgcccctttgagccaccgaagcccaagactaagcacaaggtggacatcgacacagtggagaagtttgagacgttgcgcaagcaagagcagcaatatttcgatgagatggttcaaaagtgcaaggatgttggtgctacactggttatttgccaatggggattcgatgatgaggcaaaccatctattgatgcacaggaatttgcctgctgtcagatgggtcgggggtgttgaattagaacttatcgcaatagccacaggcggcagaattgttccaagattccaggagttgaccccagagaagttagggaaggctggcatggtccgtgaaaaatcatttggcacaacaaaagaacgaatgctgtatattgagcactgtgcgaactcaaaagctgtcactattttcatccgtggaggtaacaaaatgatgatagaagaaacgaagcgtagtatccacgatgctctgtgtgtggcaaggaatctcatccgcaataagtcaattgtatatggaggtggtgcagctgaaatcacatgctcacttgcagttgatgcagctgctgataaataccctggcgtcgagcagtatgcaataagggcattcgcagaagcattggactctgtccctatggctcttgcggagaacagtggactacagcccattgagacactctctgcggttaaatctcagcaaattaaggagaatattccattctatgggatagattgcaacgacgtgggaacaaacgatatgagggagcaaaatgtgtttgaaacattgataggaaagcagcagcagattttgcttgcaactcaagtcgttaagatgattctaaagatcgacgatgtcatctctaattctgaatactgatgaagtactgctgcaacctttttagttcttcccttttgcctcttttgtttgctttttctattagcttttgatactattcaaccatttttttcctctcttgtaagcttttattttaagatcatcctc

SEQ ID NO: 1760 - DNA, 1972 bp, Brachypodium distachyon
ccgcctcctcccggcgcgatccgactcgtccctccgaacagagcgcgcactcgcgcactcgtagcaggcggcggccatggtgctggtcttcgacgagttcggccggcgtttcatcatcctgagggagcaggagagcaagtcgcgcctgcgggggctcgatgcgcacaaggccaacgtcgccgccggcaaggccgtcgcgcgcatcctccgcacctcgctcggccccaagggcatggacaagatgctccagtcccctgacggcgacgtcacaatcacaaatgatggtgcaacaatcctggaacaaatggatgttgacaaccagatcgcaaagctgatggtggagctatcccgcagtcaagactatgaaattggggatggtaccactggggtggtggtcatggcagggtcgctcctggagcaagctgaaaaacttcttgagcgaggtattcatccaataaggattgcggaaggttatgagatggcctcgcggatagcttttgaccaccttgaacacatctccaataagtttgagttcacggccacaaatatagagcctttggtgcagacctgcatgaccactctgtcctcaaagattgttaaccgttgtaagcggatgcttgctgagattgctgtcaaggcagtccttgcagttgctgatttggaaaggaaggatgtaaacttggacttgattaaagtagaaggcaaggttggtgggaagctagaggacactgagctaatatacggaattgctgttgacaaagacatgagccatccacaaatgccaaagagaattgaggatgctaatattgccatcttgacctgcccatttgagcccccgaagcccaagacaaagcataaggttgacattgacactgtagaaaaattccagactctgcgtgagcaagagcagaaatactttgatgaaatggttcagaaatgcaaggatgttggtgcaaccttggttatttgccaatggggttttgacgatgaagccaatcacttgcttatgcatagaaatctgcctgctgtcagatgggttggtggtgttgaattggaattgattgccatagctacaggggggcggattgttccaagattccaagagttgagtcctgaaaagcttggaaaggctggattagttagagagaagtcatttggaacaacaaaagatcgaatgctttacatcgagaagtgtgcaaattccagagctgtaactatcttcattcgtggtggcaacaaaatgatgattgaggaggccaagcgaagtattcatgatgctctgtgtgtggctaggaatcttatccgcaataactctattgtttatggtggcggctcagctgagatatcttgctcaatagctgtcgatgctgctgcagatcgatatgctggagttgagcagtatgcaatcagatcgtttgctgatgcgttggacggcattccactagccttagctgaaaacagtggtttgccacctattgatacactgactgcagtaaaatctcagcaagttaaggaaggcaatccccactgtggcattgactgcaacgatgtcgggacgaatgacatgagagagcagaacgtgtttgaaaccctgattggcaagcagcagcagttattgctggcaacgcaggtggtgaagatgattctcaagattgacgatgttatcactccgtccgagttctgagtattggctatattgcaagcatggacaacgaagctggatgtgacaactggcaagcaattagtctaccagacctgaagcagttgtgtttgtttggtggagctagcgagcaacctgtgtgtttttgctgtgacgctcatccacactgtagcgcatgaaatatcttcctgtagcttagaagtttggatgaacaatctcatttttcacccctatattttcagatgcttaatgctatatagtttggatgtttttgctcgtaccttttaccatctaaaattgattattcaatca

SEQ ID NO: 1761 - DNA, 1984 bp, Brachypodium distachyon
cccctcgcgccgcctcctcccggcgcgatccgactcgtccctccgaacagagcgcgcactcgcgcactcgtagcaggcggcggccatggtgctggtcttcgacgagttcggccggcgtttcatcatcctgagggagcaggagagcaagtcgcgcctgcgggggctcgatgcgcacaaggccaacgtcgccgccggcaaggccgtcgcgcgcatcctccgcacctcgctcggccccaagggcatggacaagatgctccagtcccctgacggcgacgtcacaatcacaaatgatggtgcaacaatcctggaacaaatggatgttgacaaccagatcgcaaagctgatggtggagctatcccgcagtcaagactatgaaattggggatggtaccactggggtggtggtcatggcagggtcgctcctggagcaagctgaaaaacttcttgagcgaggtattcatccaataaggattgcggaaggttatgagatggcctcgcggatagcttttgaccaccttgaacacatctccaataagtttgagttcacggccacaaatatagagcctttggtgcagacctgcatgaccactctgtcctcaaagattgttaaccgttgtaagcggatgcttgctgagattgctgtcaaggcagtccttgcagttgctgatttggaaaggaaggatgtaaacttggacttgattaaagtagaaggcaaggttggtgggaagctagaggacactgagctaatatacggaattgctgttgacaaagacatgagccatccacaaatgccaaagagaattgaggatgctaatattgccatcttgacctgcccatttgagcccccgaagcccaagacaaagcataaggttgacattgacactgtagaaaaattccagactctgcgtgagcaagagcagaaatactttgatgaaatggttcagaaatgcaaggatgttggtgcaaccttggttatttgccaatggggttttgacgatgaagccaatcacttgcttatgcatagaaatctgcctgctgtcagatgggttggtggtgttgaattggaattgattgccatagctacaggggggcggattgttccaagattccaagagttgagtcctgaaaagcttggaaaggctggattagttagagagaagtcatttggaacaacaaaagatcgaatgctttacatcgagaagtgtgcaaattccagagctgtaactatcttcattcgtggtggcaacaaaatgatgattgaggaggccaagcgaagtattcatgatgctctgtgtgtggctaggaatcttatccgcaataactctattgtttatggtggcggctcagctgagatatcttgctcaatagctgtcgatgctgctgcagatcgatatgctggagttgagcagtatgcaatcagatcgtttgctgatgcgttggacggcattccactagccttagctgaaaacagtggtttgccacctattgatacactgactgcagtaaaatctcagcaagttaaggaaggcaatccccactgtggcattgactgcaacgatgtcgggacgaatgacatgagagagcagaacgtgtttgaaaccctgattggcaagcagcagcagttattgctggcaacgcaggtggtgaagatgattctcaagattgacgatgttatcactccgtccgagttctgagtattggctatattgcaagcatggacaacgaagctggatgtgacaactggcaagcaattagtctaccagacctgaagcagttgtgtttgtttggtggagctagcgagcaacctgtgtgtttttgctgtgacgctcatccacactgtagcgcatgaaatatcttcctgtagcttagaagtttggatgaacaatctcatttttcacccctatattttcagatgcttaatgctatatagtttggatgtttttgctcgtaccttttaccatctaaaattgattattcaatcatcc

SEQ ID NO: 1762 - DNA, 1999 bp, Zea mays
gcccacactccaccacccgcgccccgccgcccgccccgccgccgcctcctacttcgcctcggccgcctcggatccggaccgagcgccggccatggcgctcgccttcgacgagttcgggcgccccttcatcatcctgcgggagcaggagaagaagacgcgcctgcgggggctcgacgcgcagaaggccaacatcggcgcgggcaaggccgtcgcgcggatcctccgcacctcgctcggccccaagggcgcggacaagatgctccagtcccccgacggcgacgtcatcatcacaaatgatggggcgaccatcctggagcagatggatgttgacaaccagatcgcaaagctgatggtggagctgtcccgtagtcaagactacgaaatcggggatggtaccaccggtgtggtagtcatggcaggggcgctccttgagcaggccgagaagcttttagaacgtggtattcaccccattagggttgctgaaggctatgagatggcatcaaaggtagcttttgatcacctagaacgaatctccgaaaagtttgagttcagtgcagacaacattgagcccctggttcagacatgcatgacaactctatcctcaaagattgttaaccgttgcaagcgggcattggcagagattgctgtcaaagcagtacttgcggttgcagatttggagaggaaggatgttaacttggatttaattaaagtagaaggcaaggttggtgggaagctggaggacaccgagcttgtatatggaattattgttgacaaagatatgagccatccacaaatgccaaagagaattgaggatgctaagattgccatcctgacatgcccatttgagccaccgaagcctaagaccaagcataaggttgacattgatactgtcgagaaattccagacactgcgtgagcaagagcagaaatacttcgatgaaatggttcagaagtgcaaagatgctggtgcaaccctggttatttgtcagtggggttttgatgatgaagccaatcatttgttgatgcatagaaatctgccagctgtcagatgggttggtggtgttgaattggaattgattgccattgcaacaggaggacgaattgttccgagattccaagagttgagtcctgaaaagcttgggaaggctggattagtcagagagaaatcattcggaacaacaaaggacaggatgctttacattgagcagtgtgccaattccagagctgtaactatcttcattcgtggtggaaataaaatgatgattgaggagaccaagcgcagtcttcatgatgctctttgtgtggcaaggaatctgatccggaacaactcaatcgtgtacggcggtggctcagcagagatatcttgctcaattgctgttgaaactgctgcagatcggcaccctggagttgagcagtacgctatcaggtcattcgctgatgcattagacgctgttccactggccttggctgaaaacagtggtttgtcgccaattgataccttgacggcggtaaaagctcagcaagttaaggagagcaacccccactgcggcatagactgcaacgatgtaggcaccaacgacatgaaagagcagaacgtctttgagaccctgattggcaagcagcagcagatcctgctggccactcaggtggtgaagatgatcctgaagatcgacgacgtcatctcaccgtccgagtactgatgaagcctgaaggaaggaggaaaaaaaaagagaggaacaggtggctatgctggatgagagtttagtaggcagcattgctgatgtgttcaggcttgctccttgtatcttatgagctgcctagcacctttttgtgtgagggattgtttgtattgcacgatattgcatcgaggaatacgtatgtacgtgttgtcaagaccctaggcaattctcttcagggctgtgagatggttggggtactgataccttttttttgtattgttttcatttcaccacttagctgaagctgtcctttttgtttta

SEQ ID NO: 1763 - DNA, 1794 bp, Eutrema parvulum
agatctgtaacttggatcagatcgaggaaagttgaagctctaaaatggcgctggcgttcgatgagttcgggcgtccgttcattatactgagggagcaagatcaaaagacgcgtcttagaggcatcgatgctcagaaagccaatattgctgctggcaaagcggtggctcggatccttcgatcctctctcggacctaagggaatggacaagatgcttcagggacctgacggagacgtcaccatcacaaacgatggtgcaaccatcttggagcaaatggatgttgacaatcagattgcaaaacttatggttgagctgtcacggagtcaggattatgagattggtgatggcacaacaggtgttgttgtcatggctggtgcacttctggagcaagctgaacgtcaattagataggggaattcatcccatccgtatcgctgaaggatatgagatggcttctagagtcgcagttgagcacctggagcgtatagctcaaaagtttgaattcgacgttaacaatttcgagccacttgttcaaacatgcatgactactctatcctcgaagattgtgaatcgatgcaagcgcagtttagctgagattgccgtaaaagcagttcttgctgttgctgatttagagaggagggatgttaacttagatctgatcaaagtagagggtaaagtcgggggaaagttggaggacactgagcttatatatggaatactggttgacaaagacatgagccatccacaaatgccaaagcaaattgaagatgcccacattgccattttgacttgcccctttgagcctccgaagccgaagactaagcataaggtggacattgacacagtggagaagtttgagacattgcgcaagcaagagcagcaatattttgatgagatggttaaaaagtgcaaggatgttggtgctacactggttatttgccaatggggattcgatgatgaggcaaaccatctattgatgcacaggaatttgcctgctgtcagatgggttgggggtgttgaattagaacttatcgcaatagccacaggcggcagaattgttccaagattccaggagttgaccccagagaagttaggaaaggctggcttggttcgtgaaaaatcatttggcacaactaaagaacgaatgctgtatattgagcactgtgcgaactcgagagctgtcactgttttcatccgtggaggtaacaaaatgatgatcgaagaaacgaagcgtagtatccacgatgctctgtgtgtggctaggaatctcatccgcaacaaatcaattgtatatggaggtggtgcagctgaaattgcatgctcacttgcggttgatgcagctgctgataaataccctggcgttgagcagtatgcaattagggcatttgcagaagctttggactctgtccctatggctcttgcagagaacagtggattacagcccattgagacactctctgcggttaaatctcagcaaattaaggagaatattcccttctatgggatagattgcaatgacgtgggaacaaacgatatgagggagcaaaatgtgtttgaaacattgatcgggaagcagcagcagattttactcgcaactcaagtcgttaagatgattctaaagatcgacgatgtcatctctaattctgaatactgatgtgctgctgcaacctttgtacttcactttgacctcttgggtgttttggtttgctattttttattagcttttgacactgtttaacatcattttccctttctcttgcaagcttttattttatgaacatcctcgatttttgtgt

SEQ ID NO: 1764 - DNA, 2004 bp, Sorghum bicolor
accacaccccgcctccctccccgcccgcactccaccacccgcgccgcgccgccgcctctgactccgcctcggccgcctcggatccggaccgagcgccggcgatggcgctcgccttcgacgagttcgggcgccccttcatcatcctgcgggagcaggagaagaagacgcgactgcgggggctcgacgcgcagaaggccaacatcgccgcgggcaaggccgtcgcgcggatcctccgcacctcgctcggccccaagggcatggacaagatgcttcagtcccccgacggcgacgtcatcatcacaaatgatggggcaaccatcttggagcagatggatgttgacaaccagattgcgaagctgatggtggagctgtcccgtagtcaagactatgaaatcggggatggtactaccggcgtggtagtcatggcaggggcgctcctcgagcaggctgagaagcttctggaacgtggtattcaccccattagggtggctgaaggctatgagatggcatcaagggttgcttttgatcacctagaacgtatatcccaaaagtttgagttcactgctgacaacattgagcccctggttcagacatgcatgacaactttatcctcaaagattgtcaaccgttgcaagcgggcattggcagagattgctgtcaaagcagttcttgcggttgcagatttggagaggaaggatgttaacttggatttaattaaagtagaaggcaaggttggtgggaagctggaggacactgagcttgtatatggaattattgttgacaaagatatgagccatccacaaatgccaaagagaattgaggatgctaagattgccatcctgacttgcccatttgagcctccgaagcctaagacaaagcataaggttgacattgatactgtcgagaaattccagacactgcgtgagcaagagcagaaatacttcgatgaaatggttcagaagtgcaaggatgctggtgcaaccctggttatttgtcagtggggttttgatgatgaagccaatcatttgttgatgcacagaaatctgccagctgtcagatgggttggtggtgttgaattggaattgattgccattgctacaggaggaaggattgttcctagattccaagagttgagccctgaaaagcttgggaaggctggattagtcagagaaaaagcatttggaacaacaaaggaccggatgctttacattgagcagtgtgccaattccagagctgtaactattttcattcgtggtggaaacaaaatgatgattgaggagaccaagcgtagtcttcatgatgctctttgtgtggcaaggaatcttatccggaataactcaattgtgtacggcggtggctcagcagagatatcttgttcaattgctgttgaaactgctgcagatcgtcaccctggagttgagcagtatgctatcaggtcatttgctgatgcattagatgctgttccactagccttggctgaaaacagtggtttgtcacgaattgataccttaaccgcagtaaaagcccaacaagttaaggagagcaacccccactgcggtatagactgcaatgatgttggcaccaacgacatgaaagaacagaacgtcttcgagacccttattggcaagcagcaacagatcttgcttgccactcaggtggtgaagatgatcttgaagatcgacgatgtcatctcaccgtccgagtactgacgaagtctgaaggaaaaaggaagggatggctatgctggatgacagttcagtaggcagcattgctgatgtgacattggtgtactccgtatccaggcttgctccatgtatctcgtgagctgcctgcctgcctaccactttttgtgtgaccgtttgtggaaattgtttgtatttcacgatgagtatgcgtatggatgtagtctagactctagacaacaagttttttgtgatggttgcagtattgatacttttgtagtgttttcgccacttggctgaagctatcttttttgtttgatgc

SEQ ID NO: 1765 - DNA, 1802 bp, Eutrema halophilum
agatctgtaacttggatcagatcgaggaaagttgaagctctaaaatggcgctggcgttcgatgagttcgggcgtccgttcattatactgagggagcaagatcaaaagacgcgtcttagaggcatcgatgctcagaaagccaatattgctgctggcaaagcggtggctcggatccttcgatcctctctcggacctaagggaatggacaagatgcttcagggacctgacggagacgtcaccatcacaaacgatggtgcaaccatcttggagcaaatggatgttgacaatcagattgcaaaacttatggttgagctgtcacggagtcaggattatgagattggtgatggcacaacaggtgttgttgtcatggctggtgcacttctggagcaagctgaacgtcaattagataggggaattcatcccatccgtatcgctgaaggatatgagatggcttctagagtcgcagttgagcacctggagcgtatagctcaaaagtttgaattcgacgttaacaatttcgagccacttgttcaaacatgcatgactactctatcctcgaagattgtgaatcgatgcaagcgcagtttagctgagattgccgtaaaagcagttcttgctgttgctgatttagagaggagggatgttaacttagatctgatcaaagtagagggtaaagtcgggggaaagttggaggacactgagcttatatatggaatactggttgacaaagacatgagccatccacaaatgccaaagcaaattgaagatgcccacattgccattttgacttgcccctttgagcctccgaagccgaagactaagcataaggtggacattgacacagtggagaagtttgagacattgcgcaagcaagagcagcaatattttgatgagatggttaaaaagtgcaaggatgttggtgctacactggttatttgccaatggggattcgatgatgaggcaaaccatctattgatgcacaggaatttgcctgctgtcagatgggttgggggtgttgaattagaacttatcgcaatagccacaggcggcagaattgttccaagattccaggagttgaccccagagaagttaggaaaggctggcttggttcgtgaaaaatcatttggcacaactaaagaacgaatgctgtatattgagcactgtgcgaactcgagagctgtcactgttttcatccgtggaggtaacaaaatgatgatcgaagaaacgaagcgtagtatccacgatgctctgtgtgtggctaggaatctcatccgcaacaaatcaattgtatatggaggtggtgcagctgaaattgcatgctcacttgcggttgatgcagctgctgataaataccctggcgttgagcagtatgcaattagggcatttgcagaagctttggactctgtccctatggctcttgcagagaacagtggattacagcccattgagacactctctgcggttaaatctcagcaaattaaggagaatattcccttctatgggatagattgcaatgacgtgggaacaaacgatatgagggagcaaaatgtgtttgaaacattgatcgggaagcagcagcagattttactcgcaactcaagtcgttaagatgattctaaagatcgacgatgtcatctctaattctgaatactgatgtgctgctgcaacctttgtacttcactttgacctcttgggtgttttggtttgctattttttattagcttttgacactgtttaacatcattttccctttctcttgcaagcttttattttatgaacatcctcgatcttttttgcgtcgtga

SEQ ID NO: 1766 - DNA, 1859 bp, Raphanus sativus
ctctcctctctcagatctgtactccgatcagatcgaggaaagttaaggatctgaaaatggcgttggcgttcgatgagttcgggcgtccgttcatcattctaagggagcaggatcaaaagacgcgcctcagaggcatcgatgctcagaaagccaacatcgccgccgggaaagccgtggctcggatcctccgctcctccctcggacctaagggaatggataagatgcttcagggacctgacggagacgtcaccatctcaaacgatggtgcaaccatcttggagcaaatggatgttgacaaccagattgcgaagcttatggtcgaactgtcccggagtcaggattacgaaattggtgacggcacaacaggtgttgtcgtcatggctggtgcacttctggagcaagctgaacgtcagttagataggggaatccatcctatccgtatcgctgaaggatacgagatggcttctagagtagcagttgaacatttggagcgtatagctcagaagtttgagttcgatgttgataactacgagccgttggttcaaacgtgcatgactactctatcctcaaagattgtgaatcgatgcaagcgcagtttagctgagattgctgtgaaagcagttcttgctgttgctgatttagagagaagggacgttaacttggatttgataaaagtagagggcaaagtcgggggaaatttggcggacactgagcttatatacggaatacttgttgacaaagacatgagccatccacaaatgccaaagcaaattgaagatgctcacattgcaattctgacttgcccctttgagccaccgaagccgaagactaagcataaggtggacattgacacggtggagaagtttgagacattgcgcaagcaagagcagcagtatttcgatgagatggttcaaaagtgcaaggatgttggtgctacactggttatttgccactggggattcgatgatgaggcaaaccatctattgatgcacaggaacttgcctgctgtcagatgggtcggaggtgttgaattagaacttatcgcaatagccacaggcggcagaattgttccaagattccaagagttgaccccagagaagttaggcaaggctggcatggtccgtgaaaaatcatttggcacaacaaaagaacgaatgctgtatatcgagcactgtgcgaactcaaaagctgtcactattttcatccgtggaggtaacaaaatgatgatagaagaaactaagcgtagtatccacgatgctctgtgtgtggcgaggaatctcatccgcaataattcaattgtatatggaggtggtgcagctgaaatcacatgctcacttgctgttgatgcagctgctgataaataccctggcgtcgaacagtacgcaataagggcattcgcagaagctctggactctgtccccatggctcttgcagagaacagtggattacagcccatagagacactctctgcggttaaatctcagcagattaaggagaacattcctttctatgggatagattgcaatgacgtgggaacaaacgatatgagggagcaaaatgtgtttgaaacattgataggaaagcagcagcagatcttgcttgcaactcaagtcgttaagatgattcttaagatcgacgatgtcatctctaattctgaatactgatgatgtactgacatttgcacttctttccttttccctcttttgtttgctttctattagcttttgatactattcatcaattttttcctctcttgtaagcttttattgtaaccttgggcctgtacttgggtttgtgtactttcggtgtttggacttggtatctgtttggaccttgttctttcgtaataatatagacga

SEQ ID NO: 1767 - DNA, 1810 bp, Brassica oleracea
tccactctccttctcatttcttcccccaagatctgtatcggatcgaagaaagcttaaacctcgaaaatggcgctggcgttcgacgagttcgggcgcccgttcattatactgagagagcaggatcaaaagacgcgtctcagaggcatcgatgctcagaaagccaatatcgccgccggcaaagcggtggctcggatcctccgttcctctctcggacccaagggaatggacaagatgcttcagggacctgacggagacgtcaccatcactaacgatggtgcgacgatcttggagcaaatggatgttgacaaccagattgcgaagcttatggttgagctgtcacggagtcaggattatgagattggtgacggcacaacgggtgttgttgtcatggctggtgcgcttcttgagcaagctgagcgtcaattagatagggggattcatcctatccgtatcgctgagggatatgagatggcttctagagtggctgttgagcatttggagcgtatatctcagaagtttgagttcgatgttaataactacgagcctttggttcaaacatgcatgactactctatcctccaagattgtgaaccgatgcaagcggagattagctgagattgctgtgaaagcagttcttgctgttgctgatttagagaggagggatgttaacttggatctgataaaagtagagggcaaagtcgggggaaacttggaggacactgagcttatatatggaatactggttgacaaagatatgagtcatccacagatgccaaagcaaattgaagatgcccacattgccattttgacttgcccctttgagccaccgaagccgaagactaagcataaggtggacattgacacagtggagaagtttgagactctgcgcaagcaagagcagcaatatttcgatgagatggttcaaaaatgcaaggatgttggagctacacttgttatttgccaatggggattcgatgatgaggcaaaccatctattaatgcacaggaatttgcctgctgtcagatgggtcgggggtgttgaattagaacttatcgcaatagctacaggcggcagaattgttccaagattccaggagttgaccccagagaagttagggaaggctggcatggtccgtgaaaaatcatttggcacaacaaaagaacgaatgctgtatattgagcactgtgcgaactcaaaagctgtcactatattcatccgtggaggtaacaagatgatgatagaagaaacaaagcgtagtatccacgatgctctgtgtgtggcaaggaatctcatccgcaataagtcaatcgtatatggaggtggtgcagctgaaatcgcatgctcacttgcagttgatgcagctgctgataaataccctggcgtcgagcagtatgcaataagggcatttgcagaagctttggactccgtacctatggctcttgcagagaacagtggattacagcccattgagacactctctgcggttaaatctcagcaacttaaggagaacattcctttctatgggatagattgcaatgacgtgggaacaaacgatatgagggagcaaaatgtgtttgaaacattgatcgggaagcagcagcagattttgcttgcaactcaagtcgttaagatgatcctaaagatcgacgatgtcatctccaattctgaatactgatgatgtactgccggaacctttgtactatcctttggcctcatgtgtcttttttttctttgttagctttctattggcttttgacactactcgacaacaatgttttgttcccccttggcaagcttttttaatttaagaa

SEQ ID NO: 1768 - DNA, 1982 bp, Musa acuminata
ccgcgatcgagcgcttcactctgcgggagagagaacgccgtccacctccgccgcattctctgaaggggaggaggtagaaggagagaggaggaggaggagaggggagatggcgctggcgttcgacgagtacgggcggcccttcatcatcataaaggagcaggggcagaaggcacggctgcgggggctcgaggcgcagaaggccaacatctccgcggggaaggcggtggctcggattcttcgcacctccctcggccctaagggcatggacaagatgctccagagtccagacggggacgtcgtcatcacaaacgatggggcaacaatcctggagcagatggatgttgacaatcagattgcaaagctaatggtggaactatcccgtagtcaggactatgaaattggtgatggtacaaccggagttgttgttttggccggtgcgcttcttgagcaggctgagaagctattggaacgtggtattcatcctattagaatctctgagggatatgaaatggcctctaagttatctgtggagcatcttgagagtatatcacagaagtttgaatttagtgttaccaatatagagcctttggtgcaaacttgcatgacaactttatcttcaaaaattgtcaatcgttgcaagcgtgcactagctgagattgctgttaaggcagttcttgcagttgctgatttagagaggaaagacgttaatttggaactaatcaaggttgaaggaaaggtcggaggaaaattggaagatacagagctcatatatggaattcttgttgacaaggatatgagccatccacaaatgccaaaaagaatcgaggatgcaaatattgctatcctgacatgcccatttgagccacccaagccaaagacaaagcataagattgacattgacactgttgagaaatttcaaactttacgccagcaggagcagaattactttgatgatatggtccaaaaatgcaaggatgttggtgcaacccttgttatctgtcaatggggttttgatgatgaagcaaaccatttattaatgcatcggaatttgcctgctgttagatgggttggtggtgttgaattggaattgattgctatagctacaggtgggaggatagttccaaggttccaggagttgacaactgaaaagctgggaaaggctggattagttagagagaaatcatttggaactaccaaggatcggatgctgtatattgaacactgtgctaactccagagctgtaacaattttcattcgtggtggtaacaaaatgatgatagaagaaactaaacgtagtcttcatgatgcactttgtgtggctcggaatctgatccggaacaattctattgtatatggtggtggctctgctgaaatttcttgctcaattgctgtagaagctgctgcagatagatatcctggggtggagcagtatgctatcaggtcatttgctgaagctttagattctattcctatggctcttgctgagaacagtggccttccacctattgatactcttaccgcagtcaaatctcagcaaattaaggaaagtaatccatattgtggcatagattgcaatgatgttgggacaaacaatatgagagagcagaatgtctttgagacgctgattggcaaacaacaacagattttgcttgcaacacaagtcgtaaaaatgattttgaagattgatgatgtaatcactccggctgagtactgattttggtgatgaagattttgagcaaagaaatatctctatcataatttgctattgctaaatggtttaaatttccgtgttgcatctaagaattctaatggcttgatttttgtgctttcttcgttaatttgagtgacttttttttgtaatgattttgttataagtttatttatgggtctgatctgtatctgtatcatgctacacttcgatcaaggggaagatgggtgactgtttcctacgattggatagacatctgtagatctggatcaga

SEQ ID NO: 1769 - DNA, 1904 bp, Arabidopsis thaliana
cagacattcttcttctcgcttttttccccatttcaacttttttttttcctctccagtgcactaggaaacaaaaaaaacccaagatctatagttcgatcggatcgagagaagctcgaaaatggcgctggcgttcgatgagttcgggcgtccgttcattatactgagagagcaagatcaaaagactcgtcttagaggaatcgatgctcagaaagccaatatcgccgctggtaaagccgtggctcggatccttcgatcctctcttggacccaaaggaatggataagatgcttcaaggacctgacggagacatcaccatcacaaacgatggtgctacgatattggagcaaatggatgttgacaaccagattgcgaaactaatggtggaactgtcgcggagtcaggattatgaaattggtgatggaacaacaggtgttgttgttatggctggtgcacttcttgagcaagctgaacgtcagttagatagaggaattcatcccattcgtattgctgaaggatatgagatggcttctagggtggctgttgagcatttggagcgtattgcccaaaagtttgaattcgatgttaataattatgagcctctggttcagacttgcatgactactctgtcctcgaagattgtgaatcgatgcaagcgcagcttagctgagattgctgttaaagcggttcttgctgttgctgatttagagaggagggatgttaacttagatctgatcaaagtagaggggaaagttgggggaaagttggaggacactgagcttatttatggaatactgattgacaaagatatgagtcatccgcaaatgccaaagcagattgaagatgcccacattgccattttgacttgtccctttgagccaccgaagccgaagactaagcataaggtggacattgatacagtggaaaagtttgagacattgcgcaagcaagagcagcaatatttcgatgagatggtacaaaagtgcaaggatgttggtgctacgctggttatttgccaatggggattcgatgatgaggcaaaccatctattgatgcacaggaatttgcctgctgtcagatgggtagggggtgttgaattagaacttatcgcaatagccacaggcggtagaattgttccaagattccaggagttgaccccagagaagttagggaaggctggcgtggttcgtgagaaatcttttggcacaacaaaagaacgaatgctgtatattgagcactgtgcgaactcaaaagctgtcactgttttcatccgtggaggtaacaaaatgatgatagaagagacgaaacgtagtatccacgatgctctgtgtgtggctaggaatctcatccgcaacaaatcaattgtttatggaggtggggcagctgaaatcgcttgctcacttgcggttgatgcagctgctgataaataccctggcgtggagcagtatgcaattagggcgtttgcagaagctttggactctgtccctatggctcttgcagagaacagtggattacagcccattgagacactctctgcggttaaatctcagcaaattaaggagaatattcccttctatggaatagattgcaatgacgtgggaacaaacgatatgagggagcaaaatgtgtttgaaacattgatcgggaaacagcaacaaattttgctagctacgcaagtcgttaagatgattctaaagatcgacgatgtcatctccaattctgaatactgatttgttgctacctttgtcctaacctttggcttcttcggtgttttttgtttgctttctattagcttttgatacccttcgacatcgttatccttgacttgttccctttgttttgcaaccttctatttaagaacatcgtcagatcttaatttttgtgtgtacttgtccacagatcgaagca

SEQ ID NO: 1770 - DNA, 1693 bp, Brassica oleracea
gatcgaggaaagtttgaagctcgaaaaatggcgctggcgttcgacgagttcgggcgtccgttcataatactgagggagcaggatcagaagacgcgtctcagaggcatcgatgctcagaaagccaatatcgccgccggcaaagcggtggctcggatcctccgctcctctctcggacctaagggaatggacaagatgcttcagggacctgacggagacgtcaccatcacgaatgatggtgcaactatcttggagcaaatggatgttgacaaccagattgcgaaacttatggtcgaactgtctcggagtcaggattatgaaatcggtgacggcacaacaggcgttgttgtcatggctggtgcgcttctggagcaagctgaacgtcaacttgatagggggattcatcctatccgtgtcgctgagggatatgagatggcttctagggtagcagttgagcatttggagcgtatatctcaaaagtttgagttcgacgttaataatttcgagccactggtccaaacatgcatgactactctgtcctcgaagattgtgaatcgatgcaagcgcagtttagctgagattgctgtcaaagcagttcttgctgttgctgatttggagagaagggatgtcaacttagatctgataaaaatagagggcaaagttgggggaaacttggaggacactgagcttatatacggaatactggttgacaaagacatgagtcatccacagatgccaaagcaaattgaagatgcccacattgccatattgacttgcccgtttgagccaccgaagcctaagactaagcataaggtggacattgacacagtggagaagtttgagacattgcgcaagcaagagcagcaatatttcgatgagatggttcagaagtgcaaggatgttggtgctacattggttatttgccaatggggattcgatgatgaggcaaaccatctattgatgcacaggaatttgcctgctgtcagatgggtcgggggtgttgaattagaacttatcgcaatagccacaggcggcagaattgttccaagattccaggaattgaccccagagaagttagggaaggctggtatggtgcgtgaaaaatcatttggcacaacaaaagaacgaatgctgtatattgagcactgcgcgaactcaaaagctgtcactattttcatccgtggaggtaacaaaatgatgatagaagaaactaagcgtagtatccacgatgctttgtgtgtggcgaggaatctcatccgcaataagtcaattgtatatggaggtggtgcagctgaaatcgcatgctcacttgcggttgatgcagctgcagataaataccctggcgtcgagcagtatgcaataagggcatttgcagaggccttggactctgtccctatggctcttgcagagaacagtgggctacagccaattgagacactctctgcggttaaatctcagcaacttaaggagaatattcctttctatggaatagattgcaatgacgtgggaacaaacgatatgagggagcaaaacgtgtttgaaacattgatcgggaagcagcagcagatcttgcttgcaactcaagtcgttaagatgattctaaagatcgacgatgtcatctctaattctgaatactgatcatgttctgctgaaacctttgtactgtactaccctttggtctcttgttttttgtttg

SEQ ID NO: 1771 - DNA, 2007 bp, Cichorium intybus
ttaaaagagccggttatagatttagggcaaaacaaaaaatacacaaacagatactctttcaagttccaagcacactctctgtgtgccgatctcactgttgttttcgcttcagtcgtcgatctaagagcttagtctactgagagatctgcaaaatggcgttagcgttcgatgaatatggtcggccgttcataatattgagggaacaagagagtaagagtaggttaaggggtttagatgctcagaaggctaatatcgccgccggcgttgctgtttctcgcatcctccgtacatctcttggacctaaaggcatggacaagatgctccagagccccgacggcgacatcactatcacaaatgatggcgcgacaattttggagcagatggatgttgacaatcaaattggaaaacttatggttgagctatcacggagtcaagactatgagatcggcgatggaacaaccggtgtagttgttttggctggtgcacttttagaacaagcagagaagcttttagaacgtggaatccatcccatccgagttgcagaaggatttgaaatatcatcaaggattgctgttgatcacttagaacaaatatcacataagtttgatttcaatgccacaaacatagaacctttggttcaaacttgcatgaccaccttatcttccaaaattgtgaaccgatgcaaacgtagcttggctgagattgctgtaaaggcagtcatggctgttgctgatttagagaggaaagatgttaacctagacctcattaaagtggaaggaaaagttggtgggaaactggaagatacagaacttatctatggaatcattgttgacaaagatatgagtcacccacagatgcctaaacaaatagaagatgctaaaattgcaatcttgacttgcccttttgaacccccaaagccaaaaaccaaacataaggttgacattgatactgttgaaaagtttcaaactttacgtaagcaagaacagaagtactttgatgacatggttcaaagatgcaaggatgtcggggctacattggtcatttgccaatggggatttgatgatgaagcaaatcacttgctaatgcacagaaacttgccagctgtcagatgggttggtggtgttgaacttgagcttatagcaatagccactggtggtagaattgttcccaggttccaggagctaacaaccgaaaaactaggaaaggctggattggttagagaaaaatcattcggtaccacaaaagatcggatgctttacatcgagcattgtgcaaattcaagggctgtaactgtatttattcgtggcggtaacaagatgatgatagaggagactaaaagaagcatacatgatgcattatgtgttgctagaaatttgatccgtaataattccattgtatatggtggtggggcagctgaaatttcatgctcaattgctgtggaagctgctgctgataaatacccaggagttgaacagtatgcgattcgggcattcgcggatgcattggattccgtacccatggctcttgcggaaaatagtggtctgagttgcattgaaacattatcagcagtgaaagcacaacaaattaaggagaataatcattgctgtggtatcgactgtaatgatacggggacgaatgatatgcgtgagcaaaatgtgtttgaaaccttgatcggcaagcaacagcagatattgcttgcgacacaagtcgtgaagatgattttgaagattgatgatgtcatctctccatctgagtattgatatttttgaggtaatgtagtttgaagttttggtctatgtacaacttttgaaaactgattgattggtggaaaacttttttcatggattatgtttgttttgttttgagaaaagaacgttttacggtttatgcaaccaacttttgaagacggtttgtcgagatgatggctttgtgttatattttggattgaatgaactgtctgaatgtgagtactgagtaaatggtcattcttctgtttatttatttgat

SEQ ID NO: 1772 - DNA, 2037 bp, Zea mays
actggagccctataggctatagccaccaccgcactcgcctccctctctccctcccacactccaccacccgcgccgccgcctcctactccgccccggcccctctgatccggaccgagcgccggccatggcgctcgccttcgacgagttcgggcgccccttcattatcctgcgggagcaggagaagaagacgcgccttcgggggcttgacgcgcagaaggccaacatcgcctcggccaaggccgtcgcgcggatcctccgcacgtcgctgggacccaagggcatggacaagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcaaaggtagcttttgaccacctagaacatatatccgaaaagtttgagttcagtgcagacaacattgaacccctggtccagacctgcatgacaactctatcctcaaagattgttaaccgttgcaagcgggcgttggcagagattgctgtcaaagcagtacttgcggttgcagatttggagaggaaggatgttaacttggatctaattaaagtagaaggcaaggttggtgggaagctggaggacactgaacttgtatatggaattattgttgacaaagatatgagccatccacaaatgccaaagagaattgaggatgctaagattgccatcttgacatgcccatttgagcctccgaagccaaagacaaagcataaggttgacattgacactgtcgagaaattccagacactgcgtgagcaagagcagaaatactttgatgaaatggttcagaagtgcaaggatgctggtgcaaccctggttatttgccagtggggttttgatgatgaagccaatcatttattgatgcatagaaatctgccagcagtgagatgggttggtggtgttgaattggaactgattgccattgctacaggagggcggattgttccgagattccaagagttgagtcctgaaaagcttggaaaggctggattagtcagagagaaatcattcggaacaacaaaggaccggatgctttacattgagaagtgtgccaattctagagctgtaaccattttcatccgtgggggaaacaaaatgatgattgaggagaccaagcgcagtcttcatgatgctctttgcgtagcaaggaatctgatccggaataactcgattgtgtacggtggcggctcagccgagatatcttgctcaattgctgttgaaactgctgcagatcggcacccgggagttgagcagtatgctatcaggtcattcgctgatgcattagatgctgttccactagcgttggccgaaaacagtggtttgtcaccaattgataccttaactgcggtaaaagctcaacaagtcaaggagagcaacccccactgtggcatagactgcaacgacgttggcaccaccgacatgaaagaacagaacgtcttcgagaccctgattggcaagcagcaacagatcttgcttgccacccaggtggtgaagatgatcctgaagatcgacgatgtcatctcaccgtccgagtactgacggaaagaaggaacggatggctatgctggatatgcgtaggcggcattgctgatgtgttttgattggtgtacctccttgtccaggcttgctgcctaccactcactccctgtgtgacgttttgctgaaattggtttgtactgtgcacgataatatctggaaatagactctagacagtccttagttatctttttattatataaaaaaagtcagcgccttctcgttagggttgagatgtttgcagtattgatgcttttgtagtgtttttatagctcagcttaagctgtcatttttgtttgatgatttgc

SEQ ID NO: 1773 - DNA, 1981 bp, Cichorium intybus
aaaatacacaaacagatactctttcaagttccaagcacactctctgtgtgccgatctcactgttgtttttgcttcattcgtcgatctaagagcttagtctactgagagatctgcaaaatggcgttagcgttcgatgaatatggtcggccgttcataatattgagggaacaagagagtaagagtaggttaaggggtttagatgctcagaaggctaatatcgccgccggcgttgctgtttctcgcatcctccgtacatctcttggacctaaaggcatggacaagatgctccagagccccgacggcgacatcactatcacaaatgatggcgcgacaattttggagcagatggatgttgacaatcaaattggaaaacttatggttgagctatcacggagtcaagactatgagatcggcgatggaacaaccggtgtagttgttttggctggtgcacttttagaacaagcagagaagcttttagaacgtggaatccatcccatccgagttgcagaaggatttgaaatatcatcaaggattgctgttgatcacttagaacaaatatcacataagtttgatttcaatgccacaaacatagaacctttggttcaaacttgcatgaccaccttatcttccaaaattgtgaaccgatgcaaacgtagcttggctgagattgctgtaaaggcagtcatggctgttgctgatttagagaggaaagatgttaacctagacctcattaaagtggaaggaaaagttggtgggaaactggaagatacagaacttatctatggaatcattgttgacaaagatatgagtcacccacagatgcctaaacaaatagaagatgctaaaattgcaatcttgacttgcccttttgaacccccaaagccaaaaaccaaacataaggttgacattgatactgttgaaaagtttcaaactttacgtaagcaagaacagaagtactttgatgacatggttcagagatgcaaggatgttggggctacattggtcatttgccaatggggatttgatgatgaagcaaatcacttgctaatgcacagaaacttgccagctgtcagatgggttggtggtgtggaacttgagcttatagcaatagcaactggtggtagaattgttcccaggttccaggagctaacaaccgaaaaactaggaaaggctggattggttagagaaaaatcattcggtaccacaaaagatcggatgctttacatcgagcattgtgcaaattcaagggctgtaaccgtatttatccgtggcggtaacaagatgatgatagaggagactaaaagaagcatacatgatgcattatgtgttgctagaaatttgatccgtaataattccattgtatatggtggtggggcagctgaaatttcatgctcaattgctgtggaagctgctgctgataaatacccaggagttgaacagtatgcgattcgggcattcgcggatgcattggattccgtacccatggctcttgcggaaaatagtggtctgagttgcattgaaacattatcagcagtgaaagcacaacaaattaaggagaataatcattgctgtggtatcgactgtaatgatacggggacgaatgatatgcgtgagcaaaatgtgtttgaaaccttgatcggcaagcaacagcagatattgcttgcgacacaagtcgtgaagatgattttgaagattgatgatgtcatctctccatctgagtattgatatttttgaggtaatgtagtttgaagttttggtctatgtacaacttttgaaaactgattgattggtggaaaacttttatatgtttgttttgttttgagaaaagaacgttttatggtttatgcaaccaacttttgaggacggtttgttgagattatggctttgtgtttttatattttggatccaaggaactgtctgaatgtgactagatgatgatttttcctttgatttatttgatataattataatgtttctaccc

SEQ ID NO: 1774 - DNA, 1877 bp, Chrysanthemum coronarium
aagaaaaacatttcatagatggcgttagcgttcgatgagtacggtcggccgtttataatcctgcgagaacaagagagcaaaagcaggttgagaggaatagacgcgcagaaagcgaatatagcggcgggggttgctgtgtcgaggatattgaggacttctcttggtcctaaaggcatggataagatgcttcagagccctgatggtgacattactattacaaatgatggtgcaacaatcttggagcagatggatgttgacaaccaaattggaaagcttatggttgaactatcacggagccaagactacgagatcggtgatggtactactggtgtggttgttatggccggtgcacttttggaacaagctgagaagctcttggaacgtggaattcatcctatccgtgttgcagagggtttcgaaatatcttcaaggattgctgttgatcatctagaatcaatagcagataagtttgatttcagcgccacaaatattgagcctttggttcaaacttgctcgactaccttgaactctaaaatcgtgaaccgatgcaagcgtagtttggctgagattgccgttaaggcagtcatggctgttgctgatttagagaggagagatgttaacttagacctcattaaagttgaggggaaagttggtggcaaattggaggataccgaacttatctatggaatccttgtcgacaaagatatgagtcacccacaaatgccaaagcaaattcaagatgcacatatcgctatcttgacttgcccatttgagcccccaaagcctaagaccaagcataaggttgacatcgatactgttgagaagttccagactttacgtaagcaagaacagcagtactttgatgaaatggttcagaagtgcaaggacgtaggggcaacattggtaatctgccaatggggatttgacgatgaagcaaatcacttactgatgcacagaaacttgcctgctgtcagatgggttggtggtgtagaactggagcttattgctatcgcaactggtggtagaattgttcccaggttccaggaactaacacccgaaaagctaggaaaggctggtttggttagagagaaggcatttggtaccacaaaagaccggatgctatatatcgagcattgtgcaaactcaagggctgtaaccatatttattcgtgggggtaacaagatgatgattgaagagactaaacgtagcatccacgatgcattgtgtgttgctagaaatctcatccgcaataactctatcgtgtatggtggtggtgcagctgaaatttcatgctccattgcagtagaagccgctgctgataaatatcctggagttgaacagtacgccatcagggcttttgccgatgctttggatgctgtacccatggctcttgcggagaatagtggtctgtcacccattgaaacactatctgcagtgaaagcacaacaaattaaggacaacaatcattgctgtggcatagactgcaacgacactggtaccaacgatatgcgtgagcaaaatgtattcgagaccttaatcggaaagcaacagcagatcttacttgccacacaagtcgtgaagatgatcttgaagatcgatgacgtcatctccccatcagagtattgatattgaggtacctacctacaagttttggtctatgtagaacattgcaaccaattgaatcgctggaaaatctttttcatgcatttaagctggtggtttagtattgttttgtactttggtcgggtgtgtttctgtcgattgttttctgctcgtggctagtgtttgtgttggtattttattttgagacaagaatgttcaactgtttacccaaacaagtttttaggatttttctccatgcagtggtttctctactt

SEQ ID NO: 1775 - DNA, 1870 bp, Chrysanthemum coronarium
aaaacatttcatcgatctgacacaaagatggcgttagccttcgatgaatacggtcggccgtttattatcctgcgagaacaagagagcaagagcaggttgagagggatagacgcccagaaagcgaatatagcggcgggggttgctgtgtcgaggatattgaggacttctcttggtcctaaaggcatggataagatgcttcagagccctgatggtgacatcactattacaaatgatggtgcaacaatcttggagcagatggatgttgacaaccaaattggaaagcttatggttgaactatcacggagccaagactacgagatcggtgatggaactactggtgtggttgttatggctggtgcacttttggaacaagctgagaagctcttggaacgtggaattcatcctatccgagttgcagagggttttgaaatttcttcgaggattgctgttgatcatctagaatcaatagcagataagtttgatttcagcgccacaaatattgagcctttggttcaaacttgctcgactaccttgaactctaaaattgtgaaccgatgcaagcgtagcttggctgagattgctgtaaaggcagtcatggctgttgctgatttagagaggagagatgtcaacttagacctcattaaagtcgaggggaaggttggtgggaaattggaggacaccgaacttatctatggaatccttgttgacaaagatatgagtcacccacaaatgccaaagcaaattcaagatgcacatatcgcgatcttgacttgcccatttgagcccccaaagcctaagaccaagcataaggttgacatcgatactgttgagaagttccagactttacgtaagcaagagcagcagtactttgatgaaatggttcagaagtgcaaggacgtcggagcaacattggtaatctgccagtggggatttgatgatgaagcaaatcacttactgatgcacagaaacttgcctgctgtcagatgggttggtggtgtagaactggagcttattgctatcgcaactggtggtagaattgttcccaggttccaggaactaacacccgaaaagctaggaaaggctggtttggttagagagaaggcatttggtaccacaaaagaccggatgctatatatcgagcattgtgcaaactcaagggctgtaaccatatttattcgtgggggtaacaagatgatgattgaagagactaaacgtagcatccacgatgcattgtgtgttgctagaaatctcatccgcaataactctatcgtgtatggtggtggtgcagcagaaatttcatgctcaattgctgtagaagctgctgctgataaatatccaggagttgaacagtacgccatcagggcttttgccgatgctttggatgctgtacccatggctcttgcggagaatagtggtctgtcacccattgaaacactatctgcagtgaaagcacaacaaattaaggacaacaatcattgctgtggcatagactgcaacgacactggtaccaacgatatgcgtgagcaaaatgtattcgagaccttaatcggaaagcaacagcagatcttacttgccacacaagtcgtgaagatgatcttgaagatcgatgacgtcatctccccatcagagtattgatattgaggtacctacctacaagttttggtctatgtagaacattgcaaccaattgaatcgctggaaaatctttttcatgcatttaagctggtggtttagtattgttttgtactttggtcgggtgtgtttctgtcgattgttttctgctcgtggctagtgtttgtgttggtattttattttgagacaagaatgttctgctgtttacgcaaacaagtttttaggatttttctccatgc

SEQ ID NO: 1776 - DNA, 1799 bp, Chrysanthemum coronarium
acatttcatcgatctgacacaaagatggcgttagccttcgatgaatacggtcggccgtttattatcctgcgagaacaagagagcaagagcaggttgagagggatagacgcccagaaagcgaatatagcggcgggggttgctgtgtcgaggatattgaggacttctcttggtcctaaaggcatggataagatgcttcagagccctgatggtgacatcactattacaaatgatggtgcaacaatcctggagcaaatggacgttgacaaccaaattggaaagcttatggttgaactatcacggagccaagactacgagatcggtgatggaactactggtgtggttgttatggctggtgcacttttggaacaagctgagaaactgttggaacgtggaattcatcctatccgtgttgcagagggtttcgaaatatcttcaaggattgctgttgatcatctagaatcaatagcagataagtttgatttcagcgccacaaatattgagcctttggttcaaacttgctcgactaccttgaactctaaaattgtgaaccgatgcaagcgtagcttggctgagattgctgtaaaggcagtcatggctgttgctgatttagagaggagagatgttaacttagacctcattaaagttgaggggaaagttggtgggaaattggaggataccgaacttatctatggaatccttgttgacaaagatatgagccacccacaaatgccaaagcaaattcaagatgcacatatcgcgatcttgacttgcccatttgagcccccaaagcctaagaccaagcataaggttgacattgacactgttgaaaagttccagactctccgtaagcaagagcagcagtactttgatgaaatggttcagaaatgcaaggacgtaggggcaacattggtaatctgccaatggggttttgacgatgaagcaaatcacttactgatgcacagaaacttgcctgctgtcagatgggtcggtggtgtagaactggagcttattgctatcgcaactggtggcagaattgttcccaggttccaggaactaacacccgaaaagctaggaaaggctggtttggttagagagaaggcatttggtaccacaaaagatcgcatgctatatatcgagcattgtgctaactcaagggctgtaaccatatttatccgtgggggtaacaagatgatgattgaagagactaaacgtagcatccacgatgcattgtgtgttgctaggaatctcatccgcaataactctatcgtgtatggtggtggtgcggctgaaatttcatgctccattgcagtagaagccgctgctgataaatatcctggagttgaacagtatgccatcagggctttcgctgatgctttggatgctgtacccatggctcttgcggagaatagtggtctgtcacccattgaaacactatctgcagtgaaagcacagcaaattaaggaaaacaatcactgttgtggcattgactgcaacgatactggtaccaatgatatgcgtgagcaaaatgtattcgagaccttaatcggaaagcaacaacagatcttacttgccacacaagttgtgaagatgatcttgaagatcgacgacgtcatctccccatcagagtattgatatcgaggtacttacctacaagttttggtctatgtagaacattgcaaccaattaattgctggaaagctttttcatgcatttaagctggtttagtattgttttgtactttggtctggtgtgtttcggtcgagtgttttctgctcgtggctagtgtttgtgttggtatt

SEQ ID NO: 1777 - DNA, 2105 bp, Echinacea purpurea
cgggggagactctggaagaacacgcacacacacactgtgtgccgatctgagtgagtgaacgagatctgcaaaaatggcgttagcgttcgatgaatacggtcggccgttcataatactccgggaacaagaaaacaagaccagattaagaggtatagatgctcagaaggccaacatcgccgccggtgttgccgtttctcgcatcctccgtacatctctcggtcccaaaggcatggataagatgctccagagccccgacggcgacattaccatcacaaatgatggtgcaacaatcttggaacaaatggatgttgataatcaaattggaaaacttatggttgaactgtcacgtagtcaagattatgaaattggggatggaacaactggtgtggttgttctggctggtgcacttttagaacaagctgagaagcttttggagcgtggaattcatcccattcgagttgcagaagggtttgaaatttcttcaaagatggctgttgatcatttggaacagatatcacataaatatgatttcagtgctacaaatctagaatcattggttcaaacttgcatgaccaccttatcctccaaaatagtgaatcgctgcaagcgtagcttggctgagattgccgtaaaaagtgttctggctgttgctgatttagagagaaaagatgttaacctagatttgataaaagtggagggaaaggttggtgggaaattagaggatacagaacttatttatggaattcttgttgataaagatatgagtcacccacaaatgccaaagcaaattgaagatgcaaaaattgctattttgacctgcccttttgagcccccaaagcctaagaccaaacataaggttgacattgatacagttgaaaagtttcaaactttgaggaagcaagaacagaagtactttgatgacatggttcagaaatgcaaggatgtaggggcaacactggtaatttgtcaatggggctttgatgatgaagcaaatcacttattaatgaacagaaatttgccagctgtcagatgggtcggtggtgtagaattggagctaatagcaatagctactggtggtagaattgttcccaggtttcaagaactaacacctgaaaaactaggaaaggctggtttggttagagaaaaggcatttggtaccacaaaagatcgaatgctttatatcgagcattgtgcaaactcaaaggctgtaaccatttttattcgtggtggtaacaagatggtgattgaagagacaaaacgcagcgttcatgatgcattatgtgttgctagaaatctcatccgtaacaactcgattgtatatggtggcggggctgcagaaatttcatgctcgattgcggttgaagctgctgctgataaatatccaggtgttgaacagtatgccatcagggcctttgcagacgccttggactctgtacccatggctctcgcagagaatagtgggttgcaacccattgaaacattatctgcagtgaaagcacagcaaattaaggaaaacaatcatttctgtggcatcgactgcaacgacactggtacaaacgacatgcgtgagcaaaatgttttcgaaacgttaattggcaagcaacagcagatattgcttgccacacaagttgtgaaaatgatcttgaagatcgatgatgtcatctccccatcagactactgacatcttggtggtttttactacccttcaagttttgctcaaatgtagaacattgcagcaacttcattgctggaaaacctagtcttggtttttaactctgtttatgcgtcttgctgtcagttgtttggtgtttgtgtttggtttatttttagacgagtactgttttactctttagcgtgcgattcttgagcagtttctgcagtttcgaatttttatggcatttgtgatcacgcgttaaaacgtgttgtttttccctgtctaatgcccttcgggttctgggtctggttttgactacatagactgtagcggcctgtactggatctggaccttaccggttttttacgctgtacctttcgaagttgatacatggtttgcagttttgttcgaggccaaatgattaataaaccaagcctacagagctagttcc

SEQ ID NO: 1778 - DNA, 1963 bp, Chrysanthemum coronarium
cgacacaaaaacacacacactctaactgtgtgtgccgatctgaaaactcaaaaccctcatttcaccgatctgaaaaaaccaacacaaaaacatggctttagccttcgatgagtatggtcggccgtttataatcctgcgagaacaagagagcaagagcaggttacgaggaatagacgcgcagaaagcgaatatagcagctggtgtggctgtttcgaggatcttaaggacgtctcttggtcctaaagggatggataagatgcttcaatcccctgatggagacattactattacaaatgatggtgctacgatcttggaacaaatggacgttgaaaaccaaattggtaaacttatggttgaactatcacggagtcaagactacgagattggtgatggaactactggtgtggttgttatggctggtgcgcttttggaacaagctgagaaactgttggaacgtggaattcatcccatccgcgttgcagagggttttgaaatatcttcaaagattgctgttgagcatctagaatcaatagcagataagtttgaattcggcgccacaaatattgagcctttggttcaaacttgctcgactaccttgaactctaaaatcgtgaaccgatgcaagcgtagcttggctgagattgctgtaaagggagtcatggccgttgctgatttggagagaagagatgtcaacttagacctcattaaagtcgaggggaaagttggtgggaaattggaagataccgaacttatctatggaatccttgttgacaaagatatgagccacccccaaatgccaaagcaaattcaagatgcacatatcgcgatcttgacttgcccatttgagcccccaaagcccaagacgaagcataaggttgacattgatactgttgaaaagttccagactctacgtaagcaagagcagcagtactttgatgagatggttcagaaatgcaaggacgtaggggcaacattggtaatctgccaatggggttttgacgatgaagcaaatcacttactgatgcacagaaacttgcctgctgtcagatgggtcggtggtgtagaactggagcttattgctatcgcaactggtggtagaattgttcccaggttccaggaactaacacccgaaaagctaggaaaggctggtttggttagagagaaggcgtttggtaccacaaaagatcgcatgctatatatcgagcattgtgctaactcaagggctgttaccatattcattcgtgggggtaacaagatgatgattgaagagactaaacgtagcatccacgatgcattgtgtgttgctagaaatctcatccgcaataactctatcgtatatggtggtggtgcggctgaaatttcatgctccattgcagtagaagccgctgctgataaatatcctggagttgaacagtatgccatcagggcttttgccgatgctttggatgctgtacccatggctcttgcggagaatagtggtctgtcacccattgaaacactatctgcagtgaaagcacagcaaattaaggaaaacaatcattgctgcgggatcgactgcaacgatactggcaccaacgatatgcgtgagcaaaatgtattcgagaccttaatcggaaagcaacaacagatcttacttgccacacaagtcgtgaagatgatcttgaagatcgacgacgtcatctccccatcagagtattgatatcgaggtacctacctacaagttttggtcctatgtagaacattgcaaccaattaattgctggaaagtcgttgttttcatgcatttaagctggtttagtattgttttgtactttggtctggtgtgttctggtcgagtgttttctgctcgtggctagtgtttgtgttggtattttatttcgagacaagaatgtttcactgtttacgcaaacaagtatttaggatttttctcaatgcagtatggtatctctagttatgcatacatg

SEQ ID NO: 1779 - DNA, 1955 bp, Brachypodium distachyon
cgccgcctcactctctccatcccctccttccacagctccgctccgcgtgcgatccgcccttcctgaagcttctgggaggagcagcgccagcgctccggcggccatggcgctcgccttcgacgagttcggccggcccttcatcatcctcagggagcaggagaagaagtcgcggctgcaggggctcgacgcgcagaaggccaacatcgccgccgggaaatctgtcgcgcgcatcctccgcacatccctcggtcccaagggcatggacaagatgctccagtcccccgacggcgacgtcaccatcactaatgatggggcaacaatcctggagttaatggatgttgacaaccagattgccaagctcatggttgagttgtcccgtagtcaagattatgacattggagatggtaccactggggtggtggtcatggctgggtctctcctggagcaagctgaaaagctgctggaacgtggtattcacccgataagggtcgctgaaggttatgagatggcatcaaggatagcttttgatcaccttgaacgcatttccacgaaatttgagttcagtgctactgatatagagcccttggtgcagacttgcatgacaacattgtcctcaaagattgttagccgttgtaagcgggctctagctgagattgctgtcaaagctgttcttgcagttgctgatttggaaaggaaggatgtaaatttggacttgattaaagtggaaggtaaggttggtgggaagctagaagatacggagctagttcatggaatcatcgttgacaaagatatgagccacccccaaatgccaaagagaattgaggatgcacacattgccatcctgacctgcccatttgagcccccgaagcctaagacaaagcataaggttgacattgatactgtagagaaattccagacgctgcgtgggcaagagcagaaatacttcgatgaaatggttcagaaatgcaaggatgttggtgcaacccttgttatttgtcaatggggttttgatgatgaagccaaccatttactgatgcatagaaatctcccggctgtcagatgggttggtggggttgaattagaattgattgccattgctacaggagggcgtattgttccgagattccaagagttgagtactgaaaagcttgggaaggctgggttagtcagagagaagtcatttggaacaacaaaagatcggatgctatacattgaaaagtgtgctaattctagagctgttacaattttcatccgcggtggcaacaaaatgatgattgaggagaccaagcgaagtcttcatgatgctctttgtgtggcaaggaatctgatcatcaataactcgattgtttatggtggtggctcagcagagatatcttgctcaattgctgttgaggctgctgcagatcggcatgctggagttgagcagtatgctatcaggtcatttgctgatgctttggatgctattccactagctttagccgaaaacagtggtttaccgcctattgatacgctgactgtcgtaaaatcccaacatgttaaggagagcaatccccactgcggcatcgactgcaatgatgtcggtaccaatgacatgaaagagcagaatgtttttgaaactctgattggcaagcagcagcagatcttgctggcaacgcaggtggtgaagatgatcctaaagattgatgatgttatcacgccttctgaatattgatgatgcctgggaagaatggaaatcgactgctaggctggacttgctcctagaattctaatatggagtggtcgcttgttttgtttgatgagctacctaggcttgtgacgctggctcgatcatataactttggcgttcacacttcgtatagcttgagttgagacaatagcagaaactctgtcgttagttttacacccttgttgtatttttcagacgcttaatgctatggttggaccttgtttcatat

SEQ ID NO: 1780 - DNA, 2010 bp, Brachypodium distachyon
gcgtcgtccagaaaacacagcgccgcctcactctctccatcccctccttccacagctccgctccgcgtgcgatccgcccttcctgaagcttctgggaggagcagcgccagcgctccggcggccatggcgctcgccttcgacgagttcggccggcccttcatcatcctcagggagcaggagaagaagtcgcggctgcaggggctcgacgcgcagaaggccaacatcgccgccgggaaatctgtcgcgcgcatcctccgcacatccctcggtcccaagggcatggacaagatgctccagtcccccgacggcgacgtcaccatcactaatgatggggcaacaatcctggagttaatggatgttgacaaccagattgccaagctcatggttgagttgtcccgtagtcaagattatgacattggagatggtaccactggggtggtggtcatggctgggtctctcctggagcaagctgaaaagctgctggaacgtggtattcacccgataagggtcgctgaaggttatgagatggcatcaaggatagcttttgatcaccttgaacgcatttccacgaaatttgagttcagtgctactgatatagagcccttggtgcagacttgcatgacaacattgtcctcaaagattgttagccgttgtaagcgggctctagctgagattgctgtcaaagctgttcttgcagttgctgatttggaaaggaaggatgtaaatttggacttgattaaagtggaaggtaaggttggtgggaagctagaagatacggagctagttcatggaatcatcgttgacaaagatatgagccacccccaaatgccaaagagaattgaggatgcacacattgccatcctgacctgcccatttgagcccccgaagcctaagacaaagcataaggttgacattgatactgtagagaaattccagacgctgcgtgggcaagagcagaaatacttcgatgaaatggttcagaaatgcaaggatgttggtgcaacccttgttatttgtcaatggggttttgatgatgaagccaaccatttactgatgcatagaaatctcccggctgtcagatgggttggtggggttgaattagaattgattgccattgctacaggagggcgtattgttccgagattccaagagttgagtactgaaaagcttgggaaggctgggttagtcagagagaagtcatttggaacaacaaaagatcggatgctatacattgaaaagtgtgctaattctagagctgttacaattttcatccgcggtggcaacaaaatgatgattgaggagaccaagcgaagtcttcatgatgctctttgtgtggcaaggaatctgatcatcaataactcgattgtttatggtggtggctcagcagagatatcttgctcaattgctgttgaggctgctgcagatcggcatgctggagttgagcagtatgctatcaggtcatttgctgatgctttggatgctattccactagctttagccgaaaacagtggtttaccgcctattgatacgctgactgtcgtaaaatcccaacatgttaaggagagcaatccccactgcggcatcgactgcaatgatgtcggtaccaatgacatgaaagagcagaatgtttttgaaactctgattggcaagcagcagcagatcttgctggcaacgcaggtggtgaagatgatcctaaagattgatgatgttatcacgccttctgaatattgatgatgcctgggaagaatggaaatcgactgctaggctggacttgctcctagaattctaatatggagtggtcgcttgttttgtttgatgagctacctaggcttgtgacgctggctcgatcatataactttggcgttcacacttcgtatagcttgagttgagacaatagcagaaactctgtcgttagttttacacccttgttgtatttttcagacgcttaatgctatggttggaccttgtttcatatctgctttgtggttagtatgacatgaattatctggt

SEQ ID NO: 1781 - DNA, 2112 bp, Musa acuminata
cagaaatccccaaccctagtggcttccgctgccccggttgttgtttccctgcggaaatataagggcctccgcccaccgcctcctcctcaaggacctccttgcttcctcctgacacaaccattctttggaagtagtagaagaagggcaaaggaagagaagaagtataaggggggcagaatggcgctggcgttcgacgagtacggccggcccttcatcataatcaaggagcaggggcagaaggcgcggctgcggggcctcgaggcgcagaaggccaacatctccgccgggaaggccgtcgctcgtatccttcgtacctcgctcggccccaagggcatggacaagatgctgcagagccccgatggcgacgttatcgtcacaaatgatggggccactatcttggagcagatggatgttgataatcagattggcaaactgatggtggaattatctcgtagtcaggactatgaaattggtgatggtaccactggggttgttgttttggctggtgcacttctcgaacaggctgagaagcttttggaacgtggtattcatcctattagaattgctgagggctatgaaatggcctctaggctagctgtggatcatcttgagcacatatcacagaaatttgaatttagtgttaccaatatagagcctttggtgcaaacttgcatgacaacattatcttcaaaaattgttaaccgttgcaagcgtgcgttagctgagattgctgttaaggcagttcttgcagttgcagatttggagaggaaagatgttaacttggaattaattaaggttgaaggaaaggttggaggaaaattggaagacacagaactcatttacggaattgttgtcgacaaggatatgagccacccccaaatgccaaaaagaattgaagaagcaaagattgctattcttacatgcccatttgaaccacccaagccaaagacaaagcataagattgacattgacactgttgaaaaatttcaaactctacgcgagcaagagcagaaatactttgatgatatggtccaaaaatgcaaggatgttggtgcaaccctagttatctgtcagtggggttttgatgatgaggcaaatcatttattgatgcatcgaaatttgcctgctgttagatgggttggtggtgttgaattagaattaattgcaatcgctacaggtgggagaatagttccgaggttccaggacttgacagatgaaaagctgggaaaggctggattagttagagaaaaatcatttggaacaactaaggaccggatgttgtatattgaacattgtgctaactccagagccgtaacaattttcattcgtggcggtaacaaaatgatgatagacgaaactaagcgtagtcttcatgatgcactttgtgtggcaaggaatctgatccgtagcaattcaattgtttacggtggtggctctgcggaattatcttgctcaattgctgtagaagctgctgcagacaaatatcctggggttgagcagtatgctatcaggtcctttgctgaagctttagattttattccgatggctcttgctgagaactgtggcctcccacctattgatactgttacagctgtcaaatctcagcaaattaaggaaaataatccttattgtggtatagattgcaacgatgttgggacaaataacatgatggagcagaatgtatttgagacgctgattggcaaacaacaacagatcttgctggcaactcaagtagtgaaaatgattttgaagattgatgatgtgatcactccatccgcctattgattttggtggataagttcctaagctaagatctatttgtcagaatttgctatggctaagtgggatataagcattatccttgcatccaaagactctcattgcatctcttttgtgctttctttaatgatttatgagtgtacaatgtcagtcttgcgacaattttgtcaccggccaatctatcggcatcatatgtatttcgtttcatttggttctttccaaatgggaaattggaaaagaagactgactgtatgcacttgaagtctggatttgatacactgcaactcttgatgttctaggaatctgggtagctagaatttctttcagggcctg

SEQ ID NO: 1782 - DNA, 1885 bp, Echinacea purpurea
cacacacacactgtgtgccgatctgagtgagtgaacgagatctgcaaaaatggcgttagcgttcgatgaatacggtcggccgttcataatactccgggaacaagaaaacaagaccagattaagaggtatagatgctcagaaggccaacatcgccgccggtgttgccgtttctcgcatcctccgtacatctctcggtcccaaaggcatggataagatgctccagagccccgacggcgacatcaccatcacaaatgatggtgcaacaatcttggaacaaatggatgttgataatcaaattggaaaacttatggttgaactgtcacgtagtcaagattatgaaattggggatggaacaactggtgtggttgttttggctggtgcacttttagaacaagctgagaagcttttggaacgtggaattcatcccattcgagttgcagaagggtttgaaatttcttcaaagatggctgttgatcatttggaacagatatcacataaatatgatttcagtgctacaaatctagaatcattggttcaaacttgcatgaccaccttatcctccaaaatagtgaatcgctgcaagcgtagcttggctgagattgccgtaaaaagtgtcctggctgttgctgatttagagagaaaagatgttaacctagatttgataaaagtggagggaaaggttggtgggaaattagaggatacagaacttatttatggaattcttgttgataaagatatgagtcacccacaaatgccaaagcaaattgaagatgcaaaaattgctattttgacctgcccttttgagcccccaaagcctaagaccaaacataaggttgacattgatacagttgaaaagtttcaaactttgaggaagcaagaacagaagtactttgatgacatggttcagaaatgcaaggatgtaggggcaacactggtaatttgtcaatggggctttgatgatgaagcaaatcacttattaatgaacagaaatttgccagctgtcagatgggtcggtggtgtagaattggagctaatagcaatagctactggtggtagaattgttcccaggtttcaagaactaacacctgaaaaactaggaaaggctggtttggttagagaaaaggcatttggtaccacaaaagatcgaatgctttatatcgagcattgtgcaaactcaaaggctgtaaccatttttattcgtggtggtaacaagatggtgattgaagagacaaaacgcagcgttcatgatgcattatgtgttgctagaaatctcatccgtaacaactcgattgtatatggtggtggggctgctgaaatttcatgctcgattgcagttgaagctgctgctgataagtatccaggtgttgaacagtacgccatcagggcctttgcagacgccttggactctgtacccatggctcttgcagagaatagtggtttgcaacccattgaaacattatctgcagtgaaagcacagcaaattaaggaaaacaatcattgctgtggcatcgactgcaacgatactggtacaaacgacatgcgtgagcaaaatgttttcgaaaccttaattggcaagcaacagcagatattgcttgccacgcaagttgtgaaaatgatcttgaagatcgatgatgtcatctccccatcagactactgacatcgtggtggtttttaccgcccttcaagttttgctcagttgtagaacattgcagcaagttcattgctggaaaacctagtcttggtttttaactctgtttatgcgtcttgctgtcagttgtttggtgtttgtgtttgttttatttttagacgagtactgttttactctttagcgtgcgattcttgagcagtttctgcagtttcgaatttttatggcatttgtgatcac

SEQ ID NO: 1783 - DNA, 1670 bp, Chenopodium quinoa
gatgaattcggacgtcccttcattatactgagggagcaagaatcaaagacccgtttaagaggtttagaagctcagaaatccaacatttccgccggtaaagccgtcgctcgcatccttcgctcttctctcggccctaaaggcatggacaaaatgctccaatctcccgacggcgacatcactatcacaaatgatggtgctactatcttggaccagatggatgttgataacccaattgcaaagttgatggttgaattgtcccgcagtcaggattatgaaattggtgatggcactactggagtagttgtcatggctggtgcccttctggagcaggctgaaaatctcttagatcgtggtatccatcctattagaatagcagaaggatatgaagtggcttctcggatcgctgttgaacatctggagaagatcgcacataaattcgaatttggagaaaccgatgtagagcctttgatccagacttgcatgactactttgtcttcaaaaattgtaaatcgctgtaagcgcagtttggctgagattgcggttaaagcggttttggctgttgcagacttggagcggaaggatgttaatcttgatctaattaaagtagaggggaaagtgggaggtaaacttgaagatactgaactcatctatggtattgttgtggacaaggacatgagccaccctcaaatgccgaaaaaaattgaagatgctaatatagcaattttaacttgcccttttgagccaccaaagccaaaaaccaagcataaggttgagattgacactgtggagaagtttgagacattacgcaaacaagagcaacattactttgatgaaatggttcaaaagtgcaaggatgttggtgcaactttggttatctgtcaatggggtttcgatgatgaagcaaaccatttgttgatgcataggaatttgcctgctgtcagatgggtaggcggtgttgagctggagcttattgcaattgccacaggtggaagaattgtcccaagatttcaagaattgactcctgaaaagctgggacgggctgggttggttcgtgagaaagcttttggtacaacaaaagatcgaatgctgtacattgaacattgtgccaattcaaaggctgtgaccatatttatccgtggcggtaacaaaatgatgattgaagagacaaagagaagcatccacgacgcactttgtgttgcaaggaacctaatccgcaacaattctattgtgtatggtggcggctctgctgaaattgcttgttctcttgctgtagaggcaggtgctgaccgatttccaggagttgagcagtatgctatcagggcttttgctgaatctcttgatgcagttcccatggcacttgctgaaaacagtggtcttcagcctattgaaacactgtctgctgtgaaacatcagcaaatcaaggagaacattactcacttgggtatagattgcaacgatgttggtacaaacgacatgcgtgagcagtatgttttcgagaccttgatcgggaagcagcagcagattttgttagctacccaggttgtgaagatgattttgaagatagacgatgtcattaccccatctgaattttgatagtatgtaatttaggttatgttgtgtgagtcctcccccttcttaagcgtaggtgtcattctattgggtctttgatg

SEQ ID NO: 1784 - DNA, 1827 bp, Chrysanthemum coronarium
aaaagaacccgtttcatagatggcgttagcgtttgatgagtacggtcggccgtttataatcttgcgagaacaagagagcaaaagcaggttgagagggatagacgcccagaaagcgaatatagcggcgggggttgctgtgtcgaggatattgaggacttctcttggtcctaaaggcatggataagatgcttcagagccctgatggtgacattactattacaaatgatggtgcaacaatcttggagcagatggatgtcgacaaccaaattggaaagcttatggttgaactatcacggagccaagactacgagaacggtgatggtactactggtgtggttgttatggccggtgcacttttggaacaagctgagaagctcttggaacgtggaattcatcctatccgtgttgcagagggtttcgaaatatcttcaaggattgctgttgatcatctagaatcaatagcagataagtttgatttcagcgccacaaatattgagcctttggttcaaacttgctcgactaccttgaactctaaaattgtgaaccgatgcaagcgtagcttggctgagattgctgtaaaggcagtcatggctgttgctgatttagagaggagagatgtcaacttagacctcattaaagtcgaggggaaggttggtgggaaattggaggacaccgaacttatctatggaatccttgttgacaaagatatgagtcacccacaaatgccaaagcaaattcaagatgcacatatcgcgatcttgacttgcccatttgagcccccaaagcctaagaccaagcataaggttgacatcgataccgttgagaagttccagactctacgtaagcaagagcagcaatactttgatgaaatggttcagaagtgcaaggatgtcggagcaactttggtaatctgccaatggggatttgacgatgaagcaaatcatttactgatgcacagaaacttgcctgctgtcagatgggtcggtggtgtagaactggagcttattgctatcgcgactggtggtagaattgttcccaggttccaggaactaacacctgaaaagctaggaaaggctggtttggttagagagaaggcatttggtaccacaaaagaccggatgctatatattgagcattgtgcaaactcgagggctgtaaccatatttattcgtgggggtaacaagatgatgattgaagagactaaacgtagcatccacgatgcattgtgtgttgctagaaatctcattcgcaataactctatcgtatatggtggtggtgcagctgaaatttcatgctcaattgcagtagaagccgctgctgataaatatcctggagttgaacagtatgccattagggcttttgctgatgctttggatgctgtacccatggctcttgcggagaatagtggtctgtcatccattgaaacactatctgcagtgaaagcacaacaaattaaggacaacaatcattgctgtggcatagactgcaacgacactggtaccaacgatatgcgtgagcaaaatgtattcgagaccttaatcggaaagcaacagcagatcttacttgccacacaagtcgtgaagatgatcttgaagatcgatgacgtcatctccccatcagagtattgttattgaggtacctacctacaagttttggtctatgtagaacattgcaaccaattgaatcgctggaaaatctttttcatgcatttaagctggtggtttagtattgtttttgtactttggtcgggtgtgtttctgtcggttgttttatgctcgtggctagtgtttgtgttggtactttattttgtagacaagaatgttcaact

SEQ ID NO: 1785 - DNA, 2003 bp, Allium cepa
gcgttctcgtctagaacaaacccgaaccctaattctctctctaaactcttcactgcattcataattcgcactactttatatttctcatctataacgattttgccatcagccgtcattactgttgagtccctacattagcatcaatggcgttagcgttcgatgaatatggccgaccgttcctaattatgaaagagcaagatcagaaaaccaggcttcgtggtctcgaagctcagaaatcaaatattagtgccggagtggcagttgcgaggatcctgaggacgtcgcttgggccaaaaggaatggacaagatgcttcagagccctgatggggatgttgttattacaaatgacggggcaacgattttggaacagatggatgtagacaatcaaattgcaaaattgatggtcgagttgtctcgaagtcaggactatgagattggtgatggtacaactggtgtggttgtattggctggttcccttctagagcaagctgaaaagcttctagaacgtggtattcatcctattcgaattgcagaaggatacgagacagcttccagaatagctgttgatcatcttgaacacatttctcaaaaatttgagttcagcattagtgatattgagccactggtgcaaacctgcatgaccactttgtcatcaaagattgttaatcgatgcaagcgcactctagcagaaattgctgtaaaagcagttcttgctgttgcagatttagataggaaagatgtcaatttggaccttattaaggtagaagggaaagtagggggaaagttggaggacacagaacttgtttatggaataattattgacaaagatatgagccatccacaaatgccaaaacatattgaagatgcaaaaattgccatcctaacttgcccatttgagccacccaagcccaagacaaagcataaggttgacattgacactgtagagaagtttcaaactttgcgtaagcaggagcaacaatattttgacgacatggttcaaaaatgcaaggatgttggggcaactctagttatttgtcagtggggctttgatgatgaagccaatcacttgttaatgcatagaaatttgcctgctgttagatgggttggtggcgttgaattggaattaattgcaattgctacaggtggacgaattgttccaagatttcaagaactaacacctgaaaaacttggaaaggctggtctagtaagagaaaaagcatttgggacaaccaaagataggatgctttatatagagcaatgtgcaaattcaagggcagtgacaatatttattcgtggtggaaataaaatggtgatcgaggaaactaaacgtagtgtacatgacgcactatgtgtggcaaggaatttgatccgcaacaattctattgtttatggtggtggttcagctgagatttcatgctcaattgctgttgaagctgctgcagataagaatcctggagttgagcaatatgctattaggtcctttgctgatgcattagatgctgttccaatggctttggctgaaaatagtggcctccaacctattgacactcttaccgcagtcaaagcacaacaaatcaaggaaaataatgcttaccttggaatagattgcaatgatgtaggaacaaacaacatgcaggagcagaatgttttcgaaacgctgatcggaaagcagcagcaaattctgctggcaacacaagttgttaaaatgatattgaagattgatgatgtcattactccaaacgattactgattatgaagtttctgtgcgtatgtttttctgttcctgctagtctctgttttgtttactatgttagcaagtatctgtaatatttgtttttacactttgaagcactgggagtgttattagttgaccagaaatgtttcctgatttttagttaatttaattatattttggtggtgtttgaggtttggtaatcatggaatttaataacttgtatcaagcaagtttttctatttgttacgactcaagttctatctgcaa

SEQ ID NO: 1786 - DNA, 1993 bp, Allium cepa
gtcctcgtctagaacaaacccgaaccctaattctctctctaaactcgtcactgcattcaaaattcgcactacatttatatttctcatctataacgattttgccatcagccgtcattactgttgaatccctacatcagcatcaatggcgttagcgttcgatgaatatggccgaccgttcctaattatgaaagagcaagatcagaaaaccaggcttcgtggtctcgaagctcagaaatcaaatattagtgccggagtggcagttgcgaggatcctaaggacgtcgcttgggccaaaaggaatggacaagatgcttcagagccctgatggggatgttgttattacgaatgacggggcaacgattttggaacagatggatgtagacaatcaaattgcaaaattgatggtcgagttgtcacgaagtcaggactatgagattggtgatggtacaactggtgtggttgtattggctggttcccttctagagcaagctgaaaagcttctagaacgtggtattcatcctattcgaattgcagaaggatacgagacagcttcgagaatagctgttgatcatcttgaacacatttctcaaaaatttgagttcagcattagtgatattgagccactggtgcaaacctgcatgaccactttgtcatcaaagattgttaatcgatgcaagcgcactctagcagaaattgctgtaaaagcagttcttgctgttgcagatttagataggaaagatgtcaatttggaccttattaaggtagaagggaaagtagggggaaagttggaggacacagaacttgtttatggaataattattgacaaagatatgagccatccacaaatgccaaaacatattgaagatgcaaaaattgccatcctaacttgcccatttgagccacccaagcccaagacaaagcataaggttgacattgacactgtagagaagttccaaactctgcgtcagcaggaacataagtatttcgatgacatggttcaaaaatgcaaggatgttggtgctactttagttatctgtcagtggggttttgacgacgaagccaatcacttattgatgcatcgaaatttgcctgctgttagatgggttggtggcgttgaattggaattaattgcaattgctacaggtggacgaattgttccaagatttcaagaactaacacctgaaaaacttggaaaggctggtctagtaagagaaaaagcatttgggacaaccaaagataggatgctttatatagagcaatgtgcaaattcaagggcagtgacaatatttattcgtggtggaaataaaatggtgatcgaggaaactaaacgtagtgtacatgacgcactatgtgtggcaaggaatttgatccgcaacaattctattgtttatggtggtggttcagctgagatttcatgctcaattgctgttgaagctgctgcagataagaatcctggagttgagcaatatgctattaggtcctttgctgatgcattagatgctgttccaatggctttggctgaaaatagtggcctccaacctattgacactcttaccgcagtcaaagcacaacaaatcaaggaaaataatgcttaccttggaatagattgcaatgatgtaggaacaaacaacatgcaggagcagaatgttttcgaaacgctgatcggaaagcagcagcaaattctgctggcaacacaagttgttaaaatgatattgaagattgatgatgtcattactccaaacgattactgattatgaagtttctgtgcgtatgtttttctgttcctgctagtctctgttttgtttactatgttagcaagtatctgtaatatttgtttttacactttgaagcactgggagtgttattagttgaccagaaatgtttcctgatttttagttaatttaattatattttggtggtgtttgaggtttggtaatcatggaatttaataacttgtatcaagcaagtttttctatttgttacgactcaagttc

SEQ ID NO: 1787 - DNA, 1962 bp, Festuca arundinacea
ggcacgaggatccgacccttcgagaaccttccgagcagagagcggtgcgcgcgtagcaggcatcgtcggcggcggccatggcgctggccttcgacgagttcggccggccgttcatcatcctgagggagcaggagaccaagtcgcgcctccggggcctcgacgcgcacaaggccaacgtcgccgccggcaaggctgtcgcgcgcatcctccgcacctccctcggtcccaagggcatggacaagattctccagtcccccgacggcgacgtcaccatcacaaatgacggagcgacaatcctagagcaaatggatgtcgacaaccagattgcaaagctgatggtggagctttcccgcagtcaagactatgaaagtggggatggtaccactggggtggttgtcttggccgggtccctccttgaacaagctgagaaactgttagagcgtggtattcacccaatacgaatcgccgaaggctatgagatggcctcaaagatagcttttgatcaccttgaacgtatctccaagaagtttgagttcactgctgcaaatatagagcccttggtgcagacctgcatgacaactctgtcctcaaagatagttaaccgttgtaagcggatgcttgctgagattgctgtcaaggcagtccttgctgttgctgatttggaaaggaaggatgtaaacttggacttgattaaagttgaaggcaaggttggtgggaagctagaggacactgagctaatatacggaattgctgttgacaaagacatgagccacccacaaatgccaaagagaatcgaggatgttaacattgccattctgacctgcccatttgagcctccgaagcctaagacaaagcataaggttgacattgacactgtagaaaaattccagacgctgcgtgggcaagagcagaaatactttgatgaaatggttcagaaatgcaaggatgttggggcaaccttggttatctgtcaatggggtttcgacgatgaagccaatcatttgcttatgcaaagaaatctgcctgctgtcagatgggtcggtggtgttgaattagaattgattgccatagctacaggggggcgaattgttccaagattccaagagttgactcgtgacaagcttgggaaggctggattagttagagaaaagtcatttggaacgacgaaggatcggatgctttacattgagaagtgtgcaaattccagagctgtgactatcttcatccgtggtggcaacaaaatgatgattgtggaggccaagcgaagtattcatgacgctctgtgtgtggctaggaatctgattcgcaataactctattgtttatggcggtggctcagctgagatatcttgctcaattgctgtcgaagctgctgcggatcggtatgctggagtcgagcagtatgcaatcaggtcgtttgctgatgcattggatgggattccactagccttagctgaaaacagtggtttgtcacctattgatacgttgactgcggtaaaatctcagcaagttaaggagaacaatccccactgtggcatcgactgcaatgacatcgggacaaacgacatgagagaacaagacgtctttgaaaccctgattggaaagcagcaacaaatcttgttggcgacacaggtggtgaagatgattctcaagatcgacgatgttatcacgccatcagagttctgagtactgataatgtttcatggatggagaaccagacactgaagcaacttctgtttgtttaatgatgaactgcatacctggcctgcctgtattgtggtgtgacacttgctcaacacgttagttttcgtgtcctcacattgtattccatgaagtcccttttaaaatagaatagaagaatgtaatggtgaaatgtctatttttctgtattttggatgctaatgctctggtatgtatgctcaacatacctatctaatatgcatcagtgagaaaaaaaaaaaaa

SEQ ID NO: 1788 - DNA, 1863 bp, Cichorium intybus
ggtcggccgttcataatattgagggaacaagagagtaagagtaggttaaggggtttagatgctcagaaggctaacatcgccgccggcgttgccgtttctcgcatcctccgtacatctcttggtcctaaaggcatggacaagatgctgcagagccccgacggcgacatcactatcacaaatgatggcgcgacaatcttggagcagatggatgttgacaatcaaattggaaaacttatggttgaactatcacggagtcaagactatgagattggcgatggaacaaccggtgtagttgttttggctggtgcacttttagaacaagcagagaagctcttggaacgtggaatccatcccatccgagttgcagaaggattcgaaatatcatcaaggattgctgttgatcacttggaacaaatatcacataagtttgatttcaatgccacaaacatagaacctttggttcaaacttgcatgaccaccttatcttccaaaattgtgaatcgatgcaaacgtagcttggctgagattgctgtaaaggcagtcatggctgttgctgatttagagaggaaagacgttaacctagacctcattaaagtggaaggaaaagtaggtgggaaactggaagatacagaacttatctatggaatcattgttgacaaagatatgagtcacccacagatgcctaaacaaatagaagatgctaaaattgcaatcttgacttgcccttttgaacccccaaagccaaaaaccaaacataaggttgacattgatactgttgaaaagtttcaaactttacgtaagcaagaacagaagtactttgatgacatggttcagagatgcaaggatgttggggctacattggtcatttgccaatggggatttgatgatgaagcaaatcacttgctaatgcacagaaacttgccagctgtcagatgggttggtggtgtggaacttgagcttatagcaatagcaactggtggtagaattgttcccaggttccaggagctaacaaccgaaaaactaggaaaggctggattggttagagaaaaatcattcggtaccacaaaagatcggatgctttacatcgagcattgtgcaaattcaagggctgtaaccgtatttatccgtggtggtaacaagatgatgatagaggagactaaaagaagcatacatgatgcattatgtgttgctagaaatttgatcagtaataattccattgtatatggtggtggggcagctgaaatttcatgctcaattgctgtagaagctgctgctgataaatatccaggagttgaacagtatgctattcgggcatttgcggatgcattggattccgtacccatggctcttgcggaaaatagtggtctgagttgcattgaaacattatccgcagtgaaagcacaacaaattaaggagaataatcattgctgtggtatcgactgtaatgatacggggacgaatgatatgcgcgagcagaatgtgtttgaaaccttgatcggcaagcaacagcagatattgcttgcgacacaagtcgtgaagatgattttgaagattgatgatgtcatatctccatctgagtattgatatttttgaggtaatgtagtttgaagttttggtctatgtacaacttttgaaaactgattgattggtggaaaacttttatatgtttgttttgttttgagaaaagaacgttttatggtttatgcaaccaacttttgaggacggtttgttgagattatggctttgtgtttttatattttggatccaaggaactgtctgaatgtgactagatgatgatttttcctttgatttatttgatataattataatgtttcaacatacaaagttaaacagagatcaacg

SEQ ID NO: 1789 - DNA, 1895 bp, Avena sativa
gcagcgccagcgcttcggcggccatggcgctcgccttcgacgagtacgggcggcccttcatcatcctcagggagcaggagaagaagtcgcggctgcaggggctcgacgcgcagaaggccaacatcgccgccggcaagtccgtcgcgcgcatcctccgcacgtccctcgggcccaagggcatggacaagatgctccagtcccccgacggcgacgttaccatcactaatgatggggcgaccatcctggagctaatggatgttgacaaccagattgctaagctgatggtggagttgtcacgcagtcaagactatgacattggagatggtaccactggagtggtggtcatggctgggtcgctcctagagcaggctgagaagctactggaacgtggtattcacccaataagggttgctgaaggttatgagatggcgtcaaggatagctgttgatcaccttgaaagcatctccacgaaatatgagttcagtgccacagacattgagcctttggtgcagacctgcatgacaactttgtcctcaaagattgttagccgttgtaagcgggccctagctgagattgctgtcaaagcagtccttgcggttgctgatttggaaaggaaggatgtaaatcttgacttgattaaggtggaaggtaaggttggtgggaagctagaggatactgagctagtacaaggaatcattgttgacaaagatatgagccacccccaaatgccaaagagaatcgaggatgctcacattgccattctgacctgcccatttgagcccccgaagcctaagacaaagcataaggttgacattgacactgtagagaaattccagacactgcgtgggcaagagcagaaatacttcgatgaaatggttcagaaatgcaaggatgttggtgcaaccctggttatttgtcaatgggggtttgatgatgaagccaatcatttactaatgcaaagagaactgcctgctgtcagatgggttggtggtgttgaattagaattaattgcaattgctacaggtgggaggattgttccgagattccaagagttgagtactgaaaagcttgggaaggctggattagtcagagagaagtcatttggaacaacaaaagatcggatgctatacatcgagaagtgtgccaattccaaagctgtaactattttcatccgtgggggcaacaaaatgatgattgaagagaccaagcgaagtattcatgatgcgctttgtgttgcaaggaatctcatcatcaacaactcaattgtgtatggtggtggctcagcagagatatcttgctcgattgctgttgaagctgctgcagatcggcatcctggagttgaacagtatgcaatcagggcatttgctgatgctttggatgctattccattggctttagctgaaaacagtggtttgccacctattgatactctgaccgtggtaaaatctcaacatgtcaaggagaacaattctcgttgcggcattgattgcaatgatgtgggtaccaatgacatgaaagagcagaatgttttcgaaactctgattggcaagcagcagcagatcttgctggcaacccaggtcgtcaagatgatcctcaagatcgatgatgttatcacgccttctgaatactgatgatgcctgcagagaagaggaatcgactgtgctaggtgactactacgctccagtaggcagctgtatgggttgatttggatttgctcctagaattctggcactgagtggtcgctttgtttcattttacgagctatatggttttgtgtgcttgctcgatcattataacattggcgttcactcttcgtactatagaacaaatcctgtcgataccagtttagtcctttgttgtattgtttgggatgcttaatgctatttttttggatc

SEQ ID NO: 1790 - DNA, 1881 bp, Vicia sativa
gcaatagcaacttgagagtgtgtgtcattgtttagggttctacctcacacttctcatttcccgatcgcacttttctcaaaccgcaaactcaaacatcaacatagggttagggtttacgatcttccaaaccaaaaatggcgttggctttcgacgagttcggaagaccattcataatcctccgagagcaagaaacgaagaacaggcttcgtggtctcgatgctcagaaagctaacatctccgccggtaaagccgtcgctcgtatcctccgaacatctctcggtcctaaaggcatggacaagatgcttcagagtcccgacggcgatgtcatcatctcgaatgatggagcgacgattttggaacagatggatgttgacaaccagattgcgaagctgatggtggagttgtcgaggagtcaagactatgagatcggtgatgggactactggagttgttgtgttggctggatctcttcttgagcaagctgagaggcttttggaacgtggaattcaccccattaggattgctgaggggtatgaaatggcttctaggattgcggttgagaatctcgaacgaattgctaataagtttgagtttggcgaaactattttggagcctctgattcagacttgtatgactacactgtcatccaaaattgtgaatcggtgtaagcgtagcttggctgagattgctgtcaaagccgttcttgctgttgctgatctagagagaaaagatgttaacttggatctaattaaagtagaaggtaaagttggtgggaaattggaagatactgagttggtgtatggtatcattgttgacaaggatatgagccatcctcaaatgcccaagcaaattgtagatgctaacattgctattctgacttgcccatttgagcccccgaagccaaaaaccaagcataaggttgatattgacacagtggagaagtttcagacattaaggaaacaagagcagcaatattttgatgacatggttaaacaatgcaaggatgtaggtgcaacccttgttatttgccaatggggttttgatgatgaagcaaatcatctcttgatgcacaggaacttgccagctgttaggtgggttggtggtgttgagttggaattgattgccatagcaacaggtggaagaattgttcctaggttccaggagttaactgcagaaaagttaggaaaggctggtatcgttagagagaaagcatttggaactactaaagaccggatgctatacatcgagcactgtgcaaattcaagggctgtaacaatattcattcgtggaggtaacaaaatgatcattgaagagaccaagcgtagtattcacgatgcactatgtgtggccaggaatcttattcgcaataactcaattgtgtatggtggtggttcagctgagattgcatgctctattgctgtcgaagcagctgctgacaaatatcctggagtagaacagtatgccattagagcatttggtgatgctttggaatctatccccatggcccttgctgaaaatagtggtcttcaaccaattgaaactttatctgctgtgaagtctcaacaaataaaggataataatcctcactttggcattgattgcaatgatgttggcacaaatgacatgcgggagcaaaatgtctttgaaacttgataggaaagcaacaacagatattgcttgctactcaagttgtcaagatgatattgaaaattgatgatgttatttctccatctgagtactagactagtacacctatttttgaacttacgttgcatgtcaaaggctcagaaattgctgatggtatttttgttcgtcctgtatgattttagtcagtttgtattttaacttgaagtatatttatgttatgattttggcatgtttt

SEQ ID NO: 1791 - DNA, 2014 bp, Festuca arundinacea
ggcacgagggaagaagaaagtatcacaaaccctcgtcccccgcggcgcgtcctccagaaccgcagcgcgcctcactctcagcccacagatcagctccccgcgcgatccgcccttccagaagcttcttctggggggagcagcaccagcgctccggcggccatggcgctcgccttcgacgagtacgggcggcccttcatcatcctcagggagcaggagaagaagtcgcggctgcaggggctcgacgcgcagaaggccaacatcgccgccggcaagtccgtcgcgcgcatcctccgcacgtccctcgggcccaagggcatggacaagatgctccagtcccccgacggcgacgtcaccatcactaacgatggggcgacgatcctggagctaatggatgtcgacaaccagattgcgaagctgatggtggagttgtcacgcagtcaagactatgacatcggtgatggtaccaccggggtggtcgtcatggctgggtcgctcctggagcaggctgagaagctgctggaacgtggtattcacccaataagggtcgctgaaggttacgagatggcgtcaaggatagctgttgatcaccttgaaagcatctccaccaaatatgagttcagtgctacagacattgagcctttggtgcagacctgcatgacaactttgtcctcaaagattgttagccgttgtaagcgagcgcttgctgagattgctgtcaaagcagttcttgcagttgctgatttggaaaggaaggatgtaaatttggacttgattaaagtggaaggtaaggttggtgggaagctagaggatactgagctagttcagggaatcattgttgacaaagatatgagccacccccaaatgccgaagagaatcgaggatgctcacatcgccattcttacttgcccatttgagcccccgaagcctaagaccaagcataaggttgacattgacactgtagagaaattccagacactgcgtgggcaagagcagaaatacttcgatgacatggttcagaaatgcaaggatgttggtgcaacactagttatttgtcaatggggttttgatgatgaagccaatcatctactaatgcaaagagatttgccggctgtcagatgggttggtggtgttgaattagagttaattgccattgctacaggtgggaggattgttccgagattccaagagttgagcaccgaaaagcttgggaaggctggattagtcagagagaagtcatttggaacaacaaaagataggatgctttacatcgagaagtgtgccaattccaaagctgtaactattttcatccgtggtggcaacaaaatgatgattgaggagaccaagcgaagtattcatgatgctctttgtgttgcaaggaatctgatcatcaacaactcaattgtgtatggtggtggctcagcagagatatcttgctcgattgctgttgaagctgctgcagatcggcatcctggagttgagcagtatgcaatcagggcatttgctgatgctttagatgctattccactggctttagctgaaaacagtggtttgccacctatcgacactctaaccgtggttaaatctcaacatgtcaaggagaacaattcccgctgtggcattgattgcaatgatgtgggtaccaatgacatgaaagagcagaatgttttcgaaactctgatcggcaagcagcagcagatcttgctggcaacgcaggttgtcaagatgatcctcaagatcgatgatgttatcacgccctctgaatattgctgatgcctgggaacaacggaaatcgactgagctaggtgtgattcgctccggtagacagcaattttctaggggttgatttggatttgctgacatggagtggttgcttgttttgtttgatgagctatcttgttttgtgacacgctttctggatacaacagcgcaaatcccgttgataccagtctagtcctttgttgtattattcagatgcttaattctatagcttggaccattattgtctgctttgaag

SEQ ID NO: 1792 - DNA, 2046 bp, Lolium multiflorum
agaaagcaccacaaaccctcgccccccacagagccgcagcgccgcctcagtccccgagcgcgcgatccgcccttccagaggctccttcctccggggggcgctccggtccggcggccatggcgctcgccttcgacgagtacggccggcccttcatcatcctcagggagcaggagaagaagtcgcgcctgcagggcctcgacgcgcagaaggccaacatcgccgccggcaagtccgtcgcgcgcatcctccgcacctccctcgggcccaagggcatggacaagatgctccagtcgcccgacggcgacgtcaccatcactaacgatggggcgaccatcctcgagctaatggatgtcgacaaccagatcgcgaagctgatggtggagttgtcacgcagtcaggactatgacatcggtgatggcaccaccggggtggttgtcatggctgggtcgctcctggagcaggctgagaagctgctggaacgtggtattcacccgataagggtcgctgaaggctatgagatggcgtcaaggatagctgttgatcaccttgaaagcatctccaccaaatatgagttcagtgctacagacattgagcctttggtgcagacctgcatgacaactttgtcatcaaagattgttagccgttgtaagcgggcacttgctgagattgctgtcaaagcagtccttgcagttgctgatttggaaaggaaggatgtaaatttggacttgattaaagtggaaggtaaggttggtgggaagctagaggatactgagctagttcaaggaatcattgttgacaaagatatgagccacccccaaatgccgaagagaatcgaggatgctcacatcgccattcttacttgcccgtttgagcccccgaagccgaagaccaagcataaggttgatattgacactgtagagaaattccagacactgcgtgggcaagagcagaaatacttcgatgacatggttcagaaatgcaaggatgttggtgcaacactagttatttgtcagtgggggtttgatgatgaagccaatcatctactaatgcaaagagatttgccggctgtcagatgggttggtggtgttgaattagagttaattgccattgctacaggtgggagaattgttccgagattccaagagttgagcactgaaaagcttgggaaggctggattagtcagagagaagtcatttggaacaacaaaagataggatgctttacatcgagaagtgtgccaattccaaagctgtaactattttcatccgcggtggcaacaaaatgatgattgaggagaccaagcgaagtatccatgatgctctttgtgttgcaaggaatctgatcatcaacaactcaattgtgtatggtggtggctcagcagagatatcttgctcgattgctgttgaagctgctgcagatcggcatcctggagttgagcagtatgcaatcagggcatttgctgatgctttagatgctattccactggctttagctgaaaacagtggtttgccacctattgacactctaaccgtggttaaatctcaacatgtcaaggagaacaattcccgctgtggcattgattgcaatgatgtgggtaccaatgacatgaaagagcagaatgtttttgaaactcttatcggcaagcagcagcagatcttgctggcaacgcaggttgtcaagatgattctcaagatcgatgatgttatcacgccctctgaatattgctgatgcctgggaacaacggaaatcgactgtgctaggtgtcatgcgctccggtaggaagcaattttctaggggttgatttggatttgctgacatggagtggttgcttgttttgtttgatgagctatcttgttttgtgacacgctttctggatacaacagcgcaaatcccgttgataccagtctagtcctttgttgtattattcagatgcttaattctatagtttggaccattattgtctgctttgaagtaagtgtttcattttgttaattacttgcctaaagtacctcagttgacgagattgagcctatgttcccaacaaagt

SEQ ID NO: 1793 - DNA, 2079 bp, Chenopodium quinoa
caaaagttgtgagttgggttttagttttaggtcacaaaaaagcttaaaaatgggtcggatgatccataaaacaccgtactattcttaagttagaacgctatactaatctctctacttctctcactctcattttcatattttcggagtttgtacaattcacactatttctgttctctctcaaaattcattacttttattgctggttcttcttcttgttccgaatcatctcgaaagggggaaatgtcgtttgcggcattcgatgaatcggggcggcgattcataatattgagggagcaagaacagaaggctcgattgagcggattagaggctgtgaaaactaatgttactgctggaaaagcggtttctcgtattcttcgtacttcacttggtcctaagggcatggacaagatgctccaatctcccgacggtgacattgctatcacaaatgatggtgctactatcttggaccagatggatgttgataacccaattgcaaagttgatggttgaattgtcccgcagtcaggattatgaaattggtgatggcactactggagtagttgtcatggctggtgcccttctggagcaggctgaaaatctcttagatcgtggtatccatcctattagaatagcagaaggatatgaagtggcttctcggattgctgttgaacatctggagaagatcgcacataaatttgaattcggagaaaccgatgtagagcctttgatccagacttgcatgactacgttgtcttcgaaaattgtaaatcgctgtaagcgcagtttggctgagattgcggttaaagcggttttggctgttgcagacttggagcggaaggatgttaatcttgatctaattaaagtggaggggaaagtgggaggtaaacttgaagatactgaactcatctatggtattgttgtggacaaggacatgagccaccctcaaatgccgaaaaaaattgaagatgctaatatagcaattttaacttgcccctttgagccaccaaagccaaaaaccaagcataaggttgagattgacactgtggagaagtttgagacattacgcaaacaagagcaacattactttgatgaaatggttcaaaagtgcaaggatgttggtgcaactttggttatctgtcaatggggtttcgatgatgaagcaaaccatttgttgatgcataggaatttgcctgctgtcagatgggttggaggtgttgagctggagcttattgctattgccaccggaggaagaattgtccccagatttcaagaattgactcctgaaaagttgggacgggccgggttggttcgtgagaaagcttttggtaccacaaaagatcgaatgctgtacattgaacattgtgccaattcaaaggctgtgaccatatttatccgtggcggtaacaaaatgatgattgaagagacaaagagaagcatccacgacgcactttgtgttgcaaggaacctaatccgcaacaattctattgtgtatggtggcggttctgctgaaattgcttgttctcttgctgtagaggcaggtgctgatcgatttccaggagttgagcagtatgctatcagggcctttgctgaatctcttgatgcagttcccatggcacttgctgaaaacagtggtcttcagcctattgaaacactgtctgctgtgaaacatcagcaaatcaaggagaacattactcacttgggcatagattgcaatgacgttggcacaaacgacatgcgtgagcagtatgttttcgagaccttgatcgggaagcagcagcagattttgttagctacccaggttgtgaagatgattttgaagatagatgatgtcattaccccatctgaattttgatagtatgtaatttaggttatgttgtgtgagtcctcccccttcttaagcgtaggtgtcattctattgggtctttgatgatgcttttgtggcgtaaaatggaacgtttctcatgacaatgaattgaaactctgtttgcccctaaattttgtatgtcgaatctttttctctgagtattctcagttagaccgtcttttctgatcaatatagatgtttatttgtggcttaaaa

SEQ ID NO: 1794 - DNA, 1967 bp, Allium cepa
cctagttacggggaccactaaagcccaagtaccacgacatccagtgtcctcgtctagaacaaacccgaaccctaattctctctctgaactcttcactgcattcaaaattcgcactacatttatatttctcatctataacgattttgccatcagccgtcattactgttgaatccctacatcagcatcaatggcgttagcgtccgatgaatatggccgaccgttcctaattatgaaagagcaagatcagaaaaccaggcttcgtggtctcgaagctcagaaatcaaatattagtgccggagtggcagttgcgaggatcctaaggacgtcgcttgggccaaagggaatggacaagatgcttcagagccctgatggggatgttgttattacaaatgacggggcaacgattttggaacagatggatgtagacaatcaaattgcaaaattgatggtcgagttgtcacgaagtcaggactatgagattggtgatggtacaactggtgtggttgtattggctggttccttctagagcaagctgaaaagcttctagaacgtggtattcatcctattcgaattgcagaaggatacgagacagcttcgagaatagctgttgatcatcttgaacacatttctcaaaaatttgagtttagcattagtgatattgagccactggtgcaaacctgcatgaccactttgtcatcaaagattgttaatcgatgcaagcgcactctagcagaaattgctgtaaaagcagttcttgctgttgcagatttagataggaaagatgtcaatttggaccttattaaggtagaagggaaagtagggggaaagttggaggacacagaacttatttatggaataattattgacaaagatatgagccatccacaaatgccaaaacatattgaagatgcaaaaattgccatcctaacttgcccatttgagccacccaagcccaagacaaagcataaggttgacattgacaccgtggagaagtttcaaactttgcgtaagcaggagcaacaatattttgatgacatggttcaaaaatgcaaggatgttggtgctactttagttatctgtcagtggggttttgacgacgaagccaatcacttattgatgcatcgaaatttgcctgctgttagatgggttggtggcgttgaattggagttgattgccattgctacaggcggacgaattgttccaaggtttcaagaattaacacccgagaaacttgggaaagctggtctagttagggaaaaagcatttgggaccacaaaagaccggatgctttatatcgagcagtgtgcgaattctagggcggtgacaatatttattcgtggtggcaacaaaatgatgatagaagaaacaaaaagaagcgtacatgatgcactatgcgtggcaaggaatttgatccgcaataactcaatagtttatggtggtggctcggctgagatctcatgctcaattgctgttgaagctgctgcagataagcatcctggagttgagcagtatgctattaggtctttcgctgaagcattagatgctgttccaacagcacttgcagaaaacagtggtttacagcctattgacactcttaccgctgtcaaagcccagcaaatcaaggaaagcaattcattcttgggcatagactgtaacgatgttgggaccaacaatatgcgacagcaagatgttttcgaaacgttgatcggaaagcaacagcaaattatgctggcaacgcaggttgtgaaaatgatattgaagatcgatgatgttatcaccccaactgagtactaacttcattccaaactttgcaagattttgtttgctttgtataatttatgacttttgaattgaatgctgcaaaatttttgtaatatttaacactgaatttgtggggaaatggtgtttggttcttccagtacttttcatgattttctgatgtgtttgcatatagaaatttggagtgt

SEQ ID NO: 1795 - DNA, 1879 bp, Centaurea maculosa
aatggcgttggccttgaatgatatgggaggccggttataatattaagggaacaagagagtaagagcaggttaaggggtttagatgctcacaaatctaacattgccgctggcgttgcggtatctcgtatcctccgtacgtctctcggtcccaaaggcatggacaagatgctccagagccccgacgccgatatcaccatcacaaacgatggtgcaacgatcttggagcagatggacgtcgacaatcaaattggaaaacctatggttgaactttcccagagtcaagactatgagattggtgatggaacgaccagtatagttgttatggccggtgcacttttagaacaagccgagcggctgttggaacgcggaatccatcccatccgtgtagcagaaggattcgagatatcttcaaggattgcagttgatcatttagaacagatctcacataagtttgagttcactgctacaaatatagaacctttggttcaaacttgcatgaccaccttatcctctaaaattgtgaaccgatgcaagcgtagtttggctgagattgctgtaaagggagtcatggccgttgccgatctagagaggaaagatgttaacttagacctcattaaagtagaagggaaagtaggtgggaagttggaggataccgaactcatttacggaatcatagtcgacaaagatatgagtcatcctcagatgccaaagcaaattgaagatgcaaagattgccattttgacttgcccatttgagcccccaaagcctaagaccaagcataaggttgacattgataccgttgagaagttccaaactttacgtgagcaagagaagaagtacttcgacgagatggttcaaagatgcaaggatgtaggggctacgttggtaatatgccaatggggctttgacgatgaagcaaatcatttattaatgcacagaaacttgcctgctgtcagatgggttggtggtgtggaactggagcttatagcaatagcaactggtggtagaattgttccgaggttccaggaactaacacctgaaaagctcggaaaggctggtttggtcagagagaaggcatttggtaccacaaaagatcgaatgctttatattgagcattgtgcaaattcaagagctgtgaccgtatttattcgtgggggtaacaagatgatgatagaggagactaaacgcagcatccatgatgcactttgtgttgctagaaatctcatccgcaataattctatcgtatatggtggcggtgcagcggaaatttcatgttcaattgcagtcgaagctgccgccgataaatatcccggagttgaacagtatgccattagggcttttgcggatgctttggattccgtgcccatggctcttgcggagaatagcggtctgcaaccgattgaaacactgtctgcggtgaaagcgcagcaaattaaggagaacaatccttgttgtggcatagattgcaacgatgccggcacaaacgacatgcgtgagcaaaacgtatttgaaaccttaatcggaaagcaacaacagatcttgctcgctacgcaagtcgttaagatgatcttgaagatcgatgacgtgatttcgccttcggattattgatgagttttggcctatgtagaacattgctagaaaaacttattttcttcttcttcatgaattattgtggttaattgttttgtagaggtcgatcgtttgatgttcgtgttttcgtttatatttgagagaaaagtgtttatcaacctatgtatgtggtatggaaaaaaagttctgtaaaaagtgcttggatttgcttatttgtgtaaaatgatcaaaatggataaaggcgaaggagagctttattaaaataagagtaaaaaagtcatttggtttt

SEQ ID NO: 1796 - DNA, 1978 bp, Allium cepa
cttctttctctaaacactttagccttcgctgttttcaaaaggcacgctgcatttgtcttcgtcttctataacctttttaccatcagccgccattaccgtttgaatccctacatcaggatcaatggcgttagcgttcgatgaatatggccgaccgttcttaattatgaaggagcaagaccagaaaaccaggcttcgtggtctcgaagctcagaaatcaaatattagcgccggagtggcagttgcgaggatcctgaggacgtcgcttgggccaaaaggaatggacaagatgctccagagccctgacggggatgtcgttattacaaatgatggggctacgatcttggaacagatggatgtagacaatcaaattgcaaaattgatggttgagctgtcacgaagtcaggactacgagatcggtgatggtacaactggtgtggttgtattggctggttcccttctagagcaagctgaaaagcttctagaacgtggtattcatcccattcgaattgcagaaggatacgagacagcgtccagaatagctgttgatcatcttgaacacatttctcaaaaatttgagttcagcattagtgatattgagccactggtgcaaacctgcatgaccactttgtcatcaaagattgttaatcgatgcaagcgcactctagcagaaattgctgtaaaagcagttcttgctgttgcagatttagataggaaagatgtcaatttggaccttattaaggtagaagggaaagtagggggaaagttggaggacacagaacttgtttatggaataattattgacaaagatatgagccatccacaaatgccaaaacatattgaagatgcaaaaattgccatcctaacttgcccatttgagccacccaagcccaagacaaagcataaggttgacattgacactgtagagaagttccaaactctgcgtcagcaggaacataagtatttcgatgacatggttcaaaaatgcaaggatgttggtgctactttagttatctgtcagtggggttttgacgacgaagccaatcacttattgatgcatcgaaatttgcctgctgttagatgggttggtggcgttgaattggagttgattgccattgctacaggcggacgaattgttccaaggtttcaagaattaacacccgagaaacttgggaaagctggtctagttagggaaaaagcatttgggaccacaaaagaccggatgctttatatcgagcagtgtgcgaattctagggcggtgacaatatttattcgtggtggcaacaaaatgatgatagaagaaacaaaaagaagcgtacatgatgcactatgcgtggcaaggaatttgatccgcaataactcaatagtttatggtggtggctcggctgagatctcatgctcaattgctgttgaagctgctgcagataagcatcctggagttgagcagtatgctattaggtctttcgctgaagcattagatgctgttccaacagcacttgcagaaaacagtggtttacagcctattgacactcttaccgctgtcaaagcccagcaaatcaaggaaagcaattcattcttgggcatagactgtaacgatgttgggaccaacaatatgcgacagcaagatgttttcgaaacgttgatcggaaagcaacagcaaattatgctggcaacgcaggttgtgaaaatgatattgaagatcgatgatgttatcaccccaactgagtactaacttcattccaaactttgcaagattttgtttgctttgtataatttatgacttttgaattgaatgctgcaaaatttttgtaatatttaacactgaatttgtggggaaatggtgtttggttcttccagtacttttcatgattttctgatgtgtttgcagatagaaatttggagtgtaatatgccgtcctctgcatgtggattatcttttcaacgtatagctacctagtttgaattaatcaaaaaacacacac

SEQ ID NO: 1797 - DNA, 1713 bp, Allium cepa
tcagccgtcattactgttgaatccctatattagcatcaatggcgttagcgttcgatgaatatggccgaccgttcctaattatgaaagagcaagatcagaaaaccaggcttcgtggtctcgaagctcagaaatcaaatattagtgccggagtggcagttgcgaggatcctaaggacgtcgcttgggccaaaaggaatggacaagatgcttcagagccctgatggggatgttgttattacgaatgacggggcaacgattttggaacagatggatgtagacaatcaaattgcaaaattgatggtcgagttgtcacgaagtcaggactatgagattggtgatggtacaactggtgtggttgtattggctggttcccttctagagcaagctgaaaagcttctagaacgtggtattcatcctattcgaattgcagaaggatacgagacagcttcgagaatagctgttgatcatcttgaacacatttctcaaaaatttgagttcagcattagtgatattgagccactggtgcaaacctgcatgaccactttgtcatcaaagattgttaatcgatgcaagcgcactctagcagaaattgctgtaaaagcagttcttgctgttgcagatttagataggaaagatgtcaatttggaccttattaaggtagaagggaaagtagggggaaagttggaggacacagaacttatttatggaataattattgacaaagatatgagccatccacaaatgccaaaacatattgaagatgcaaaaattgccatcctaacttgcccatttgagccacccaagcccaagacaaagcataaggttgacattgacaccgtggagaagtttcgaactttgcgtaagcaggagcaacaatattttgatgacatggttcaaaaatgcaaggatgttggggcaactctagttatttgtcagtggggctttgatgatgaagccaatcacttgttaatgcatagaaatttgcctgctgttagatgggttggtggcgttgaattggaactaattgcaattgctacaggtggacgaattgttccaagatttcaagaactaacacctgaaaaacttggaaaggctggtctagtaagagaaaaagcatttgggacaaccaaagataggatgctttatatagagcaatgtgcaaattcaagggcagtgacaatatttattcgtggtggaaataaaatggtgatcgaggaaactaaacgtagtgtacatgatgcactatgtgtggcaaggaatttgatccgcaacaattctattgtttacggtggtggttcagctgagatttcatgctcaattgctgttgaagctgctgcagataagcatcctggagttgagcagtatgctattaggtctttcgctgaagcattagatgctgttccaacagcacttgcagaaaacagtggtttacagcctattgacactcttaccgctgtcaaagcccagcaaatcaaggaaagcaattcattcttgggcatagactgtaacgatgttgggaccaacaatatgcgacagcaagatgttttcgaaacgttgatcggaaagcaacagcaaattatgctggcaacgcaggttgtgaaaatgatattgaagatcgatgatgttatcaccccaactgagtactaacttcattccaaactttgcaagattttgtttgctttgtataatttatgacttttgaattgaatgctgc

SEQ ID NO: 1798 - DNA, 1954 bp, Avena sativa
cgaccccccgcggcgtctcctccagaaccacagcgccgcctcactctcccccctcagatcagctccccgcgcgatccgccctcccaggagtttcttccggggggagcagcgccagcgcttcggcggccatggcgctcgccttcgacgaatacgggcggcccttcatcatcctcagagagcaggagaagaagtcgcggctgcagggtctcgacgcgcagaaggccaacatcgccgccgccaaggctatcgcgcgcatcctccgcacgtcccttgggcccaagggcatggacaagatgctccagtcccccgacggcgacgttaccatcactaatgacggggcgaccatcctggagctaatggacgttgacaaccagattgcaaagctgttggtggagttgtcacgcagtcaagactatgacattggagatggtaccactggagtggtggtcatggctgggtctctcctagagcaggctgagaagctactggaacgtggtattcacccaataagggttgctgaaggttatgagatggcgtcaaggatagctgttgatcaccttgaaagcatctccacgaaatatgagttcagtgccacagacattgagcctttggtgcagacctgcatgacaactttgtcctcaaagattgttagccgttgtaagcgggccctagctgagattgctgtcaaagcagtccttgccgttgctgatttggaaaggaaggatgtaaatctggacttgattaaggtggaaggcaaggttggtgggaagctagaggataccgagctagtgcaaggaatcattgttgacaaagatatgagccacccccaaatgccaaagagaatcgaggatgctcacattgccattctgacctgcccatttgagcccccgaagcccaagaccaagcataaggttgacattgacactgtagagaaattccagacactgcgtgggcaagagcagaaatactttgatgaaatggttcagaaatgcaaggatgttggtgcaaccctggttatttgtcaatgggggtttgatgatgaagccaatcatttactaatgcaaagagaactgcctgctgtcagatgggttggtggtgttgaattagaattaattgccattgctacaggtgggaggattgttccgagattccaagagttgagtactgaaaagcttgggaaggctggattagtcagagagaagtcatttggaacaacaaaagatcggatgctttacatcgaaaagtgtgccaattccaaagctgtaactattttcatccgtggaggtaacaaaatgatgattgaggagaccaagcgaagtattcatgatgctctttgtgttgcaaggaatctcatcatcaacaactcaattgtgtatggtggtggctcagcagagatatcttgctcgattgctgttgaagctgctgctgatcggcatcctggagttgagcagtatgcaatcagggcatttgctgatgctttggatgccattccactggctttagctgaaaacaagtggtttgccacctattgatactctgacagtggtaaaatcccaacatgtcaaggagaacaattcccgctgcggcattgattgcaacgatgtgggtaccaatgacatgaaagagcagaatgtttttgaaactctgattggcaagcagcagcagatcttgctggcaacccaggtcgtcaagatgatcctcaagatcgatgatgttatcacgccttctgaatattgacgatgcctgcagagaacatgaatctactgtgctaggtgacatatgctccagtaggcagctttatgggttgatttggatttgctcctagaattccgtcaccgagtggtcgctttgttttgtttgacgtgcgatatggttttgtgcgctcgcgtgatcattataacattggtgttcacactctgtacaatagaacaaatcctgtcgataccagtttagt

SEQ ID NO: 1799 - DNA, 1774 bp, Allium cepa
gctccattttccttctttcactcttaaacttctcctccgccgccattacggctgctttatttcgtccgatttgatggcgttagcattcgacgagtacggacggcctttcctaatagtgaaagagcaagatcagaagacgaggcttcgaggtctcgaagctcagaaatccaacataagtgctggagtggcagttgcgaggatcttgaggacttctctagggccgaaggggatggataagatgctccagagccctgatggcgatgttgttattacaaatgacggggcaacaatcttggaacaaatggatgtcgacaatcaaattgcaaaattaatggttgagctgtcacgaagccaggattacgagattggtgatggtacaactggtgtggttgttttggctggttctcttttagaacaggctgagaagcttttagaacgtggtattcatcctataagaattgcagaaggatatgagacagcatctcgaataactgttgaccatcttgagcagatttctcaaaagtttgtgtttagcattaatgatattgagcccctggtgcaaacttgcatgactactttgtcatcaaagattgttaatcgatgcaaacgtactctagcagagattgctgtaaaagcagttctggctgttgcagatttagagaggaaagacgtcaatttggatctgattaaggtagaagggaaagtaggaggaaatttagaggacacagaactcatttacggaattattgtagacaaggatatgagccatccacaaatgccgaagcatatcgaagatgcaaaaattgctattttgacttgcccattcgagccacccaaacccaagacaaaacataaggttgacattgacactgtagagaagttccaaactctgcgtcagcaggaacagaagtatttcgatgacatggttcaaaaatgcaaggatgttggtgctactttagttatctgtcagtggggttttgacgacgaagccaatcacttattgatgcatcgaaatttgcctgctgttagatgggttggtggcgttgaattggagttgattgccattgctacaggcggacgaattgttccaaggtttcaagaattaacacccgagaaacttgggaaagctggtctagttagggaaaaagcatttgggaccactaaagaccggatgctttatatcgagcagtgtgcgaattctagggcggtgacaatatttattcgtggtggcaacaaaatgatgatagaagaaacaaaaagaagcatacatgatgcactatgcgtggcaaggaatttaatccgcaataactcaatagtttatggtggtggctcggctgagatctcatgctcaattgctgttgaagctgctgcagataagcatcctggagttgagcagtatgctattaggtctttcgctgaagcattagatgctgttccaacagcacttgcagaaaacagtggtttacagcctattgacactcttaccgctgtcaaagcccagcaaatcaaggaaagtaattcattcttgggcatagactgtaacgatgttgggaccaacaatatgcgacagcaagatgttttcgaaacgttgatcggaaagcaacagcaaattatgctggcaacgcaggttgtgaaaatgatattgaagatcgatgatgttatcaccccaactgagtactaacttcattccaaactttgcaagattttgtttgctctgtataatttatgactttgaattgaatgctacaaaatttttgtaatatttaacactgaa

SEQ ID NO: 1800 - DNA, 2069 bp, Avena sativa
atcacaaaccctcgaccccccgcggcgtctcctccagaaccacagcgccgcctcactctcccccccagatcagctccccgcgcgatccgccctcccaggagtttcttccggggggagcagcgccagcgcttcggcggccatggcgctcgccttcgacgagtacgggcggcccttcatcatcctcagagagcaggagaagaagtcgcggctgcagggtctcgacgcgcacaaggccaacatcgccgccgccaaggctatcgcgcgcatcctccgcacgtcccttgggcccaagggcatggacaagatgctccagtcccccgacggcgacgttaccatcactaatgacggggcgaccatcctggagctaatggacgttgacaaccagattgcaaagctgttggtggagttgtcacgcagtcaagactatgacattggagatggtaccactggagtggtggtcatggctggggctctcctagagcaggctgagaagctactggaacgtggtattcacccaataagggttgctgaaggttatgagatggcgtcaaggatagctgttgatcaccttgaaagcatctccacgaaatatgagttcagtgccacagacattgagcctttggtgcagacctgcatgacaactttgtcctcaaagattgttagccgttgtaagcgggccctagctgagatttctgtcaaagcagtccttgcggttgctgatttggaaaggaaggatgtaaatctggacttgattaaggtggaaggcaaggttggtgggaagctagaggatactgagctagtggaaggaatcattgttgacaaagatatgagccacccccaaatgccaaagagaatcgaggatgctcacattgccattctgacctgcccatttgagcccccgaagcccaagaccaagcataaggttgacattgacactgtagagaaattccagacactgcgtgggcaagagcagaaatacttcgatgagatggttcagaaatgcaaggatgttggtgcaaccctagttatttgtcaatggggttttgatgatgaagccaatcatttactaatgcaaagagaactgcctgctgtcagatgggttggtggtgttgaattagaattaattgccattgctacaggtgggaggattgttccgagattccaagagttgagtactgaaaagcttgggaaggctggattagtcagagagaagtcatttggaacaacaaaagatcggatgctttacatcgaaaagtgtgccaattccaaagctgtaactattttcatccgtggaggtaacaaaatgatgattgaggagaccaagcgaagtattcatgatgcgctttgtgttgcaaggaatctcatcatcaacaactcaattgtgtatggtggtggctcagcagagatatcttgctcgattgctgttgaagctgctgctgatcggcatcctggagttgagcagtatgcaatcagggcatttgctgatgctttggatgctattccactggctttagctgaaaacagtggtttgccacctattgatactctgacagtggtaaaatcccaacatgtcaaggagaacaattcccgctgtggcattgattgcaacgatgtgggtaccaatgacatgaaagagcagaatgtttttgaaactctgattggcaagcagcagcagatcttgctggcaacccaggtcgtcaagatgatcctcaagatcgatgatgttatcacgccttctgaatattgacgatgcctgcagagaacatgaatcgactgtgctaggtgacatacgctccagtaggcagctgcatgggttgatttggatttgctcctagaattccgtcaccgagtggtcgctttgttttgtttgacgagctatatggttttgtgcgcttgctcgatcattataactttggtgttcacactctgtacaatagaacaaatcctgtcgataccagtttagtccgttgttgtattgtttgggatgcttaatgctattgtttggatcattattttgtctgctttgaagtaagtgttacttatttttatattctatgcttggctgaagt

SEQ ID NO: 1801 - DNA, 2001 bp, Avena sativa
atcacaaaccctcgaccccccgcggcgtctcctccagaaccacagcgccgcctcactctcccccccagatcagctccccgcgcgatccgccctcccaggagtttcttccggggggagcagcgccagcgcttcggcggccatggcgctcgccttcgacgagtacgggcggcccttcatcatcctcagagagcaggagaagaagtcgcggctgcagggtctcgacgcgcacaaggccaacatcgccgccgccaaggccatcgcgcgcatcctccgcacgtcccttgggcccaagggcatggacaagatgctccagtcccccgacggcgacgttaccatcactaatgacggggcgaccatcctggagctaatggacgttgacaaccagattgcaaagttgttggtggagttgtcacgcagtcaagactatgacattggagatggtaccactggagtggtggtcatggctggggctctcctagagcaggctgagaagctactggaacgtggtattcacccaataagggttgctgaaggttatgagatggcgtcaaggatagctgttgatcaccttgaaagcatctccacgaaatatgagttcagtgccacagacattgagcctttggtgcagacctgcatgacaactttgtcctcaaagattgttagccgttgtaagcgggccctagctgagatttctgtcaaagcagtccttgcggttgctgatttggaaaggaaggatgtaaatctggacttgattaaggtggaaggcaaggttggtgggaagctagaggatactgagctagtggaaggaatcattgttgacaaagatatgagccacccccaaatgccaaagagaatcgaggatgctcacattgccattctgacctgcccatttgagcccccgaagcccaagaccaagcataaggttgacattgacactgtagagaaattccagacactgcgtgggcaagagcagaaatacttcgatgagatggttcagaaatgcaaggatgttggtgcaaccctagttatttgtcaatggggttttgatgatgaagccaatcatttactaatgcaaagagaactgcctgctgtcagatgggttggtggtgttgaattagaattaattgccattgctacaggtgggaggattgttccgagattccaagagttgagtactgaaaagcttgggaaggctggattagtcagagagaagtcatttggaacaacaaaagatcggatgctttacatcgaaaagtgtgccaattccaaagctgtaactattttcatccgtgggggcaacaaaatgatgattgaggagaccaagcgaagtattcatgatgctctttgtgttgcaaggaatctcatcatcaacaactcaattgtgtatggtggtggctcagcagagatatcttgctcgattgctgttgaagctgctgctgatcggcatcctggagttgagcagtatgcaatcagggcatttgctgatgctttggatgctattccattggctttagctgaaaacagtggtttgccacctattgatactctgacagtggtaaaatcccaacatgtcaaggagaacaattcccgctgtggcattgattgcaacgatgtgggtaccaatgacatgaaagagcagaatgtttttgaaactctgattggcaagcagcagcagatcttgctggcaacccaggtcgtcaagatgatcctcaagatcgatgatgttatcacgccttctgaatattgacgatgcctgcagagaacatgaatcgactgtgctaggtgacatacgctccagtaggcagctgcatgggttgatttggatttgctcctagaattccgtcaccgagtggtcgctttgttttgtttgacgagctatatggttttgtgcgctcgcttgatcattataacattggtgttcacactctgtacaataggacaaatcctgtcgataccagtttagtcctttgttgtattgtttgggatgcttaatgctattgt

SEQ ID NO: 1802 - DNA, 2036 bp, Avena sativa
atcacaaaccctcgactccccgcggcgtctccagaaccacagcgccgcctcactctcccccctcagatcagctccccgcgcgatccgccctcccaggagtttcttccggggggagcagcgccagcgcttcggcggccatggcgctcgccttcgacgagtacgggcggcccttcatcatcctcagagagcaggagaagaagtcgcggctgcagggtctcgacgcgcacaaggccaacatcgccgccgccaaggctatcgcgcgcatcctccgcacgtcccttgggcccaagggcatggacaagatgctccagtcccccgacggcgacgttaccatcactaatgacggggcgaccatcctggagctaatggacgttgacaaccagattgcaaagctgttggtggagttgtcacgcagtcaagactatgacattggagatggtaccactggagtggtggtcatggctggggctctcctagagcaggctgagaagctactggaacgtggtattcacccaataagggttgctgaaggttatgagatggcgtcaaggatagctgttgatcaccttgaaagcatctccacgaaatatgagttcagtgccacagacattgagcctttggtgcagacctgcatgacaactttgtcctcaaagattgttagccgttgtaagcgggccctagctgagatttctgtcaaagcagtccttgcggttgctgatttggaaaggaaggatgtaaatctggacttgattaaggtggaaggcaaggttggtgggaagctagaggatactgagctagtggaaggaatcattgttgacaaagatatgagccacccccaaatgccaaagagaatcgaggatgctcacattgccattctgacctgcccatttgagcccccgaagcccaagaccaagcataaggttgacattgacactgtagagaaattccagacactgcgtgggcaagagcagaaatacttcgatgagatggttcagaaatgcaaggatgttggtgcaaccctagttatttgtcaatggggttttgatgatgaagccaatcatttactaatgcaaagagaacttcctgctgtcagatgggttggtggtgttgaattagaattaattgccattgctacaggtgggaggattgttccgagattccaagagttgagtactgaaaagcttgggaaggctggattagtcagagagaagtcatttggaacaacaaaagatcggatgctttacatcgaaaagtgtgccaattccaaagctgtaactattttcatccgtggaggtaacaaaatgatgattgaggagaccaagcgaagtattcatgatgctctttgtgttgcaaggaatctcatcatcaacaactcaatcgtgtatggtggtggttcagcagagatatcttgctcgattgctgttgaagctgctgctgatcggcatcctggagttgagcagtatgcaatcagggcatttgctgatgctttggatgctattccactggctttagctgaaaacagtggtttgccacctattgatactctgacagtggtaaaatcccaacatgtcaaggagaacaattcccgctgcggcattgactgcaacgatgtgggtaccaatgacatgaaagagcagaatgtttttgaaactctgattggcaagcagcagcagatcttgctggcaacccaggtcgtcaagatgatcctcaagatcgatgatgttatcacgccttccgaatattgacgatgcctgcagagcatgaatcgactgtgctaggtgacatacgctccagtaggcagctgcatgggttgatttggatttgctcctagaattctgacactgagtggtcgctttgttttgtttgacgagctatatggttttgtgcgctcgcttgatcattataacattggtgttcacactctgtacaataggacaaatcctgtcgataccagtttagtcctttgttgtattgtttgggatgcttaatgctattgtctggatcattattttgtctgctttgaagtaagtgttaca

SEQ ID NO: 1803 - DNA, 2099 bp, Avena sativa
atcacaaaccctcgaccccccgcggcgtctcctccagaaccacagcgccgcctcactctcccccctcagatcagctccccgcgcgatccgccctcacaggagtttcttcaggggggagcagcgccagcgcttcggcggccatggcgctcgctttcgacgagtacgggcggcccttcatcatcctcagagagcaggagaagaagtcgcggctgcagggtctcgacgcgcacaaggccaacatcgccgccgccaaggccatcgcgcgcatcctccgcacgtcccttgggcccaagggcatggacaagatgctccagtcccccgacggcgacgttaccatcactaatgatggggcgaccatcctggagctaatggacgttgacaaccagattgcaaagctgttggtggagttgtcacgcagtcaagactatgacattggagatggtaccaccggagtggtggtcatggctggggctctcctagagcaggctgagaagctactggaacgtggtatacacccaataagggttgctgaaggttatgagatggcgtcaaggatagctgttgatcaccttgaaagcatctccacgaaatatgagttcagtgccacagacattgagcctttggtgcagacctgcatgacaactttgtcctcaaagattgttagccgttgtaagcgggccctagctgagatttctgtcaaagcagtccttgcggttgctgatttggaaaggaaggatgtaaatctggacttgattaaggtggaaggcaaggttggtgggaagctagaggataccgagctagtgcaaggaatcattgttgacaaagatatgagccacccccaaatgccaaagagaatcgaggatgctcacattgccattctgacctgcccatttgagcccccgaagcccaagaccaagcataaggttgacattgacactgtagagaaattccagacactgcgtgggcaagagcagaaatacttcgatgagatggttcagaaatgcaaggatgttggcgcaaccctagttatttgtcaatgggggtttgatgatgaagccaatcatttactaatgcaaagagaacttcctgctgtcagatgggttggtggtgttgaattagaattaattgccattgctacaggtgggaggattgttccgagattccaagagttgagtactgaaaagcttgggaaggctggattagtcagagagaagtcatttggaacaacaaaagatcggatgctttacatcgaaaagtgtgccaattccaaagctgtaactatttttatccgtggaggtaacaaaatgatgattgaggaaactaggcgaagtattcatgatgctctttgtgttgcaaggaatctcatcatcaacaactcaattgtgtatggtggtggttcagcagagatatcttgctcgattgctgttgaagctgctgcagatcggcatcctggagttgagcagtatgcaatcagggcatttgctgatgctttagatgccattccactggctttagctgaaaacagtggtttgccacctattgatactctgacagtggtaaaatcccaacatgtcaaggagaacaattcccgctgcggcattgattgcaatgatgtgggtaccaatgacatgaaagagcagaatgtttttgaaactctgattggcaagcagcagcagatcttgctggcaacccaggtcgtcaagatgatcctcaagatcgatgatgttatcacgccttctgaatattgacgatgcctgcagagaacatgaatcgactgtgctatgtgacatacgctccagtaggcagctgcatgggttgatttggatttgctcctagaattccgtcaccgagtggtcgctttgttttgtttgacgagctatatggttttgtgcgcttgctcgatcattataactttggtgttcacactctgtacaatagaacaaatcctgtcgataccagtttagtccgttgttgtattgtttgggatgcttaatgctattgtttggatcattattttgtctgctttgaagtaagtgttacttatttttatattctatgcttggctgaagtataccttagttgacgttggtgtgtattgc

SEQ ID NO: 1804 - DNA, 1930 bp, Allium cepa
tagttacgggggagtgtcatttgaaaactaaatattaatgttcattagattgctcttttaaagctaccaaacttagaactaaacagaacccgaatccacttctccgcgccagacttgaaccctaaccttttctcaccgacctcacgctccattttccttctttcacacttaaacttctcctccgccgccattacggctgctttatttcgtccgctttgatggcgttagcattcgacgagtacggacggcctttcctaatagtgaaagagcaagatcagaagacgaggcttcgaggtctcgaagctcagaaatccaacataagtgctggagtggcagttgcgaggatcttgaggacttctctagggccgaaggggatggataagatgctccagagccctgatggcgatgttgttattacaaatgacggggcaacaatcttggaacaaatggatgtcgacaatcaaattgcaaaattaatggttgagctgtcacgaagccaggattacgagattggtgatggtacaactggtgtggttgttttggctggttctcttttagaacaggctgagaagcttttagaacgtggtattcatcctataagaattgcagaaggatatgagacagcatctcgaataaccgttgaccatcttgagcagatttctcaaaagtttgtgtttagtattaatgatattgagcccctggtgcaaacttgcatgactactttgtcatcaaagattgttaatcgctgcaaacgcactctagcagagattgctgtaaaagcagttctggctgttgcagatttagagaggaaagacgtcaatttggatctgattaaggtagaagggaaagtaggaggaaatttagaggacacagaactcatttacggaattattgtagacaaggatatgagccatccacaaatgccgaagcatatcgaagatgcaaaaattgctattttgacttgcccattcgagccacccaaacccaagacaaaacataaggttgacattgacactgtagagaagttccaaactctgcgtcagcaggaacataagtatttcgatgacatggttcaaaaatgcaaggatgttggtgctactttagttatctgtcagtggggttttgacgacgaagccaatcacttattgatgcatcgaaatttgcctgctgttagatgggttggtggcgttgaattggagttgattgccattgctacaggcggacgaattgttccaaggtttcaagaattaacacccgagaaacttgggaaagctggtctagttagggaaaaagcatttgggaccacaaaagaccggatgctttatatcgagcagtgtgcgaattctagggcggtgacaatatttattcgtggtggcaacaaaatgatgatagaagaaacaaaaagaagcgtacatgacgcactatgtgtggcaagaaatttaatccgcaataactcaatagtttatggcggcggctcagttgagatctcatgctctattgctatcgaagctgctgcagataagcatcctggagttgagcagtatgctattaggtcattcgctgaagcattagatgccgttccaacagctcttgcagaaaacagcggtttacagcctattgacactcttacagttgtcaaagcccagcaaatcaaggaaaataattcgttcttgggcatagactgtaacgatgttgggactaacaacatgcaagagcaaaatgtattcgaaacgttgatcggaaagcaacagcaaattatgctggcaacgcaggttgtcaaaatgattttgaagatcgatgatgttatcacaccaactgagtactaaatttgattttaactatgcaagattttgttattctgtataatttattactgtcttgatttgtatgctacggaaattttgtaacatttgacattgaattcctgggg

SEQ ID NO: 1805 - DNA, 1983 bp, Allium cepa
gaatccactttctccgcgccagacttgaaccctaaccttttctcactgacctcacgctccattttccttctttcactcttaaacttctcctccgccgccattacggctgctttatttcgtccgatttgatggcgttagcattcgacgagtacggacggcctttcctaatagtgaaagagcaagatcagaagacgaggcttcgaggtctcgaagctcagaaatccaacataagtgctggagtggcagttgcgaggatcttgaggacttctctagggccgaaggggatggataagatgctccagagccctgatggcgatgttgttattacaaatgacggggcaacaatcttggaacaaatggatgtcgacaatcaaattgcaaaattaatggttgagctgtcacgaagccaggattacgagattggtgatggtacaactggtgtggttgttttggctggttctcttttagaacaggctgagaagcttttagaacgtggtattcatcctataagaattgcagaaggatatgagacagcatctcgaataaccgttgaccatcttgagcagatttctcaaaagtttgtgtttagtattaatgatattgagcccctggtgcaaacttgcatgactactttgtcatcaaagattgttaatcgctgcaaacgcactctagcagagattgctgtaaaagcagttctggctgttgcagatttagagaggaaagacgtcaatttggatctgattaaggtagaagggaaagtaggaggaaatttagaggacacagaactcatttacggaattattgtagacaaggatatgagccatccacaaatgccgaagcatatcgaagatgcaaaaattgctattttgacttgcccattcgagccacccaaacccaagacaaaacataaggttgacattgacactgtagagaagttccaaactctgcgtcagcaggaacataagtatttcgatgacatggttcaaaaatgcaaggatgttggtgctactttagttatctgtcagtggggttttgacgacgaagccaatcacttattgatgcatcgaaatttgcctgctgttagatgggttggtggcgttgaattggagttgattgccattgctacaggcggacgaattgttccaaggtttcaagaattaacacccgagaaacttgggaaagctggtctagttagggaaaaagcatttgggaccacaaaagaccggatgctttatatcgagcagtgtgcgaattctagggcggtgacaatatttattcgtggtggcaacaaaatgatgatagaagaaacaaaaagaagcgtacatgatgcactatgcgtggcaaggaatttgatccgcaataactcaatagtttatggtggtggctcggctgagatctcatgctcaattgctgttgaagctgctgcagataagcatcctggagttgagcagtatgctattaggtctttcgctgaagcattagatgctgttccaacagcacttgcagaaaacagtggtttacagcctattgacactcttaccgctgtcaaagcccagcaaatcaaggaaagcaattcattcttgggcatagactgtaactatgttgggaccaacaatatgcgacagcaagatgttttcgaaacgttgatcggaaagcaacagcaaattatgctggcaacgcaggttgtgaaaatgatattgaagatcgatgatgttatcaccccaactgagtactaacttcattccaaactttgcaagattttgtttgctttgtataatttatgacttttgaattgaatgctgcaaaatttttgtaatatttaacactgaatttgtggggaaatggtgtttggttcttccagtacttttcatgattttctgatgtgtttgcagatagaaatttggagtgtaatatgccgtcctctgcatgtggattatcctttcaacgtatagctacctagtttgattatcgaaaaacacacac

SEQ ID NO: 1806 - DNA, 2022 bp, Allium cepa
tagttacggggggcccgacccaaatgtttaatttaccaccaaaagcccaagcacaacgacaaccagcgttctcgtctagaacaaacccgaaccctaattctctctctaaactcttcactgcattcataattcgcactactttatatttctcatctataacgattttgccatcagccgccattactgttgagtccctacattagcatcaatggcgttagcgttcgatgaatatggccgaccgtcctattatgaaagagcaagatcagaaaaccaggcttcgtggtctcgaagctcagaaatcaaatattagtgccggagtggcagttgcgaggatcctaaggacgtcgcttgggccaaaaggaatggacaagatgcttcagagccctgatggggatgttgttattacgaatgacggggcaacgattttggaacagatggatgtagacaatcaaattgcaaaattgatggtcgagttgtcacgaagtcaggactatgagattggtgatggtacaactggtgtggttgtattggctggttcccttctagagcaagctgaaaagcttctagaacgtggtattcatcctattcgaattgcagaaggatacgagacagcttcgagaatagctgttgatcatcttgaacacatttctcaaaaatttgagtttagcattagtgatattgagccactggtgcaaacctgcatgaccactttgtcatcaaagattgttaatcgatgcaagcgcactctagcagaaattgctgtaaaagcagttcttgctgttgcagatttagataggaaagatgtcaatttggaccttattaaggtagaagggaaagtagggggaaagttggaggacacagaacttatttatggaataattattgacaaagatatgagccatccacaaatgccaaaacatattgaagatgcaaaaattgccatcctaacttgcccatttgagccacccaagcccaagacaaagcataaggttgacattgacaccgtggagaagtttcaaactttgcgtaagcaggagcaacaatattttgatgacatggttcaaaaatgcaaggatgttggggcaactctagttatttgtcagtggggctttgatgatgaagccaatcacttgttaatgcatagaaatttgcctgctgttagatgggttggtggcgttgaattggaactaattgcaattgctacaggtggacgaattgttccaagatttcaagaactaacacctgaaaaacttggaaaggctggtctagtaagagaaaaagcatttgggacaaccaaagataggatgctttatatagagcaatgtgcaaattcaagggcagtgacaatatttattcgtggtggaaataaaatggtgatcgaggaaactaaacgtagtgtacatgatgcactatgtgtggcaaggaatttgatccgcaacaattctattgtttacggtggtggttcagctgagatttcatgctcaattgctgttgaagctgctgcagataaaaatcctggagttgagcaatatgctattaggtcctttgctgatgcattagatgctgttccaatggctttggctgaaaacagtggcctccaacctattgacactcttaccgcagtcaaagcacaacaaatcaaggaaaataatgcttaccttggaatagattgcaatgatgtaggaacaaacaacatgcaggagcagaatgttttcgaaacgctcatcggaaagcagcagcaaattctgctggcaacacaagttgttaagatgatattgaagattgatgatgtcattactccaaacgattactgattttgaagtttctgtgcttatgtttttctgttcctgctagtcactgttttgtttcctctgttagcaagtatctgtaatatttgttttcactttgaagcactggagtgttattagttgaccagaaatgtttcctgatttttagttaatttaattatcttttggtggtgtttgaggtttggcaatcatggaatttaataacttatatcta

SEQ ID NO: 1807 - DNA, 1589 bp, Chrysanthemum coronarium
aaaaaagaacccgtttcatagatggcgttagcgtttgatgagtacggtcggccgtttataatcttgcgagaacaagagagcaaaagcaggttgagagggatagacgcccagaaagcgaatatagcggcgggggttgctgtgtcgaggatattgaggacttctcttggtcctaaaggcatggataagatgcttcagagccctgatggtgacatcactattacaaatgatggtgcaacaatcctggagcaaatggacgttgacaaccaaattggaaagcttatggttgaactatcacgaagccaagactacgagatcggtgatggaactactggtgtggttgttatggctggtgcacttttggaacaagctgagaaactcttggaacgtggaattcatcctatccgagttgcagagggtttcgaaatatcttcaaggattgctgttgatcatctagaatcaatagcagataagtttgatttcagcgccacaaatattgagcctttggttcaaacttgctcgactaccttgaactctaaaatcgtgaaccgatgcaagcgtagtttggctgagattgccgttaaggcagttatggcggttgctgatttagagaggagagatgtaaacttagaccttattaaagtcgaggggaaagttggtgggaaattggaggataccgaacttatctatggaatccttgttgacaaagatatgagtcacccacaaatgccaaagcaaattcaagatgcacatatcgcgatcttgacttgtccatttgagcccccaaagcctaagaccaagcataaggttgacatcgatactgttgagaagttccagactctacgtaagcaagagcagcagtactttgatgaaatggttcagaagtgcaaggacgtaggggcaacattggtaatctgccaatggggatttgacgatgaagcaaatcacttactgatgcacagaaacttgcctgctgtcagatgggttggtggtgtagaactggagcttattgctatcgcaactggtggtagaattgttcccaggttccaggaactaacacccgaaaagctaggaaaggctggtttggttagagagaaggcatttggtaccacaaaagaccggatgctatatatcgagcattgtgcaaactcaagggctgtaaccatatttattcgtgggggtaacaagatgatgattgaagagactaaacgtagcatccacgatgcattgtgtgttgctagaaatctcatccgcaataactctatcgtgtatggtggtggtgcagctgaaatttcatgctccattgcagtagaagccgctgctgataaatatcctggagttgaacagtatgccatcagggcttttgccgatgctttggatgctgtacccatggctcttgcggagaatagtggtctgtcacctattgaaacactatctgcagtgaaagcacaacaaattaaggacaacaatcattgctgtggcatagactgcaacgacactggtaccaacgatatgcgtgagcaaaatgtattcgagaccttaatcggaaagcaacagcagatcttacttgccacacaagtcgtgaagatgat

SEQ ID NO: 1808 - DNA, 1947 bp, Centaurea maculosa
ggtttttgggcataaaacccattcgatctctctctcaccttcttccatttccatcaccatcgtcgtcactctctgtgtcgatctcgccgtcatcttccacctttatatgtcgatctaagacctaaatcaagcttttagatcagcaacaatggcgttggcgttcgatgaatacgggcggccgttcataatcttaagggaacaggaaagtaaaagtaggttaagaggtttagatgctcagaaggccaacatctccgccggcgtggccgtcgctcgcatcctgaggacctctcttggtcctaaaggcatggacaagatgctccagagccccgacggcgatatcaccataacaaatgatggtgcaacaatcttggagcagatggacgttgacaatcaaattggtaaattgatggtggagctttcaaggagtcaggactatgagattggtgatggaacaacaggagtcgttgttatggctggtgcgctgctagaacaggctgagcggttattggaacgtggtattcatccaatccgtgttgcagagggctatgagatagcttcaaagattgctgttgatcatttgcaacaaatagctcacaagtttgagttcactgctacacatatagaacctctggttcaaacttgcatgactaccttatcctctaagattgtgaatcgttgcaagcgcagtttggccgagattgctgtgaaggcagtcatggcagttgcagatttggagaggaaggatgtaaacctagacctcattaaagtggagggtaaagtaggtgggaaattggaggataccgagcttatttatgggattcttgttgacaaagatatgagtcacccacagatgccaaagcaaatcgaggatgcgaaaattgccattttgacttgcccctttgagccgccaaagccaaagaccaagcataaggttgacattgatacagttgagaagttccaaacattgcgccaacaagagcagaagtactttgatgacatggttcagcaatgcaaggatgttggagctacactggtgatttgtcaatgggggtttgatgatgaagcaaatcacttgttgatgcacaggaatttacctgctgtcagatgggttggtggtgttgaattagagcttatagcaatagccactggtggaagaattgttcccaggttccaggaactaacccctgaaaagctaggcaaggctggcttggttagagagaaggcatttggtaccactaaagatcggatgctatatattgagcattgtgcaaattcaagagctgtaactattttcattcgtgggggtaacaagatgatgattgaggagaccaagcgcagcctccatgatgcattatgtgttgcaagaaatctcatccgcaataacaacatcgtctatggtggcggtgcagcggaaatttcatgctcggttgccgttgaagcagccgctgataaatacccaggagtcgagcagtatgccgtcagggcttttgctgatgcgttggattctgttcccatggctcttgccgaaaatagtggcctacagcccattgaaacactatctgcagtgaaatctcaacaaataaaggacaacaaccctttttgtggcatagactgcaatgatgctggcacaaacgacatgcgtgacaaaacgtattcgagacgcttatcggaaagcaacagcagctgttgcttgccacacaagtcgtcaagatgatcttgaagatcgatgatgtcatctctccaaccgagtattaagtttcaactttcaggtacttgacttccaagtttctttttgtgttgaaaaacatttttgtagtgtgttttctgctttaaatatttccgtgtttggattattattattattattcgagtaagattgtcgaaaagcgctaatttttgtgttgtgctagcccttgaaaccatttaacagcagaaatattatttgtg

SEQ ID NO: 1809 - DNA, 2077 bp, Physcomitrella patens
gaaagcttctcgctgctctcctgggcatttgcctctttctgctgtcgcgagcttacgatttgcgcaacccctggcttcagggttttgctctgctgattgtgaccatggctctcgccttcgatgagtatggccgtcccttcattatcattcgcgatcaggagaccaagtctcgcgttcgcgggctcgacgctcagaaagccaatattatggctgccaaggctgtagcgcgcgtcctccgcacttcccttggccctaatggcatggacaaaatgctccagagccctgatggagacgtcactatcacgaacgatggtgcaaccattctggagcaaatggaaatcgagaatcaaattggaaagctgatggtggagctttctagaagccaagactacgagatcggcgacggtactactggcgttgttgtccttgcgggtgctctactggaacaagcagaagttttgttggaaagagggattcaccccatccgtgtcgcagagggatatgaaatggcgtcgaagctggcagtggaaaaccttactcgcattggacaaacttttgaatttagtcccgacaacattgaacctcttgtgcaaacatgcatgaccacgttgtcttctaaaatagttggccgttgcaagcgacaattagcagaaattgcagtgaaggctgtcctcgcagtagctgaccttgagaggtcagatgtcaatcttgatcttatcaaagtggaaggaaaggtaggcggaaagctagaagacaccgaacttgtatatggaatagttgttgataaggatatgagtcatcctcaaatgccgaaggagattagagatgcaaaaattgccattctaacttgtccattcgagccccctaagcctaagaccaagcataaagtggatatcgattcggtggagaaatttgaggccttgcaggcggctgagaagtcatacttcaatgagatggttcagcaatgcaaggatgctggtgcaaccctagttatttgtcaatggggttttgatgatgaagccaatcatttgttaatgcatgaaaatttgccagcagtacgctgggttggaggagttgagctggagcttattgctattgctacaggtggccggattgttccaaggttcaaagaacttacgcctgagaagcttggtaaggctggtctcgtgagagagaagggttttggaaccactaaagatcggatgctctacattgagcagtgcgcaaattccagagctgtcactatctttatacgtggtggtaacaagatgatgattgaggaaaccaaaaggagcttgcatgatgccttgtgtgtggctcgtaacctgattcgggacaaggccatagtatatggtggcggtgctgctgaaatctcatgctctcttgccgtggaggctgctgctgataagatatccggtgttgagcagtatgctatgcgagcctttgcagatgcgctagatatggtccctatggctctggcagagaacagtggcttgcagcctatcaatacattaactgctgtgaaagctcagcaagtgaaggagcagaaccctcatctgggaatcgattgcaacgacgttggaacgaatgatatgcgcgagcaaaatgttttcgagactctgattgggaagaagcaacaagtcttattggcaactcaggtggtgaagatgatactgaaaatagatgacgtgattagtccttcatcatattaatttcttcatggttccgctcaggcttgttttgacgaaatttctaatcaagttttctaggattctcttcgtcttttcaaagacggctgcacacttcctacgagatttactgaacagagaacatggacaattaacaagctcggagttgctattgggtattcttctgtgaaactggaggggtgcttctagcaagaatttctctacttgtgttaattccttggaatctaggatctttacttgagtttctggcctaatcttgcttaaacttcaattctataatatggttgtggaggcttttaagtacagtggcttcgtacgagctacttgttttgttgagcggattggatctattaatgatattcttctta

SEQ ID NO: 1810 - DNA, 1867 bp, Chrysanthemum coronarium
catttcatcgatctgacaaaaagatggcgttagctttcgatgagtacggtcggccgtttataatcctgcgagaacaagagagcaaaagcaggttgagaggaatagatgcgcagaaagcgaatatagcggcgggtgtggctgtgtcgaggatattgaggacttctcttggtcctaaaggcatggataagatgcttcagagccctgatggtgacattactattacaaatgatggtgcaacaatcttggagcagatggatgttgacaaccaaattggaaagcttatggttgaactatcacgaagccaagactacgagatcggtgatggaactactggtgtggttgttatggctggtgcacttttggaacaagctgagaaactcttggaacgtggaattcatcctatccgtgttgcagagggtttcgaaatatcttcaaggattgctgttgatcatctagaatcaatagcagataagtttgatttcagcgccacaaatattgagcctttggttcaaacttgctcgactaccttgaactctaaaattgtgaaccgatgcaagcgtagcttggctgagattgctgtaaaggcagtcatggctgttgctgatttagagaggagagatgtcaacttagacctcattaaagtcgaggggaaggttggtgggaaattggaggacaccgaacttatctatggaatccttgttgacaaagatatgagtcacccacaaatgccaaagcaaattcaagatgcacatatcgcgatcttgacttgcccatttgagcccccaaagcctaagaccaagcataaggttgacatcgatactgttgagaagttccagactttacgtaagcaagaacagcagtactttgatgaaatggttcagaagtgcaaggacgtaggggcaacattggtaatctgccaatggggatttgacgatgaagcaaatcacttactgatgcacagaaacttgcctgctgtcagatgggtcggtggtgtagaactggagcttattgctatcgcaactggtggtagaattgttcccaggttccaggaactaacacccgaaaagctaggaaaggctggtttggttagagagaaggcatttggtaccacaaaagaccggatgctatatatcgagcattgtgcaaactcaagggctgtaaccatatttattcgtgggggtaacaagatgatgattgaagagactaaacgtagcatccacgatgcattgtgtgttgctagaaatctcatccgcaataactctatcgtgtatggtggtggtgcagctgaaatttcatgctccattgcagtagaagccgctgctgataaatatcctggagttgaacagtatgccatcagggcttttgccgatgctttagatgctgtacccatggctcttgcagagaatagtggtctgtcacctattgaaacactatctgcagtgaaagcacaacaaattaaggacaacaatcattgctgtggcatagactgcaacgacactggtaccaacgatatgcgtgagcaaaatgtatttgagaccttaatcggaaagcaacagcagatcttacttgccacacaagtcgtgaagatgatcttgaagatcgatgacgtcatcctccccatccgagtattgatattgaggtacctacctacaagttttggtctatgtagaacattgcaaccaattgaatcgctggaaaatctttttcatgcatttaagctggtggtttagtattgttttgtactttggtcgggtgtgtttctgtcgattgttttctgctcgtggctagtgtttgtgttggtattttattttgagacaagaatgttctgctgtttacgcaaacaagtttttaggatttttctccatgc

SEQ ID NO: 1811 - DNA, 2324 bp, Ananas comosus
ccagttttacgtcaaatcaaacagcccctaaactaacaaaaatgattctagtcttaaaaattagtagttcagggcggtgccaaacccagtaaaagaaaaattagctgaggggcttatttcaaaatggccaattgttggggagttgcattacatttttaccttcattttaaggcatgatgtgtggatgtggaaggactaaaggactagaaacggagagatgggtgtgttggggatttgaagtaatcggctcgtctagcttgttgtggttagcattgtcttgtttacttggaatgtaagtggatctggtttgagtcagtttaggtgtaggaggaatcggatggggtgctaaagatttgatttttctatgccttaggaatgaatgataatacacttcattgctaatctgtagcgttttctttctcttttaacctctgggacgtatgagtaatatctatttccatcagattggattaactatgttgatatcgtgtagtatctcagttaattgttcgtaacaattatgcatatataaaactgtttcagtattgttcttcaaatctactaagttatttcgtagattggattcttactgttgctcattagacccattcgttgtgagataacagcttgaagcaaatcctgttcgaattttatgacgtgcaattcgctgatctttgtgtcttgcatcaatagcaaatgatggggcaacaatcttggagcaaatggatgtcgacaatcagattgcaaagctgatggtggaattatctcgtagtcaggactatgaaattggtgatggtacaactggagttgttgttatggctggtgctcttttagaacaggccgaaaagctactcgaacgtggcatccatcctattaggattgctgagggttatgagatggcctccaggattgcttttgagcatcttgagcgtatctctcaaaagtttgaattcagtgcgactgatatagagcctttggttcagacgtgcatgacaactttgtcctcgaaaattgttaaccgctgtaagtgtatgttagctgagatcgctgttaaggcagttctagcagttgctgatttagacaggaaagatgtgaacttagacttaattaaagttgaaggaaaggttggagggaagctggaagacactgagctcatctatggtattgttgttgacaaggacatgagccatccgcagatgccaaaaagaattgaaaatgcgaagattgctattttgacttgcccatttgagccaccgaagccgaagactaagcataaggttgacattgacactgtagagaagtttcaaactttgcgtcagcaagaacagcagtactttgatgatatggttcagaaatgcaaggatgttggcgcaactctagttatttgtcaatggggctttgacgatgaagcaaatcatctgttaatgcataggaatctgccagctgtcagatgggttggcggtgttgaactggaattgattgcaatagctacaggtggaagaatagttcccagattccaagagttgacaccagaaaagttggggaaggccggattggtgagagagaagtctttcggaacaacaaaagatcgtatgctgtacattgaacagtgtgcaaattccagggctgtaaccattttcattcgtggtggcaacaagatgatgattgaggagacaaaacgtagtcttcatgatgcactttgcgttgcaaggaatcttattcgtaacaattccatagtttatggtggtggctcagctgagatctcttgctctattgctgttgatgctgctgcagatcgatatcctggagttgagcagtatgctatcaggtcatttgctgaagctttagattcaataccattggctctagcggagaacagtggcctgcaacctattaatactctgactgcagtcaaatctcagcaagtcaaggaaaacaatccgttctgtggcatcgattgcaacgatgtcgggacaaatgacatgaaagagcagaatgtattcgagactttgatcggaaaacagcagcaaatcttgttggcaacacaggtggtgaaaatgatccttaagattgacgatgtgatcgcaccatccgattattgatgttgtttgagagagaagcatttgccaagttttgcgttctggacagtttaactatcgtccgaaactgaaactggtctaaaaggccaagtcgttatgtggtgtttggaaatgtttgttgagcctgataactgtgctttaagatctgatttacatctcgctgtgactgcttatattgtgccttgttaatgtattggagagtgaagaacttttggacaaactgac

SEQ ID NO: 1812 - DNA, 1506 bp, Avena sativa
aaggctatcgcgcgcatcctccgcacgtcccttgggcccaagggcatggacaagatgctccagtcccccgacggcgacgttaccatcactaatgacggggcgaccatcctggagctaatggacgttgacaaccagattgcaaagctgttggtggagttgtcacgcagtcaagactatgacattggagatggtaccactggagtggtggtcatggctggggctctcctagagcaggctgagaagctactggaacgtggtattcacccaataagggttgctgaaggttatgagatggcgtcaaggatagctgttgatcaccttgaaagcatctccacgaaatatgagttcagtgccacagacattgagcctttggtgcagacctgcatgacaactttgtcctcaaagattgttagccgttgtaagcgggccctagctgagattgctgtcaaagcagtccttgccgttgctgatttggaaaggaaggatgtaaatctggacttgattaaggtggaaggcaaggttggtgggaagctagaggataccgagctagtgcaaggaatcattgttgacaaagatatgagccacccccaaatgccaaagagaatcgaggatgctcacattgccattctgacctgcccatttgagcccccgaagcccaagaccaagcataaggttgacattgacactgtagagaaattccagacactgcgtgggcaagagcagaaatacttcgatgagatggttcagaaatgcaaggatgttggcgcaaccctagttatttgtcaatggggttttgatgatgaagccaatcatttactaatgcaaagagaacttcctgctgtcagatgggttggtggtgttgaattagaattaattgccattgctacaggtgggaggattgttccgagattccaagagttgagtactgaaaagcttgggaaggctggattagtcagagagaagtcatttggaacaacaaaagatcggatgctatacatcgagaagtgtgccaattccaaagctgtaactattttcatccgtggtggcaacaaaatgatgattgaggagaccaagcgaagtattcatgatgctctatgtgttgcaaggaatctgatcatcaacaactcaattgtgtatggtggtggctcagcagaaatatcttgctcaattgctgttgatgctgcagcagatcggcatccaggagttgaacagtatgcaatcagagcatttgctgatgctttggatgccattccactagctttagctgaaaacagtggtttgccgcctattgatacactgaccgtggtaaaatcccaacatgtcaaggagagcaattcccgctgtggcatcgactgcaatgatgttggtaccaatgacatgaaagagcagaatgtttttgagactctgatcggcaagcagcagcagatcttgctagcaacgcaggtggttaagatgatcctcaagatcgatgatgttataacgccatcggaatattgatgacgcctg

SEQ ID NO: 1813 - DNA, 1570 bp, Cichorium intybus
caagatgctccagagccccgacggcgacatcaccatcacaaatgatggtgcaacaatcttggagcaaatggatgttgacaatcaaattggtaaactgatggttgaactttcaaggagtcaagactatgagattggtgatggaacaacaggagttgtagtcatggctggggcacttctagaaaaagctgaacgactcttagaacgcggtattcatccaattcgcgttgcagaaggctatgaaatcgcctcaaagattgctgttgatcatttacaacaaatctcacacaagtttgaattcaatgcttcaaatatagaacctctagtccaaacttgcatgactaccttatcctctaaaattgtgaaccgttgtaagagaagtttggctgagattgctgtgaaggcagtaatggcggttgctgatttagagagaaaggatgttaatttggatcttattaaagtggagggaaaagtaggtgggaaattggaggatactgagcttatttatgggattcttgttgataaagatatgagtcacccacaaatgccaaagcaaattgaggatgctaaaattgctattttgacttgcccctttgagccaccaaagcctaagaccaaacataaggttgatattgatacggttgaaaagtttcaaactttacgtgaacaagaaaagaaatactttgatgacatggttcaacaatgcaaggatgttggggctacattggtaatttgccaatggggttttgatgatgaagcaaatcacttgttaatgcatagaaacttgcctgctgtgaaatgggttggtggtgttgaattagagcttatagccatagccactggtggaagaattgtcccaaggtttcaggaactaacagctgacaaactaggcaaggctggtttggttagagagaaagcatttggtaccacaaaagatcggatgttatacattgaacattgtgcaaattcaagggctgtaaccgtatttattcgtggaggtaacaaaatgatgatagaggagaccaaacgcagcatccatgatgcattatgtgttgcaagaaatctcatccgcaataattcaattgtatacggtggtggcgcagctgaaatttcatgctcaattgcagttgaagcagctgcggataaatatcctggagttgaacagtatgctgttagggcttttgcagacgcgttagattctgtccccatggctcttgctgaaaacagcggtcttcaacccattgaaacactatctgcggtcaaatctcaacaaataaaggagaataatgcgtgctgtgggattgattgtaatgatgctggcacaaacgacatgcgtgagcaaaatgtatttgaaaccctgattggcaagcaacaacagctgttgcttgcaacgcaagtcgtgaagatgattttgaaaattgatgacgtcatctccccatctgagtattgattgattttcatgtacttgaagttttgctctatgtgctaacagtttcatgtcgttttgtttacttgagatgtttgttaggggttttttagtgtgttttctggttagattttttatgaatttctt

SEQ ID NO: 1814 - DNA, 2774 bp, Ananas comosus
ccagttttacgtcaaatcaaacagcccctaaactaacaaaaatgattctagtcttaaaaattagtagttcaggggggtgccaaacccactaaaagaaaaattagctgaggggcttatttcaaaatggccaattgttggggagttgcattatatttttaccttctttttaaggcatgatgtgtggatgtggaaggactagaaacggagagatgggtgtgttggggatttgaagtaatcggctcatctaacttgttgtggttagcattgtcttgtttacttggaatgtaagtggatctagtttgagtcagtttaggtgtaggaggaatcgggtgggatgctaaagatttgatttttctaggccttaggaatgaatgataatacacttcattgctaatctgtagcgttttctttctcttttaacctctgggacgtatgagtaatatctatttccatcagattggattaactatgttgatatcgtgtagtatctcagttaattgttcgtaacaattatgcatatataaaactgtttcagtattgttcttcaaatctactaagttatttcgtagattggattcttactgttgctcattagatccattcattgtgagataatagcttgaagcaaatcctgttcgaattttatattgtgcaattcgctgatcttcttgcatcaatagcaaatgatggggcaacaatcttggagcaaatggatgtcgacaatcagattgcaaagctgatggtggaattatctcgtagtcaggactatgaaattggtgatggtacaactggagttgttgttatggctggtgctcttttagaacaggccgaaaagctactcgaacgtggcatccatcctattaggattgctgagggttatgagatggcctccaggattgcttttgagcatcttgagcgtatctctcaaaagtttgaattcagtgcgactgatatagagcctttggttcagacgtgcatgacaactttgtcctcgaaaattgttaaccgctgtaagcgtatgttagctgagattgctgttaaggcagttctagcagttgctgatttagacaggaaagatgtgaacttggacttaattaaagttgaaggaaaggttggagggaagctggaagacactgagctcatctatggtattgttgttgacaaggacatgagccatccgcagatgccaaaaagaattgaaaatgcgaagattgctattttgacttgcccatttgagccaccgaagccgaagactaagcataaggttgacattgacactgtagagaagtttcaaactttgcgtcagcaagaacagcagtactttgatgatatggttcagaaatgcaaggatgttggcgcaactctagttatttgtcaatggggcttcgacgatgaagcaaatcatctgttaatgcataggaatctgccagctgtcagatgggttggcggtgttgaactggaattgattgcaatagctacaggtggaagaatagttcccagattccaagagttgacaccagaaaagttggggaaggccggattggtgagagagaagtctttcggaacaacaaaagatcgtatgctgtacattgaacagtgtgcaaattccagggctgtaaccattttcattcgtggtggcaacaagatgatgattgaggagacaaaacgtagtcttcacgatgctctttgcgttgcaaggaatctgattcgtaacaattccatagtttatggtggtggctcagctgagatctcttgctctattgctgttgatgctgctgcagatcgatatcctggagttgagcagtatgctatcaggtcatttgctgaagctttagattcaataccattggctctagcggagaacagtggcctgcaacctattaatactctgactgcagtcaaatctcagcaagtcaaggaaaacaatccgttctgtggcatcgattgcaacgatgtcgggacaaatgacatgaaagatcagaatgtatttgagactttgatcggaaaacagcagcaaatcttgctggcaacacaggtggtgaaaatgatccttaagattgatgatgtgatcgcaccatccgattattgatgttgcttgagaagcatttgcgaagttttgcgttctggacagtttaactacagtccgaaactgaaactggtctaaaaggcggagtcattatgcggtgtttggaaatgttgttgagcctcataactgtgctttaagatctgatttacatctcgctgtgactgcttatattgtgccttgttaatgtattggagagtgaagaacttttggacaaactgacaacgaggatagcagtaaatgtttttgtcgattattttatttatcaacgacagtgaagatttgaggtatttctttgaagaattttcttttctgataaattcttatgtcgcttagggttctgttctgaagctttattatcataaatataatagcattgaaaagtagcgtaaacagtgtagcagtgcttctgtcattaggggatgattgcttctgtcatttgtcttatggctgagtggctgtcatgcaggcgaacgaggaagaaggaagaagtcctctctttgaactgatattccttttgctacctgcatgtactatggtgattgtgatttcagggtgtgatgtgaaggagtatagtttgattcttgtattatgagtctagagcatgttgggtgtttgttcatattgttagatggaatatctgttacacagaattttcttaggggaagagggaaattatggtagagagaga

SEQ ID NO: 1815 - DNA, 2344 bp, Chrysanthemum coronarium
aaaacatttcatcgatctgacacaaagatggcgttagccttcgatgaatacggtcggccgtttattatcctgcgagaacaagagagcaagagcaggttgagagggatagacgcccagaaagcgaatatagcggcgggggttgctgtgtcgaggatattgaggacttctcttggtcctaaaggcatggataagatgcttcagagccctgatggtgacatcactattacaaatgatggtgcaacaatcttggaacagatggacgttgacaaccaaattggaaagcttatggttgaactatcacgaagccaagactacgagatcggtgatggaactactggtgtggttgttatggctggtgcacttttggaacaagctgagaaactattggaacgtggaattcatcctatccgtgttgcagagggtttcgaaatatcttcaaggattgctgttgatcatctagaatcaatagcagataagtttgatttcagcgccacaaatattgagcctttggttcaaacttgctcgactaccttgaactctaaaattgtgaaccgatgcaagcgtagcttggctgagattgctgtaaaggcagtcatggctgttgctgatttagagaggagagatgtcaacttagacctcattaaagttgaggggaaggttggtgggaaattggaggacaccgaacttatctatggaatccttgttgacaaagatatgagtcacccacaaatgccaaagcaaattcaagatgcacatatcgcgatcttgacttgcccatttgagcccccaaagcctaagaccaagcataaggttgacatcgatactgttgagaagttccagactttacgtaagcaagaacagcagtactttgatgaaatggttcagaagtgcaaggacgtaggggcaacattggtaatctgccaatggggatttgacgatgaagcaaatcacttactgatgcacagaaacttgcctgctgtcagatgggttggtggtgtagaactggagcttattgctatcgcaactggtggtagaattgttcccaggttccaggaactaacacccgaaaagctaggaaaggctggtttggttagagagaaggcatttggtaccacaaaagaccggatgctatatatcgagcattgtgcaaactcaagggctgtaaccatatttattcgtgggggtaacaagatgatgattgaagagactaaacgtagcatccacgatgcattgtgtgttgctagaaatctcatccgcaataactctatcgtgtatggtggtggtgcagctgaaatttcatgctccattgcagtagaagccgctgctgataaatatcctggagttgaacagtatgccatcagggcttttgccgatgctttggatgctgtacccatggctcttgcggagaatagtggtctgtcacccattgaaacactatctgcaacaaaagcacgacaaaaagacaaaacctttcgttgcagtgaaaccagctaccgtattcctatgaaatggtgaataccatttctgcaactgctgcagacgaagaaaatgaaaatagcaagcacaaaagtcgagctgattcggtcatggagttgctacaagtgcacaagcacaggctgcacagtgacgaaataagttgagaaggcttcatatgacctaaaatcagtcatcacgacatacgaaggaaaccacaaccatgatgtcccagctgcccgtaacagcagtcatgctaacaacaacaacaataaccacactatggctgcacaaactctatccatgcagtctcagcttcacatgcccgaaccatctcgaatgcaaaacaacatggctaggttccaaaggcctccttatggtttacccggtggtcaacatatgggtaccaatcaaagccatggctatggttatgcaatgaaccaacaaaggccaggaggactagctcaaatggctatggctaaccaaggtcaacagcatatgggtccgactccaacccatggctatgcttatgcgatgaaccaacatttgggatttatggtgccaaaaggagagccaaaggtggagcccatgtcggatcccggtttgaaccttgccaatggtgcaacattataccagcagatgacaaacaggttaccgctcgggccttagatgtagagtttgataaagatatgcattctctctctataaggattttttttggagaagagtagaagtatatttaaatttgatatcacattatcttttcttgttgttgttacaacttttagagggggttttaagtacttatttcaagattctgaaactacattgggagaaggtctcattttttatacatcaatttattttatat

SEQ ID NO: 1816 - DNA, 2167 bp, Cajanus cajan
gggcagaggagggaagagaaggaggaggaggaggaagagatagagatggaggacattgaggatttgctgattgggagcagccgaagtgaagctccaccaggatttcgtttgccattagcagctgctgttggcgtcggcgttggaactaagcggaatcaactctcttcttctttaccttcgcctgcgatccctggcactcagactatctacatcaagacctttggctgctcgcataaccagagcgacagcgaatacatggctggtcagctttcggcttttggttactctttgagcgataatcccgacctagcagatctctggctcattaacacttgcacagttaaatccccgagtcaatctgctatggataccatcatatcaaaaggaaaatcttcaaataaaccactagttgttgctggctgtgtccctcaaggaagtcgagatttgaaagagctcgaagggatcagcgttgttggagttcagcaaattgatcgtgttgttgaagttgtagaggagactttaaaaggtcacgaagtgcgcctctttacacgaaagaaattgccagcactggacctccctaaggtaaggaagaacaagtttgttgagattcttcctatcaatgttggttgtttaggtgcttgtacttattgcaagacaaagcatgctcggggtcacctaggaagttacacagttgatagccttgttgggcgtgtaaaatctgtcatatctgatggagttaaagagatatggcttagcagtgaggacactggagcatatggtcgtgacattggtgtcaatcttccaactttgttgaaggccttagtagcagaactaccagctgatgcaagcacaatgctgcgtattggaatgaccaatccaccttatatccttgagcacttgaaagagatagcagagatattacgccatccatgtgtgtactcttttctgcatgtaccagttcagtctggaagtgatactattttgagcgcaatgaatcgggaatatactgtgagtgagttcaggactgttgtagatactttaactgagcttgtaccagagatggagattgccactgatataatatgtggatttcctggtgaaactgatgaagattttgtgcaaactgttaaccttgttaaagagtacaagttccctcaagttcatatttcacaattttatcctcgaccagggacacctgctgcaaggatgaaaaaagttccaagtaatgtggtgaagagaagaagccgagaactgacaaatgtctttgaatcctttacaccatactctgggatggagggcaaagtggaaagaatatggattactgatattgcatctgatggagttcacttggttggtcatacaaaaggatatatacaagttcttgtacttgctccagacaatatgctgggaacttcagctatggttaaaataacatctgtgggaaggtggtcagtttttggggaagtaattgagacagtcaaccatgtaagtgacggtaaagctctgaacaagctggttcctaatcaggatatggctaatctctgcggtaatccagccaagaatggtggattctcggaagtgcaagaatcttgtgcttgtggaaatgacagttgctgtagtcaggatactctcgataacagtgataattcaagacagaaccaaagcaaaaggaatttcattggatggatgttgaggaagcggaagcatctgcacaaaaaggtagagagggagcttgcctcgggatatgttaaaaagcaagaaggaagcatgagggagtgggacttcgttgataaggctcttttgggtggaatatctatcagcctcttgacgattattgctctggtagtagtagcccttacgtttagagttatttggtcccagtaaaaggctgttagtttttaatatttttccgaatcaaattgtcattcgaaagttttgacttgtacaaatttcttagattttatcaagtgttgtcatatgtattattcccgcaaattttcagcccacatcatgcattaggttttatggcagttgtattgatacacgattcgtagaaaatccttttggggcttgatttataagagcgaacgaacttgctcatccagactgactattattttgcgtggttaacaataataggaagaacatcgtttcgtaatataataaa

SEQ ID NO: 1817 - DNA, 2282 bp, Phaseolus vulgaris
gattatgcattttgatagtcccacaccggagcaacggtggctggtgctgtttatactttctataaaactatgttcccagatggaacggtgatgtagaaatacgtgaagagcttttggttgaagaaacaattcaagtatgagatcttgggcagaggagagagaagagaagggagaggagatggaggacattgaagatttgctggtcggaagcggaagcgcaactgcgccgggcttccgtttgccaatggcggcagctgttggtgttggcgttgggagcaagcggaataaactctcctcttcgccttctccggcaatccccggcactcagactatctacataaagacctttggctgctctcacaaccagagtgacagtgaatatatggctggccagctttcggcttttggctattcgttgagtgacaatccagagcaagcagatctctggctcattaacacttgcacagtgaaatcccccagtcaatctgccatggataccatcataacaaaaggaaaatcttctaataaaccgctagttgttgctggctgtgtccctcaaggaagtcggtatttgaaagagctggaagggatcagcatagttggagtccagcaaattgatcgtgttgttgaaattgtagaggagactttaaaaggtcacgaagtgcgccttttgacccgtaagacattgccagcacttgaccttccaaaggtaaggaagaacaagtttgttgagattcttcctattaatgttggttgtttaggtgcctgcacttattgcaagacaaagcatgctcggggtcacctaggaagttacacaatcgatagccttgttgggcgtgtaaaatctgtcatttctgatggagttaaagagatatggcttagtagtgaggacactggagcatacggtcgtgacattggtgtcaatcttccaactttgttgaaagccttagtggcagaactacctgctgatgcaagcacaatgctacgtattggaatgaccaatccaccttatatccttgaacacttgaaagagatagccgagattttgcggcacccatgtgtatactcttttctccatgtaccagttcagtctggaagtgatactgtcttgagtgcaatgaatagggaatatactgtgagtgagttcaggactgttgtagatactctaactgagcttgtgccagagatgcagattgccactgatataatatgtggatttccgggtgaaactgatgaagattttgtgcagactgtcaatcttgttaaagattataagttctctcaagttcacatttcacaattttatcctcgaccagggacacctgctgcaaggatgaaaaaggttccaagtaaagtggttaagggaagaagccgagagctgacaaatgtctttgaatccttcacaccatactctgggatggaaggcaaagtggaaagaatttggattactgacgttgcatctgatggaattcacttggttggtcatacgaaaggatatatacaagttcttgtacttgctcccgaccatatgcttggagcttcagctatggctaagataacatctgtgggaaggtggtctgtctttggggaagtaattgagacagtcaaccatgcaagtgacaataaagctctaaacaagttggttcctgaccgggacttgcattctctctgcgttaacccagccaaggctggtggattctcagaagagccagaatcttgtgcctgtggaagtgacgtctgttgcagtatcgacaagagtgatgtttcaagaggcactgcagtgccacagaaccaaagcaatagaaatttctttgaatggatgctaaggaagcgggagcatctgcacaaaaaggttgagagcgagcttgcctcgggatctgttaaaaagcaggaaggaaagatgaagaagtgggacttcgttgataaggttcttttgggtggaatgtctatcagtatctttactataattgctctagtagcagctcttgcgttcagagtgatttggtcccagtaaaagggccgttaacagtttttatttattttttctgaatcaaactgttattcccgattttgacctgtacaagttgtatcaagtgttttcgcaaacatccacaaattttcgcccctcaatatcttgttttaggatttacggcagttgtattgatatgatgcgattcatagaaaatcattttggggcttgatttgagagagaactagcttgttttagcttatcgagactgtaccattattttacatggttaaaaatgatagaaagttgagca

SEQ ID NO: 1818 - DNA, 2271 bp, Medicago truncatula
gggcttttgagagtgtgagcagtagcatagcagcacagaagaaaaagaagaagaaatggaagacattgaagatttactcatcggagtcgctaccggagctccaccgggattccgttctccgttatcctccgttaccgtcggcgttgcaacgaagaagattcaacgctcttcacttttaccctcaccctcaccctcaatccctggcactcagacgattttcataaagacatttggatgttctcataaccagagtgatagtgaatatatggctggtcagctttcagcatttgggtattcattgagtgataatcctgatgaagcagatctatggctcataaacacttgcacagtgaagtccccaagtcaatctgccatggataccatcataacaaaaggaaaatcttcaaataaaccactagttgttgctggctgtgtccctcaaggaagtcgagatgtgaaagagctggaagggattagcattgtaggagtccagcaaattgatcgcgtcgttgaagttgtagaggagactttaaaaggtcacgaagtgaggcttttgacccgtaagacattgccagcgcttgaccttccaaaggtgagaaagaacaaatttgttgagattcttccaattaatgttggttgtttaggtgcttgcacttattgcaagacaaaacatgctcggggtcacctagggagttacacaatagatagccttgctgggcgtgtaaaatctgtggtatctgatggagttaaagaaatatggctgagcagtgaagataccggagcatatggtcgtgacattggtgtcaaccttccaactttattgaatgccttagtagcagaattaccagctgatggaagcactatgctgcgtattggaatgaccaatccaccttttatccttgagcacttgaaagagatagcagaggttttacggcatccatgtgtttacacctttttgcatgtgccagttcagtctggaagtgatgctattttgagtgcaatgaatcgagaatatactgtgggtgagttcagaactgttgtagataccttaactgagcttgtgccggggatgcagattgccactgatataatatgtggatttccaggtgaaactgatgaagattttgagcaaactgttaacctcataaaagaatacaagttctctcaagttcatatttcacaattttatcctcgaccagggacacctgcagcaagaatgaaaaaggttccaagtaatgtggtgaagagaagaagccgtgaattgacaaatgtatttgaatcattcacgccatactctgggatggaaggcaaagtggaaagaatttggattactgatattgcaactgatggagttcacttggttggtcatacaaagggatatatacaagttctcgtaattgctccagacgacatgcttggaagttcagctctggccaagataacatctgtgggaaggtggtcggtttttggggaagtaattgagacaatcaatcctgcaagtgacaataaagctttgaacaagcaggttcctactcaggatatgtcttctctctgttgtaaccaaaccaagacttgtgaaatctcagaagagccagaatcttgtgcttgtggaaatgttgacagctgctgcagtcagagtactctcgtgaagaccgacaattcaagagacactgtagtgctgccacagaatcaaaacaacaaaaatttgtttggatggatactaaggaaaaggaagaatctgcacaaaagggtagaaagtgaacttgcctcaggatctgatctaaagcaagaaaggagcatgagaaagtgggactttgttgataaagctcttttgggtggaatctctatcagcatcttgacaattattgctttattagtttgtcttaggtttagtgttctttggtcccagtaaaaggctgttattatttactttttttaaaatttatctggagtcattgttattccaaagttttgacatacaaagtggtcagattttatcaagtattcgcacatgtattctcttgcaaaacctcaccacacatcttgcttcatgttttgtggctgttgtattcataaatgatatgattcattcagaatccttttacaacaatactggtgtggtatacaataattggaagttacatcatttcataatttaataaaagcaattacaagcataaaggaatgtttattttgatggctaaataaaattcagaatctgggatatacatataatgaaagtgtgctttaagtagtgaaaatggaagtgaa

SEQ ID NO: 1819 - DNA, 2601 bp, Cicer arietinum
gttggaatttgttttattagggctgagagtgtaagcagaggcagcagagaagaagtaagcaaggaaggaaggaaatggaggacattgaagatttgctgatcggaaccgaaactggtacaccaccgggatttcgttctccgttaacgtccgctacagttggcgttggaacgaagaaaaatcaacgctccttaccttcaccttcaccttcaccttcaatccctggcactcagactattttcataaagacctttgggtgctctcataaccagagtgatagtgaatatatggctggtcagctttcagcttttggttattcattgagtgataatcctgacgaagcagatctatggctcataaacacttgcacagtaaaatccccgagtcaatctgcaatggataccattataacaaaaggaaaatcatcaaataaaccactagttgttgctggctgtgttccccaaggaagtcgagatgctaaagaactggaagggatcagcattgtaggagtccagcaaattgatcgtgtcgttgaagttgtagaagagactttaaaaggtcacgaagtccggcttttgacccgtaagagattgccagcacttgaccttccaaaggtgagaaagaacaaatttgttgagattcttccaattaatgttggttgtttaggtgcttgtacttattgcaagacaaagcatgctcggggtcacttagggagttacacaatagatagccttgctggacgtgtaaaatctgtgatatctgatggagttaaagagatatggctgagcagtgaagatactggagcatatgggcgtgacattggtgtcaatcttccaactttattgaatgccttagtagcagaattaccagcagatgcaagcactatgctgcgtattggaatgaccaatccaccttttatccttgaacacttgaaagagatagcagaagttctacgacatccatgtgtttactcctttttgcacgtgccagttcagtctggaagtgatgctattttgagtgcaatgaaccgagaatatactgtaagggagttcaggactgttgtagataccttaactgagcttgtgccagagatgcagattgccactgatataatatgtggatttccaggtgaaaccgatgaagattttgagcaaactgtcaaccttataaaagaatacaagttttctcaagttcatatttcacaattttatcctcggccaggcacacctgcggcaaggatgaaaaaggttccaagtaatgtggtgaagagaagaagccgtgaactaacaaatgtctttgaagcgttcacgccatacaatgggatggaaggcagagtggaaagaatttggattactgatatagcatctgatggagtacacttggttggtcatacaaagggatatatacaagttctcgtgattgcttcagatgatatgcttggaacttcagctatggttaagataacatctgtgggaaggtggtcggtttttggagaaataattgagacaatcaaagaagcaaaggacaataaagctttgaacacgcagattcctaatcaagatatgtctttactatgctgtaaccaaaccaaaactggtgtaatctcagaagagccagaatcttgtgcttgtggaaatgacattgacagctgctgcagtcagagtactctcgagaagattgataattcaagcggcactgtaatgcaacagaatcaaaacaacaaaaatttgtttggatggatattgaggaagcggaagaatcttcacaaaagggtagaaagtgaacattcctcaggatctgatataaagcaagaaagaagcatgaaaaagtgggactttgttgataaggctcttttgggtggaatatctatcagcattttgacaattgttgttctattagtttgtcttagttttagtgttatttggtcccagtaaaaagctgttactttttttcttcttaattcatctggaatcattgttattccaaagttttgacttacaaatttgtcagattttatcaagtgttcgaatatgtactctcctgcaaaacctcaccacatattttgcttcatgttttgcagctgttgtatcaatatgatatgattcatacaaaaccctttttgtaccagtacttgactggcgtggttaacaataatatgaagtacattatttcataatttaataaaagctattatgagcatgaaggaatgtttattttgacagctgagaacttgggatatacatatagtgaaactgtgctttagctagtgaaagtagaagtgaactatgcacatttttcctataccctctttcatttgggtgcaatggtgcatgtctgtttattcatatgtatttatttgtgaacaataataattcgacaataggtaaagacagtgaatacaagctgaacatcaaagcagggtatctgatttggaaggcaatctcttgaagaaattgactggtactgacggaaacttgctccgaaaccgaggatgacgaagcatgtagatgccaactataattgctactacttggaatggagtaatgtaaatgaacacagcccagatcagtgagaagatgatgaagatagctgtagcccttgagt

SEQ ID NO: 1820 - DNA, 2173 bp, Trifolium pratense
acgtttattagggctgaaagtgtaaacagtggcagcacagagaagaagaagaaatggaggacattgaagatttgctcatcggaaccggcgccggaactccaccgggctttcgttctccgttaacctccgctaccgtcggctttgaaacgaagaagaatcaacgctcttcactattatcttcaccttccccttcaatccctggcactcagactattttcataaagacatttggatgttctcataatcagagtgatagtgaatatatggctggtcagctttcagcttttggttactcattgagtgataatcctgatgaagcagatctatggctcataaacacttgcacagtaaaatccccgagtcaatctgccatggataccatcataacaaaaggaaaatcttcaaataaaccactagttgttgctggctgtgtccctcaaggtagtcgcgatacaaaagagctggaagggatcagcattgtaggagtccagcaaattgaccgtgttgttgaagttgtagaggaaactttaaaaggtcacgaagtgcggcttttgacccgtaagacattgccagcactcgaccttccaaaggtgagaaagaacaaatttgttgagattcttccaattaatgtcggatgtttaggtgcttgcacttattgcaagacaaaacatgctcggggtcaccttgggagttacacaatagatagccttgttgggcgtgtaaagtctgtggtatctgatggagttaaagaaatatggctgagtagtgaagataccggagcatatggtcgcgacattggtgtcaatcttccaactttattaaatgccttagtagcagaattaccagctgatgcaagcactatgctgcgtattggaatgaccaatccaccttttatccttgagcacttgaaagagatagcagaggttctacggcatccatgtgtttacacctttttgcatgtgccagttcagtctggaagtgatgctattttgactgcaatgaatcgagaatatactgtgagtgagttcaggactgttgtagataccttaactgagcttgtaccagggatgcagattgccactgatataatatgtggatttccaggtgaaaccgatgaagattttgagcaaactgtcaaccttataagagaatacaaattctctcaagttcatatttcacaattttatcctcgaccaggcacacctgcggctaggatgaaaaaggttccaagtaatgtggtgaagagaagaagccgtgaactgacgaatgtctttgaagccttcacgccatactctgggatggaaggcaaagtggaaagaatttggattactgatattgcatctgatggagtgcacttggttggtcatacaaaaggatatatacaagttctcgtaattgctccagacaatatgcttggaagttcagctctggccaagataacatcggtcggaagatggtcggtttttggggaaataattgagacaataaatcatgcaagtgacaataaagctttgaacaagcaggttcctaatcaggatatgtcttctctctgttgtaaccaaaccaacacttgtgtaacctcggaagtgccagaatcttgtgcttgtggaaatgttgacagctgctgcagtcagagtactctcgagacggccgataattcaagagatactgtagtgctgccacagaagcaaaacagcaaaaatttgtttggatggatactaaggaagcgaaagaatctgcacaaaagggttgaaagtgaacttgcctcaggatctgatataaagcaagaaaagagcatgaaaaagtgggactttgttgataaggctcttttgggtggaatctctatcagcatcttgacaattattgctttattagtttatcttagggttagtgttatttggtcctaataaaaaggctgttattatttactttttaaaattttatctggaatcatttttattccaaagttttgacttacaaattgatcggattttatcaagtattcgcacatgtgttgtcatgcaaaacctcaccacacaccacacatcttgcttcatgttttgcggctgttgtattaataaatatgaatatgattcatacaaaaatccttttacagcaatgtttgactggtgtggttcacaataacaggaagtacatatatcataatttaatt

SEQ ID NO: 1821 - DNA, 2177 bp, Trifolium pratense
tacatggggagggctgagagtgtgagcactgagcagtggcagcacagagaagaagaaatggaggacattgaagatttactcatcggaaccggagccggaactccaccgggatttcgttctccgttaacgtccgttaccgttggctttggaacgaagaagaatcaacgctcttcactattaccttcaccttccccttcaatccctggcactcagactattttcataaaaacatttggatgttctcataatcagagtgatagtgaatatatggctggtcagctttcagcttttggttactcattgagtgataatcctgatgaagcagatctatggctcataaacacttgcacagtaaaatccccgagtcaatctgccatggacaccatcataacaaaaggaaaatcttcaaataaaccactagttgttgctggctgtgtccctcaaggaagtcgtgatacaaaagagctggaagggatcagcattgtaggagtccagcaaattgaccgtgttgttgaagttgtagaggagactttaaaaggtcacgaagtgcggcttttgacccgtaagacattgccagcacttgaccttccaaaggtgagaaagaacaaatttgttgagattcttccaattaatgttggatgtttaggtgcttgcacttattgcaaaacaaaacatgctcggggtcaccttgggagttacacaatagatagccttgttgggcgtgtaaaatctgttgtatctgatggagttaaagaaatatggctgagtagtgaagataccggagcatatggtcgtgacattggtgtcaatcttccaactttattgaatgccttagtagcagaattaccagctgatgcaagcactatgctgcgtattggaatgaccaatccaccttttatccttgagcacttgaaagagatagcagaggttctacggcatccatgtgtttactcctttttgcatgtgccagttcagtctggaagtgatgcaattttgactgctatgaatcgagaatatactgtgaatgagttcaggactgttgtagataccttaaccgagcttgtaccagggatgcagattgccaccgatataatatgtggatttccaggtgaaaccgatgaagattttgagcaaactgtcaaccttataagagaatacaaattctctcaagttcatatttcacaattttatcctcgaccaggcacacctgcggcaaggatgaaaaaggttccaagtaatgtggtgaagagaagaagccgtgaactgacgaatgtctttgaagccttcacgccatactctgggatggaaggcaaagtggaaagaatttggattactgatattgcatctgatggagtgcacttggttggtcatacaaaaggatatatacaagttcttgtaattgctccagacaatatccttggaagttcagctctggccaagataacatctgtgggaagatggtcggtttttggggaaataattgagacaatcaatcatgcaagtgacaataaagctttgaacaagcaggttcctaatcaggatatgtcttctctctgttgtaaccaaaccaagacttgtgtaacctcggaagtaccagaatcttgtgcatgtggaaatgttgacagctgctgtagtcagagtactcttgagacgaccgataattcaagagacactgtagtgctgccacagaatcaaaacagcaaaaatttgtttggatggatactaaggaagagaaagaatctgcagaaaagggttgaaagtgaacttgcctcaggttctgatataaagcaagaaaagagcatgaaaaagtgggactttgttgataaggctcttttgggtggaatcactatcagcatcttgacaattattgctttattagtttatcttaggtttagtgttatttggtcctagtaaaaaggctgttattatttactttttaaaattttatctggaatcattgttattccaaagttttgacttacaaattattcagattttatcaagtgttcgcacatgtgttgtcatgcaaaacctcaccatacaccacacatcttgcttcatgttttgcggctgttgtattaataaatatgaatatgattcatacaaaaatccttttacagcaatgtttgactggtgtggttcacaataacaggaagtacatatatcataatttaatt

SEQ ID NO: 1822 - DNA, 2128 bp, Lupinus angustifolius
tgttgaattgtaaaaaatgacaagttttgtcagtggtcgaaaatagcctttaattgaaaggtatattataaaaggagaagaggtgtttttagggttgtgagtatgaaggaatcaatgggaacggaaatgttgttggaggacattgaagatttgatgattggcggcgccaccggtttccgcttgccaattgcgtctaacactgttgccgttgctccttcaactaaaaagaggattcaaccacaacactcttcaattcctggcactcagactatttacatcaagacctttggatgctcccataaccagagtgatagcgaatacatggctggtctcctttcagcctttggctattccttatctgataatcctgaccaatcagatctctggctcgtcaacacttgcactgtcaaatcccctagtcagtctgcaatggataccatcatctccagagccaaatcttctaataaaccactcgttgttgccggctgtgtccctcaaggaagtcgtaacatcaaagagcttcaaggtatcagcattgttggcgttcagcaaattgaccgcgttgttgaagtcgttgaggagactttaaaagggcacgaggttcgtctcttgactcgtaccaccctcccagcacttgaccttcctaaggtcaggaagaacacgtttgttgagattcttcctattaatgttggttgtttaggtgcttgcacttattgcaagactaagcatgctcgtggtcacttaggcagttacactgtacaaagccttgtagggcgtgtaaaatctgtcatatctgatggcgttaaagagatatggctcagcagtgaagacaccggagcatatggtcgtgaccttggtgtcaatcttccaactttattgaatgctttagtagctgaactaccagctgatgctagcacaatgctccgtattggaatgaccaatccacccttcatccttgagcacctgaaagaaatagcacaaattttgcggcatccatgtgtgtactcatttttgcatgtaccggttcagtctgggagtgatactattttgagtgctatgaatcgagaatatactgtgagtgagttcaagactgttgtagataccttaactgagcttgtgccagggatgcagattgccactgacataatatgtggatttcctggtgaaacggatgaagattttgaacaaactgtcaaccttgttaatgagtaccagttcccacaagttcacatttcacaattttatccacgaccagggacacctgctgcaaggatgaaaaaggttccaagtaatgtggtgaagagacgaagccgagaattgacaaatgtctttgaagccttcacgccatataatgggatggaaggcagagtggaaagaatttggattactgatattgcatctgatggagttcatttggttggtcatacgaagggatatatacaagttcttataattgcttcagacaatatgctgggaacgtcagctatggttaagataacatctgtaggaaggtggtcagtttttggagaagtgattgagatggtcagctgtagtgaccataaagtttcatgcaagcagattcctaatcaggatgtgccttctctctgctgtaatccagccaagaatggtggactctcagaaaggccggaatgttgtgcttgtggaaatgacagctgctgtggtcagagtatgctggagaagagcgatgactcaagaagctctgttgtgccgcagaatcaaaacagtagaagctttgttggatggatactgaggaagcggaagcatctgctgcatagagggacagagaatgaccttgactcagcctcaggatctgttttgaagcacgaagggggccatgggagcatgacaaagtgggactttgttgataaagctcttctgggtggaatatctatcagcatcttcactattattgctttagtagtagctcttaagtttagtgttttttggtccaagtaaaaggatgttagtgtataatttttgtcgaaccaaattgttattccatatttttgacttgcaggttggtgcacttgtattcttccacaactttcagtagttgtatgatatgatggcaaacatttgactggcagttagcaacaataggaagtaa

SEQ ID NO: 1823 - DNA, 1297 bp, Glycine max
actcacacactctttcttaagttctcagaaaccttaaaaacaacaacgtaggagtgttcggaaaagatggctaagcaggaagtggtggaagggttcaagttcgagcagaggcacgggaaagaacgcgtgagagtggcgcgcgtgtggaagacgaggcaggggcagcacttcattgtggagtggcgcgtggggatcactctcttttcggattgcgtcaactcgtacctccgcgatgacaactctgacatcgttgctactgataccatgaaaaacaccgtgtatgcaaaagcaaaggaatgctctgacatactttctgccgaggagtttgctattctgcttgctaagcactttgtatcattttaccagaaggttactggtgctattgtgaatattgtggaaaaaccatgggagcgtgtcactgtggatggtcaacctcatgaacatggtttcaaacttgggtctgagaagcatacaacagaggcgatagtacaaaagtctggttcacttcagttgacttctggtattgaaggattgtcagtgttgaagacaacccagtctggttttgtgaatttcataagagacaagtacacagcacttcctgatacccgtgaaaggatggtagcaacagaagtaaccgcactgtggaggtattcgtatgaatcgctgtatagcctccctcagaagccgctttactttacagaaaagtatcaggaagtgaaaaaagttctggctgacactttttttggcccaccaaaagggggagtctatagcccatctgttcaaaacacactctacctgatggcaaaggccacactgaacaggtttcctgacatagcttatgtcagtctaaagttgccaaatcttcatttcatacctgtcaatatctcaaaccaggatggccctattgtgaagtttgaggatgatgtgtacttgccaacggatgagccacatgggtcaattcaagctagtttgagccgcctttggtcaaagctgtagaaactgcagaaactatggtgctcatcccttctggtggattgctagtgcagcctaaactagcaaacctggcctcagataatgctttccattaatgtgtcttgtaattctggtttttgttatctttatcttttgttttgtttcatgaagaactattatgcatgaataacttccaggagggatattctgtgggttgcaccaatgttaagctttttgtttctactattccaataatttcctagtgtccttgtggaatctgaaataagtcttactatgacgttgatgcaatgcttttttatggtca

SEQ ID NO: 1824 - DNA, 1248 bp, Phaseolus vulgaris
actcactctttcacttaactaaacagtgtttattccgaaaagatggcgcaggaagttgtggaggggttcaagtttgagcagaggcacgggaaagagcgcgtcagagttgcgcgcgtgtggaggacgccgcagggtcgccacttcgttgtggagtggcgcgtaggtattactctcttctctgattgcgtcaactcgtatctccgcgatgataactctgacatcgttgccactgacaccatgaaaaacacggtgtatgcaaaagcaaaggaatgctcggatatactttctgtcgaggactttgctattctacttgccaagcactttgtatcattttacaagaaggttactggtgctattgtgaatatcgtggaaaaaccatgggagcgtgtcattgtggatggtcaacctcatcaacatggtttcacacttgggtctgagaagcatacaacagaggcaatagtacagaagtctggttcactacaattgacttctggtattgaaggattgtcagtgttgaagacaacccagtctggttttgagaatttcattagagacaagtacacagcacttccagatacccgcgaaaggattttggcaacagaagtaactgctctgtggaggtattcgtacgaatcgctatacaacctccctcagaagccactatacttcacagacaagtatctggaagtgaaaaaagttctggctgacacattttttgggccaccaaacaggggagtctatagcccatctgttcaaaacacactctaccttatggcaaaggccacactgaacagatttcctgacattgcttatgtccatctaaagatgccaaatcttcatttcttaccagtcaacatctcaagcaaggatggtccaattgtgaagtttgaggatgatgtttatttaccaacggacgagcctcatggctcaattgaagcaagcttgagccgggtttggtcaaagctgtagaaactgcagaagctatgtgtggtgctcatcccttctggcctcagagatgctgattttcattaatgcacgtgtcatcatgtaattctggtttttgttatctttatgttttgtttaatggagaaactaatatgcatgaataacttccacgagggatattctgcaggttgcaccaatgctaagtttttgatgtccaaaattccaataaatttccttgtgatctttatggaaactgaaataagtgttattcttatgaagttgatgaaatgcttctttatgatc

SEQ ID NO: 1825 - DNA, 1239 bp, Vigna unguiculata
ggactcttactcactctttcacctcacttaaaaagagaaagaaaagaacacagcaacgtaaaagtgttccgaaaacatggcgcatgaagttgtggagggattcaagttcgagcagaggcacggaaaagagcgcgtgagagttgcgcgcgtgtggaagacgccacagggtcgccacttcgttgtggagtggcgcgtgggtatcagtctcttctctgattgcgtcaactcctatctccgcgatgataactctgacatagttgccaccgataccatgaaaaacacggtttatgcgaaagcaaaggaatgttcggacatactttctgtcgaagactttgctattctacttgccaagcactttgtatcattttaccagaaggttactggtgctattgtgaatattgtggaaaaaccatgggagcgtgtcactgtggatggtcaacctcatcaacatggtttcaaacttggatctgagaagcatacagcagaggcaatagtacagaaatctggttcactgcaattgacttctggtattgaaggattgtcagtgttgaagacaacccagtctggttttgtgaatttcataagagacaagtacacagcacttcctgatacccgtgagaggattttggcaacagaagtaactgctctttggaggtattcgtacgaatcgctatacaccctccctcagaagcctttatacttcacagacaagtatctggaagtgaaaacagttctggctgacacgttttttgggccaccaaatactggagtctatagcccttctgttcaaaacacactctacctgatggcaaaggcaacactgaacagatttcctgacattgcttatgtccatctaaagatgccaaatcttcatttcttaccagtcaacatctcaaacaaggatggtccaattgtgaagtttgaggatgatgtgtatttaccaacggatgagcctcatggctcaattcaagcaagcttgagccgtctttggtcaaagctgtagaaactgtagaagctatttgtggtgctcatcccttctggcctcagagatgctgctttctttccattgatgcatgtgtcatgtagttctggtttttgctatctttgtattttgtttagtggagaaactaatatgcatgaataacttccacaagggatattctgtagattgcaccaatgttaagtttttgatgttcgaatggaaactgaataaaatgtttttattatggggttcatgcc

SEQ ID NO: 1826 - DNA, 1606 bp, Cajanus cajan
ttccataagctccacatcacgatcctatctaggaaccgtggaagaaacgaaaaaacaatcttaatcctacgaacatcacgacagatccaccattttcaaacggagcattttctccatcaacaacccatataaaattcaatcctcctccaaacccattccaatttcttacaccatgacgtaacgcgcacacagaggatactaaaaccagcgaacacggccttgtcctaacgctaaacccgcgcgcgtataagtagcgccaagctcgaaagcgttgaatcgaaccacttggcttcgcagaactgaaaagcaaaaagtgttcccgaaagatggctcaggaagtggtggaggggttcaagttcgaccagagtcacgggaaagagagagtgagagtcgcgcgcgtgtggaagaccaagcagggtcgccacttcgttgtggagtggcgcgtggggatcacgctcctctctgattgcgtcaactcctatctacgcgatgacaactctgacatcgttgcaactgataccatgaaaaacactgtgtatgcaaaagcaaaggaatgctcggaaatactttctgttgaggactttgctatagtacttgctaagcactttgtatcattttacaaacaggttaccggtgctattgtgaatattgttgaaaaaccgtgggagcgtgttgttgtggatggccaacctcatgaacatggtttcaaacttgggtctgagaagcatacagcagaggcagtagtgcaaaagtctggtgcactacagttgacttctggtattgaaggattgtcagtgttgaagacaaccaagtctggttttgagggtttcataagagacaagtacacagcacttcccgatacacgtgaaaggatgctagcaacagaagtaactgcactgtggaggtattcgtatgaatcattatatagcctccctcagaagccgctttactttacagacaagtatctggaagtgaaaaaagttctggctgacactttttttggcccaccaaatggaggagtctatagcccatctgttcaaaacacgctctacctgatggcaaaggccacactaaacagatttcctgacatagcttttgtccatctaaagatgccaaatcttcatttcataccggtcaatatctcaaacaaggatggtcctattgtgaagtttgatgatgatgtgtatttaccaacggacgagccacatgggtcaattaaagctagcttgagccgcctttggtcgaactcgaagctgtagaaactatggtgctcatcccttctggtggattgccagtgcagcctaagctaccaaacatggcctcagagatactggttttcattaacgtgtcatgtaattctggttttctgttttctttatattttgtttcgtgaactaatatgcatgaataacttccaggagggatattctgcaggttgcaccaatgttaagtttttctttttatgcctaaaattcctaataaatttctagtatccttatggagactgaaatgtgttactattacgttggtgcgatgcttttttatggtcatataaagaaccagtgttgtcaccaaattgttataagagtaaagacgcggtttaatg

SEQ ID NO: 1827 - DNA, 1293 bp, Lotus japonicus
gaaggaagaagaagaaagcatcagcataagcatcgatggcgaaggaagtagaagggttcaagttcgagcagagacacgggaaagagagagtgagagttgctcgcgtttggaagaacaatcaaggtcaccacttcgttgtggagtggcgcgtcagcatctccctcctctccgattgcctcaactcctatctccgtgatgataactctgacatcgttgccactgacaccatgaaaaacactgtatatgcaaaagcaaaggaatgttcggaaatactttctgtggaggactttgctattctacttgctaaacacttcacatcattttacaagcaggttactactgctattgttaaaattgtggagaaaccatgggagcgtgttaatgtggatggtcaacctcatgaacatgggttcaagctcggatccgagaagcatacagcagaggctatagtgcaaaagtctggtgcactacagttgacttctggtattgaaggattgtcattactgaagacaaccaagtctggttttgagggttttataagagacaagtacacagtacttcctgaaacacgtgaaaggatgctggcgacagaagtaactgcactatggaggtattcatatgaatcactatatagcatcccgcagaagccgctttattttactgagaagtacctcgatgttaaaaaagttatagttgacactttctttggacatccaaaggagggagtgtatagtccatctgttcaaagcactctctaccagatggcgaaggccacactaaacagatttcctgacgtagcttctatacaactaaagatgccaaatattcatttcataccagtcaatctctcaaacaaggacggtccaattgtaaagtttgatgacgatgtgtatttgccaacggacgagccacatgggtcaattgaagctagcttgagccgcattttgtcaaagatgtagaaacactacttaaacatctcagcccatcccttctggtcaaatggagatgctgcttacactatggtgcttatcctgatttaagatcatacacaaatggaatcttgccagagcgatactcctttcaaataaagaactcaataatgttaattctggtttgttttcattatattttgttcatggagagcttatgtgcataaataatcagcatggtggattttctgcaatttgcaccaatgtatatcagaactgtttattcactgagaagtttggcaagacgactagtttcagcatttataatcgaacttttcattcgttgaatcaactagtgttttat

SEQ ID NO: 1828 - DNA, 1984 bp, Cicer arietinum
ggcgattgtcctaatccggaaggacaaaactgaaagacatagatacaatataataaatttagctcttctaaaataaaaaaattattaaaataaacaaaattatagttatattatttgttctctaaaaatagttattttttcttagaggagtcaaatcaagattcttacgtgtataaatagaacgatatcgatggagctgagacactaaactagcgtagaaaacagaaagaaaaagaagaaaaataagatcgatggcgaagaacgtggaagggttcgaattcgaacagagacacgggaaagagagagtgagagttgctcgcgtgtggaaaagcaaagatggtaaacgacactttgttgttgagtggcgtgtcagcatcaatctcctctccgattgtgtcaactcatatattcgtgatgacaattctgatatcgttgctactgataccatgaagaacactgtttatgcaaaagcaaaggagtgttcagaaatactttctgcggaggactttgctattctacttgccaaacattttacatcattttacaggcaggttaccactgctattgtaaatattgtggagaaaccgtgggagcgtgttagtgtggatggtcaacctcatgaacatggtttcaaacttggatccgagaagcatacaacagaggcaatagtaaaaaagtctggtgcactacaattgacttctggcattgaaggattatcacttttgaagacaaccaagtctggttttgagggtttcataagagacaagtttacagcacttcccgaaacacgtgaaaggatgcttgcaacagaagtaactgctctatggaggtacacgtatgaatcattctatagcatccctcagaagccgctttattttacagacaagtatctggatgtaaaaagagttcttgttgacacattttttggctctccaaaggaaggagtctatagtccatctgttcaaagtactctctaccagatgggaaaggccacactaaacaggtttcctgacatagcttctattcaactaaagatgccaaatattcatttcctaccagtcaatctctcaaacaaggatggacacattgtaaagtttgacgacgatgtttatttaccaacggacgagccacacggttcaattgaagctagcttgagccgcactcggtcaaagatgtagaaactactttaacatctcagctcatccctactggtcaattggtgctgctgcttatacagtggtttttgtcttaatttaagagcacgtaacaagtaaacctggcaagagatattaatcttaatgttggtttgttttctgtgcctcttgtttcatggaaaacttgcatgatccatatcatgcaggttgcaccaatgtagatcaaaactcttgttggggttataacttgttcggatgtctgaaaattccaataaagtcttttaataatatttccatcatgaattcttgtcctgttttttcctttctctcgtttctgacccatgcatatgcttctgcatagatctgtacatgggttgggtttggccaaacccaataccctagcaaatcataatctgatctttctttgaaggagtagatgaattctatgttttagacactaaaatctgctgaaaggtctgaagctgaaaatgaatgtcaacattaaaataaagtatcatttacatacctatgcttgcaagcatgattgggcatagtttaaagatcttagcagatgaaagtgtcaaatgggaagagaattagcacatattattcataggagtaatgcaatcctaaaattgtgttgggatgagcagaaccattggtgaattgcataaattgaatcctataaatgaggattgtacaataatctttcaaaatcatcaagcatcttttttccttctatcgatactatctttatcatatttttgttaatctgtgtgaataattattaagtctttgtattgaaataacaagtttttaatttttgtttt

SEQ ID NO: 1829 - DNA, 1099 bp, Trifolium pratense
acaagcatagaaaacagtaagaaaaaagatcgatggccgagaaagtagaaggatacgaattctcacagagtcacggtaaagagagagtaagagtggcgcgtgtctggaaaaccaaagatggtcaaagacacttcgtggttgagtggcgcgttagcatcaatctcctttccgattgcatcaactcatatcttcgcgatgataattctgatattgttgctactgataccatgaaaaacactgtgtatgcaaaagcaaaggaatgttcggaaatactttcggccgaggattttgctattctacttgccaaacattttacatcattttacaggcaggttaccactgctattgtaaaaattgtggagaaaccatgggagcgagttagtgtcgatggtcaacctcatgaacatggtttcaaacttggatccgagaagcatacaacagaggcaatagtgaaaaagtccggcgcactacaattgacttctggaattgaaggactgtctgtgttgaagacaaccaaatctggttttgagggttttataagagacaagtatacagtacttcctgatacacgcgaaaggatgctggcaacagaagtaactgcactatggaggtattcgtatgaatcagtaaatagcatcccgcagaagccgctttattttacagacaagtacctggatataaaaagggttctggttagcacctttttcggctctccaaaggaaggggtttacagtccatctgttcaaagcactctctatcagatggcaaaggccacactgaacagatttcctgatatagcttctattcaactaaagatgccaaatattcatttcttaccagtcaatctctcaaacaagaatggcccgattgtaaagttcaacgacaatgtgtttttaccaacggatgagccacatgggtcaattgaagctagcttgagtcgcagtcggtcaaagttatagaaactactaaaacatctcagttcatcctttccgagcaatttgcggtgcagcttaatttaagattatgtaacaagtaaacatggaaagagagacactgctttcaattaacatgtgatgttaatgtaaatatgctggtttgt

SEQ ID NO: 1830 - DNA, 1313 bp, Trifolium pratense
tgaaaacagaaagaaaagatcgatgggtgagaaagtgttagaaggtttcgaattctcacagtgtcacgggaaagagagagtaagagtagctcgtgtttggaaaaccaaagatggtcaaagacacttcgttgttgagtggcgcgttagcatcaatctcctttccgattgtgtcaactcatatcttcgcgatgataattctgatattgttgctactgataccatgaaaaacactgtgtatgcaaaagcaaaggaatgttccgaaatactttctgccgaggattttgctattctacttgccaaacattttacatcattttacaggcaggttaccactgctattgtaaaaattgtggagaaaccgtgggagcgagttagtgtcgatggtcaacctcatgaacatggtttcaaacttggatccgagaagcatacaacagaggcaatagtgaaaaagtccggtgcactacaattgacttctggtattgaaggactgtctgtgttgaagacaaccaaatctggtttcgagggttttataagagacaagtatacagtacttcctgatacacgcgaaaggatgctggcaacagaagtaactgcactatggaggtattcgtatgaatcagtaaatagcattccgcagaagccgctttattttacagacaagtacctggatataaaaagggttctggttgacacctttttcggctctccaaaggaaggggtctatagtccatctgttcaaagcactctctatcagatggcaaagaccgcactgaacagatttcctcacatagcttctattcaactaaagatgccaaatattcatttcttaccggtcaatctctcaaacaagaatggtcagattgtaaagttcaatgatgatgtgtttttaccaacggacgagccacatgggtcaattgaagctagcttgagccgcagtcggtcaaagttgtagaaactactaaaacatctcagttcatcctttccgatcaatttgcggtgcagcttaatttaagatcatgtaacaagtaaaaatgggaagagagacaatgctttcaattaacatgtgatgttaatgtaaatatgctggtttgttttctttgcatatgatggtgttatgcatgctgctgcaccaatgatcaaaactgttgttggattatatagtttttggatgttggaaattctaatgaagtctaataaattacttatgttcttagggagaatgaaataattaagagttatatttgtgatattgatgtagtatggtcttttggtcatttagtaatttcttgaaatatggattcttgtccataaga

SEQ ID NO: 1831 - DNA, 1304 bp, Trifolium pratense
gaaaacagaaagaaaagatcgacgatgggtgagaaagtgttagaaggtttcgaattctcacagagtcacgggaaagataaagtaagagtagctcgtgtctggaaaagcaaagatggtcaacgacacttcgttgttgagtggcgcgttagcatcaatcttctttccgattgtgtcaactcatatcttcgcgatgataattctgatattgttgctactgataccatgaaaaacactgtgtatgcaaaagcaaaggaatgttccgaaatactttctgccgaggattttgttattctacttgccaaacattttacatcattttacaggcaggttaccactgctattgtaaaaattgtggagaaaccgtgggagcgagttagtgtcgatggtcaacctcatgaacatggtttcaaacttggatccgagaagcatacaacagaggcaatagtgaaaaagtccggtgcactacaattgacttctggtattgaaggactgtctgtgttgaagacaaccaaatctggtttcgagggttttataagagacaagtatacagtacttcctgatacacgcgaaaggatgctggcaaccgaagtaactgcactatggaggtattcgtatgaatcagtaaatagcattccacagaagccgctttattttacagaaaagtacctggatataaaaagggttctggttgacacctttttcggctctccaaaggaaggggtctatagtccatctgttcaaagcactctctatcagatggcaaaggccgcactgaacagatttcctgacatagcttctattcaactaaagatgccaaatattcatttcttaccagtcaatctctcaaacaagaatggcccgattgtaaagtttaatgacgatgtgtttttaccaacggatgagccacatgggtcaattgaagctagcttgagtcgcagtcggtcaaagttatagaaactactaaaacatctcagttcatcctttccgatcaatttgcggtgcagcttaatttaagattatgtaacaagtaaacatggaaagagagacactgctttcaattaacatgtgatgttaatgtaaatatgctggtttgttttctttgcatatgatggtgatgatcaaaactgttgttgggttatataatttggatgtgggaaattcaaatgaagtctaataaattccttatgttcttagggagaatgaaataattaagagttacatttgtgatattgatgcagtatggtctgttggttatttagtaacaatctcttgaaatatggattcttgtccataagataattgtt

SEQ ID NO: 1832 - DNA, 1451 bp, Trifolium pratense
tgttagaaggattcgaattctcacagagtcacgggaaagagagagtaagagtagctcgtgtctggaaaagcaaagatggtcaaagacacttcgttgttgagtggcgcgttagcatcaatctcctttccgattgcatcaactcatatcttcgcgatgataattctgatattgttgctactgataccatgaaaaacactgtgtatgcaaaagcgaaggaatgttcggaaatactttctgccgaggattttgctattctacttgccaaacattttacatcattttacaggcaggttaccacagctattgtaaaaattgtggagaaaccatgggagcgagttagtgtcgatggtcaacctcatgaacatggtttcaaacttggatctgagaagcatacaacagaggcagtagtgaaaaagtgcggcgcactacaattgacttctggtattgaaggactgtctgtgttgaagacaaccaaatctggttttgagggttttataagagacaagtatacagtacttcctgatacacgcgaaaggatgctggcaacagaagtaactgcactatggaggtattcgtatgaatcagtaaatagcattccgcagaagccgctttattttacagaaaagtacctggatataaaaagggttctggttgacacctttttcggctctccaaagaaggggtctatagtccatctgttcaaagcactctctatcagatggcgaaggccacactgaacagatttcccgacatagcttctattcaactaaagatgccaaatattcatttcctaccggtaaatctctcaaacaagaatggtcagattgtaaagttcaatgatgatgtgtttttaccaacggacgagccacatgggtcaattgaagctagcttgagccgcagtcggtcaaagttgtagaaactaataaaacatctcagttcatcccttctggtcaatcggcggtgcagcttaatttaagatcatgtaacaagtaaacatggaaaagagacactgttttcaattaacatgtgatattaatgtgaatatgctggtttgttttctttgcatatgatggtgttatgatgcatgttgcaccaatgatcaaaactgttgttgggttatatagtttggatgagggaaattccaatgaagtcaaataaatcccttatgttcttagggagaatgaaataattaagagttacatttatgatattaatgaagttcttgtcatgattgtgtcatatactttacgttgctctgaagtcatagttgacatcaatctaacatgttcctcagctaatgattgtctgttataattcaattcgtcgtgtattaaactattttgtatatcaggaactaatgatgtgtttgctctaggctttggaggataatcttttaaacttttcccacaactacgtaacatcatctcaatatctgctagtgcatattgtat

SEQ ID NO: 1833 - DNA, 1282 bp, Medicago truncatula
aaaaaataaaccagaaagaaagaaagaaaaaaaaaaaagaaggtaaaagcacgatcgatggcgaagaacgtggaaggattcgaattcgaacagagacatggaaaagagagagtaagagtagctcgtgtttggaagagtaaagatggtaaacaacagtttgttgttgaatggcgcgttagtatcaatcttctttcagattgtgttaactcttatgttcgtgatgataattctgatattgttgctactgataccatgaagaacaccgtgtatgcaaaagcaaaagaatgttcggaaatactttctgtggaggactttgccattttacttgccaaacatttcacatcattttacagccaggttaccactgctattgtaaaaattgtggagaaaccgtgggagcgtgttaatgtggacggtcaacctcatgaccatggtttcaaacttggatccgagaagcatacaacagaggcaatagtaaaaaagtctggtgcactacaattgacttctggtattgaaggattgtctgtgttgaagacaaccaagtctggttttgaaggttttgtaagggacaagtataccatacttcctgatacacgcgagaggatgctggcaacagaagtaactgcgctatggaggtattcatatgaatcgttatatagcgtccccaagaagcctctttattttacagaaaagtacctggatgtgaaaagagttttgcttgacacattttttggctctccaaaggaaggggtctatagcccatcagttcaagccaccctctaccagatggcgaaggcagcattaaacagatttcctgacatagcttctattcaactaaagatgccaaatattcatttcataccggtcaatctctcaaacaagaatggtcagtttgtaaagtttgatgacgatgtatatttaccaacggacgagccacatggttcaattgaagctagcttgagctgcagtcggtcaaagatgtagaaactactcaaacatatcacctcatccgttcgggtcaactggtggtgtagcttacactatggtgcttaacgtaatttaagaacatgcaacaagtgaacctggcaataaagatactgctttgagttaacatgtgatattaatgttaatgccgttttttttttttgcaccaataatcaaaactgttgttggattgtacataatttggatttcagaaattccaataaagtctaattagtccttttgttcttaagtggaatgaaacagttaagactcactatttatgatattgatgcagtgc

SEQ ID NO: 1834 - DNA, 1268 bp, Arachis hypogaea
gaacactctaaacttataataaaaagtaaaaaagaaaaggggagaaatttcccatggcagaaagagtagagggattcaacttcgagcaaaggcatgggaaacagagggtaagggtggctcgcgtgtggaagacgaaggaaggaaaacactacgttgtggagtggcgagtcagcatcagcctcctctctgattgtgtcaactcttatctccgtgatgataactccgatatcgttgccactgacaccatgaagaacactgtatatgcaaaagccaaggagtgctctgaaatactttctgttgagaactttgctattgagcttgccaagcactttatatcattctataggcaggttactgcagctattgtaaacattgtggaaaagccatgggaacgcatcatcatggatggtcaacctcatatgcatggtttcaaacttggatctgagaggcatacagttgaggcaatagtaaaaaagtctggtgctctacagttgacttctggtgttgaaggattatcagtgctgaaaactactaagtctggttttgaagggtttatacgagacaagtacacagctcttcctgaaacacgtgaaaggatgctggcaacagaagtaactggtctgtggaggtactcttatgaatcactaagcagcatcccacagaagccgctttactttatggagaggtacaacgatgttaaaagagttctgcttgaaacctttttcggtccaccgaatgagggggtgtacagcccatctgttcaaaacactctctatcaaatggcaagggccacattgaacagatttcctgacatagattctgttcaactaaagatgccaaatattcatttcctaccagtcaatatctcaaatacaggtggtcaaattgtaaagtttaacgatgatgtatacttacccacggatgagccacatgggtcgattcaagctacactgagccgcttttggtcaaagatgtaggaactgctgaaacaccacatatcatcctttctgatcaaaataacaagttatatataaataatgttggttatgcttttccagctgtttctttacatgccttttcttcagaataaaatgtataggcaggaactgcttgggttgttctatgagcatgtcaaatctgattgatatggctagcttgaaaatctgaacttaaagagaaattccggatatcattattggaaaatatggattaatgttaattagtaatggctgatattattatccaaaaaaagaaaaaaaacaaaagta

SEQ ID NO: 1835 - DNA, 1190 bp, Arachis hypogaea
gaaagagtagagggattcaacttcgagcaaaggcatgggaaagagagggtaagggtggctcgcctgtggaagacgaaggaaggaaaacactacgttgtggagtggcgagtcggcatcagcctcttctcggattgtgtcaactcttatctccgtgatgacaactccgatatagttgccactgacaccatgaagaacactgtatatgcaaaagccaaggagtgctctgaaatactttctgttgagaactttgctattgagcttgccaagcactttatatcattctataggcaggttactacagctattgtaaacattgtggaaaagccatgggaacgcatcatcgtggatggtcaacctcatatgcatggtttcaaacttggatctgagaggcatacagttgaggcaatagtaaaaaagtctggtgctctacagttgacttctggtgttgaaggattatcagtgctgaaaactactaagtctggttttgaagggtttatacgagacaagtacacggctcttcctgaaacacgtgaaaggatgctggcaacagaagtaactggtctgtggaggtactcttatgaatcactaagcagcgtcccacagaagccactttactttatggagaggtacggcgatgttaaaagagttctgcttgaaacctttttcggtccaccgaatgtgggggtgtacagcccatctgttcaaagcactctctatcaaatggcaagggccacattgaacagatttcctgacatagattctgttcaactaaagatgccaaatattcatttcctaccagtcaatatctcaaatacaggtggtcaaattgtaaagtttaacgatgatgtatacttacccacggacgagccacatgggtcaattcaagctacattgagctgcttttggtcaaagatgtaggaactgctgaaacaccacagatcatcctttctgatcaaaataacatgttatgtataaataatgttggttatgcttttccagctgtttctttacatgccctttcttcagaataaaatgtataggcaagaactgcttgggttgttctatgagcatgtcaaaagtcaaaactgattggtatggccagtttgaaaatctgaacataaagagaaattccggatatcattatgggagaatatggtcagtaatggctgatattgttatcctctacaaaa

SEQ ID NO: 1836 - DNA, 1239 bp, Arachis hypogaea
ttggatgaggatgatgatgtaatccgcacacagactccaaccgagagaaaagcaaaaccagcaaatctctgctgtcttatctccaatataaattggaacggaatcgacacacaggtcaaatcaaacactctaaagtctaaacttataataaaaaacaaaaaagaaaagaaaaggggagaaatttcccatggcagaaagagtagagggattcaacttcgagcaaaggcatgggaaacagagggtaagggtggctcgcgtgtggaagacgaaggaaggaaaacactacgttgtggagtggcgagtcagcatcagcctcctctctgattgtgtcaactcttatctccgtgatgataactccgatatcgttgccactgacaccatgaagaacactgtatatgcaaaagccaaggagtgctctgaaatactttctgttgagaactttgctattgagcttgccaagcactttatatcattctataggcaggttactgcagctattgtaaacattgtggaaaagccatgggaacgcatcatcatggatggtcaacctcatatgcatggtttcaaacttggatctgagaggcatacagttgaggcaatagtaaaaaagtctggtgctctacagttgacttctggtgttgaaggattatcagtgctgaaaactactaagtctggttttgaagggtttatacgagacaagtacacagctcttcctgaaacacgtgaaaggatgctggcaacagaagtaaccggtctgtggaggtactcttatgaatcactaagcagcatcccacagaagccgctttactttatggagaggtacaacgatgttaaaagagttctgcttgaaacctttttcggtccaccgaatgagggggtgtacagcccatctgttcaaaacactctctatcaaatggcaagggccacattgaacagatttcctgacatagattctgttcaactaaagatgccaaatattcatttcctaccagtcaatatctcaaatacaggtggtcaaattgtaaagtttaacgatgatgtatacttacccacggacgagccacatgggtctattcaagctacattgagccgcttttggtcaaagatgtaggaactgctgaaacaccacagatcatcctttctgatcaaaataacatgttatatataaataatgttggttatgcttttccagctgtttctttacatgccctttcttcagaataaaatgtataggcaaga

SEQ ID NO: 1837 - DNA, 1255 bp, Trigonella foenum-graecum
tactaccgactcaggaaagaaaaaagaaaaacacgatcgatggcgaagaacgtggaaggattcgaattcgaacagagacatgggaaagagagagttagagttgcgcgtgtgtggaagagcaaagatggtaaacgacactttgttgttgagtggcgcgttagcatcaatctcctttccgattgtgttaactcttatattcgtgatgataattctgatattgttgctactgataccatgaagaacaccgtgtatgcaaaagcaaaggatgttcggaaatactttctgtggaggactttgctattctacttgccaaacattttacatcattttacagccaggttaccactgctattgtaaaaattgtggagaaaccgtgggagcgtgttaatgtggatggtcaacctcatgaacatggtttcaaacttggatctgagaagcatacaacagaagcaatactgaagaagtctggtgcactacaattgacttctggtattgaaggattgtcagtgttgaagacaaccaaatctggttttgagggttttataagggacaagtatacaatacttcctgatacacgcgaaaggatgctggcaacagaagtaactgcactatggaggtatttgtatgaatcagtatatagcatccccaagaagccgctttattttacagacaagtacctggatataaaaagagttctgcatgacacgttttttggctctccaaaggaaggggtctatagcccatctgttcaagccaccctctaccagatggcaaaggcgacactgaacagatttcctgacatagcttctattcaactaaagatgccaaatattcatttcataccggtcaatctctcaaacaagaatggtcagtttgtaaagtttgatgatgatgtgtatttaccaacggacgagccacatggttcaattgaagctagcttgagccgcagtcgttcaaagatgtaaaaactattcaaacatatcagcttatgcgttcgcgtcaactggtggtggtgtagtttacactatggtgcttaacataataatttaagaacttgtaccatgtgatgttaatgctgttttttttttgcaccgatgatcgaaactgttgttggatttcagaaattccaatgaagtctaataagttccttatgttcttaaggggaatgaaataattaagagttactattttatgatattgatgcggtgctgtattttggtcattcaacaatctcttgaaataatgattctttgct

SEQ ID NO: 1838 - DNA, 1373 bp, Lupinus angustifolius
acaaaaggttttcaattttccaaatttagaaaattttgaagcaagttctcaccaattttaatataaattattacaaaatccctatgattctgtctcaatccaagcattcctgactcactcatcacagaaaagggaaagaagaaaagatcgatgacgaaggaagtaatagaaggattcaactttgaacagagtcacgggaaagagagggtgagggtagctcgcgtttggaaaaaccaagaaagtggtcgatatttcgttgtagagtggcgtgtcagtattagtctgctttctcattgcatcaactcctatatccatgatgacaactcagacatcgttgctactgataccatgaaaaacaccgtatatgcaaaagcaaaggagtgctctgaaatactttctgcggagaactttgctattgaacttgctaagcacttcacatcattttacaaacaggttactactgctattgtaaatattgtagaaaaaccatgggagcgtattaatgtggatggtcaacctcatgaacatggtttcaaacttggatctgagaagcatacaactgaggcaatagtgaaaaagtctggggaactacggttgacttcgggtattgaaggattgtcattgttgaagacaaccaagtctggttttgagggttttataagagacaagtacacagctcttcctgaaacacgtgagaggatgctagcaacggaagtaactgcacaatggaggtattcatatgaatctctgcaaagcgtccctcagaagccgctttacttcacagagaagtacctggatgtgaagaaagttctcattgacactttttttggccctccaaatgtgggagtctacagcccatctgttcaaagcactctctatcagatggcaaaggccacactaaacagagtccctgacatatcatcaatccaactaaagatgccaaatattcatttcttacctgccaatatctcaaacaaggaaggtcaaattgtaaagtttgaggatgatgtgtattttccaacggatgagccacatgggtcaattgaagccagcttgagccgcttttggtcaaagatgtagaaacaactgaaccatatcagttaatcctttctggtcaattggaagtgctgcttatacaactaacaagtaaacttggcttacttggttagagatacttcctttggtcattatgtcatataatgttaattcttgctttcttgttgatcttcactttgtgtcatgtatggtggcgggtcttgcgctaaatttaaactaaatctaattaatatttattttcagaattcatcaacttgatttaaagtgaaaggggatttaacatctattcttaaatattaatttgtattgatttggaa

SEQ ID NO: 1839 - DNA, 1059 bp, Solanum tuberosum
caacaatctactccagttgtgaagaagaaaaaacttatccaaattcagaaatggcgaccactcagctaacagcatcgtctatctctggcaatggttttgcatcctttgaagggctcaggtccacttgcattgtaaaggccgtatcttttacccctttgaagcacaacaacagcaggtcttttagtcgtctggttgtcaaggctgccaccaccgtagctcctaagtacactactcttaagcctttgggcgacagagtgttggtgaagattaagaccgcggaggagaaaactgttggtggtatcctacttccagtaacagcccagtcgaaacctaatggaggtgaggtggttgctgttggggagggtcattcagctggcaagatcaaagtggacattagtgtgaagactggtgcccaagtcatctactcaaagtacgcgggaactgaggtggagtttgatggatcaaagcacctcattctgaaagaggatgatattgttggtattcttgagacagatgatgtcaaggatctgcagccattaaatgacagagtcctaatcaaggttgccgaagctgaagaaaaaactgctggaggcttactgttgactgaggcagccaaggagaagccttcaattggctcgattatagccgtcgggcctggtcctattgatgaagaagggaacaggaaaccactttcagtatccccaggaaatacagttctctactccaaatatgcaggcagtgaattcaaaggggctgatggttctgattacatcacactcagggtgtctgatgtaatggctgtgctatcttagtggggctattgagctattccatgccaaaattttcagcagagatctaggaaggaggaagctgcattcaactttcgagtgaggagtaaaactctctgcaaatttatgactaatatcgaagtgtagaatcaattttctgaatgcatttctgttcttgatttgaggaattaccctttgggaattttgtatgttaaaagtgattgaaaactgcagattatgaaagattagcaataatatttgcataattcat

SEQ ID NO: 1840 - DNA, 1128 bp, Solanum phureja
aaaagtcctcctcttgaaccttctagggttttgttatcctcttcttacctactcttctccatatttccaacaatctactccagttgtgaagaagaaaaaacttatccaaattcagaaagaaatggcgaccactcagctaacagcttcgtctatctctggcaatggttttgcatcctttgaagggctcaggtccacttgcattgtaaaggccgtatcttttacccctttgaagcacaacaacagcaggtcttttagtcgtctggttgtcaaggctgccaccaccgtagctcctaagtacactactcttaagcctttgggcgacagagtgttggtgaagattaagaccgcggaggagaaaactgttggtggtatcctacttccagtaacagcccagtcgaaacctaatggaggtgaggtggttgctgttggggagggtcattcagctggcaagatcaaagtggacattagtgtgaagactggtgcccaagtcatctactcaaagtacgcgggaactgaggtggagtttgatggatcaaagcacctcattctgaaagaggatgatattgttggtattcttgagacagatgatgtcaaggatctgcagccattaaatgacagagtcctaatcaaggttgccgaagctgaagaaaaaactgctggaggcttactgttgactgaggcagccaaggagaagccttcaattggctcgattatagccgtcgggcctggtcctattgatgaagaagggaacaggaaaccactttcagtatccccaggaaatacagttctctactccaaatatgcaggcagtgaattcaaaggggctgatggttctgattacatcacactcagggtgtctgatgtaatggctgtgctatcttagtggggctattgagctattccatgccaaaattttcagcagagatctaggaaggaggaagctgcattcaactttcgagtgaggagtaaaactctctgcaaatttatgactaatatcgaagtgtagaatcaattttctgaatgcatttctgttcttgatttgaggaattaccctttgggaattttgtatgttaaaagtgattgaaaactgcagattatgaaagattagcaataatatttgcataattc

SEQ ID NO: 1841 - DNA, 1082 bp, Solanum melongena
ttatccccttcttacctactctcctctatattttctactgtacaacgctctactccagttgacaacagacaacttatcttaatccagaaatggcgaccactcagctaactgcatcatctatttctggcaatggttttgcatcctttgaagggctcaggtccactggcattgtaaaggccatatcttttgcccctctgaagcgtaacaatgggaagtcttttcgtcctcttgttgtcaaggctgccactaccgtagctccgaagtacacttcgcttaagcctttgggtgacagagtgttggtaaagattaagaccgcggaggagaagacagtaggtggtatcctactcccagtagcagcccagtcaaaacctaatggaggtgaggtggttgctgttggggagggtcattcagctggcaaaaccaaagtggacattagtgtgaagaccggtgcccaagtcatctactctaagtacgccgggacagaggtggagtttgatggatcaaagcacctcattctgaaagaggatgatattgttggtattcttgagacagatgatatcaaggatctgcagccattaaatgacagagtcctaatcaaggttgccgaggctgaagaaaaaactgctggaggtttgctgttgactgaggcagccaaggagaagccttccattggcactattatagctgttgggcctggtcctcttgatgaggaagggaacaggaaaccactttcagtatcagcaggaagtacagttctctactccaaatacgcgggcagtgaattcaaaggtgctgatggttctgattacattacactcagggtgtctgacgtgatggccgtgctatcttattgagttattccatgccaaaaatttcagtagaatatctgggaaggtggaagctgcattcaactgtagagcgaggagtaaaactctctgcaaattaatgattaatgccaattttagaatcaattttctgaactcatctctgttcttgatttgaggaactgcccttttgggaattttgtatgtttaaagtgatggaaactgcagattatgaaagatgagcaataatttttgcat

SEQ ID NO: 1842 - DNA, 1182 bp, Capsicum annuum
ctcaaacgaacaaactattctagaagcatcttatcttttacagaaaacccttggctcctcttgaactctctagggttttgttatccttttcttacccaccaccctctatatttctggtacaatcctatctaacctcactactactccacttgagaaaataaaataaaacatctcctaattcaggattagaaagaaatggcaagcactcagctaacagcatcgtccatttctggcaatggttttgcatcctttgaaggacttaggtccacttgtattgtgaagtccgcatcatttgcccctttgaagctgaacaacagctcttttcgtggtcttgttgttaaggctgccaccaccgcagcccctaagtacacttcgcttaagcctttgggtgacagagtgttggtaaagattaagaccacagaggagaagactgtaggtggtatcctacttccaataacagcccagtctaaacctaacagaggtgaggtagttgctgttggggagggtcattcagctggcaagaccaaagttgacattagtgtgaagactggtgccaaagtcatctactcaaagtacgctggaacagaggtggagtttgatggatcaaagcacctcattctgaaagaggatgatattgttggtattcttgagacagatgatgtcaaggatctgcagccattaaatgatagagtcctaatcaaggttgcagaggctgaagaaaaaaccgctggaggcttactgttgagtgaggcagccaaggagaagccttcaattggcacgattatagctgttgggcctggtcttcttgatgaggaagggaacaggaaaccactttcagtatccccaggaaatacagttctgtactccaagtatgcaggcaatgaattcaaaggtgctgatggatctgattacattacactcggggcacccgatgtaatggctgtactatcttgagttgttctcaccaaaattttcagtaagatctagaatggcggaagctgcattcaactttcgagtgaggagtaaaacacactgcaaattaatgattcatatcaagtgtagaatcaattttctgaacgtatttctgttcttgatttgaggaattaccctttttttagaatttttttaatgttaaaaagtgatgaaaactacagattatgaggatgagagctcaaattcttc

SEQ ID NO: 1843 - DNA, 1187 bp, Nicotiana tabacum
aaagaaaaattctagaaacatcttatctttggcagaaaacccctttctcttgaaccttctagggttttgttatcctcttcttaccaaaccaccccatattttttcaacaacctaaccacccactctcactaccccagttgagaagaaaaagaagccttctttttgactcctaattcaggaagaaatggcgaccactcagctaacggcatcatccatttgtgcaaagggttttgtatcctttgaagggcttaggtcaactggtagtgtaaaggttgcatcttttgccccattgaagcagaatagcaggtcttttcgtagtcttgttgttaaggctgccactactgtagctcctaagtacacaacgcttaagccgttgggcgatagagtattggtaaagattaagaccgcggaggagaagactgtaggtggtatcctacttccagtaacagcgcagtcaaaacctcaaggaggtgaggtggttgctgttggggagggtcgttcagctggcaagactaaagtggacattagcgtgaagacgggtgcccaagtcgtctactcaaagtacgctggaacagaggtggagttcgatggatcaaagcacctcattctgaaagaggatgatattgttggtgttcttgagacagatgatatcaaggatttgcagccattaaatgacagagtcctaatcaaggttgccgaggctgaagaaaaaaccgcaggaggcttactgttgactgaggcagcaaaggagaagccttcaattggcgcgattatagctgttgggcctggtcctttggacgaggaagggaacaggaaaccactttcagtatcccctggaaatacagttctctactccaaatatgcaggtagtgaattcaaaggtgctgatggatccgattacattacactcagggcatctgatgtaatggccgtgctatcttagttggatatcgagtcaattattccgtgccaaaatttcactaaggtttaggaagaggaagctgcattcacatttcggcaaacactgcaaattaatgattaatgtcaagtgtagaatcaattttctgaacgcactccctttcttgatttgaggaatttttacccttctgggtatgtttgtatgttaaaagtgattgaaaactgcagattatgaattggaactgaattttttctgagcggccgcatga

SEQ ID NO: 1844 - DNA, 1159 bp, Nicotiana benthamiana
aaattctagaaacatcttatcttttgcagaaaaaccccctgccaaagtctctcttgaaccttctagggttttgttatcctcttcttaccaaacacacactatattttttcaacaacctaactacatcctctcactaccccagttgagaagaaaaagaagccttctgtttgactcctaattgaggaagaaatggcgaccactcagctaacagcatcatccatttgtgcaaacggttttgtatcctttgatgggcttaggtcaatgggtagtgtaaaggtcgcatcttttgccccattgaagcagaatagaaggtcttttcgtagtcttgttgttaagtctgctaccactgtagctcctaagtacactatgcttaagccgttgggcgatagagtattggtaaagattaagactgctgaggagaagactgtaggtggtatcctacttccagtaacagctcagtcaaaacctcaaggaggtgaggttgttgctgtcggggaaggtcgttcagctggcaagactaaagtggacattagcgtgaagacgggtgcccaagtcgtctactcaaagtatgctggaacagaggtggagttcgatggatcaaagcacctcattctgaaagaggatgatattgttggtgttcttgagacagatgatatcaaagatttgcagccgttaaatgacagagtcctaatcaaggttgccgaggctgaagaaaaaaccgcaggaggcttactgttgactgaggcagcaaaggagaagccttcaattggcgcggttatagctgttgggcctggtcctcttgatgaggaaggaaacaggaaaccactttcagtatcccctggaaatacagttctatactcgaaatatgcgggcagtgaattcaaaggcgctgatggatcggattacattacactcagggcatctgatgtaatggccgtgctatcttagttagatatcgagtcaattattccatgccaaaatgtcacgtaaggtttaggaagaggaagctgcattcacatttcggcaaacactgcaaattaatgattaatgtcaagtgtagaatcaattttctgaacgtgcttttcttttcttgatttgaggaatttttaccctttcgggtattttgtatgttttgtacgttaaaaggtgattgaaagta

SEQ ID NO: 1845 - DNA, 1058 bp, Capsicum annuum
cttttcttacccaccaccctctatatttctggtacaatcctatctaacctcactactactccacttgagaaaataaaataaaacatctcctaattcaggattagaaagaaatggcaagcactcagctaacagcatcgtccatttctggcaatggttttgcatcctttgaaggacttaggtccacttgtattgtgaagtccgcatcatttgcccctttgaagctgaacaacagctcttttcgtggtcttgttgttaaggctgccaccaccgcagcccctaagcgcgaaattagaggcctaatggattcaatcatttatcttttccgcgactttaaatacacttcgcttaagcctttgggtgacagagtgttggtaaagattaagaccacagaggagaagactgtaggtggtatcctacttccaataacagcccagtctaaacctaacagaggtgaggtagttgctgttggggagggtcattcagctggcaagaccaaagttgacattagtgtgaagactggtgccaaagtcatctactcaaagtacgctggaacagaggtggagtttgatggatcaaagcacctcattctgaaagaggatgatattgttggtattcttgagacagatgatgtcaaggatctgcagccattaaatgatagagtcctaatcaaggttgcagaggctgaagaaaaaaccgctggaggcttactgttgagtgaggcagccaaggagaagccttcaattggcacgattatagctgttgggcctggtcttcttgatgaggaagggaacaggaaaccactttcagtatccccaggaaatacagttctgtactccaagtatgcaggcaatgaattcaaaggtgctgatggatctgattacattacactcggggcacccgatgtaatggctgtactatcttgagttgttctcaccaaaattttcagtaagatctagaatggcggaagctgcattcaactttcgagtgaggagtaaaacacactgcaaattaatgattcatatcaagtgtagaatcaattttctgaacgtatttctgtt

SEQ ID NO: 1846 - DNA, 1111 bp, Petunia hybrida
taattgttgggggaagttctagaatcatcttatctttgcacaagaacccctccaaaaagtcctctcccgaaccttctagggtttcattatccattccattttcaacaacctaaccactcactcccttaaatcctcattctttcttactacagctcagaaaggaatggcaacaactcagctaactgcatcatccattggctttggatcctttgaaggacttaggtctacaactactgtaaaggttgcatctttaaagcagaataacagcaggtcctttcgtggacttgttgtcaaggctgctactgttgttgcccccaagtacactgctctcaagcctttgggtgatagagttctggtgaagatcaagattgcagaggaaaagaccgtgggtggtatcctacttccaacaacagcacagtcaaaacctcagggaggcgaagtcgtagctgttggggagggccgttcagttggccagaataaagtggacattagtgtgaagactggtgcacaagtcgtgtactcaaaatatgccggaacagaggtggagttcaacggaacaaatcacctcatattgaaggaggatgacattgttggtattcttgagacagaggatatcaaggatctgcagccgttgaacgacagagttctaatcaaggttgccgtggctgaggagaaaactgctggaggcttattgttgactgaagcagccaaggagaaaccttccattggcacggtaatagctgttggtcccggaccacttgatgaggaagggaacaggaaaccattatcagtatcctcaggaaatactgttttgtactccaaatatgctggcaatgaattcaaaggtgctgatggttctgattacattgctctgagggcatctgatgtaatggccgtgctttcatagttcgactgagccttccatacctcaagtttcaatggacctgcagagcctgcacaatacggattagactttttgctagtgtggaatgttttatcagaaaatgagtagtgccaaatgtagatgctaatttttgaactacgctatgctaccatgtggttcagtggtttaaatcccagtaaaaggtttttacttttcctaaaaaaaagc

SEQ ID NO: 1847 - DNA, 1319 bp, Nicotiana benthamiana
atcttatttttgcacaaaaccccctgtcaaatcccctctaggaatttctagggtttcgttatccacaatctcctccagtttctacaacctcaccacacatctcagtcctcactccctcctcagtccctactagaagatccttttcttcattgccatcactcctaattccttcctattacagctcagaaaggaatggcaacaactcagctaactgcatcatccatttctgtcaagggttttgcatcctttgaagggcttaggtccacaactactgtaaatgtcgcatctttaaagcagaacaggaggtcctttcgtggacttattatcaaggctgctactgttgtagcccccaaatacgcttctcttaagcctttgggtgatagagttttggtgaagattaagactgtagaggaaaagactgtaggtggtatcctacttccaacaacagcacagtcgaaacctcaaggaggtgaggttgttgctgttggggagggtcgttcagttggcaagactcaggtggacattagtgtgaagactggcgcccaagttatttactcaaaatatgcgggaacagaggtggagttcaatggatcaaatcacctcatcttgaaggaggatgacattgtcggtactctcgagacagatgaaatcaaggatctgcagcccttgaatgacagagttctaataaaggtcgctgaggctgaggaaaaaactgctggaggcttattattaactgaagcatccaaggagaagccttccattggcacggttatagctgtaggtcctggtccacttgacgaggaaggaaaccggaaaccactatcagtatccacaggaaatacagttctatactccaaatatgctggcaatgaattcaaaggtgctgatggttctgagtacattgcattgagggcatctgatgtaatggctgtgctgtcatagataaattgagccattcattccaataccaaaaactccaatggacgttcagggcatggaagaaagttaccttcacattgtggagtagaacttttgcaagttagtgttaagtgttctatcaaaaatatgattagtgccaaatgcagtatctaatttttgaactacattctgcaaccaagtgatgcagtgttcgaatctaagtattagtggtcttttcttcccctcttcttttattcagggtttagaacccaatttattaagggacaaaatcgcacctctctttaattttgtttgcagatattcccatggaagaatcaagacaattgccaaaaagggaaactgatttctgaccataaattaaatttttatacattagaatt

SEQ ID NO: 1848 - DNA, 1032 bp, Nicotiana benthamiana
agggttttgttatcctcaaaaggctctacgaattctatcttcaacactctaaaaaacacacacttgagtcactcagtctgtagtagataatacttcttctttgtcatcagttcaacctctttaaagaaagcaatggcgacaactcagttgactgcatcctccatttctgctaaaggttttgcttcctttgaagggcttaggtcaactagtaatgtgaaggttgtatcttttgctccgttaaagaagaatagcaggttgtctcgtggtcttgttgttaaggctgcaactactgttgcccctaagtatacttcagttaaacctctcggtgatagagttctagtgaagataaagactgcagaggagaagagtgtaggtggtattttgcttccgacatcagcacaatcaaagccacaaggaggtgagattgttgctgttggggagggtcgttcaattgggaagactaaagtggaaattagtgtgaagaatggtacccaagtgctgtactcaaaatatgcgggaactgaagttctgtttgatggatcaacacacctgatcctgaaagaggatgacattgttggtattcttgagaccgatgatatcaaggatctgcagcccttgaacgacagaattttaatcaaggtggctgaggttgaggaaaaaactgctggaggattgtttttgagcgaggccgcaaaagagaaaccttcaattggctcggtaatcgctgctggaccaggtcctctcgacgacgaagggaaccggaaatcgctttcagtatcaccgggaaatacagttctgtattccaaatatgcaggcaatgacttcaaaggtgcagatggcgccgactatgtaacactaagggcatctgatgtaattgctgtgctttcatagatgaattatatgacaagctattcattctcatacctatgttcgcgcggtgtagtgtagagaagaagagaatgatgtaacacttttgaataaaacttttgttaattaatgattaatatcaaagtgtagaatgcaatattagat

SEQ ID NO: 1849 - DNA, 1080 bp, Nicotiana benthamiana
gaacttcctagggttttgttatcctcaaaaggctctacgaattctatcttcaacactctaaaaacccacacctcagtcactcagtctgtagtagataatacttctttcccagtaaagctcagaaagcaatggcgacaacgcagttgactgcatcattcatttctgctaaaggttttgcttcctttgaagggcttaggtcaactagtaatgtaaaggttgtatcttttgctcctttaaagcagaataacaggttgtctcgtggtcttgctgttaaggctgcaactactgtagcccctaagtacacttcagttaaacctctcggtgatagagttctagtgaagataaagactgcagaggagaagagtgtaggtggtatcttgcttccgacatcagcacagtcaaagccacaaggaggtgagattgtcgctgttggggagggtcgttcaattgggaagactaaagtggaaattagtgtgaagaatggtacccaagtgttgtactcgaaatatgcgggaactgaagttctgtttgatggatcaacgcacctgatcctgaaagaggatgacattgttggtattcttgagaccgatgatatcaaggatctgcaacccttgaacgacagaattttaatcaaggtggctgaggttgaggaaaaaactgccggaggattgtttttgagcgaggccgcaaaggagaaaccttcaattggctcggtaatcgctgctggaccaggacctctcgacgaggaagggaacaggaaatcactttcagtatctccgggaaatacagttctgtattccaaatatgcaggcaatgacttcaaaggtgccgatggctccgactacgtaacactaagggcatctgatgtaattgctgtgctttcatagatgaattatatgacaagctattcattctcatacctattttcgcgcggtgtagtctagagaagaagagaatgatgcaacacttttgaataaaacttttgttaattaatgatgaatgtcaaagtgtagaatgcaatattagatactgttattttcttatatatcttaaagtttgcagaaatctcaagtttttgat

SEQ ID NO: 1850 - DNA, 1203 bp, Solanum tuberosum
ccacgcggtgggcggcgctcctaaactagtgatcccccgggctggcaggtaacagctctacacattttatcttcaaacagtctaaaacacaccccttattcactcctcactccatagtagagaaaacctctccattgctaccagtcaaaccaattttgccaataaagaaaggaatggcgacaactcagctgaccgcgtcatccatttctgccaagggttttgcatcctttgaggggcttaggtccacaagtaatttaaaggtttcgtctttcgctcctttaaagcagaatagcaggtcgtttcatggacttgtcgttaaggcttcaacagtcgtatcccccaagtacacttcactcaaaccattgggtgatagagttctggtgaagattaagactgcagaggagaagagtgtaggcggcatcctgcttccaatgtcagcacagtcgaagccacaaggaggcgaggttgttgctgttggggagggtcattcaattggcaagactacagtggaaattagtataaagaatggtacccaagtgctgtactcgaaatatgcgggaaccgaactggagttcgatggatctaagcacctgattttgaaagaggatgacattgttggtattcttgagacagatgatatcaaggatctgcagcccttgaatgacagagttctaatcaaggtggctgaagttgaggaaaaaactactgggggattgtttttgagccaggctgcaaaggagaaaccttcatttggcacggtgatagctgttggacctggtcctctcgacgaggaagggaaaaggaaagcactttcagtatctcctggaaatacagttctgtattccaaatatgctggcaatgacttcaaaggagctgatggttcagagtacatcacattgagggcatctgatgtaattgctgtgcttcagtagatgttttgttatatatataacaaggcagttcattctcataccagtattttgcagtgtagtatagcaaagaggagaatgttgtaaccattttggaataatacttttgcaaattaatgatcaatatctagtgcagaatccagttctggaagtgccttttcttgtttagtttgcagaagtcaagttttcgttcctggactgtaagatgcttaatgtaccagactgtcccaaccgaagttgagaccaatcaatgtgggatgtttagtgcaaaaaa

SEQ ID NO: 1851 - DNA, 1022 bp, Solanum phureja
gttatccttaacagctctacacattttatcttcaaacagtctaaaacacaccccttattcactcctcactccatagtagagaaaacctctccattgctaccagtcaaacctattttgtcaataaagaaaggaatggcgacaactcagctgaccgcgtcatccatttctgccaagggttttgcatcctttgaggggcttaggtccataagtaatttaaaggtttcgtctttcgctcctttaaagcagaatagcaggtcgtttcatggacttgtcattaaggcttcaacagtcgtatcccccaagtacacttcactcaaaccattgggtgatagagttctggtgaagattaagactgcagaggagaagagtgtaggcggcatcctgcttccgatgtcagcacagtcgaagccacaaggaggcgaggttgttgctgttggggagggtcattcaattggcaagactacagtggaaattagtataaagaatggtacccaagtactgtactcaaaatatgcgggaaccgaactggagttcgatggatctaagcacctgattttgaaagaggatgacattgttggtattcttgagacagatgatatcaaggatctgcagcccttgaatgacagagttctaatcaaggtggctgaagttgaggaaaaaactactgggggattgtttttgagccaggctgcaaaggagaaaccttcatttggcacggtgatagctgttggacccggtcctctcgatgaggaagggaaaaggaaagcactttcagtatctcctggaaatacagttctgtattccaaatatgctggcaatgacttcaaaggagctgatggttcagagtacatcacattgagggcatctgatgtaattgctgtgcttcagtagatgttttgttatatatatataacaaggcagttcattctcataccagtattttgcagtgtagtatagcaaagaggagaatgttgtaaccattttggaataatacttttgcaaattaatgatcaatatctagt

SEQ ID NO: 1852 - DNA, 2581 bp, Solanum lycopersicum
atccctttgtatacacacatctcatttactcaattttcccaaataaagctcagaaagaaatggtaacaactcaaatggcagtatcatccccatatagctgatgatgaaccaaatgatccctaaacgtaaagaatttccgctatgttaacatgttacagtaggttattaatgtttgccttttagtttaacctcattgtggaaaacgtcagtgtataaaagttaaacttttgctgaaaatcggttaattgtatcaggtattagccgttggtcccggtcctcttgatgaggaaggaaacaggacattactttcagtatcccctggaaatacagttctgtattccaaatatgctggaaatgacttcaaaggagttgatggctctgactatatcacattaagggcatctgatgtaatggctgtgctttcatagatgattatattcgatcgaagaagaatgattagagagaacatgacaaatcttctgctcatgaccctaaataggagatcatgaaggtcgatgatcagaaatgaatggatagaatgttagtaatagaatgttagtagatagttgagtgattttttttccccctattattgttattatcttattcttcatttttattaatcaatctttgtttcttttttctttggttaccttattatttgtattgtcaacattttttttctttcttagtattttgtttgagcttctttaaagtcgtgatttatcaaaaataacttttctacttcgttcaaggtaaaagtaaggtctgtgtagcgttaaacttttactatggaattacactgaatacattggttgatatgttcattcaaaagtaaataatgaataaaattgtgtatttacgtaaagatctttttgtttgatgatgttgatgcagcggaataaatatttagtagtaaggttgtttccgatattgccaataacgaaggagatataatcaaatacaaaatacataaaacattttaactttgaaaaatctattcaaatgttaaacatatttaatatgatgatttttttaaaaaaaaagaaattaggtttcaagtgagtcttagaatagtagttctttgttagattaataaatgtatctctaaattcaaagtaaatttttaccacgttatttttttttaataagatatttctacaatagttgttaaagctccgcttctacgattaggtcattagaaaaagaacaatagtgtgaactatcaagtatgtatcaccgaattcaaaacaagttattttttcaacaagatttttcaacaatagttggtaaagctcgcgtttactattaggtcagtagaaaacgaacaatagtgtcaactatcaagtataattcaagaagtggaatacgaggtagagatattattttcgatatatggacttcttttttctttgaaatttgaaaaaacaaataaaaaagaaaaggaagtccctcttagaaacttctagggttttgttatccttaacagctctacacattttatctacaatagtctaaagtctaaacacacaccttcagtccatagtagagaaaacctctccattgctattaaggctcatcaattttgccaataaaggaatggcgacaactcagctgaccgcgtcatccatctctgccaagggttttgcatcctttgaggggcttagatccataagtaatttaaaggttgcgtctttcgctcctttaaagcagaatagaaggtcgttccatggactcgtcgttaaggcttcaacagttgtatcccccaagtacacttcactcaaaccattgggtgatagagttctggtgaagattaagactgcagaggagaagagtgtaggcggcatcctgcttccagtatcagcacagtcgaagccgcaaggaggcgaggttgttgctgtcggggaaggtcattcaattggcaagactacggtggagattagtataaagaatggtacccacgtggtgtactcgaaatatgcgggaactgaactggagtttgatggatcaaagcacctgattttgaaagaggatgacattgttggcattcttgagacagatgatatcaaggatctgcagcccttgaatgacagagttctaatcaaggtggctgaagttgaggaaaaaacttctgggggattgtttttgagccaggctgcaaaggagaaaccttcatttggcgcggtgatagctgttggacccggtcctctcgacgaggaagggaaaaggaaagcactttcagtatctcctggaaatacagttttgtattccaaatatgctggcaatgacttcaaaggagctgatggttctgaatacatcacattgagggcatctgatgtaattgctgtgcttcagtaaatgttttgttatttatttaacaagtcagttcattctcataccagtattttgcagtgtagtatagaaaagaggagattgttgtaaccattttggaataaaacttttgcaaattaatggtcaatttctagtgcagaatccagtctggaagtgccttttcttatttagtttacatatcctgctgtaagatgcttaatgtaccaggctgtcttatcaaagttaagac

SEQ ID NO: 1853 - DNA, 1196 bp, Tabernaemontana elegans
tctagggttttgttatccattccttcactcttctcatccatttctaacccccaactcatccgctccccaggcagcagtatcctctcgtcattcagtctcctctgctgtccttacaaccataaatggcaacaactcagctcacagcatcaacaatctcagcaaaggggtttgtgtcattcgaagggcttagagcttcatcgagcaatgtcaaaatcttgtcttttgcacccttgggtcagaatggtgtttcgaagagattgttccgaggccttgttgtcaaggctgcgaccactgtggctactaagtacacatcattgaaacccttgggtgatagagtgctcgtgaagatcaaggttccggaggacaagactgtaggtggtatcctattgccgactagtgcacaaaccaaacctcaaggaggtgaggtggttgctgtgggagagggccgcactgttgggaagaccaaggtggacatcagtgtgaagactggaacccaagttgtatactctaagtatgctgggacagaggttgaattcaatggagcaaatcacctcatattgaaggaagatgacattgtgggtattcttgatactgatgatgttaaagacatgaagcctttgaatgacagagtcttgataaaggttgctgaagctgaagaaaaaacagctggaggtttgttgctgacagaagcttccaaggagaagccctccattggcacggtgatagctgttggccccggacctcttgacgaagaaggaaacaggaagcccttgtcagtatctccaggaaacacagtgttgtattccaaatatgctggcaatgacttcaaaggcaccgatggttcagagtacattgcactgagagcatctgatgtgatggctgtgctatcctaaatagtgaggccaattactgtgtctttttggttaatagggaaaaatcgaagcaattaaaacacaaggacagtgatctgatcacatcaatatatttttttgtgagaaaattattattgcttctagtgcatgacgtgatattctgtaatttggtgaactgctgttattccctctatctcccatccccggaccaaagggaaaggacgttttgggttgtgcactaaaatcattgtcactcgatgaaaagatgagatcgctccaaatgcatgtaactgaacgttgttctttcatggtgattctagatat

SEQ ID NO: 1854 - DNA, 986 bp, Amsonia hubrichtii
cttatccatttcattgctcttctcctcctttgcttacacccacccctcacaatcccattcctacaccggtattcactcatcattgactctcctctgctcttccacttactgtccaccaaatctctctcgcaaccataaatggcaacaactcagctcacagcatcaacaatctctgcaaaggggtttgtgtcgttcgaagggcttagagcttcatctggcagtagcaaaatctcgtcttttgcacctttgggacagaatggcctttctaagagattgttccgtggtcttgttgtcaaggctgccactactgttgctcctaagtacacgtcgctgaagcccttgggtgatagagtgctcgttaagattaaggttcccgaggaaaagactgtaggtggtatcctattgccaacaactgcacaatccaaacctcaaggaggtgaggtggttgcagttggagagggccgtagtgtggggaagaacaaggtggacatcagtgtgaagactggaagccaaattgtatactccaagtatgctgggacagaggttgaatttaatggagcaaatcatctcatattgaaggaagatgacattgtgggtattcttgataccgatgatgtgaaggacatgaagcctttgaatgatagagtcttgataaaggtggctgaggctgaagaaaaaacagctggaggtttgttgctaactgaagcctccaaggagaagccctcaattggaacggtggtagctgttggtcccgggcctcttgacgaggaaggaaacaggaagcccccgtccctatctccaggaaatacagtgttgtattccaaatatgctggtaatgactttaaaggtagcgatggtacagattacattgcactgagagcatctgatgtgatggccgttctgtcctagtagtgtagtggatccctaaatgtttttttggtttatagggaaaactgaatcaatttaagcatgaggacagtgatttg

SEQ ID NO: 1855 - DNA, 1183 bp, Sarracenia psittacina
acatttctagaactttctagggttctatatcttcaacttcgtcttctccatttccaacgttgctctgtaaaactccttttactctctccagcgaaagctcttcaatttcttcaatctcggtaggagaaaaaggatctgtcaaggaatggcgactgctcagttgagtgcatcatcaatttcggctaggaatttgccgcaattcgaagggctcagaccctcaatagtcaaggtctcgtcggttactcctttgaggcaaacggggcttagcctcaggtccttccgtggtctcgtcgttaaagctgccactactgttgcccctaagtatactaccctcaagccattgggtgatagagtattggtgaaaattaagactgctgaggagaagaccgtgggcggcatcttacttccaacatcagcacaatcaaagcctcaaggaggtgaagttgttgctattggagagggtaaaacaattggaaagagtaaagtagacatcagcgtaaagcctggtgcccaaattgtgtattccaagtatgcagggactgaagtggagtttaatggatcaaaccatctcatactaaaggaggatgacattgttggtatcctagagacagatgatgtgaaagatttgaagccattgaatgatagagttttgattaaggtcactgaggcagagcagaaaactgctggagggttgttactaacagaggcaagcaaagagaaaccttccattggcacagtgattgctgtagggcctggtcccctggatgaggaaggtaaaagaaaagcgttatcagtttctgcagggaacaccgtactgtattcaaagtatgcaggaaatgagttcaagggtgctgatggttcagactacattgccctcagggcatcagatgtcatagctgcgctttcttagttgactacttctggccgcatgttttggctgctccttttttccttgtcacatgatttttaactcaccatgaaacgtgaatgagttcattgctctctgtaccaacacttttggggagcagttataagttgaagtgtgtgaatgtagtggaaacttttgggcattttcttgttatatctatgtttgttttcaatttggtgctatgcactaaaggcccttgatagccccgaatgacttatgagttgatccaactcgatttccatggattgaattgtt

SEQ ID NO: 1856 - DNA, 1104 bp, Solanum tuberosum
ttcttccggcacgagggtgtgccaattactcaattctttaattctttctcttcatctccggcgccaccacctccgccacccgccgtaaaatatatatttttagtcagttttcaaaattaaacaatgcttgtctctgtttttctcgctctgtttcttccttgtgttggaatgagcgctgttttcttagtctacatctgtttactctggtacgctgctgcttaccagtctgccggccctggcgctgaaaattaccataatgaaaagacgaatcaggaattgggtctttctgctgctcaattggacaaactaccgaaaattactgggaacgaattggtaatgggtaatgattgtgcggtgtgtttggatgaaattgagaacgagcaaattgctcgagttgttccgggttgtaaccatggatttcaccttgaatgtgctgatacttggctttcgaaaaatccgatttgtccggtttgtagaactaaactggagccggagttcttcaatccacctgaaagtaacccatgttgaagaaattcataattaaaattatttcaactttatttttattaatgcttgatagattataggagtagtttgatataattggtgttgaatcgtattaatatttttttttccgtttaattctgaatctgggtggtggatgttgttatgagaaatagcttaattgaatcaagtacagtttcttgaaaaaaacaccaatgacagggtagttatcaaggacgaattgagaagatggtccagaagcagagaggtacaagcagagatgaggagcacagaaaatgtggaggcagaatcctgagaactactctacacatgagacacttaacgtgatagattttcctaattagcgaagacaagaaagattgggattgcctgatcacggcattttctgccttttaacacccgctgtttgaactgttagttctagttactgagacctggcaactctcatcctatgtgaagtcgcggccgtggtgagggagggcccagtagatatagtctccccgtttctgtggcccaaagaggagactcttttttgaaacaccaatctgcggtgttggagcttcctgttagaaaaagggg

SEQ ID NO: 1857 - DNA, 711 bp, Solanum phureja
ccctctgcagcatggtgtgccaattactcaattctttaattctttctcttcttcgccggcgccaccacctccgccacccgccgtaaaatatatatttttagtcatttttcaaaattaaacaatgcttgtctctgtttttctcgctctgtttcttccttgtgttggaatgagcgctgttttcttagtctacatctgtttactctggtacgctgctgcttgccagtctgccggccctggcgccgaaaattaccataatgaaaagacgaatcaggaactaggtctttctgctgctcaattggacaaactaccgaaaattactgggaaggaattggtaatgggtaacgattgtgcggtgtgtttggatgaaattgagaacgaacaaattgctcgagttgttccgggttgtaaccatggatttcaccttgaatgtgctgatacttggctttcgaaaaatccgatttgtccggtttgtagaactaaactggagccggagttcttcaatccacctgaaagtaacccatgttgaagaaattcataattaaaattatttcaactttatttttattaatgcttgataagattataggagtagtttgatatgattggtgttgaatcgtattaatatttttttttccgtttaattctgaatctgggtggtggatgttgttatgagaaatagcttaattgaatcaagtacagtttcttgaattt

SEQ ID NO: 1858 - DNA, 716 bp, Solanum melongena
ctctgcagcatggtgtgccaatttcttaattttttaattctttctctcctccgccgccgccacctcctccgccacccgccgtaaaaaaaacttttccgttctccgaaaatacccaaaaaattcaaacaatgcttgtctctgtttttctcgctctgtttcttccctgcgttggaatgagcgctgtttttttagtctacatctgtttgctctggtacgccgccgctcaccagtccggtccagagaattacccgaacccggtgaagacgaatcagcaagtgggtctttccgctggtcaattagataaactcccgaaaattactgggaaggaattggtaatgggtagtgattgtgcggtttgtttggatgaaattgaaaacgagcaaatggctcgggttgtacccggttgtaaccatgggtttcatcttgaatgtgctgatacttggctttccaaaaatccaatttgccctgtttgtaggactaaactggagcctgagttctttaatccgcctgaaagtaacccatgttgaagaaaaaaactaaaccaatttctgctgtaaaagttctaaattattcaacttttttagattacaggagtagtttgagatgatgggtgtttaaatttaatcgtattttttggaatttaattctgaattttgggtggtgggtgttgttatcagaaaaaatagcttaattacgtcaagtacagtttcttggct

SEQ ID NO: 1859 - DNA, 731 bp, Petunia hybrida
tttgccaattcctccaaaatattctttaattctttctcttcttcaccatcgccaccaccttcagcaccctccttaaatatatactcacgtacaatcgttttcatatacttacaacaacaacaacaacgtacccactgtgaaaatgctggtctcagtatttctcgctctttttctaccttgcataggaatgagcgcagtttttctagtgtacatatgtttgttgtggtacgctgctacgtaccaaactgctggagcagctgcaggaaactaccaaaacgacgcgatcaagccaaatcaagaaaatggtttatcagcagcacaattagacaaactcccgaaaattacagggaaagaattagttatgggaaatgattgtgcggtgtgtttggatgaaattgaaaatgagcaatttgctagagttgttccaggttgtaaccatggatttcacttagaatgtgctgatacttggctttcaaaacatcctgtttgtcctgtttgtagaactaagcttgaacctgagttctttaatcctcctgaaagtaacccttgttaaaaagttaagcaatctctgctgtaaacttttctaatttattttaatgattgataggagtagtggtcatttcatgtaggttgaaatgatggtgtttaatttttacttctttttttaatttgtttaattctgaatcttgggtggagggtgttgtaatgagaagagtataattcaatcagta

SEQ ID NO: 1860 - DNA, 597 bp, Nicotiana tabacum
ggcagcatggtgtgcaaattactcaattctttaattctttctcttctccgacaacgccaccacctccgccaccctccttaaaaccttaaaaaaaaaccaaaaattctttaacaacaatgcttgtctctgtgtttctcgctctgtttcttccttgtgtaggaatgagcgccgttttcttagtctacatctgtttgctatggtacgccgccagctaccaatccgccggtgccggtactggaaattacacaaatgaccctgtgaagccgaaccaagaaaaaggtctgtccgctgctcaattagataaactaccaaaaatcacagggaaagaactggtaatgagcaatgattgtgcggtgtgtttggatgaaatagagagcgagcaatttgctagggttgttccaggttgtaaccatggatttcatttagaatgtgctgatacttggctttccaaaaatccagtttgtccagtttgtagaacaaagcttgagcctgacttctttaatcctcctgaaaacaacccttgttaaacaaatttaagcaatctctgctgtaaaatctctttatttttcttgtcttaataggagtagtatttattcc

SEQ ID NO: 1861 - DNA, 701 bp, Nicotiana benthamiana
gcagcatggtgtgcaaattactcaattcttttattctttctcttctccgacaacgccaccacctccgccaccctccttaaaaccttaaaaaaaacagaaacaaaaattatttagcaataatgcttgtctctgtgtttctcgctctgtttcttccctgtgtaggaatgagcgccgttttcttagtctacatttgtttgctatggtacgccgccagcaaccaatccgccggcgccggtactggaaattacacaaatgaccctgtgaagccaaatcaagaaaaaggtctgtccgctgctcaattagataaactaccaaaaatcacagggaaagaactggtaatgagcaatgattgtgcggtgtgtttggatgaaatagagagcgagcaatatgctagggttgttccaggttgtaaccatggatttcatttagaatgtgctgatacttggctttctaaaaatccagtttgtcctgtttgtagaactaagcttgagcctgacttcttttgtcctcctgaaaacaacccttgttaagcaaatttaagcaatctctgcagtaaaatctctttatttttcttgtcttaataggagtagtatttatttcatatagatttaggttatggttgttttttccttcttttttttcttccttaaatctgaatcttgggtggtgggtgttgttatcagaagagcttaattcaatca

SEQ ID NO: 1862 - DNA, 629 bp, Nicotiana benthamiana
gcagcatggtgtgcaaattactcaattctttaattctttctcttctccgacaacgccaccacctccgccaccctccttaaacctttaaaaaaaaccaaaaattatttaacaacaatgcttgtctctgtgtttctcgctctgtttcttccctgtgtaggaatgagcgccgttttcttagtctacatttgtttgctatggtacgccgccagcaaccaatccgccggcgccggtactggaaattacacaaatgaccctgtgaagccaaatcaagaaaaaggtctgtccgctgctcaattagataaactaccaaaaatcacagggaaagaactggtaatgagcaatgattgtgcggtgtgtttggaggaaatagagagcgagcaatatgctagggttgttccaggttgtaaccatggatttcacatagaatgtgctgatacttggctttccaaaaatccactttgtcctgtttgtagaactaagcttgagcctgacttctttaatcctcctgaaagtaacccttgttaaacagatttaagcaatctctgctgtataatctctttatttttcttgtcttagtaggagtagtatttatttcatatagatttaggttatggatgttttttcgttct

SEQ ID NO: 1863 - DNA, 1053 bp, Capsicum annuum
cccaggtgttaatttaaactcatttattaatttcaacaaatttttttctcttctttcatccaaacactgccttatttccccctatataaataactcatcttcccttacaactctttctcctgcagcatggtgtgccaattactcaattctttaattctttctcttcttcaacaacgccaccaccttcaccaccctccttaaatttatttttaacgaaaactttggtgcatcgcgcaaaaagatttctcaaatttacaacgaaaactttaatacaccgtgcaatcaacaatgctggtctcggtattcctcgctcttttccttccatgcgttggaatgagcgcggtgttcttagtttacatctgtctactctggtacgctgcagcgtaccagaattccggggccactggacccggacaagacccagtgaagacgaatgaacagaaaggtcttaacgaggcacaattagataaattaccaaaaattactgggaaagaattggtaatgggaaatgattgtgcggtgtgtttggatgaaattgagaatgagcaaattgctagaattgtaccaggttgtaatcatggatttcatgttgaatgtgctgatacttggctttcgaaaaatccaatttgtcccgtctgtaggactaaattggagcctgagttctttaatccacctgaaagtagtagcccatgttgaagaaaatgaggattaaagatgtaaaacatttgatttatttttatgtctgacaggttaagaggagtagttaattagtcatttcatatagattgggattattatgggtgtttaaattttgttggtttgattttggatcttgggtggtggggtgttgttatcagaaatagcttaagtcaatcaagtacagtttcatatatttctattgcttgtgttcttcatttctgatttggtaccattgttgaagttttggggactagcttaaaaaaaataaaaaaaaatatctgagcttccaccatttttgttattttagtgatttcgcaactcaaaattaaagatgaaaggtgcttattattcgag

SEQ ID NO: 1864 - DNA, 733 bp, Capsicum annuum
ttctcttcttcaacaacgccaccaccttcaccaccctccttaaatttatttttaacgaaaactttggtgcatcgcgcaaaaagatttctcaaatttacaacgaaaactttaatacaccgtgcaatcaacaatgctggtctcggtattcctcgctcttttccttccatgcgttggaatgagcgcggtgttcttagtttacatctgtctactctggtacgctgcagcgtaccagaattccggggccactggacccggacaagacccagtgaagacgaatgaacagaaaggtcttaacgaggcacaattagataaattaccaaaaattactgggaaagaattggtaatgggaaatgattgtgcggtgtgtttggatgaaattgagaatgagcaaattgctagaattgtaccaggttgtaatcatggatttcatgttgaatgtgctgatacttggctttcgaaaaatccaatttgtcccgtctgtaggactaaattggagcctgagttctttaatccacctgaaagtagtagcccatgttgaagaaaatgaggattaaagatgtaaaacatttgatttatttttatgtctgacaggttaagaggagtagttaattagtcatttcatatagattgggattattatgggtgtttaaattttgttggtttgattttggatcttgggtggtggggtgttgttatcagaaatagcttaagtcaatcaagtacagtttcatat

SEQ ID NO: 1865 - DNA, 2335 bp, Sorghum bicolor
gtataaatatcacaattctggtcgcttcatacacaacaatgcaactaaatcaaaacacaacgcccatagaaactaagcatagagaaatagcgccaacaaattaaatgggcccttttcacatccccagtacaagtggtcctcgcaagttttatcaccttgtgctcttccatgtgcacccgttctggatccaactcttgtacttcctttccatctccgtcttgggtttcttgatgctgagagctctgcccatgaagtccatctccgtccctaggccctcggctctcgacctagtcttcacgtccgtgtcagcgacgacagtctccagcatggtcgccgtcgagatggaatccttctccaactcccagctcctcctcatgaccctcctgatgctcctcggcggcgaggtgttcacaagcatgcttggtctccacttcaccttcaccaagttcatcaagaagagagaaatacctcatagtaataataatagtctccatggtaatatcaatggaccggcaccggcggcacctagtagcttagagcacggtcaccgtcgccgtcccatggagatggaagcccaggccgccgccgtccaaatggagctagcagggttcaacaacgacgaccaacgtgattttgcatccatagctaggctgctaatgttcatcgtgcttggctacctctcggtggtgcacctcgccggctacacgctcattctaatctacctcagcgtggtcggcagcgcgagagaagtgctggtcggcaagaggatcagcctgagcaccttctccgtcttcacggtcgtctcgacgttcgcgaactgtggcttcgtgccaacgaacgaggggatggcgtccttcaagtccttcccgggcatgctcctcctcgtcatgccacacatcctcctcgggaacacgctcttccccgtcttcctcaggctctccattacagcgctcgagagggtcaccaggaggggagacctccgcgagctgctgagggacggaggacccggcggcggcggcggcggcggcggcggaccagctgctgctgctataggctacgaccacctgctgcccggaggccgcacatggtgcctggctctcaccgtggcggtgttcctggcggggcagctgctgctctactgcgccatggagtggggctccgatgggcttcgagggctcaccgcgttccagaagctcgttgccgcgctcttcatgtccgtcaactccaggcactccggcgagatggttgtcgacctcgccaccgtgtcgtccgccatcgtcgtgctctatgtgctcatgatgtatctaccgccttacaccacatttttacccatagcgatggaagaccaccagcagcagcaaaatgaggcacaatccgacgacaagagcaagagcagcagcagtattagcatctggcagaagctgctcatgtccccgctctcgtgcctaaccatcttcatcgtcgtcatctgcatcaccgagcgccggcagatcgctgacgacccaatcaacttcagcgtcctcaacatcgtcgtcgaagtcatcagtgcgtatggcaatgtgggattcagcaccgggtacagctgcagcaggcaggtgacgcccgacggcagctgcagggacgcgtgggttggcttctccggcaagtggagcagggaagggaagctcacgctcatggccgtcatgttctacggcaggctcaagaagttcagcatgcatgggggtcaggcatggaagctaggctaaatcaaagtgtcaagatgacgtagcaggagctgcgggaggatttgaaaggagacgttggcaggaacggttggcgagtgcagagtgtggtcaccacgcgcacgtcgtcgctctgtgtgagcaatttgttttagccgacatgtatcttgttatttcaaattgtgttgtgtaaccaggtgtttccactaatggtataagtagtcagatgtaataggtgtgagttagcgcctgtgatatatttgtaatcgtgtgaacattcagttgccaaggtgaaaaggggagccgacaccctgtcgccctcttgtgttcatctgctgttcctcatccactattcatgcatgaattcaattgttaggcttagccaccatgataatcgtgtgtgattgttgatcctctgcttacatttggtatcagaaccaaacaaatcagcacgaggcgttgcgttgatctaccatgggagatcggggaaccggaggcaatggcggacggatccattatccagcactcacctccaccaactatactagttggagcatctgagtccaggcaattatggaggatcagggcgtataggaggtggttgagctagtggc

SEQ ID NO: 1866 - DNA, 2389 bp, Zea mays
tccgatgtctcgactctcgctcatttccgcgtataaattgcacaaataattctggcggattcatacacagcaaataaatcaaaatgcaacgctccccacagaaactaagcaaagaaatagcgccaacaagttaaataatgccccctttgcacgtccccggtagtagtactcctcgcaagttctatcacctggtgctgttccatgtgcacccgttctggatccaagtcctgtacttccttttgatctccgttttgggtttcttgatgctgagagtcctgcccatgaagtccagctccgtgcctaggccctcggctctggacctactcttcacgtcggtgtcggcgacgacagtctccagcatgatcgccgtcgagatggaatccttctctaacgcgcagctcctcctcatgaccctccttatgctcctcgggggcgaggtgttcacaagcatgcttggtctccacttcacctgcaccaagctcagaaacaagagagaaacacctcataataatctccatggtaatagcttagagcagagtcgtcgtcgtcaccgtcccatggagatggaagcccaggccgccgccgtccaaatggagcttgcagggttcaacaaggacggccatggcgatttcgcatccatggctaggttgctaatgtttatcgtgctgggctacatcttggtcgtgcacatcgccggctacgcgctcattctaatctaccttagcgtggtcggcagcgcgagagcagtgcttgttaggaagaggatcagcctgagcaccttctccgtcttcacggtcgtctcgtcgttcgcaaactgtggcttcgtgccaaccaacgaggggatggtgtccttcaagtccttcccgggcatgctcctcctggtcatgccacacatcctgctcgggaacacgctcttccccatcttcctcaggctctccattacggcgctcgagagggtcacaaggtggcgagacctctgcgagctgctgagagacagaggacccggcggcgggccagctgcggctgccgccgccgccgctataggctacgaccacctgctcccgggaccgcgcacatggttccttgctctcaccgtggcggtgttcctggcggtgcagctggtgctctactgcgccatggagtggggctccggtggccttggagggctcaacgcgttccagaagctcgttgcagcggtcttcatgtccgtcaactccaggcactccggcgagatggtcgtcgacctcgccaccgtctcctccgccgtcgtcgtgctgtatgtgctcatgatgtatctaccgccttacactacatttttaccggtagcagtggaagacgaccagcagcagcaaaatgaggcacaaccccacgacaatagcacgagcaagagcagcacaagtattagcatctggcacaatctgctcatgtcgccgctctcgtgcctaaccatcttcatcgtcgtcatctgcatcaccgagaggcggcagattgctcgtgacccaatcaacttcagcgtcctcaacatcgtcgtcgaggtcatcagtgcgtatggcaacgtgggattcagcaccgggtacagctgcagcaggcaggtgacgcccggcggcggctgctgcaaggacgcgtgggttagcttgtccggcaagtggagtgtggaagggaagctcacgctcatggccatcatgttctatggcaggctcaagaagttcagcatgcttgggggtcaggcatggaggctgaactgaaccgaagtactatttcgaaactcgctcgatcaacctgatctccaggactccaagactagtacttgaattctcagtctattcagacggaaccggatcatatgacaaatccatctgcgaggagtttggctgcattctgtaaagtcggtaggggcaaggggttgttcatatcctttttatttaaaaataaaaaatagttttatatctcgacttttgaaaattatattttgaggtgtctgtcacccaggggacggcagggagttaaatgtaatttttaataaataggttctcgtcgctcactcactcattacgggcttattcggttattttcaatctatatggattgtacgagattgatacggattggaaaaaattttgatttactagggattaaaactctctcaatctccattaatccatataaattagagtagaaccgaacaagtctacatgggtgccagcgtacctttcgcttggtggggaaggtgacaaggtagtaacatcatttgtgaaagtatagatggccaaacaggccagcacggcccgacccggcacggcctgccaggcccggctagcaaagcgtaccgtgccagatgggccggcgtgccgctgccgcggcccaggcacaaccctatataattgtgggg

SEQ ID NO: 1867 - DNA, 1137 bp, Sorghum bicolor
taatcttccgttcccctctcctcccctttctgacttccgagagcacctcaccggcgccccctcccgtgctgccccttcccgagccgccgtcgcctagctgccccctccccagcgcgccacccgtctgcacaccgccgccctcgccgcgcctgcacatcggcgcctggaggacgagaagcgaggaagaagaccccagcctcgcctgaaaacgcatcccaagacttcaacctccctttccggccggagatccgcctcgcatctccgcgacagatccgggcaaacggcggctgatgcagttcttcggcggctcgtcgctgacgtcggtcgcgccggaggcgaccccagccccggcggcgccccccggcacgggcacgggcgccagcgcgcaggtcctctacgtcttcaaccgcaacggcgtctgcctgctctaccgcgagtggcaccgcccgctccgcacgctcgaccccacccaggaccacaagctcatgttcggactcctcttctcccttcgctccttcaccgccaagatcgacccaaccacggctgagaagggaaatcttggcgtgccactactgccaggccaaggttgttcgttttatagcttcaagacaaacacatacaaactgaacttcatggagagcccttctggtataaagcttatactaattacacatccaaggactggtgatcagcgagactcgctaaagcatatctacaatctatatgtggaatatgttgtaaagaatcctttgtatgctcctggaacaccaatcaagtgtgaacttttcaataaacatcttgatcaatacgtgagaacattaatttgatgtcgttgagactatgggttggtgaggcattagggaaaaaaagggaccatttcatcatgtcaccatttcgtggaagcaccgtctcagggtcaggggtggtagacttttctggtgtaaaatttgttttattctcatacaaaggtgcagctgtcttcttgtgtaccgacttcaatttgacagctctactgtgacaacggttgtttgtttgatcatgacggatgcactcgacagggaaactgcattgtcgcttctagtgtgataaatctccatatacataattaatccatgatttattgcgtcactgttcaag

SEQ ID NO: 1868 - DNA, 740 bp, Zea mays
gcacgccaccgcctatccactcgcctgcacatcgccgccctagcagagacgtctgcacatcggcgcctggaggacgagaagcgaggaagaagacccacactctcctggaaaacgcatcacaagacttcagcctccctttccggccggagatccgactcgcgtctccgcgacagatccgggcaaacggcggctgatgcagttcttcggcggttcgtcgctgacgtcgatcgcgccggaggcgaccccagccccggcggcgccccccggcacgggcacgggcgccagcgcgcaggtcctctacgtcttcaaccgtaacggcgtctgcctgctctaccgcgagtggcatcgcccgctccgcacgctcgatcccacccaggaccacaagctcatgttcggactcctcttctcccttcgctccttcaccgccaagatcgacccaaccacggctgaaaagggaaatcttggagtgccactgctgccaggccaaggttgctcgttttatagcttcaagacaaacacatacaaactgaacttcatggagagcccttctggtataaagcttatattaattacacatccaaggactggtgatcagcgagactcgctaaagcatatatacaatctatatgtggaatatgttgtaaaaaatcctctgtatgctcctggaacaccaatcaagtgtgaacttttcaataaacatctcgatcaatacgtgaaaacattaatttgatgccattgag

SEQ ID NO: 1869 - DNA, 1259 bp, Panicum virgatum
agcctacgcggcagatcggcggcgatgcagttcttcggcgggtcgtcgctgacctcggtcgcgccggaggcgagcccggccccggcggcgcccccaggcacgggcacgggcgccaacgcgcaggtgctctacgtcttcaaccgcaacggcgtctgcctgctctaccgcgagtggcaccgcccgctccgcaccctcgaccccacccaggaccacaagctcatgttcggcctcctcttctccctccgctcattcaccgccaagatcgacccgaccacggctgaaaaggggaatcttggcgtgccgctactgccaggccaaggccgttcattctacagcttcaagacaaacacgtacaaactcaacttcatggagagcccttctggtattaagcttattctaattacacatccaaggactggtgatcagcgagattcgctgaagcatatctacaatctatatgttgagtatgttgtaaaaaatcctctgtatgctcctggcacaccaatcaagtgtgaacttttcaataaacatctcgatcaatatgtgagaacattaatctgatatccttgagacagggttgatgcggcattagctaaaatggggcccatgttctttagcatggtgggttcaccatgctgtttgatcactgtctcaagggtgatagaggattttctggtggaagacttgccgtgtttccacagttgcaccatgtatttagatggacagatggtacaaagctgctgtctacttgtcttgtataccgacttcaatttgattagcactattgtggcaacactcctgtagattacttgtttgatcatgatggatgccctcgaggtgggaactgtattgtcgcatttggtgtgatatgttgccttcagatgactaatccatgagttatcgtgccactgttcaagttttcctcttcagttgcttaccagatatgtactacatagtatttgtttgaatcaggtatcttgtcagatacagtcaaactagagtgaagattaactagtaaaaacaacatattttctgcttgagacatcattgcagctttacaatatagaccaggttcatgtcctattaccacagcactttctcgtaaagatggcaacgggtaaaatccgtgcggatatcaacttcataaatccgtacccgcgtgctaaaatccgcgcccgcaacccgcaacgggtagaaaatgatacccgtacctgctatccgcggatacccgcatacccgcaagttttagaaaatcaagc

SEQ ID NO: 1870 - DNA, 1331 bp, Setaria italica
ccgcgccgtcgtccccaactccgcctccgcccagcgcccgccgggtctccttctcctccagccgtcgccacgggccagacgctcagggctcaggccaccgcgcgcccccgccctcacgcaggcgtcgcgccgccggctcagggcactaggcgtctaggccgccgcggtccgcgcgtccgtgacccggtctccccgcctgctccggtcgaggacgccgcgtcccccgccccctgctccaaagcccgtcggtggcggtgagcttccccgcctccgatctctttctttctcgtctactccctcccgttccggccggagatccgccccgcaccctccgcggcagatccagtccaccggcgatgcagttcttcggcggctcctcgctgacgtcggtcgcgccggatgcgagcccggccccggcggcgccccccggcacgggcaccggcgccaacgcgcaggtgctctacgtcttcaaccgcaacggcgtctgcctgctctaccgcgagtggcaccgcccgctccgcaccctcgaccccacccaggaccacaagctcatgttcgggctcctcttctccctccgatccttcaccgccaagatcgacccgaccacggctgaaaagggtaatcttggggtgccactactgccaggacaaggctgttcattttatagcttcaagacaaacacatacaaattgaacttcatggagagcccttctggtataaagcttattctaatcacacatccaaggactggtgatcaacgagattcgttgaagcatatctacaacctatatgtggagtatgttgtaaaaaatcctttgtatgcccctgccacaccaatcaagtgtgaacttttcaataaacatcttgatcaatatgtgagaaccttaatttgaatcagtgagacttggatggtggggtattagctaaaaagggtcacattctatatcctttattttggcggtttcaccatgctgcttgagcatgactcatcgagaaagatctatgtcaagggtgctacagacttttctggtgggaaaatgctcacgctcatattgtgcttgtacaattggctcatgcatttagatggtacaaagctgctgtcgtattgtgtactgacttcagtttgacagctctattgtgactacactcctgtagattacttgtttgatcatgacggttgcgctattggtttcatatgttgtcttcagatgattaatccatgggttatctggtcatcgttcaggttttccctatctattgatcaccttgtcagatggaatgaatcgaactagagtggatactataacaaataaaagagcgtattttctgca

SEQ ID NO: 1871 - DNA, 1293 bp, Setaria italica
ccgcccagcgcccgccgggtctccttctcctccagccgtcgccacgggccagacgctcagggctcaggccaccgcgcgcccccgccctcacgcaggcgtcgcgccgccggctcagggcactaggcgtctaggccgccgcggtccgcgcgtccgtgacccggtctccccgcctgctccggtcgaggacgccgcgtcccccgccccctgctccaaagcccgtcggtggcggtgagcttccccgcctccgatctctttctttctcgtctactccctcccgttccggccggagatccgccccgcaccctccgcggcagatccagtccaccggcgatgcagttcttcggcggctcctcgctgacgtcggtcgcgccggatgcgagcccggccccggcggcgccccccggcacgggcaccggcgccaacgcgcaggtgctctacgtcttcaaccgcaacggcgtctgcctgctctaccgcgagtggcaccgcccgctccgcaccctcgaccccacccaggaccacaagctcatgttcgggctcctcttctccctccgatccttcaccgccaagatcgacccgaccacggctgaaaagggtaatcttggggtgccactactgccaggacaaggctgttcattttatagcttcaagacaaacacatacaaattgaacttcatggagagcccttctggtataaagcttattctaatcacacatccaaggactggtgatcaacgagattcgttgaagcatatctacaacctatatgtggagtatgttgtaaaaaatcctttgtatgcccctgccacaccaatcaagtgtgaacttttcaataaacatcttgatcaatatgtgagaaccttaatttgaatcagtgagacttggatggtggggtattagctaaaaagggtcacattctatatcctttattttggcggtttcaccatgctgcttgagcatgactcatcgagaaagatctatgtcaagggtgctacagacttttctggtgggaaaatgctcacgctcatattgtgcttgtacaattggctcatgcatttagatggtacaaagctgctgtcgtattgtgtactgacttcagtttgacagctctattgtgactacactcctgtagattacttgtttgatcatgacggttgcgctattggtttcatatgttgtcttcagatgattaatccatgggttatctggtcatcgttcaggttttccctatctattgatcaccttgtcagatggaatgaatcgaactagagtggatactataacaaataaaagagc

SEQ ID NO: 1872 - DNA, 983 bp, Echinochloa colona
actccctcccgactcccggccggaggggagagagagatccgttcagcaccctccgcgacagatccgggcagtcgcgcggcgatgcagttcttcggcgggtcgtcggtcgcgccggaggcgagcccggccccggcggcgccacccggcacgggcacgggcgccaacgcccaggtgctctacgtcttcaaccgcaacggcgtctgcctgctctaccgcgagtggcaccgcccgctccgcacgctcgaccccacccaggaccacaagctcatgttcggactcctcttctcgctccgatcgttcaccgccaagatcgacccgaccacggctgaaaagggcaatcttggggtgccactactgccaggccaaggctgttcattttatagcttcaagacaaacacttacaaattgaacttcatggagagcccttctggtataaagctcattctaatcacacacccaaggactggtgatcagcgagattcgcttaagcatatctacaatctatatgtggagtatgttgtaaaaaatcctctatacgcccctggcacaccaatcaagtgtgaacttttcaataaacatcttgatcaatatgtgagaacattaatttgataccatgagacttgggtggtgcggcattagctaaaaagggtcacattccatgtcctgtagactgtagtgtggtggtttcactatgctgtttgatcatgactactatgtcgagaaagatctatctcaggggtgctgcaaacttttttggtgggaaatgttggtgttctcttgtacaattggcccatgtatttagctggtacaaagctgctgtcgtcctgtgtactgacttcaatttgacagctctattgggactgcacctgtagattgcttgtttcatcatgacggatgccctcatatggaaattgtgttgtcgcttcaaccactgtgtattggtcatcttcagatgattaatccatgagttactgtttaaggcg

SEQ ID NO: 1873 - DNA, 982 bp, Saccharum officinarum
attgtcgcaccgttgctctctcctttccgtctcccccttcccagagcccgcctgcaaggtgaccccctcggctcctcctcaccgctcaccggcgcccaatccctagctgcctccgcccagccgctccctcctgagccctctccgctcagccgccccctcctcggcgaccctcctcccgagccgccaccgcccggttgccccctccccagcgcgccacccgtctgcacaccgccgcccggccactcgcctgcacaccgccgccctcgccgagccgcctgcacatcggcgcctggaggacgagaagcgcggaagacgaccccagcctcgcctggaaaacgcatcccaagactttaacttccctttccggccggagatccgcctctcatctccgcgacagatccgggcaagcggcggccgatgcagttcttcggcggctcgtcgctgacgtcggtcgcgccggaggcgaccccagccccggcggcgccccccggcacgggcacgggcgccagcgcgcaggtcctctacgtcttcaaccgcaacggcgtctgcctgctctaccgcgagtggcaccgcccgctccgcacgctcgatcccacccaggaccacaagctcatgttcggactcctcttctcgcttcgctccttcaccgccaagatcgacccaacacggctgaaaagggaaatcttggcgtggcactactgccaggccaaggttgttcgttttatagcttcaagacaaacacatacaaactgaacttcatggagagcccttctggtataaagcttatactaattacacatccaaagactggtgatcagcgagactcgcttaagcatatctacaggctatgtggaatatgtcgtaaaaaatcctctgtatgctcctggaacaccaatcaagtgcgaactcttccataaacatcttgatcaatacgtgagaacattaatttgatgtcgttgagactcacggttggtgaggcctt

SEQ ID NO: 1874 - DNA, 807 bp, Echinochloa colona
gcgggtcgtcgctgacgtcggtcgcgccggaggcgagcccggccccggcggcgccccccggcacgggcacgggcgccaacgcccaggtgctctacgtcttcaaccgcaacggcgtctgcctgctctaccgcgagtggcaccgcccgctccgcacgctcgaccccacccaggaccacaagctcatgttcggactcctcttctcgctccgatccttcaccgccaagatcgacccgaccacggctgaaaagggtaatcttggggtgccactactgccaggccaaggatgttcattttatagcttcaagacaaacacttacaaattgaacttcatggagagcccttctggtataaagctcattctaatcacacacccaaggactggtgatcagcgagattcgcttaagcatatctacaatctatatgtggagtatgttgtaaaaaatcctctatacgcccctggcacaccaatcaagtgtgaacttttcaataaacatcttgatcaatatgtgagaacattaatttgataccatgagacttgggtggtgcggcattagctaaaaagggtcacattccatgtcctgtagactgtagtgtggtggtttcactatgctgtttgatcatgactactatgtcgagaaagatctatctcaggggtgctgcaaacttttctggtgggaaatgttggtgttctcattatgcttgtacaattggcccatgtatttagctggtacaaagctgccgtcgtcctgtgtactgacttcaatttgacagctctattgggactgcacctgtagattgcttgtttca

SEQ ID NO: 1875 - DNA, 915 bp, Oryza sativa
cttcgccgtcgtcctcacctcccgtgagagatctcctcttgtgcgggcggagatccacagccggcgggctcgacctcctcctcgggcgccatccacgcgcgcgcgatgttctccttcggcggcgggtcgtcgctgacgtcggtggtgccggacgcgaccccggccccggcggcgccgccgggcaccgggacgggcgccaacgcgcaggtgctctacgtcttcaaccgcggcggcgtctgcctgctgtaccgcgagtggcaccggccgctccgcacgctcgaccccacccaggaccagaagctcatgttcggcctcctcttctccctccgctccttcaccgccaagatcgatcccaccacagcagaaaaggggaatcttggggtgccactactgccgggccagggttgctcattttacagcttcaagacaaacacatacaaattgaacttcctagagagcccttctggtatcaagcttattctaattacacatccaaggactggtgatcaacgtgacacgctgaagcatatctacaacctatatgtggaatatgttgtaaaaaatcctttgtacgctcctggcacaccaatcaagtgcgagcttttcaataagcaccttgatcaatatgtcaaaacattgatatgatacttttagaggttataccgatcctaaatacggttaatgtcatatcttctgggtaactttggtacgcttactggtatcagtgtgctatttgatttattactacattaagaggtctagtgttccttgaggaatatgctaagacttttctatcacaaacattcccttgttcctgttgtacattgaacaatgctgcattacatctgttgaactgcacaaagttgttgatgttgagtgttcgttttgaaaattgagatctacatactctgatgg

SEQ ID NO: 1876 - DNA, 833 bp, Pennisetum glaucum
cggtcgcgccggatgcgagcccggcaccggcggccccccccggcacgggcaccggcgccaacgcgcaggtgctctacgtcttcaaccggaacggcgtctgcctgctctaccgcgagtggcaccgcccgctccgcaccctcgacccaacccaggaccacaagctcatgttcgggctcctcttctccctccgatcgttcaccgccaagatcgacccgaccacggctgaaaagggtaatcttggggtgccactactgccaggacaaggctgttcattttacagcttcaagacaaacacatacaaattgaacttcatggagagccctgctggtataaagcttattttaatcacgcatccgaggactggtgatcagcgagattcattgaagcatatctacaacctatatgtggagtatgttgtaaaaaatcctttgtatgcccctggcacaccaatcaagtgtgaacttttcaataaacatctcgatcaatatgtgagaacattaatttgaatcagcgaggattgggtggtgggtcatttagctcaaggtcacattctatatgctttagtcggtggtttcactatgctgcatgagcaggactcatcaagaaagatcatgtcaaggatgctacagaccgattttcctggtggaaagatgttcatattctcattatgcttgtatacaattggcccatgtattgtgtactggcttaagtttgacagctctattgcgactacagacctgtagattacttggtcgatcatgacggttgatgttggtttcatatgttgtgttcagaatgatgattaatccatgagttatctgatggtcaaaaaa

SEQ ID NO: 1877 - DNA, 1835 bp, Panicum virgatum
tgccttgatatatagatgattttcaagaattgttgtactagctagcgaagagaaaaaccggcgcagtgtaatgtttcttgaaaatcgatcactgtagatcgtcactcacaatctcataggtagtagtaggcttttcaagaagtgccctgttttttggcggtagcttgatctctgactcattcatccgaccttttgctcgtacgtaccgtaccgatccacagctaaaacccttaccctccggcctcacaatttggcaggagaggtagctagaatgctgcggcagactcgttcgtcgtaatcaaaacatggaatctgtactgtacaaatatgactgtaacggcggagttgtacagatgggaatccggcatggtcataagcaagcacaatcactgatgatgagcagccatgcatggctgtcggcgatgcatcgcagtgcgtggtgcggcctgccaaccaatgaaaacatcaaatgaagaagagggcggatggatccgcacgtctacatgaccatgatgtagttggtgacgatgggccaggtgaatccgatcgattcggcagcccgttaccgtctgatgtgacgccgcggcggaggggcttaacactttacagagagatgccacggcagcgttgatcgacaggatcccgtcccggccggctacctacatgccatgttgtctgcaggcaggcagcgatctggttctgggtttgctcttgcgcccagagaacagagcatgcaagaatagatacaggcatctaggcatagctatgcttgattgccgtcgccggcgcttgcccatactgcaaattaaaccgtcaactgtctgtcctgatgtacgtacgtactccgtatccttgctagctgagcagcagatcgccgcgagctccttcagttcgatcactttctctccggggccgccgtgctggctccaatgatatgatcctgacggacggcgtgctggctggctcgctgtggctgaaataggggacgccgccgggacgggtggtgacacgtcgggggtttgcgtgttgggccgacgaaagaccatgctgactgggccggccgaggagactgactgagcgagtcgtggacaattgggcctatgcagcccatatatggatctgggcctagtgggtactctctcaagtctcggcccgctctggctgaactgcctgcctccgttctcttcttcttcctcgtctactccctccctctcccggccagagatccgccccgcagcctacgcggcagatccgggcaatcggcgatgcagttcttcggcgggtcgtcgctgacctcggtcgcgccggaggcgagcccggccccggcggcgccccccggcacgggcacgggcgccaacgcgcaggtgctctacgtcttcaaccgcaacggcgtctgcctcctctaccgcgagtggcaccgcccgctccgcaccctcgaccccacccaggaccacaagctcatgttcgggctcctcttctccctccgatcattcaccgccaagatcgacccgaccgcggctgaaaagggaaatcttggagtgccactactgccaggccaaggctgttcattctatagcttcaagacaaacacatacaaactgaacttcatggagagcccttctggtattaagcttattctaattacacatccaaggactggtggtcagcgagattcactgaagcatatctacaacctatatgttgagtatgttgtaaaaaatcctttgtatgctcctggcacaccaatcaagtaagttttgccggttaatggattttttttggcttcatatttagctaggtattgatgttgttgctaatattacagttcgtaaaag

SEQ ID NO: 1878 - DNA, 946 bp, Brachypodium distachyon
caccgcaccagtttctcctgtctccggccggagatccacaccacaccgccgcgccctcctccgtccgcctcggcagcagcttccacgatgcagttcttcgggggatcctcgctgacgtcagtcgcaccggaggctagccctgccccagccgcgccgccggggacgggcacgggcgccaacgcccaggtgatctacgtcttcaaccgcaacggcgtgtgcctgctgtaccgcgagtggcaccgcccgctccgcacgctcgcccgcaaccaggaccagaagctcatgttcggtctcctcttctccctccgctccttcaccgccaagatcgaccccacctcaacagaacatgggaatcttggggcgcccctgctgccaggccagggctgctcgtttcatagcttcaagacaaacacgtataaattgaactacatggagagcccatctggtataaagcttattctacttacccatccaaggactggtgatcaacgagatgccctgaagcaaatctacagcctatatgtggagtatgttgtaaagaatcctctgtatgctcctggcagcccaatcaagtgtgaccttttcaataaacatctcgatcagtatgtgaagacattgatttgaacccattcaggtttgggtgatgcatgtccgctagggaaaaacagttgcatttcatgttttaaatggaaattctgtgccatggaacagtttattgtggtggtatctcaatgttctttattttgtaattccattttggagaaaatggttgtttcaaggatttcagtgactttgttggtgcaaaatgtcatcttctcattgtattgtacaatgcttacagttgcaccatgtattagatggtcttctgtactgtcatcaatttgacagctatatattttagcacactcgtgtaaattacttgtttcattgcgatggattccctaca

SEQ ID NO: 1879 - DNA, 958 bp, Brachypodium distachyon
caccgcaccagtttctcctgtctccggccggagatccacaccacaccgccgcgccctcctccgtccgcctcggcagcagcttccacgatgcagttcttcgggggatcctcgctgacgtcagtcgcaccggaggctagccctgccccagccgcgccgccggggacgggcacgggcgccaacgcccaggtgatctacgtcttcaaccgcaacggcgtgtgcctgctgtaccgcgagtggcaccgcccgctccgcacgctcgcccgcaaccaggaccagaagctcatgttcggtctcctcttctccctccgctccttcaccgccaagatcgaccccacctcaacagaacatgggaatcttggggcgcccctgctgccaggccagggctgctcgtttcatagcttcaagacaaacacgtataaattgaactacatggagagcccatctggtataaagcttattctacttacccatccaaggactggtgatcaacgagatgccctgaagcaaatctacagcctatatgtggagtatgttgtaaagaatcctctgtatgctcctggcagcccaatcaagtgtgaccttttcaataaacatctcgatcagtatgtgaagacattgatttgaacccattcaggtttgggtgatgcatgtccgctagggaaaaacagttgcatttcatgttttaaatggaaattctgtgccatggaacagtttattgtggtggtatctcaatgttctttattttgtaattccattttggagaaaatggttgtttcaaggatttcagtgactttgttggtgcaaaatgtcatcttctcattgtattgtacaatgcttacagttgcaccatgtattagatggtcttctgtactgtcatcaatttgacagctatatattttagcacactcgtgtaaattacttgtttcattgcgatggattccctacaaaatggaattat

SEQ ID NO: 1880 - DNA, 976 bp, Secale cereale
caactccgctccgcaccattgtcgtctcctctccccggccggagatccacgccataccgccgcgcccctccgcccggctcggccgctgcttccgcgatgcagttcttcggcgggtcctcgctgacgtccgtcgcgccggagtccagcccggcaccggcggcgcctccggggacgggaacgggctccaacgcccaggtgatctacgtcttcaaccgcaacggcgtgtgcctgctgtaccgcgagtggcaccgcccgctccgcacgctcgcccgcaaccaggaccagaagctcatgttcggcctcctcttctccctgcgctccttcaccgccaagatcgaccccacctcaacagaacacgcgaatcttggggcgccactactgccaggtcagggatgttcatttcatagtttcaagacaaacacatataaattgaactacatggagagcccgtctggtataaagcttattctccttacccatccaaggactggtgatcaacgagatgcgctgaagcatatttacagcctatatgtggagtatgttgtaaagaatcctctgtatgctcctggcagcccaatcaagtgtgaccttttcaataaacatctcgatcagtatgtgaaaacattgatttgatcccattcaggtccgggaggaggtgcatgctcactagcggagaagagtggcacttcattttctcggaaattctgagccgtgtaacagtttgctgtgtggtggcatctctgtgttgtttggtttgataatcactatttgttgagaaattgttgcttcaaggatgatacagacttgtcttgtgccaaagtggtcctgttgaatctcactgtatttattgtacactttgcaccctgcattgatggtcttcatgtgtacccactgcaatttgatagctgtacactctgatcacagtgcctgtaatttgcacccttcatcatgatggaccacctcaaaaaatggaatg

SEQ ID NO: 1881 - DNA, 898 bp, Avena sativa
cctgttcccggccggagatccacgccacaccgccgcgctctccgcccggctcggcagcttgcttccgcgatgcagttcttcagcgggtcgtcgctgacgtctgtcgcaccggattccaccccggcaccggcggcgccgcctgggacgggcacgggcgccaacgcccagttgatctatatcttcaaccgcaacggcgtctgcctgctgtaccgagagtggcaccggcctcttcgcacgctcgcccgtaaccaggaccagaagctcatgttcggcctcctcttctccctccgctccttcaccgccaagatcgaccctacctcaacagaaaatgggaatcttggggcgccactactgccaggtcagggatgctcatttcatagcttcaaaacaaacacctataaattgaactacatggagagcccatctggtataaagcttattctacttacccatccaagaactggtgatcaacgagatgtgctgaagcatatctacagcctatacgtggagtatgttgtaaagaatcccctgtatactcctggtagcccaatcaagtgtgagcttttcaataaacatctcgatcaatatgtgaaaacattgatttaatcccatccaggtttgggcaggtgcatgtttggtagcggataccagttgcatacaatgcttttaatgcgaactccatggctcagtggtgtgtctgtgatttttcatttgataattctgtttttgggaagtgttgcttcaaggatgatacagacttttctggcggaaacctatcttctcattattttgtacaattgcgccctgtattagatgctcttcctgtgtgctgactgctatgtactctgatcacaaactcctgtaaattacttgcttcattatgattatgatgaattcc

SEQ ID NO: 1882 - DNA, 909 bp, Avena sativa
cgtcattattttctcctgtccccggccggagatccacgccacaccgccgcgctctccgcccgtctcggcagctgcttccgcgatgcagttcttcagcgggtcgtcgctgacgtctgtcgcaccggattccaccccggcaccggcggcgccgcctgggacgggcacgggcgccaacgcccagttgatctatatcttcaaccgcaacggcgtctgcctgctgtaccgagagtggcaccggcctctccgcacgctcgcccgtaaccaggaccagaagctcatgttcggcctcctcttctccctccgctccttcaccgccaagatcgaccctacctcaacagaaaacgggaatcttggggcgccactactgccaggtcagggatgctcatttcatagcttcaaaacaaacacctataaattgaactacatggagagcccatctggtataaagcttattctacttacccatccaagaactggtgatcaacgagatgcactgaagcatatctacagcctatacgtggagtatgttgtaaagaatcccctgtatactcctggcagcccaatcaagtgtgagcttttcaataaacatctcgatcaatatgtgaaaacattgatttaatcccatccaggtttgggcaggtgcatgtttggtagcggaaaccagttgcatatcatgcttttatgggaactccatggctcagtggtgtgtctgtgatttttcatttgataattctgtttttgggaagtgttgcttcaaggacgatacagacttttctggtggaaacctatcttctcattattttgtacaactgcaccctgtattagatgttcttcctgttgtgctgactgctatgtactctgatcacacactcctgtaaattaattactttattatgactgattcccccc

SEQ ID NO: 1883 - DNA, 836 bp, Lolium multiflorum
gcagcctacgcgatgcagttcttcagcggatcctcgctgacgtcggtcgcgccggattccagccctgcaccggcggcgccgccggggacaggcacgggcgccaacgcccagctgatctacatcttcaaccgcaacggcgtctgcctgctgtaccgcgagtggcaccgcccgctacgcacgctcgcccgcaaccaggaccagaagctcatgttcggtctcctcttctccctccgctccttcaccgccaagatcgaccctacctcaacagaaaatgggaatcttggggcgccactactgccaggtcagggatgctcatttcatagcttcaaaacgaacacttataaattgaactacatggagagcccatctggtataaagcttattctacttacccatccaagaactggtgatcaacgagatgcactgaagcatatctacagcttatatgtggagtatgttgtaaagaatcctctgtatgctcctggcagcccaatcaagtgtgaacttttcaataaacatctcgatcagtatgtgaaaacattgatttaatcccatccaggtttcgctagcgggaacagcatatcatgcttttgtggaaaattctgcaccatgcggcagtggtgtctctctgtgactttatttgataattctgttgttgtgcaagtgttgcttccaggatgatacaagacttctccgtgcaaaaatggtcctgttctcactgttttgtaccctgtattagatggtcttcttgtgtattggttactatgtactctgaccacactcgtgtaaatttaatcccttcattatgaaggatatcccaaaatggaatttgactt

SEQ ID NO: 1884 - DNA, 1184 bp, Triticum aestivum
cggggaccggtccacgatcttctccagcagcaacaactccgctccgcaccgttgtcgtctcctctccccggccggagatccacgccataccgccgcgcccctccgcccggctcggccgctgcttccgcgatgcagttcttcggcgggtcgtcgctgacgtctgtcgcgccggattccagcccggcaccggcggcgcctccggggacgggaacaggctccaacgcccaggtgatctacgtcttcaaccgcaacggcgtgtgcctgctgtaccgcgagtggcaccgcccgctccgcacgctcgcccgcaaccaggaccagaagctcatgttcggcctcctcttctccctgcgctccttcaccgccaagatcgaccccacctcaacagaacacgcgaatcttggggcgccactactgccaggtcagggatgttcatttcatagcttcaagacaaacacatataaattgaactacatggagagcccgtctggtataaagcttattctccttacccatccaaggactggtgatcaacgagatgcgctgaagcatatttacagcctatatgtggagtatgttgtaaagaatcctctgtatgctcctggcagcccaatcaagtgtgaccttttcaataaacatctcgatcagtatgtgaaaacattgatttgatcccattcaggtttgggaggaggtgcatgctcaccagcggagaacagtaggcacttcgtgttttcggaaattctgagccgtggaacagtttggtgtgtggtggcatctctgtgttatttggtttgataatcactatttgttgagaagttgttgcttcaaggatgatacagacttgtcttgtgccaaagtggtcctgttgaatctcactgtatttattgtacacttgcaccctgcattgatggtcttcatgtgtacccactgcaatttgatagctgtacactctgatcacagtccctgtaatttgcacccttcatcatgatggaccccctcaaaaaatggaatgccctctcatatcctttgttggatgatatccatgagttttctggttatagatcaaatattttctttttggcttatttatccaatagtatctttgctgtaaaagatgttcttgcgacatggtactacgttcgtatgattcagctatgtcgaagggaacaagaaacacatcgccacag

SEQ ID NO: 1885 - DNA, 660 bp, Panicum virgatum
cggtggatctgggcctagtccttgttgggccaggcaggccatgtttttcccgtggacccatatatggactcaacaagtcgaggtcggcccgtctctgcctccgatcttgtcttcttcttcctcgtctactccctccctctcccctcccggccggagatccgccccgcagcctacgcggcagatcggcggcgatgcagttcttcggcgggtcgtcgctgacctcggtcgcgccggaggcgagcccggccccggcggcgcccccaggcacgggcacgggcgccaacgcgcaggtgctctacgtcttcaaccgcaacggcgtctgcctgctctaccgcgagtggcaccgcccgctccgcaccctcgaccccacccaggaccacaagctcatgttcggcctcctcttctccctccgctcattcaccaccaagatcgacccgaccacggctgaaatgggaaatcttggtgtgccactactgccaggccaaggctgttcattctatagcttcaagacaaacacgtacaaactgaacttcatggagagcccttctggtatcaagcttattctaattacacatccaaggactggtgatcagcgagattcgctgaagcatatctacaacctatatgtcgagtatgttgtaaaaaatcctctgtatgctc

SEQ ID NO: 1886 - DNA, 618 bp, Echinochloa colona
gccaacgcgcaggtgctctacgtcttcaaccgcaacggcgtctgcctgctctaccgcgagtggcaccgcccgctccgcacgctcgaccccacccaggaccacaagctcatgttcggactcctcttctcgctccgatccttcaccgccaagatcgacccgaccacggctgaaaagggtaatcttggggtgccactactgccaggccaaggatgttcattttatagcttcaagacaaacacttacaaattgaacttcatggagagcccgtctggtataaagctcattctaatcacacacccaaggactggtgatcagcgagattcgcttaagcatatctacaatctatatgtggagtatgttgtaaaaaatcctctatatgcccctggcacaccaatcaagtgtgaacttttcaataaacatcttgatcaatatgtgagaacattaatttgatacaatgagacttgggcggtgcggcattagcttaaaagggtcacattccatgttctttaaagtggtggtttcactatactatttgatcatgactactatgtcgagaaagatctatctcgggtgaggggtgctacaaacttttctggtgggaaatgttggtgttctcat

SEQ ID NO: 1887 - DNA, 1100 bp, Setaria italica
atcacggttctctctgaatttgctttcctcctcctcggctcccctctcctcccctctccgatctccgctcgcgaccggcgtgctctcaccaccgcgccccgttcccctcctacgccgcctgctcctcccttccccaccaccggcgccgcacgccctcctcgcccgcacactccccgccgctaactatcccaagaaaccggcggaagtgggtgaaagagcgggacccagcaggagggagcgggcaagatgatcggcgtcgggaaggcgaagcagtacgccaacgtcctcgacaagcccctcagccgcggcaggcaggaggtcagtttgagtgcatttgcattcttattctcagagttggtacagtacaaccaaacacaagtcgacaacattgcggagctggaacggagactggaggatgctggttatgctgttggtgcaagggtacttgaacttctctgtcacagagagaaggggaataggcgagaaacacgacttctggggattttatcattcattcacagcactgtatggaaggtcctatttggaaaggtggctgactcacttgagaagggaactgaacatgaggatgaatacatgattagtgaaaaggagcttcttgttaaccggttcatttcggtgccaaaagatatgggagcattcaactgcggagcctttgttgcaggaattgtaaagggtgtattagataatgctggctttcctgcagtagtcactgcacactttgtgccaattgaaggccagcaaaggccaaggacgacaatcttgatcaagtttgctgaggaggttttgcaccgagaagcaagacttggctgagttttatgctatgcatgtacaccaaccctttttttttctggtctatttgtgaggtgaatcgaggctgggtagtttggcagtttcttgtactcgatttatgtaatagtagtttgagaataaaagtggtgaagatgatatcgcaggggcttcatcagtcttgttggaattcgaaatgtaaggcattgctttgtctaccaaatccgctcctgtatcagatacttttcattgactttcaccttatataaaaggaatatttcatctttgaccag

SEQ ID NO: 1888 - DNA, 1006 bp, Setaria italica
ccgctcgcgaccggcgtgctctcaccaccgcgccccgttcccctcctacgccgcctgctcctcccttccccaccaccggcgccgcacgccctcctcgcccgcacactccccgccgctaactatcccaagaaaccggcggaagtgggtgaaagagcgggacccagcaggagggagcgggcaagatgatcggcgtcgggaaggcgaagcagtacgccaacgtcctcgacaagcccctcagccgcggcaggcaggaggtcagtttgagtgcatttgcattcttattctcagagttggtacagtacaaccaaacacaagtcgacaacattgcggagctggaacggagactggaggatgctggttatgctgttggtgcaagggtacttgaacttctctgtcacagagagaaggggaataggcgagaaacacgacttctggggattttatcattcattcacagcactgtatggaaggtcctatttggaaaggtggctgactcacttgagaagggaactgaacatgaggatgaatacatgattagtgaaaaggagcttcttgttaaccggttcatttcggtgccaaaagatatgggagcattcaactgcggagcctttgttgcaggaattgtaaagggtgtattagataatgctggctttcctgcagtagtcactgcacactttgtgccaattgaaggccagcaaaggccaaggacgacaatcttgatcaagtttgctgaggaggttttgcaccgagaagcaagacttggctgagttttatgctatgcatgtacaccaaacctttttttttctggtctatttgtgaggtgaatcgaggctgggtagtttggcagtttcttgtactcgatttatgtaatagtagtttgagaataaaagtggtgaagatgatatcgcaggggcttcatcagtcttgttggaattcgaaatgtaaggcattgctttgtctaccaaatccgctcctgtatcagatacttttcattgactttcacctt

SEQ ID NO: 1889 - DNA, 1129 bp, Pennisetum glaucum
tgctcctctctccccaccaccggcgccgcacgccctcctcgcccacatactccctgccgctacctatcccaagaaacgggcgggaagtgagttgaaagggagggacccagcaggagggagcgggcaagatgatcggcgtcgggaaggcgaagcagtacgccaacgtcctcgacaagcccctcagccgcggcaggcaggaggtcagtttgagtgcatttgcattcttattctcggagttggttcagtacaatcaaacacaagtcgacaacattgcagaactggaacggagactggaggatgctggttatgctgttggtgcaagggtacttgaacttctctgtcacagagagaaggggaataggcgagaaacacgacttctggggattttatcattcattcacagcactgtatggaaggtcctatttggaaaggtggctgactcacttgagaagggaactgaacatgaggatgaatacatgattagtgaaaaggagcttctcgttaaccggttcatttcggtgccaaaagatatgggagcattcaactgcggagcctttgttgcaggaattgtaaagggtgtattagataatgctggctttcctgctgtagtcactgcacactttgtgccaattgaaggccagcaaaggccaaggacaacaatcttgatcaaatttgccgaggaggttttgcatcgagaagccagacttggctgagttttatgctatgcatgtacacccaacctttttttccctggtctacttgtgaggtgaattattgctgggtagtttggtggtttattgtacttgatttatgtaatagtagtttgagaatacgagcggtgaagccgtgaaggtgagattgcaggggctttcatcaagcatcattcttgttggaattgtaaacggctgacattgatttgcctaccaaatccgctcctgtattagatacttttcgctgactttcaccttattaaaggaatatttcgtctttgatcaatctttcctattctggaacctggcagatgattctgttttgagcaagtgtaccagtcaaatacccaaggcattgctcttttttttgttccgccaaatatatcttaggtttgttgagccagaagaacatagatgga

SEQ ID NO: 1890 - DNA, 732 bp, Sorghum bicolor
cgacgactggcgggccgctgcctccgccctaggccaggtgctgaggctttagttggtctcttcgccggcgtcgagcacccaccagcttgaaggggctgccaagatgatcggtgttgggaaggcgaagcagtacgccaacgtccttgacaagcccctcagccgtggcaggcaggaggtcagtttgagtgcatttgcattcttgttctctgagttggttcagtacaaccagactcaagttgacaacattactgagctggaacggaggctggaggatgctggttatgcggttggtgcaagggtgcttgaattactctgtcacagggagaagggaaatagacgagagacacgacttctgggtattttatcattcatccacagtactgtttggaaagtgttgtttgggaaggtggctgactcacttgagaagggaacagaacatgaggatgaatacatgatcagtgaaaaggagcttcttgttaaccgtttcatttccgtgccaaaagacatgggagcattcaactgtggagcttttgttgcgggaattgtaaagggtgtattagaaaatgctggctttcctgctgtagttactgcacattttgttccaattgaaggacagcaaaggccaaggacgacaatcctgataaagtttgctgaagaggttttacacagagaagcaagacttggctgaggtttatgtatgtacacaaaacctttgactagcctatttgtaag

SEQ ID NO: 1891 - DNA, 978 bp, Saccharum officinarum
cctactcgtgcgttctgtctgcggtctgcctctctcgcctcctctcgctctccgacgactggtgggccgccgccgccgacctaagccaggtgctgaggctttagttggtctcttcgccgtcgacgagcacccaccagcttgaaggggctggcaagatgatcggtgtggggaaggcgaagcagtacgccaacgtccttgacaagcccctcagccgtggcaagcaggaggtcagtttgagtgcatttgcattcttgttctctgagttggttcagtacaaccagactcaagttgacaacattactgagctggaacggaggctggaggatgctggttatgcggttggtgcaagggtgcttgaactactctgtcacagggagaagggaaatagacgagagacacgacttctgggtattttatcattcatccacagtactgtttggaaagtgttgtttggaaaggtggctgactcgcttgagaagggaacagaacatgaggatgaatacatgatcagtgaaaaagagcttcttgttaaccgtttcatttccgtgccaaaagacatgggagcattcaactgtggagcttttgttgcgggaattgtaaagggtgtattagataatgctggctttcctgccgtagttactgcacattttgtgccaattgaaggtcagcaaaggccaaggacgacaatcctgataaagtttgctgaagaggttttacacagagaagcaagactgggctgagttttatctatgtacacaaaacctttcactagcctatttgtaaggtgaatcgttactggtagttaggtgatttcttgtatttgatttatgtagtagcagtgtggctgagaatagaagtgatgtaggtgagattgcaggagcttcatcagtcttgtactcttgttggaattcgaccaaaactgctgtattgatacttttccttacattcaccttgtattaaaggaatcgtttatctctg

SEQ ID NO: 1892 - DNA, 1148 bp, Panicum virgatum
gatggattcatcaacttgaaggtgctgtttactgtatctgaccctagatgcaatcgatcctttcgttttgagtcgagctcctcccctctgctctcctctcctctccgatctccgctcgcgcacggggtgccctcaccatcgcgcctcgttcccctcctacgcgggagcgcctgctcctctctccccaccaccggcgccgcaccccctcctcatactccccctcccaagaaaccggctgaagcgagtgaaagcggacaaaatgatcggcgtcgggaaggcgaagcagtacgccaacgtcctcgacaagcccctcagccgcggcaggcaggaggtcagtttgagtgcatttgcgttcttgttctcagagttggttcagtacaaccaaacacaagttgacaacattgcggagctggagcggagactggaggatgctggttatgctgttggtgcaagggtgcttgaacttctctgtcacagagagaaggggaataggcgagaaacacgacttctggggattttatcattcattcacagcactgtatggaaggtcctatttggaaaggtggctgactcacttgagaagggaacagagcatgaagatgaatacatgattagtgaaaaggagcttcttgttaaccggttcatttcggttccaaaagatatgggagcattcaactgcggagcctttgttgcaggaattgtaaagggtgtattagataatgctggctttcctgcagtagttactgcacactttgtgccgattgaaggccagcaaaggccaaggacaacaatcttgattaagtttgctgaggaggttttacaccgagaagcaagacttggctgagctttaagctatggttatgtacaccaaagctcttttttatggtctatttatgaggtgaattgttacagggtagtttggtggtttcttgtacttgatttatgtaatagtagttggagaatacaagtgatgatggtgggattgcaggggcttcatcattcttgttgaaattctaaatgtaaggcattgctttgtctaccaaatctgctcctgtattagatacctttcctggactttcaaaattatacaaaaggaatctttcatcttgacaagtcaccttatagttctattttccctttgatttgcc

SEQ ID NO: 1893 - DNA, 1020 bp, Brachypodium distachyon
tgctgccgagcacccccagcaccctcgctcgtcttcctcctcgcgcgagcgccgccaccgccggttgatcttcccttcgatcatctcgcttcagaccgcttctccttccatcacaccccgaacggattccgcccgttagctccccgtttcatctccttaatcttccccaattcgcaactgaggaagaaatcaaggtagggcggccgctctaccttgcccttccgggtcctccgcccgtgggcaagatgatcggcgtggggaaggcgaagcagtacgccaacgttctcgacaagcccctcagccgtggcagacaggaggtcagtttgagtgcgtttgcattcttgttctcggagttggttcaatacaaccagacacaagttgacaacattgctgagctggaacgaaggttggaggatgctggttatgctgttggtgcaagagttctcgaacttctatgtcacagggagaaggggaatagacgagagactcgattgctggggattttatcattcattcacagcactgtatggaaagtattgtttggaaaggtggctgactcacttgagaaaggaacagaacatgaggatgaatatatgattagtgaaaaggagcttctcgtcaaccggttcatttctgtgccaaaagatatgggggcattcaattgtggagcttttgtcgcagggattgtaaggggtgtattggataatgctggctttcctgcggtagttacggcgcattttgtgccaattgaaggccagcagaggcccaggacaacaatattgattaaatttgctgaagaggttttacaccgggaagcaagactcggctgaaatttatgctttctgtgtacaacacacatctttctgttctgtttgtaagatgaatctatatcagatatgttttggagactctcgagtctcttcctccacttgatttatgtaatactagtagtttgagaatagaattgatgaatggtgagattgcctataattcttatcattattgtttggaacggtaaaa

SEQ ID NO: 1894 - DNA, 1024 bp, Brachypodium distachyon
tgctgccgagcacccccagcaccctcgctcgtcttcctcctcgcgcgagcgccgccaccgccggttgatcttcccttcgatcatctcgcttcagaccgcttctccttccatcacaccccgaacggattccgcccgttagctccccgtttcatctccttaatcttccccaattcgcaactgaggaagaaatcaaggtagggcggccgctctaccttgcccttccgggtcctccgcccgtgggcaagatgatcggcgtggggaaggcgaagcagtacgccaacgttctcgacaagcccctcagccgtggcagacaggaggtcagtttgagtgcgtttgcattcttgttctcggagttggttcaatacaaccagacacaagttgacaacattgctgagctggaacgaaggttggaggatgctggttatgctgttggtgcaagagttctcgaacttctatgtcacagggagaaggggaatagacgagagactcgattgctggggattttatcattcattcacagcactgtatggaaagtattgtttggaaaggtggctgactcacttgagaaaggaacagaacatgaggatgaatatatgattagtgaaaaggagcttctcgtcaaccggttcatttctgtgccaaaagatatgggggcattcaattgtggagcttttgtcgcagggattgtaaggggtgtattggataatgctggctttcctgcggtagttacggcgcattttgtgccaattgaaggccagcagaggcccaggacaacaatattgattaaatttgctgaagaggttttacaccgggaagcaagactcggctgaaatttatgctttctgtgtacaacacacatctttctgttctgtttgtaagatgaatctatatcagatatgttttggagactctcgagtctcttcctccacttgatttatgtaatactagtagtttgagaatagaattgatgaatggtgagattgcctataattcttatcattattgtttggaacggtaaaagatc

SEQ ID NO: 1895 - DNA, 971 bp, Sorghum bicolor
tgccagtctgcctcggttctctcccgttcggccgttcccccctcgcgtagtcgcgtgcgctgtgtctggtggcgcgactgggccgccgccgccctacgccaggtgcttagatctcaccttcgccggcgacgaccccactagcttgaagggcctggcaagatgattggtgtggggaaggtgaagcagtacgccaacgtccttgacaagcccctcagccgtggcaggcaggaggtcagtttgagtgcatttgcattcttgttctctgagttggttcagtacaaccagactcaagttgacaacattactgagctggaacggaggctggaggatgctggttatgcagttggtgcaagggtgcttgaactactctgtcacagggagaagggaaatagacgagagacacgacttctgggtattttatcattcatccacagtactgtttggaaagtgttgtttggaaaggtggctgactcacttgagaagggaacagaacatgaggatgaatacatgatcagtgaaaaggagcttcttgttaaccgtttcatttccgtgccaaaagacatgggagcattcaactgtggagcttttgttgcgggaatcgtaaagggtgtgttagataatgctggctttcctgccgttgttactgcacattttgtgccaattgaaggccaacaaaggccaaggacgacaatcctgataaagttttctgaagaggttttacacagagaagcaagactgggctgagttttatgtatgtacacgaaacctttgactagcctatttgtaaggtgaatcgttactgggtagttttgtgatttcttgtaattgatttatgtaatagcaatgtgactgagaatataagtgatctaggtgagattgcatgagcttcatctatcttgtcggaatttgaccaaaactgctgtattgatgcttttccttacattcaccttgtataacggaattgtttatct

SEQ ID NO: 1896 - DNA, 1007 bp, Saccharum officinarum
ggtcgcgcgattgggtacgggcccccctcgaggttctctcccgttcggccgttcacctcgcgtagtcgcgtgcgctctgtctggtggcgccgactgggccgctgctgctgccgccgccgccgccgccctatgccaggtgtctagatctcaccttcgccggcgaagagcacccactagcttgaaggggttggcaagatgatcggcgtagggaaggcgaagcagtacgccaacgtccttgacaagcccctcagccgtggcaggcaggaggtcagtttgagtgcatttgcattcttgttctctgagatggttcagtacaaccagactcaagttgacaacattactgagctggaacagaggctggaggatgctggttatgcggttggtgcaagggtgcttgaactactctgtcacagggagaagggcaatagacgagagacacggcttctgggtattttatcattcatccacagtactgtttggaaagtgttgtttggaaaggtggctgactcacttgagaagggaacagaacatgaggatgaatacatgatcagtgaaaaggagcttcttgttaaccgtttcatttccgtgccaaaagacatgggagcattcaactgtggagcttttgttgcgggaattgtaaagggtgtattagataatgctggctttcctgccgtagttactgcacattttgtgccaattgaaggccagcaaaggccaaggacgacaatcctgataaagtttgctgaagaggttttacacagagaagcaagactgggctgagttttatctatgtacacaaaacctttcactagcctatttgtaaggtgaatcgttactggtagtttggtgatttcttgtatttgatttatgtagtagcagtgtggctgagaatagaagtgatgtaggtgagattgcaggagcttcatcagtcttgtactcttgttggaattcgaccaaaactgctgtattgatacttttccttacattcaccttgtattaaaggaatc

SEQ ID NO: 1897 - DNA, 1091 bp, Panicum virgatum
cgcgacgggtgccccccccccccccccccacccggccaccgcctcgttcccctcctacgccgcctgctcctctctccccaccaccggcgccgcacgccctcctgctcccctcccaagaaaccggctgaagcgagtgaaagcggacaagatgatcggcgtcgggaaggcgaagcagtacgccaacgtcctcgacaagcccctcagccgcggcaggcaggaggtcagtttgagtgcatttgcgttcttgttctcagagttggttcagtacaaccaaacacaagttgacaacattgcggagctggagaggagactggaggatgctggttatgctgttggtgcaagggtgcttgaacttctctgtcacagagagaaggggaacaagcgagagacacgacttctggggattttatcattcattcacagcactgtatggaaggtcctatttggaaaggtggctgactcactcgagaagggaacagagcatgaagatgagtacatgattagtgaaaaggagcttcttgttaaccggttcatttcggtgccaaaagatatgggagcattcaactgcggagcctttgttgcaggaattgtaaagggtgtattagataatgctggctttcctgcagtagttactgcacactttgtgccaattgaaggccagcaaaggccaaggacaacaattttgattaagtttgctgaggaggttttacaccgagaagcaagacttggctgagctttaagctatgtttatgtacaccaaagcttgtttttatggtctacttgtgaggtgaattgttacagggtagtttggtggtttcttgtacttgatttatgcaatagtagtttgagaatacaagtgatgatggtgggattgcaggggctacatcattcttgttgaaattctaaaggtaagacattgctttgtctaccaaatcagcacctgtattagattagatacttttcctggactttcaccttataaaaaaggaatatttcatcttgacaagtcacctttcctattctggaacctggcagattgttctgttttgagaagtgtaccaggtcaattacgttgttctatttcccctttg

SEQ ID NO: 1898 - DNA, 845 bp, Avena sativa
actctcacgcccggtgtcgatctctcatcccgcccgaccccttcaccgccctctccctgcccagatccgcccccctccttgccagatcgccggccgcctcccccttcctcagccgtaggaagggcggccccagaggaaggcgggcaagatgatcggcgtggggaaggcgaagcagtatgctaacgtgctcgacaagcccctcagccgtggtaggcaggaggtcagtttgagtgcatttgcattcttgttctcagaggtggttcagtacaaccagacacaagttgacaacattgctgagctggaacgaaggctggaggacgctggttatgctgttggtgcaagagttcttgaactgctgtgtcaccgggagaaggggaatagacgtgagactcgactgctggggattttatcattcattcacagtactgtatggaaagtattgtttggaaaggtggctgactcacttgagaaaggaacagaacatgaagatgaatacatgattagtgaaaaagagcttcttgttaaccggttcatttctgtgccaaaagacatgggggcattcaactgtggagcttttgttgcagggattgtaaggggcgtattggataatgctggctttcctgcggtagttacagcgcattttgtgccaattgaaggccagcagaggcccaggacaacaatcttgattaaatttgctgaagaggttttacaccgggaagcaagacttggctaaaaatttatgctatatatgtacactaaactttctttttttttgttctatttgtaagatggatttatttgaagtatgttttgttgactgagagcatgtatttgatttatgtaac

SEQ ID NO: 1899 - DNA, 807 bp, Festuca arundinacea
cgaccccagaggaggacggcgggcaagatgatcggcgtggggaaggcgaagcagtatgctaacgtgctcgacaagcccctcagccgcggcaggcaggaggtcagtttgagtgcatttgcgttcttgttctcggaggttgttcagtacaatcagacacaagttgacaacattgctgagctggaacgaaggctggaggacgctggttatgctgttggtgcaagagttcttgaactgctgtgtcaccgggagaaggggaatagacgtgagactcgactgctggggattttatcattcattcacagtactgtatggaaagtattgtttggaaaggttgctgactcacttgagaaaggaacagaacatgaagatgaatacatgattagtgaaaaggagctgcttgttaaccggttcatttccgtgccaaaagacatgggggcattcaactgtggagctttcgttgcagggattgtaaggggcgtattggataatgctggctttcctgcggtggttacagcgcattttgtgccaattgaaggccaacagaggcccaggacaacaatcttgattaaatttgctgaagaggttctacaccgagaagcacgacttggctaaaatttatgctatatatgtacaccacacttttttttctgttctgtttgtaagatgaatctatttgaaatgtgttctgtttactgagagcatctacttgattcatgtaatactagtagtttgagaatatataagtggttgagggcgatacatgcattattgctggactggaagaaaagcaaaaaaaaaaaaaaaaaa

SEQ ID NO: 1900 - DNA, 889 bp, Lolium multiflorum
agtgacggacagagcttgctcggtttggacaggcagaccgttcagagttatcaaaatcagaaaaacctctcaccccccgcactcgcacccgagcgctcccgacttctcgctctcacgaccgccggcgatccctcctcccaccggcgcccggcccctccaccgctctctccctgcccagatccggccccgtcctgcccagatcgccggtcgcctcccccttcctcagccgtaggaagggcggccccagaggagggcgggcaagatgatcggcgtggggaaggcgaagcagtatgctaacgtgctcgacaagcccctcagccgcggcaggcaggaggtcagtttgagtgcatttgcgttcttgttctcggaggttgttcagtacaatcagacacaagttgacaacattgctgagctggaacgaaggctggaggacgctgggtatgctgttggtgcaagagttcttgaactgctgtgtcaccgggagaaggggaatagacgtgagactcgactgctggggattttatcattcattcacagtactgtatggaaagtattgtttggaaaggtggctgactcacttgagaagggaacagagcatgaagatgaatacatgattagtgaaaaggagctgcttgttaaccgattcatttccgtgccaaaagacatgggggcattcaactgtggagcatttgttgcagggattgtaaggggggtattggataatgctggctttcctgcggtagttacggcgcattttgtgccaattgaaggccagcagaggcccaggacaacaatcttgattaaatttgctgaagaggttttacaccgggaagcaagacttggctaaaatttatgctatatatgtacacaacacttttttctgttctgt

SEQ ID NO: 1901 - DNA, 1794 bp, Ananas comosus
caaacccgattgatctaataatagatctaaaaagcgaagatcgacagagagtaagagagacagagtgggagacgaggagggagacgatcgaagtgaagtactacgtcttcttcttcgacgcgaaacagagcttaacgaagcgatcgagagaggaaggaacgcgatcgccatgatcggggtggggaaagcgaagcaatacgcgaacgtcctcgacaagccccttagcagggggaggcaagaggtcagcttgagtgcatttgccttcttgttttcagaactggtacagtacaatcagacccaagttgacaatattgcagagttggaaagaaggctagaggatgcaggttatgctgttggagcaagagttcttgaacttctctgccatcgagaaaaggggaacaggagggagactcgattattggggattttatccttcattcacagcactgtgtggaaggttctttttggaaaggtggctgactctctcgagaaaggaaccgaacatgaagatgaatacatgatcagtgaaaaggaactgctggttaatcgatttatatctgtacctaaagatatgggtgcctttaattgtggagcttttgttgctgggattgtaaggggtgtcttggatagcgctggattccctgctgtggttacagcacattttgttccaatcgagggtcagcaacgaccgagaactacaatcttgataaagtttgctgaagaggtactacgtagggaagcaagattgggttgaagtttcggagagatcttctctttttaccctgaagtcagaagagctaatcgccggcaaacaaggcagagtaaaattgtttctggtgagttaaacatattcgaatgagttcttcagattggtttcacttattctcgatgaatttaatctctcagcagcagctacttgttagccgcgcttcattctcaacatttgtggtttgtactgcaatatatcatagatacaccgacttatttctttcccccttctttggagtgatacaccagtagtctttttgttgaaatacctcacctcatctatcccttttgtattaccagagtggattttgttcagtgaatcttttgccaatgtatggtggagaaagcactgctttgactctatttgtagtgcatgcacttttatcacattagttatgggcatatcatgatttatatgaattgcatgattttgtctgcaaacctttgcccgggccagacttacagggcctttgattttctttaaaaggaatcatataaagggcttagtttccatagtattctgaggttgttagttgctacattgtctttgtatttccaatacttaaaacagtttgatctctggaatttggcatgtattacacttcaatccttgatcgtgtcacgttttaactttccacctcgcagatgacgtgatagacctggattcggacaacaatttcttcagtataaggtgccagtattgtttttgtctattttagggcattgaacaaattttcgcaccacctacttataccactgacattactattcgccttacttccgggacaagtgtgaatgcaaaactctcgtccatattaaagaagccgagtatgctattaaagagtacctgcttgggttggtgcggaaatagtgtctggtaggtgtagaaatcgtaggcgtgtctcacctatcaattgagcaatacgtccaagaaagagactattcactaccaatctgatccaaatctaatccgagtatttgattcatgtctaacctggatatgtggttgccagtactgtgacacca

SEQ ID NO: 1902 - DNA, 950 bp, Cynodon dactylon
cagcaagccatccccgatctctcgccgcctgcagcccctccgccgctgcggcctcctcctctccacctcgcctccgacagccggccgagctcaccgcctctggagtctggatcctagcccgacgaaagctgcggaaggcagaggaaccccagaggaagagcgggcaagatgatcggcgtgggcaaggcgaaacagtacgccagcgtgctggacaagccgctcagccgcggcaggcaggaggtcagtttgagtgcatttgcattcttgttctcagagttggttcaatacaaccagacacaagttgacaacattgctgagttggaacggagactggaggatgctggttatgctgttggtgccagggtgcttgaacttctctgtcacagggagaagggtaataggcgagagacacgacttctagggattttatcattcatccacagcactgtatggaaagtcttgtttggaaaggtggctgattcacttgagaagggaacagaacatgaggacgaatacatgattagtgaaaaggagcttcttgttaaccggttcatttctgtgccaaaagacatgggagcattcaattgtggagcatttgttgcaggaattgtaaagggtgtattggataattccggttttcctgctgtcgttactgcacactttgtaccgattgaaggtcagcataggccaaggacgacaatcttgattaagtttgctgaagaggttttgcaccgtgaagcacgacttggctgagttttgtgccatgtatgtacaccacaccttttcaagtctgtctgtaaggtgaatcttcttggatagttggtttcatgtgctgatttatgtaaaaatagtatgagaatagaagtgacgaggatgaagattggaggggctttatttttccttcggatattgtaattgtaagacgttgcttcatatctatgaaattactc

SEQ ID NO: 1903 - DNA, 846 bp, Avena sativa
taggaagggcggccccagaggaaggcgggcaagatgatcggcgtggggaaggcgaagcagtatgctaacgtgctcgacaagcccctcagccgtggtaagcaggaggtcagtttgagtgcatttgcattcttgttctcagaggtggttcagtacaaccagacacaagttgacaacattgctgagctggaacgaaggctggaggacgctggttatgctgttggtgcaagagttcttgaactgctgtgtcaccgggagaaggggaatagacgtgagactcgactgctggggattttatcattcattcacagtactgtatggaaagtattgtttggaaaggtggctgactcacttgagaaaggaacagaacatgaagatgaatacatgattagtgaaaaagagcttcttgttaaccggttcatttctgtgccaaaagacatgggggcattcaactgtggagcttttgttgcagggattgtgaggggcgtattggataatgctggctttcctgcggtagttacagcgcattttgtgccaattgaaggccagcagaggcccaggacaacaatcttgattaaatttgctgaagaggttttacaccgggaagcaagacttggctaaaaatctatgctatatatgtacactaaactttcttttcttttgttctatttgtaagatggatttatttgaagtatgttttgttgactgagagcatgtatttgatttatgtaacactagtagtttgagcggtggagagcgacatcgcatgggcatgtttgaattgtggccaaagtgtaccttaccaatattttggtcatgaccaaaaggttggctcttatttggattgtt

SEQ ID NO: 1904 - DNA, 993 bp, Ananas comosus
agagtaagagagacagagtgggagacgaggagggagacgatcgaagtgaagtactacgtcttcttcttcgacgcgaaacagagcttaacgaagcgatcgagagaggaaggaacgcgatcgccatgatcggggtggggaaagcgaagcaatacgcgaacgtcctcgacaagccccttagcagggggaggcaagaggtcagcttgagtgcatttgccttcttgttttcagaactggtacagtacaatcagacccaagttgacaatattgcagagttggaaagaaggctagaggatgcaggttatgctgttggagcaagagttcttgaacttctctgccatcgagaaaaggggaacaggagggagactcgattattggggattttatccttcattcacagcactgtgtggaaggttctttttggaaaggtggctgactctctcgagaaaggaaccgaacatgaagatgaatacatgatcagtgaaaaggaactgctggttaatcgatttatatctgtacccaaagatatgggtgccttcaattgtggagcttttgttgctgggattgtaaggggtgtcttggatagcgctggattccctgctgtggttacagcacattttgttccaatcgagggtcagcaacgaccgagaactacaatcttgataaagtttgctgaagaggtactacgtagggaagcaagattgggttgaagtttcagagagatcctctctttttaccctgaagtcagaagagctaatcgccggcaaacaaggcagagtaaaattgtttctggtgagttaaacatattcgaatgagttcttcagattggtttcacttattctcgatgaatttaatctctaagcagcagctacttgttagccgcgcttcattctcaacatttgtggtttgtactgcaatatatcatagatacaccgacttatttctttcccccttctttggagtgatacaccagtagtctttttgttgaaatacctc

SEQ ID NO: 1905 - DNA, 1302 bp, Secale cereale
gactctcacttctctggttttgtcccgctcacccacgacctcgcctcccgtcggatcgccgccggccccgacctctccaccgccgccttccagtacagctccggatccaggacgctccgaccccacccgcgcccccacacgacaacctccgccgccgccgtcccggcctccctgcgtgcagatccagagtcatcgacctacccggctcccgatctgtccggcccgcgctcctccccgttcaccgtgttgaaagagggaacccaggaacccctgtacggcctcagctttgtcataagtatttcgagaaaccccaagaaatctgaagaaacccggagggagggagaccgcagaggaggccggacaagatgatcggcgtggggaaggcgaaacagtacgcaaacgtgctcgacaagcctctcggtcgtggcagacaggaggtcagtttgagtgcgtttgcattcttgttctcggaattggttcaatacaaccagacacaagttgacaacattgctgagctggaacggaggctggaggacgctggttatgctgttggtgcaagggttcttgaactgctgtgtcacagggagaaggggaatagacgagagactcgactgctgggcattttatcattcattcacagcactgtatggaaagttctttttggaaaggtggctgactcgcttgagaaaggaacagaacatgaggatgaatacatgattagcgagaaggagcttcttgttaaccggttcatttccgtgccgaaagacatgggggcattcaactgcggagcgtttgttgcagggagttgtaaggggcgtactggacaatgctggctttcccgcggtggtgacggcgcattttgtgccaattgaaggccagcagaggcccaggacaacgatcttgattaaatttgctgaagaggttatacaccgggaagcgaggcttggctgagatttctgccatctgtgtacacctcgttgcgaaagattgtttttatccaccgagttaatttcccataacttgaatttttagcttcgttcgtcctaccttgtatttaaggagcgtcccagcattcttgtctgcaaactattaaaactccccgacccgtcagtgaaattgggcaagatattatgggcatgaaccgcaaactctcggaatgttcaaaatatagctttgagagaatggtaattggactagaaatgtgcagtcagaaatggcaattggacaagaattggtgatttatgtaaggattgtactgtaagatttttttattgatttttatgcatggattggtccagtaaa

SEQ ID NO: 1906 - DNA, 1255 bp, Hordeum vulgare
ctactcgtcccgctcacacccgacctcgcctccgccagcccgccgtgcctctccccgcccccaccgtctccatccaagccggttccggatccaggccgctccgtccccgcccgctcccccacacgtcaatctcggccgcccccgtcccgccctccctgcgtgcagatccacagtcctcgacatccccggctcccgatctgcccggcccgcgctcctccgcgtccgctgtatagaaagaggtaacccaggaacccctgtacggtctcagcttggtcataagtatttcgacaaaccccaagaaatctgaagaaacccggaggaagggagaacccagaggaggccagacaagatgatcggcgtggggaaggcgaaacagtatgcaaacgtgctcgacaagcctctcggtcgtggcagacaggaggtcagtttgagtgcgtttgcattcttgttctcggaggtagttcaatacaaccagactcaagttgacaacattgctgagctggaaaggaggctggaggacgctggttatgctgttggtgcaagagttcttgaactcctatgtcacagggagaaggggaatagacgagagactcgactgctgggcattttatcattcattcacagcacggtatggaaagtactgtttggaaaggtggctgactcgcttgagaaagggacagaacatgaggatgaatacatgattagtgagaaggagcttcttgttaaccggttcatttccgtgccgaaagacatgggagcattcaactgtggagcttttgttgcagggattgtaaggggcgtattggacaacgctggctttcctgcggtggtgacggcacattttgtgccaattgaaggccaacagaggcccaggacaacgatcttgattaaatttgctgaagaggttatacaccgggaagcgaggctcggctgaaatttctgccatctgtgtacaccttgttgcgaaagattgtttttatccgcaaagttaatctcccataacttgaatttttcactttgttcgttctaccttgtatggaaggagcgtcccagcattcttgtttgcaaactattaaaactctccgccctgcaatgacgatttgttagtgaaattgggcaagatatagtgatatgtgcatgaaccgcaaacccccggaatgttcaggatataaatataacatttggtgaatgcaacatttatgtgcccgtgcacatataaatgtaacacaagctcctctgctgggttgtgcctccg

SEQ ID NO: 1907 - DNA, 1005 bp, Pseudoroegneria spicata
attccaagaattctgaagaaagcccaaggaaagagaccccagaggagggcaagatgatcagcgtagggaaggcgaagcagtatgcgaacgttcttgacaagcccctcagccgtggcagacaggaggtcagtttgagtgcattcgcattcttgttctcggagttggttcaatacaaccagacacaagttgacaacattgctgagctggaacgaaggctggaggacgctggttatgctgttggcgccagagttcttgaactgctgtgtcacagggagaaggggaatagacgagagactcgcctgctgggcattttatccttcattcacagcaccgtatggaaagtactgtttggaaaggtggctgactcccttgagaaaggcaccgaacatgaggatgaatacatgattagtgacaaggagctccttgttaaccggttcatttccgtgccgaaagacatgggcgcattcaactgtggagcttttgttgcagggattgtaaggggcgtattggacaatgctggctttcccgcggtcgtcacggcgcattttgtgccaattgaaggccagcagaggcccaggacaacaatcttgattaaatttgctgaagaggttatacaccgggaagcgaggctcggctgaaatttctgccatttgtgtacacctcattgcgaaagattgtttttatccaccgagttaatctcccataacttgaatttttagcttcgtttgttctaccttgtatggaaggcgcgttccagcattcttgtttgcaaactattaaaactctctgcgccctccatgatgagttgttagtgaaattgggcatgaaccgcaaactctcggaatgttcaagatgtagcttgagagttccggtgggcgaatgtgcagtcgggaatggtaattggacaagatttggtgaattatgcaaggactgtcatgtaagaatcagttctttttgtaccaaaaaaaggtaacgaaaatacaaacagagcctccgcttcaagta

SEQ ID NO: 1908 - DNA, 895 bp, Oryza sativa
agagctcgactactccgctccgcccggccacagcccaattcacgccacccgctccgcctctcgccgcctcgaccgcggccggcggccaccgctccggaggagggtgggcaagatgatcggcgtcgggaaggcgaagcagtacgccaacgtgctcgacaagcccctcagccgcggcaggcaggaggtcagtttgagtgcatttgcgttcctgttctcagagttggttcaatacaaccagacacaggttgataacattgctgagctggaaagaaggctggaagatgctggttatgctgttggtgcaagagttcttgaactactctgtcacagagagaaggggaataggcgagagactcgactgctaggtatattatcgttcattcacagcactgtatggaaagttttgtttgggaaggtggctgactcacttgagaaaggaacagaacatgaggatgaatacatgattagtgaaaaggagcttcttgttaaccggttcatttcggtgcccaaggacatgggagcattcaattgtggagcttttgttgcaggaatcgtaaggggtgtactggaaaatgctggctttcctgcggtagttactgcacactttgtgccaattgagggccaacaaaggccaaggacaacaatcttgataaaatttgctgaagaggttttacagcgagaagctagatttggctaaattttatcatatgttcacacttctttctgatcaattggtgaagatactgttgaaatgtttttttgtggctgactccacatgatttgtgtaccagtagttgcgaatagaagcgaaggagaaatcgttttgtttggaactgtaaaacatttgcttggatttacctcgtatataatgaatattcaagaattcttaagattt

SEQ ID NO: 1909 - DNA, 1379 bp, Secale cereale
tctcacttctctggtttcgtcccgctcacgcccgacctcgcctcccgtcgagtcgccgccggccccgacctctccgccgctttccagtacagctccggatccaggacgctcggaccccacccgcgccccacacgacaacctccgccgccgccgtccccgcctccctgtgtgcagatccagagtcatcgacctacccggctcccgatctgtccggcccgcgctcctccccgttcaccgagggaacccaggaacccctgtacggcctcagcttggtcataagtatttcgagaaaccccaagaaatctgaagaaaccccgagggagggagaccacagaggaggccggacaagatgatcggcgtggggaaggcgaaacagtacgcaaatgtgctcgacaagcctctcggtcgtggcagacaggaggtcagtttgagtgcttttgcgttcctgttctcggaggtggttcaatacaaccagacacaagtagacaacatcgctgagctagaacgaaggctggaggatgctggttatgctgttggtgcaagagttcttgaactgctgtgtcacagggagaaggggaatagacgcgagactcgactgctggggattttatcatttattcacagcaccgtatggaaagtactgtttggaaaggtggctgactcgcttgagaaaggaacagaacatgaggatgaatacatgattagtgagaaggagcttcttgttaaccggttcatttctgtgccgaaagacatgggggcattcaactgtggagcttttgttgcagggattgtaaggggcgtactggacaatgctggctttcccgcggtggtgacggcgcattttgtgccaattgaaggccagcagaggcccaggacaacgatcttgattaaatttgctgaagaggttatacaccgggaagcaaggcttggctgagatttctgccatctgtgtacacctcattgcgaaagattgtttttatccaccgagttaatttcccataacttgaatttttagcttcgttcgtcctaccttgtatttaaggggcgtcccagcattcttgtctgcaaactattaaaactctccgacctgtcagtgaaattgggcaagatattatgggcatgaaccgcaaactctcggaatgttcaagatatagctttgagagaatggtaattggactagaaatgtgcagtcagaaatggcaattggacaagaattggtgatttatgcaaggattgtactgtaagaccgaaaaccgaaaaacctggttttactttggtaggtgcattttgcaaaatattgtgtgtctttcttctctttttcttttttttgctaggaatgtgccgtgatttagaacaaggtaaaagttcaagggaaaaaa

SEQ ID NO: 1910 - DNA, 1337 bp, Secale cereale
gactcacttctctggtttcgtcccgctcacagccgatctcgcctcccgtcggatcgccgccggccctgcccgccgtgcccgtgcccgtccccacccccaccacctccatccaagccagctccggatccaggccgctccgtccccgcccgcgccgccacgcttcaatctccgccgcctccgtccccgcccgtcccggcctccctgcgtcaagatctacccggctcccgatctgtccggcccgcgccccccctcgtccactgcgttgaaagagggaacccaggaacccctgtacggcctcagcttggtcataagtatttcgagaaaccccaagaaatctgaagaaaccccgagggagggagaccacagaggaggccggacaagatgatcggcgtggggaaggcgaaacagtacgcaaacgtgctcgacaagcctctcggtcgtggcagacaggaggtcagtttgagtgcttttgcattcttgttctcggagttggttcaatacaaccagacacaagttgacaacattgctgagctggaacggaggctggaggacgctggttatgctgttggtgcaagggttcttgaactgctgtgtcacagggagaaggggaatagacgagagactcgactgctgggcattttatcattcattcacagcactgtatggaaagttctttttggaaaggtggctgactcgcttgagaaaggaacagaacatgaggatgaatacatgattagcgagaaggagcttcttgttaaccggttcatttccgtgccgaaagacatgggggcattcaactgcggagcttttgttgcagggattgtaaggggcgtactggacaatgctggctttcccgcggtggtgacgtcgcattttgtgccaattgaaggccagcagaggcccaggacaacgatcttgattaaatttgctgaagaggttatacaccgggaagcaaggcttggctgagatttctgccatatatgtacacctcattgcgaaagattattcttatccaccgagttaatttcccataacttgaatttttagcttcgttcgtcctaccttgtatttaaggagcgtcccagcattcttgtctgcaaactattaaaactctccgacccgtcagtgaaattgggcaagatattatgggcatgaaccgcaaactctcggaatgttcaaaatatagttttcagagaatggtaattggactagaaatgtgcagtcagaaatggcaattggacaagaattggtgattttatgtaaaggattgtactgtaagattttttttatgatttttatgcatggattggtccagtaaatgagtttgctaaggtggg

SEQ ID NO: 1911 - DNA, 3501 bp, Triticum aestivum
gttcttcctcatctacccactgcgcacggaggctgttcccggcgacgggcggtgaatttcccagcgacgagagagcctggattctgaagtgcaggcagatccacaccgtcgggtcctgctcctccgacggccgcttctcctcccgcaaagtccagcgccgccactggtgctgtggtcgacaaaagctaccttacttctagagttgcagcgaagaaatagagaagccaggaaccccttctaaacggattcagcttgtgcagtattccaagaattctgaagaaaccccaaggaaagagacccagaggagggcgggcaggatgatcagtgttgggaagacgaagcagtatgcaaacgttcttgacaagcccctcagccgaggcagacaggaggtcagtttgagtgcgtttgcattcttgttctcggagttagttcaatacaaccagacacaagttgacaacattgctgagctggaacggaggctggaggatgctggttatgctgttggtgcaagagttcttgaactgctgtgtcacagggagaaggggaatagacgagagactcgactgctgggcattttatcattcattcacagcacagtatggaaagtactgtttggaaaggtggctgactcgcttgagaaaggaacagaacatgaggatgaatacatgattagtgaaaaggagcttcttgttaaccggttcatttccgtgccgaaagacatgggggcattcaactgtggagcttttgttgcagggattgtaaggggcgtattggacaatgctggttttccagcggtagttacggcacattttgtgccaattgaaggccagcagaggcccaggacaacaatcttgattaaatttgctgaagaggttttacgtcgggaatcaagacttggctgaaactcgtcatctatgtacacctcaacggggaagattgcttttatccaccaagttaatctcccgtaactttaatttttttttcttttgttcgttctacattgtatggaaggagtgtcccggcattcttgtttgcaaactcttaaaactctctgccttgcgatgagttagtgtaattgagtcagaatgttcaagacaaagctttaagaattccgatggcgaatgtgcagtcagaaatggtatttggacaagatttggtgatttatgcaaggactgactgtcctgaaagaatcagttttgttttgctgcctttgttcttgctgcaaaaacgagcacccaacaacagtaattaacacaaacgacacccagatgtaagatgcatcaacaaccaaccaaaactataagccaggaaatgtatatgtcgatcacaccgggcagatagctcagcctatccagtaagtggattacattatacccataccatatgctgcacaacaaaaataagcagagaccactgttttttatttattcagaaaaatgtcagaataactcttcagatctcagcacccaagggtgcacacaaccagttttttacaaactcgtagttctaccagtcataaaacaaaaataaagaagtcaggtattattgaaccatgacccagttttagacataaaccctccatcatggcctcctgctgatccgttcgcgacaacattggccacgactgtagccagttgatagatgtacatagccagcatgctgaatcaaggatcgagatccttcttaagacaccacaatgctgctcgccgactcatttaaaggaggacaaacttcagaaatccccatacgactgaatgctggattcagttgatcatttgaattctctgcttcatcaccagatttgaacaacaaaacttttggcccatttgggtgttcctcagcggccttctcccattgtttctgggtctcttgactgactctaggatgaaggatgacttcctcaagatgttcgaaacattcaatattgatgacagaaagagcatttatatctttgcaaagaagctggagtgtgacgagaaaccgcatagctccttgtttgattgtggggaatgtcggacgttgcagctcaaaacaaaggcgtagaagcctgggcagtgcatgaacttctatactgaagtcctcaatttcgtgagcaatcagttttaaatactgcaggtggctcaaactactcaaagcttcaagaacactagttgtaagtttagtagtcgaaaggcaaagctccttgagaccccgaagtgatacaacaaactgaggcaagatagttaagttgccatgtaatttcagagagctcaggtagcagggtccttgtatggaatccaggaaatctccagagcattcatcgaaatgaagagataaagaacgtgtagtatcactattttcgtcctttttgtcctgaatgaactgttgaatggccctgataagatcggaccagtcagtgctacttgcagttgcagatggcttacaccaaatcttcaccttcctcaatctattcatatgacccatgagatgaagaaacccttcacttccatcggtgataaatcctgctagagtttcgatgctactttttccttccaaaagaaacttctgtacttcactccctgtcttctttttgaggaaaacactctttttatagactttgcctgaaatcctaaactctcccaatatgtgcattaagcagggcaacaagaaaacttccactggtagtatatttacctttgttctcctcacatcaagtgcctccaaatgctccagttttgcaatatcctctggaagttcggtaacactacccccaaggctcagatacttcagcagcagcaggttgcatatgcctttgatatgatcatccttcaagtcatcacatttttcaagatccaggactcgcagcagttcatacttgctgaaattgagtacagttttacatgcctccccgaagattgtcagggatcggacaagtgataaatcaatattcttgaatctgtcatcatctttagcatttttatgatggagagaaagccgacgggcatatttgccagcctctttcttgtcatcacaaaacaaagttacaaagttctgggagactgacaactgcaaaatgaactcacgcatcatgccataagtttggcaagtcttaacgttaccattgttgcttacaccgatgggttcgatgaggttccggtccataagctcgtcaaaattttcagctgcaagtttcatggcatcacatgaagcttgggtttctacaatcccctcagctgaccatcgcctcaacaagcttttctttctcatgggatgatcactcgggaacatggcaaaatataacaagcaggctttgagagcatggccgcccagactggcgtagctacgcatcagagcgcgtcgcatatcaccaaaggtctctccgttctccatatgataacgaatgttgttgcatgcatcttcacaggtacgtccaatcggccaaccaaattagtattttactaaagaaatttacctaacccccaacttagggttaaaagttaccgtaacgggggaccggaaaac

SEQ ID NO: 1912 - DNA, 823 bp, Musa acuminata
caaaaggaggcggtgttctgtgtgtgcttggaagacgaaatcgagggggagagagagagggcgaagagccatgatcggcgtaggaaagatcaagcagtacgccaacgtgctcgaaaagcctctcagcagaggccggcaggaggtcagcttgagtgcgtttgcattcttgttctcagagttagttcagtacaaccagactcaagttgataatattgcagagctagagagaaggcttgaggatgcaggctatgctgttggtgcaagagttcttgagcttctttgccatagagagaagggtaacagaagggagacacgattacttgggattttatcttttgtgcatagcacagtttggaaggtgcttttcggaaaggtggctgattcgcttgagaaaggaactgaacacgaagatgagtacatgataagcgaaaaggagcttctggtcaaccgatttatatccataccaaaggacatgggagcattcaattgtggggcatttgttgctggaattgtcaagggtgtcttagataatgcaggttttcctgctgtcgtgacggcgcactttgtccctatggagggccaacagcgaccacgaactacaattttgataaagtttgcagaagaggtactccgtagagaagcaagactaggctgatgtcgtctgctagctaatgttatctatcaagtggggcaatcctgatgcactttttgaatacttcgacagcagcactaaatgtatgacgatattctcgatgactttccaaaagttgatgtctttctttgtgtgtaagctgacgttgatcgtatgatgcaattatgaaac

SEQ ID NO: 1913 - DNA, 935 bp, Musa acuminata
atatacaaaaggaggcggtgttctgtgtgtgcgtgcttggaagacgaaatcgagggggagagagagagagggcgaagagccatgatcggcgtaggaaagatcaagcagtacgccaacgtgctcgaaaagcctctcagcagaggccggcaggaggtcagcctgagtgcgtttgcattcttgttctcagagttagttcagtacaaccagactcaagttgataatattgcagagctagagagaaggcttgaggatgctggctatgctgttggtgcaagagttcttgagcttctttgccatagagagaagggtaacagaagggagacacgattacttgggattttatcttttgtgcatagcacagtttggaaggtgcttttcggaaaggtggctgattcgcttgagaaaggaactgaacacgaagatgagtacatgataagcgaaaaggagcttctggtcaaccgatttatatccataccaaaggacatgggagcattcaattgtggggcatttgttgcaggaattgtcaagggtgtcttagataatgcaggttttcctgctgtcgtgacagcgcactttgtccctatggagggccaacagcgaccacgaactacaattttgataaagtttgcagaagaggtactccgtagagaagcaagactaggctgatgtcgtatgctagctgatgttatctatctagtggggaatcctgacgcactttttgaatacttcgacagcagcactaaatgtatgacgatattctcgatgactttccaaaagttgatgtctttctttgtgtgtaagctgacgttgatcgtatgatgcaattatgaaactccaatttcatctgaattcttgtaaagattcatgtcttcacctattcttcatgattctaatgacttacatcgatcagtggcatctcaggaagtgtgtcagta

SEQ ID NO: 1914 - DNA, 1182 bp, Secale cereale
accgtcactcctttcgtcacaaagccccccacaagcacaacaacacgtatccccgcttccccgctgtgttctcccccatcttcccactgcgcacggaggctgttcccggcgacgggcggtgacctggattctgaagtgcaggcagatctatcatcatcgggtcctgctcctccgacgtccgcttctcctcccgcgaagtccagcgccgccactggtgctgtggtcgacaaaagctacctcacttctagtgttgctgctgagaaatagagaagcccggaaccccttctaaacggattcagcttgtgcagtattccaagaattctgaagaaaccccaaggaaagagacccagaggagggcgggcaagatgatcagtgtagggaagacgaagcagtatgcaaacgttcttgacaagcccctcagccgtggcagacaggaggtcagtttgagtgcattcgcattcttgttctcggagttggttcaatacaaccagacacaagttgacaacattgctgacctggaacgaaggctggaggacgctggttatgctgttggtgctagagttcttgaactactgtgtcacagggagaaggggaatagacgagagactcgactgctggggattttatcattcattcacagcactgtatggaaagtactgtttggaaaggtggctgactcgcttgagaaaggaacagaacatgaggatgaatacatgattagtgaaaaggagcttcttgttaaccggttcatttccgtgccgaaagacatgggagcattcaactgtggagcttttgttgcagggattgtaaggggcgtattggacaatgctggttttccagcggtagttacggcacattttgtgccaattgaaggccagcagaggcccaggacaacaatcttgattaaatttgctgaagaggttttacgtcgggaatcaagacttggctgaaatgcacaccaggctatttcttctgttctgtttgtaagatgaatccatttcaaatatgttttgttcttgatttatgtaatactaatatactggtaattttccctcgaaaaagtatactggtaattttgagaatataagcagtagcctcattttatgagtgtctgacacgggaatactagcgaattgtatatgcagaagagaaacatcaaaaggattagaagagcccacgggg

SEQ ID NO: 1915 - DNA, 1539 bp, Triticum aestivum
ccaggggctgtggcgatagggtgcgacggaggtgggcggcggtcgtctctacgtgctgacgtggactagtaccctactgccagggctgctggcggtaggctgtctaaccctaccgtcagaacccctgacgataagaaaaagggttaaatcctgaattttttccaaccagggtgagatcctgaatttgtatgccataagggtcaaaacacgaaatttagcccccgctgtgttcttcctcatctacccactgcgcacggaggctgttcccggcgacgggcggtgaatttcccagcgacgagagagcctggattctgaagtgcaggcagatccacaccgtcggtcctgctcctccgacggccgcttctcctcccgcaaagtccagcgccgccactggtgctgtggtcgacaaaagctacctcacttctagtgttgcagcgaagaaataagaagccaggaaccccttctaaacggattcagcctgtgcagtattccaagaattctgaagaaaccccaaggaaagagacccagaggaggccggacaagatgatcggcgtggggaaggcgaaacagtacgcaaacgtgctcgacaagcctctcggtcgtggcagacaggaggtcagtttgagtgcattcgcattcttgttctcggaggtggttcaatacaaccagacacaagttgacaacattgctgacctggaacgaaggctggaggacgctggttatgctgttggtgctagagttcttgaactgctgtgtcacagggagaaggggaatagacgagagactcgactgctggggattttatcattcattcacagcactgtatggaaagtactgttcggaaaggtggctgactcgcttgagaaaggaacagaacatgaggatgaatacatgattagtgaaaaggagcttcttgttaaccggttcatttccgtgccgaaagacatgggggcattcaactgtggagcttttgttgcagggattgtaaggggcgtattggacaatgctggttttccagcggtagttacggcacattttgtgccaattgaaggccagcagaggcccaggacaacgatcttgattaaatttgctcaagaggttatacaccgggaagcgaggctcggctgaagctcatgccatctatgtacacctcattgcggaagatttcttttatccaccgagttaatctcgtattacgactttgtactaaatctgcgacacttattttggggcggagggagtattagatttgttcctgctaccttgtatggaaggagcgtctcggaattcttgtttgcacactctcaaaacctgtctgcccagccatgacgagttatggtgaatctgggcaagatgtacatgtactgacatgtgcatgaactgcaaactctcataatgtgaaagatatggtttcgagagtacaaagaaaaggcaaacaaaacacaaacagagcaccagtttcaagctacaggtggatgcaacatttatgagcctctgtatgcgctctatgtaactcgtgctccctccgtaaagaaatat

SEQ ID NO: 1916 - DNA, 1257 bp, Triticum aestivum
caccccgcctccccgctgtgttcttccccatcttcccactgcgcacggaggctgttcccggcgacgggcggtgattttcccagcgacgaaagaggctggattctgaagttgctgccagatccatcatcgtcgggtcctgctcctccgacggccgcttctcctcccgcaaagtccagcgccgccactgtattccaagaattctgaagaaaccccaaggaaagagacccagaggagggcgggcaagatgatcagtgttgggaagacgaagcagtatgcaaacgttcttgacaagcccctcagccgtggcagacaggaggtcagtttgagtgcattcgcattcttgttctcggaggtggttcaatacaaccagacacaagttgacaacattgctgacctggaacgaaggctggaggacgctggttatgctgttggtgctagagttcttgaactgctgtgtcacagggagaaggggaatagacgagagactcgactgctggggattttatcattcattcacagcaatgtatggaaagtactgttcggaaaggtggctgactcgcttgagaaaggaacagaacatgaggatgaatacatgattagtgaaaaggagcttcttgttaaccggttcatttccgtgccgaaagacatgggggcattcaactgtggagcttttgttgcagggattgtaaggggcgtattggacaatgctggttttccagcggtagttacggcacattttgtgccaattgaaggccagcagaggcccaggacaacaatcttgattaaatttgctgaagaggttttacgtcgggaatcaagacttggctgaaatgcacaccaggctatttcttctgttctgtttgcaagatgaatccatttcaaatatgttttgttcttgatttatgtaatactaatatattggtaattttccatcgaaaaggtatactggtaattttgagaatataagcagtagcctcattttatgagtgtccgacacgggaatactagcaaaatgtatgtgcagaagagaaacatcaaaaggattagaagagcccacggggaagttgaaaagtggactagttgctttcctgcatgttatggcctgtttggttatctacatcgtttttggtctatttatccgtggctgagtttagctggctgagggaatacatgcaaaaaatcatgttgtgcacaggtgcaaaacctggtgtttcgttgtgcacggcctaatgttctggcaccctttctcattaataa

SEQ ID NO: 1917 - DNA, 1086 bp, Lippia dulcis
aagaaatcagtataattagttaattccttcaccagattccagtacaagacaactgcaactaaaactcagtcgaaattgcgaaactgcgttacacagacagagggtgattgagagagggctagagatgataggagttgggaaagtgaagcaatatgcaaatgtgctcgatagacctctcagcaaaggaaaacaagaggtgagtttgagtgcgtttgcattcttgttttccgagcttgttcaatataatcagacgcaagtcgataacatagcagagttggaaagaaggctagaggatgctggatacgctgttggagccagggtactggaacttctttgtcacagggaaaagggtaacagaagagagacacgtctcttgggtatcctgtccttcatacacagcacagtctggaaggtcttgtttggaaaggtggctgactctcttgaaaaaggcactgagcatgaagatgagtacatgatcagcgagaaggaacttcttgtgaacagatttatctccatacccaaagatatgggtgccttcaactgtggagcatttgttgctggaattgtgaggggagtcttggataatgcagggtttcccgctgtcgtaacagctcattttgtacctgtagatgggcaacagagaccaagaacaaccattttgatcaagtttgctgaagaggtgctgcaacgggaagcgagattaggttgaagcagattattgatctacaaaattaaatcgacggaacctgctgcactataacgaatgagagagtacgtttctcgaacaatgctgcttttaaactgcaaattcttagacatgtctgccggcttgtggcagttggcttttttaaaagtccaaaatttgacaatacttagtggatcatatcatgtttaggggattgttgatgaatgaaacctgttgaatttctgggttttattagattgtatgatagctacacgtcttttcatcattctgtatggaaaaatctctctatttttttctgatggtatggtaatactaatatatggttataaataatttatttgttacttgtccattctcttattagaaacaacagtatgtaa

SEQ ID NO: 1918 - DNA, 958 bp, Centaurea maculosa
attataagtaacaccctataacaactagttggtaattaaattatctcatttagtatctggaagatgatcggagctgggaagatgaaagcagtacgcaaatgtgctcgataagccccttagcaagggtagacaagaggtgagtttgagtgcatttgcttacttattttcagagcttgttcagtacaatcaaacccaagttgataacattggagacctagaaaggagattggaggatgctggctatgctgttggggcacgggtgctggagttactttgccatagggaaaagggcaacagaagggagacaaggctgttgggcattttgtcttttatacatagtacagtatggaaggttttatttggaaaggttgctgactcgcttgaaaaaggcactgaacatgaagatgaatatatgatcagtgaaaaggagcttctggttaatagattcatttctgtaccaaaggatatgggaaccttcaattgtggtgcttttggtgctgggatagtaaggggagttttagataacgcaggcttcccagctgtcgttaccgctcattttgttcctgtggaaggtcaacagcgacctcgcactaccattttgataaagtttgctgaagaggtactacgaagggaagccagattaggatgatatggcgttttggcttgatatttgcatatgatacatgtttgaaatacaaaaatcaaacatgaagacttgagacagaatttggtcacacaataacactgatttttgaggtgaatttaaagtgtcatattgcaagggcatttgtgtaaatttcaaattctatgggttcttgagaaggtttcctttttttaaactgtggctgtcatcatgcagaaatatagaattgtgatgtagaaatgttattccagaatcattgatttgtgctaaatgtagtgtagaaacatgatttgtttgtaaggtttgtaaagataa

SEQ ID NO: 1919 - DNA, 1104 bp, Cocos nucifera
gggggttagcaagaacttccctcggatcctcacctccattgatacctgcaagcagaagagagggaggaggtcagaagccatgatcggggcaggaaagatcaagcagtacgccaacgtcctcgacaaaccccttagcaggggcaggcaagaggtcagcttaagtgcatttgcattcttgttttcagaattggtgcagtacaatcaaactcgagttgataatattgcagaattggagcgaaggctagaggatgcaggctatgctgttggagccagagttcttgaactgctttgccatagagagaagggaaacaggagggagacacggctactggggattttatcatttgtgcatagcaccgtgtggaaggtgctctttggaaaggtagctgattcacttgagaaaggaactgaacatgaagatgagtacatgatcagtgaaaaggaacttctggttaaccgatttatatccataccgaaagacatggggacattcaactgtggggcatttgttgctggaattgtaaagggtgtcttagatggtgctggtttccctgctgtggtaacagcacattttgtacctgtagaaggtcaacaccgaccacggacgacaattttaataaagtttgctgaagaggtactccaaagggaagcaagacttggctgaattctgatagatatttgcagctgctgcactcaacgatgtttgccacaagtctttccagatactttgatgcatcaacagcacagcatttcaccttgcttttcagagggcgcagcatcaattcttcttttgtatcatacttaaatgtagttagctgttttaagatttttgcctgtggctgcttgtttctgtttccagctgagattggatctgcttgatgcatggttagattctatcacatttacatttgtactactactctcttatatgcacacttttgcatgtctgcgtgctcacattgtcggaaccttgcaaggcctggaagggggaggtagatgttggatttgtctccaaccttcgggattgggggacaagggtggagttgctccaatcccactaccgatcccagaacaacccgtgattgattattctgtggacacagc

SEQ ID NO: 1920 - DNA, 591 bp, Manihot esculenta
ctaaatatgattggagtaggcaaagtcaagcaatactctaatgttctcgacaagccactcagtaagggtaaacaagaggtcagtttgagtgcatttgcttttttgttttcggagcttgttcagtacaatcagactcaggttgacaacattgctgaattagaacgaaggctggaggatgcaggctatgcagttggggcacgtgttcttgaacttctttgtcatagagagaaggggaacagaagggaaactcgattattgggtattttatcttttgtacacagcacagtgtggaaggtgttgtttggaaaggtagctgactccctcgagaaaggcactgaacatgaagatgaatatatgatcagtgagaaggagcttcttgtgaacagatttatttccattccaaaagacatggggacatttaattgtggagcatttgttgctggaatagtgaggggtgttttggatggtgcaggttttccagccgtagtaacagctcattttgtacctatcgagggtcagcaacgaccacggacaaccattttgataaaatttgctgaagaggtattaagaagagaagcaaggttaggttga

SEQ ID NO: 1921 - DNA, 1007 bp, Centaurea maculosa
ccctataacaactagttggattaaatctcatttagtatctggaagatgatcggagctgggaagatgaagcagtacgcaaatgtgctcgataagccccttagcaagggtagacaagaggtgagtttgagtgcatttgcttacttattttcagagcttgttcagtacaatcaaacccaagttgataacattggagacctagaaaggagattggaggatgctggctatgctgttggggcacgagtgctggagctactttgccatagggaaaagggcaatagaagggagacaaggttgctgggcattttgtcttttatacatagtacagtgtggaaggttttatttggaaaggttgctgactcacttgaaaaaggcactgaacatgaagatgaatatatgatcagtgaaaaggagctcctggtcaatagattcatttctgtaccaaaggatatgggaaccttcaattgtggtgcttttggtgctgggatagtaaggggagttttagataacgcaggcttcccagctgtcgttaccgctcattttgttcctgtggaaggtcaacagcgacctcgcactaccatcttgataaagtttgctgaagaggtactacgaagggaagccagattaggatgatatggcgttttggcttgatatttgcatatgatacatgtttgaaatacaaaaatcaaacatgaagacttgagacagaatttggtcacacaataactctgatttttgaggtgaatttaatgtgtcatattgcaagggcatttgtgtaaatttcaaattctatgggttcttgagaaggtttccttttttaaactgtggctgtcatgggtgtacctcaactcaaactcatgcagaaatatagaattgtgatgtagaaaaaatgattccaaaatcagtgatttatgctaaatgtagtgtagaaaacatgatttgtttgtaaggtttgaaagataaattgtcttctttttttgtttttgattaacgtaaattaatccgaaaaa

SEQ ID NO: 1922 - DNA, 777 bp, Centaurea maculosa
aaatcagatcaaacacaccctaaaataagtaactagttgttgttgttggaattaaaccccccattttagtatcgggaagatgatcggagctgggaagatgaaacagtacgcaaatgtgctcgataagccccttagcaagggtagacaagaggtgagtttgagtgcatttgcttacttattctcagagcttgttcagtacaatcaaacccaagttgataacattggagacctagaaaggagattggaggatgctggctatgctgttggggcacgagtgctggagctactttgccatagggaaaagggcaatagaagggagacaaggttgttgggcattttgtcttttatacatagtacagtgtggaaggttttatttggaaaggtcgctgactcgcttgaaaaaggcactgaacatgaagatgaatatatgatcagtgaaaaggagcttctggttaatagattcatttctgtgccaaaggatatgggaaccttcaattgtggtgcttttggtgccgggatagtaaggggagttttagataacgcaggcttcccagctgtcgttaccgctcattttgttcctgtggaaggtcaacaaagacctcgcactaccatcttgataaagttcgctgaagaggtactccgaagagaagcaaggttaggatgatatggtgttttggcttgatatttacatacgattgaaatacaaaaatcaaacatgaagacttgagacagaatttggtcacacaatgactattgttttttaggtgaatttaatgt

SEQ ID NO: 1923 - DNA, 778 bp, Centaurea maculosa
aataagtaactagttgttgttgttggaattaaaccccccattttagtatcgggaagatgatcggagctgggaagatgaaacagtacgctaatgtgctcgataagccccttagcaagggtagacaagaggtgagtttgagtgcatttgcttacttattttcagagcttgttcagtacaatcaaacccaagttgataacattggagacctagaaaggagattggaggatgctggctatgctgttggggcacgagtgctggagctactttgccatagggaaaagggcaatagaagggagacaaggttgttgggcattttgtcttttatacatagtacagtgtggaaggttttgtttggaaaggtcgctgactcgcttgaaaaaggcactgaacatgaagatgaatatatgatcagtgaaaaggagctcctggttaatagattcatttctgtaccaaaggatatgggaaccttcaattgtggtgcttttggtgctgggatagtaaggggagttttagataacgcaggcttcccagctgtcgttaccgctcattttgttcctgtggaaggccaacaaagacctcgcactaccatcttgataaagttcgctgaagaggtactccgaagagaagcaaggttaggatgatatggcgttttggcttgatatttgcatatgattgaaatacaaaaatcaaacatgaagacttgagacagaattttggtcacacaatgactatgatttttgaggttaatttaatgttgtcatattgcaaggccatttgt

SEQ ID NO: 1924 - DNA, 1015 bp, Cirsium arvense
aatttatgaactttgtacaaaatcagatcaaaaaacaccctaaaataagtaactagttgttgttgttggaattaaaccccccattttagtatcgggaagatgatcggagctgggaagatgaaacagtacgctaatgtgctcgataagccccttagcaagggtagacaagaggtgagtttgagtgcatttgcttacttattctcagagcttgttcagtacaatcaaacccaagttgataacattggagacctagaaaggagattggaggatgctggctatgctgttggggcacgagtgctggagctactttgccatagggaaaagggcaatagaagggagacaaggttgttgggcattttgtcttttatacatagtacagtgtggaaggttttatttggaaaggtcgctgactcgcttgaaaaaggcactgaacatgaagatgaatatatgatcagtgaaaaggagcttctggttaatagattcatttctgtgccaaaggatatgggaaccttcaattgtggtgcttttggtgccgggatagtaaggggagttttagataacgcaggcttcccagctgtcgttaccgctcattttgttcctgtggaaggtcaacaaagacctcgcactaccatcttgataaagttcgctgaagaggtactccgaagagaagcaaggttaggatgatatggtgttttggcttgatatttacatacgattgaaatacaaaaatcaaacatgaagacttgagacagaatttggtcacacaatgactattgttttttaggtgaatttaatgttgtcaaaggtcatttgtgtaaatttcaatttgtatgggttcttgagaaggtttgtttttgtaactgtggctgtcatgggtgcacctcaactaatcccatgctgccttaaaagaactccttagttgctctttgaagactcatgcagaaatatacaattgttaggtagaaaaaaatgattccagaaccattgatttatgctaaatgtagtgtaagtaaaa

SEQ ID NO: 1925 - DNA, 879 bp, Cynara scolymus
aaaccgtcatttaacccaaaactacttggaatcaatcacagagagtattgggaagatgatcggagctgggaagatgaagcagtacgcaaatgtgctcgataagccccttagcaagggtagacaagaggtcagtttgagtgcatttgcttacttattttcagagcttgttcagtacaatcaaacccaagttgacaacattggagacctagaaaggagattggaggatgctggctatgctgttggggcacgagtactggagttactttgccatagggaaaagggcaatagaagggagacaaggttgttgggcattttatctttcatacatagtacagtatggaaggttttatttggaaaggtcgctgactcacttgagaaaggcactgaacatgaagatgaatatatgatcagtgaaaaggagctcctagttaatagattcatttctgtaccaaaggatatgggaaccttcaattgtggtgcttttgcagctggaatagtaaggggagtcttagataacgcaggcttcccagctgtggttacggcccattttgttcctgtggaaggtcaacagcgacctcggactaccatcttgataaagtttgctgaggaggtactacgaagagaagcaagattaggatgatacggtgttttggcttgatatttgcatatgatatatgattgaaatacaagaatcaaacatgaagacttgagacatagaatttggcacaataactttgattgttgaggtgattttaatgtgtcatattgcaaggccatttgtgtaaattttaaatgtatgggttcttgagaaagatagcagattttctttttcttctttttgttaaccgttgttgtcaaagccagtctgtgtctatctca

SEQ ID NO: 1926 - DNA, 1157 bp, Elaeis guineensis
tctctctctcgcgcagggatttgcaggaacttccctcagatcctcacctccatcgataactgcaagcagaagaggaggaggaggtgagaagccatgatcggggcaggaaagatcaagcagtacgccaacgtcctcgacaaaccccttagcagggggaggcaagaggtcagcttaagtgcatttgcattcttgttttcagaattggtgcagtacaatcaaactcgagttgataatattgcagaattggagcgaaggctagaggatgcaggctatgctgttggagccagagttcttgaactgctttgccatagagagaagggaaacaggagggagacacggctactggggattttatcatttgtgcatagcaccgtgtggaaggtgctctttggaaaggtagctgattcacttgagaaaggaactgaacatgaagatgagtacatgatcagtgaaaaggaacttctggttaaccgatttatatccataccgaaagacatggggacatttaactgtggggcatttgttgctggaatcgtaaagggtgtcttagatggtgcgggtttccctgctgtcgtaacagcacattttgtacctgtagaaggtcaacaccgaccacggacgacaattttaataaagtttgctgaagaggtactccaaagggaagcaagacttggctgaagtctgataggtatttgcagctgctgcactcaacggtattagattgcagatatttcccacaagtctaaccagatacctttatgcatcaaccgctctggagtttctatatccagtctatgcaatctaaagctagaaaagtagcagacttaaatcagtgtttcaccttgcttttcagagggcacagcatcaattcttcttttgtatcatgcttaaatgtagtttgccgttttaagatttttgcctgtggctgcttgtttctgtttccagctgagattggatctgcttgatgcattgttagattccatcacattcacatttgtactactactatctcattgtgtgcccatgcacacatttgcatgcctgtgtgctcactttgttgaaaccttgcaaaacttggaaagggaatgtagatgttggatttgtctcaaaattttgggattggggaacaaggatggagtagctccaatcccactcgg

SEQ ID NO: 1927 - DNA, 1077 bp, Sesamum indicum
gtactttcgtatagattcacggacagaagaccgcaactcgaactcagtcgaacaccgaaattggatttgagagagaaggggtagggagaatgataggagttgggaaaatcaagccatacacaaatgtgctcgacagacccctcagcaaaggaaaacaagaggtgagtttgagtgcatttgcattcttgttttccgagcttgttcagtacaatcagacgcaagtcgacaacatagcagagctggaaagaaggttagaggatgctggctacgctgttggagctagggttctggaacttctttgtcacagggagaagggtaacagaagggagacaagactattgggtattttatctttcatacacagcacggtgtggaaggtcttgttcggaaaggtggctgactcacttgaaaaaggtactgagcacgaggatgagtacatgatcagtgagaaggaacttcttgtcaacagatttatctcaatacccaaagatatgggtgccttcaactgcggagcatttgttgctggaattgtgaagggagtcttggataatgcaggttttccagctgttgtaacagctcattttgtacctgtggatgggcaacagagaccgaggacaaccattttgattaaatttgctgaagaggtactacaacgagaagcgagattaggctaacattggctactgattttaaaatcagtttttggaaccgggaccaccctggaaaacaaaatatattggttgaaaaagagctgctcttggtctccaagttcgtttacatatttgccagcttttggcaaatttgattgtggatgaaccagttgagttgctgggaaattacatggattttagtagtgagatattattatgtttgagctggaaacccaaattgagcattcattaggctgtatagaaacttgttttcaactatttgtgtggagatcttcttaaattaatcttgggtgttcagacttctagactaccattttatggtgcattctgcattctgcggttaccgcccaccttctctttgaaggatatgtattcatacccaatccatcttccatggataaattta

SEQ ID NO: 1928 - DNA, 1023 bp, Cichorium intybus
accaacaaagacttcttattggaccaacaagaagagttatatcaaaatagttttaaaaagcgatccaaacaccccctaaaaattggttgaacaggttttatggttactcaaacttgggaacagcgagtgaaagagggtttagaattcaggaaagccgagggtgcaattcgcctttgacatcgttactcttgctcggctactgaaaggataacagcgaagatgatcggagtagggaagattaagcagtacacaaatgttctggataaaccccttagtaaaggcaggcaagaggttagcttaagtggatttgcttacttattctcagagcttgttcagtacaaccaaactcaggttgacaacatcggggaactagaaaggagattggaggatgctggttatgctgttggagtacgcgttttggaattactttgtcatagggaaaagggtaacagaagggagacacgtttgttgggcattttgtcttttgtacatagcactgtatggaaggtcctttttggaaaggtagctgactcgcttgagaaaggtaccgaacacgaagatgaatatatgattagtgaaaaagagctcctagtcaatcgatttatttcggtaccaaaagacatggggtcattcaactgtggtgcttttgttgctgggatagttaagggcgttttagacaatgcaggattcccggctgttgtcactgcccattttgttcccgttgacggtcaacaacgccctcggacaaccattttgatcaaatttgctgaggaggtactacgaagggaagcaaggttaggatgatttttgttaaattgtttagctttgtattcatggaattattgcggttttttatgtaattgaagaatcaaagactataaacggttcgaaattaatttaaatttgtagcaagagccaatgagaagtatttttcttgtggatattaagagagtggtacaaagttcttataattgttgaaatttcttattctgtagtggatgttgcaggcaacttttttattta

SEQ ID NO: 1929 - DNA, 709 bp, Echinochloa colona
cctctcggtccctgccttcctcgccttccttcctttcctagcggcggcaaacagagcgagtggcgccgcccctttgcggggcgcttcgcccggcgacgagcatccgtcagggccctatacttggtccgcccctgccgataggtaagagaggacaagatgatcggcgtcgggaaggcgaagcagtacgccaacgtcctcgacaagcccctcagccgcggcaggcaggaggtcagtttgagtgcatttgcattcttgttctcagagttggttcagtacaaccaaacacaagttgacaacattgcggagctggaacggagactggaggatgctggttatgctgttggtgcaagggttcttgaacttctctgtcacagagagaaggggaatagacgagaaacacgacttctggggattttatcattcattcacagcactgtatggaaggtcctatttggaaaggtggctgactcgcttgagaagggaacagaacatgaggacgaatacatgattagtgaaaaggagcttcttgttaacaggttcatttcggtgccaaaagatatgggagcattcaactgcggagcctttgtcgcaggagttgtaaagggtgtattagataatgctggctttcctgcagtagttactgcacactttgtgcctattgaaggccagcaaaggccaaggacaacaatcttgattaaatttgctgagg

SEQ ID NO: 1930 - DNA, 1434 bp, Aristolochia fimbriata
gtgggctctctgaacagggctccacatggattttcttgtgcagtcgggacatccgaattctgaagtatacgtgggcttttctatgttgtccgcaactggatccttaacgtagctgatcccacgggagaaaatctgaattctgagttcgtcgagatcactgcaataactctcaaccctctaaaaagcttgtccattttgtccagaagcagacgaatccttcccggatcaggtgcaggatcctgcgccgctctccgatcattacgtcgtagctgaactatcatagtcctttttcagctgttttctagtgatagagaatgatcggagttgggaagataaagcagtacacaaatgtcctcgacaaacccctcagcagaggaaaacaggaggtcagtttgagtgcttttgccttcttattttcagagcttgtgcagtacaatcagactcaagttgacaacattgctgagttggagcgcaggctcgaggatgctggctatgcagttggtgctagagttcttgaacttctctgtcacagagataagggaaaccgaagagagacaagacttcttgggattttatcctttgtgcatagcactgtctggaaagtgctatttgggaaggtggcggactcacttgagaaagggacagaacatgaagatgaatacatgatcagtgagaaagaacttttggtgaaccgatttatttctataccaaaagatatggggacatttaattgtggggcttttgtggctgggattgtgaggggtgtgttggacagtgcaggttttcctgctgtggtgacagctcattttgtgcccatggagggccagcaaagacctaggacaaccatcttgataaagtttgctgaagaggtgctccgcagagaagcaaggctgggctgatacttcagaaaaaatcactgttatctataaccctgatactgatggagtgaaatcacttttaccctattctctttatcgatggcgaggaatttgaattttataactcggcaagcatctcctattttgcgaggaaattagttcaaggaatctcatgggttttgcttttcgaggagccaattgaccagcagatttcattggtggccatcaatgtactctttgcattgattatctttcatgggcgtcaaatgtgagggggtctgtccaggctttgtatgtagccattagctttaggttaatcagactgcggcggtgtacactgctatagctactatttttcagatttggctggtgataagagaggactcgcattcgtgtttcttttataaaatcttaatagagattccaaactcctgttcatcttatctatttgttacatggggagagagaccttacgactgaatttctacttttcagttttgaaatcagttatcttcaataatattctttgtggctcacgaaagcttcaaccaaaaag

SEQ ID NO: 1931 - DNA, 585 bp, Manihot esculenta
atgatcggagtaggcaaggtcaagcagtattctaatgttctggacaaaccactcagtaagggtaaacaagaggtcagtttgagcgcatttgcatttttgttttcggaactcgttcaatacaaccagacacaagttgacaatatttctgaattagaacgaaggctggaggatgcaggctatgcagttggagctagagttcttgaacttctttgccatagagagaaggggaatagaagggaaactcgattattgggtattttgtcttttgtacacagcacagtgtggaaggtgttgtttggaaaagtagctgactcccttgagaagggcactgaacatgaagatgaatacatgattagtgagaaggagcttcttgtgaacagatttatttccattccaaaagacatggggacatttaactgtggagcatttgttgctggaatagtgaggggtgttttggatggtgcaggttttcctgcggtagtaacagctcattttgtgcctatggagggtcagcaacgacctcggacaaccattttgataaaatttgctgaagaggtactaagaagagaagcaagattaggttga

SEQ ID NO: 1932 - DNA, 1143 bp, Euonymus alatus
cttcgctccctcccgggagccatctttctgtaaactctcaacgggaactcggttgaagctgaaacggatccaaatcttctcatacgcaacgaaagttgtagctactgaaattcgcagaatatagttttctttcaatttctcagcagccaaacagatcgggaccctgaagtcattccggcacaatctgcaattttcttcgattggatccacaagtgttccgttgtagacaagtagaaaagaaactatgatcggggtagggaagatcaagcaatactctaacgtgcttgacaaaccccttagcaagggcaaacaggaggtcagtttaagtgctttcgcattcttgttctcagagcttgttcagtacaatcagacacaggttgataacatttctgagttagaacgaaggcttgaggatgctgggtatgctgttggtgctcgagttttagaacttctttgccatagggataaggggaacagaagagaaacaagattgttgggtattttatcttttgtacacagtaccgtatggaaggtgctttttggaaaggttgctgactcactggaaaaaggcactgaacatgaagatgaatacatgatcagcgaaaaagagctccttgtgaatagattcatttcaattccaaaggatatggggacatttaattgtggggcatttgttgctggaattgtaaaaggtgttttggacagtgcaggttttccagcagtagttacagctcattttgtacccgtagaaggtcagcaacgaccacgaacgaccattttgataaagtttgctgaagaggttcttgtaagagaagcaaggttaggttgatgattgtagcagattatcaccacgtgtttcttgttaacaagctggggcatatttaatgatgcgaatattgaaccggtcagctgcaatcgtggatttttatgactaaatcctgtcaaccataatttgagctcgctttgatttatttcaatatttgcactttacctcttaagagattatgacttttaccgagagaggttattaaaaaggtggctgatgtaaagtaaatattgcgtctgttggtgtttagttgggcttgaatggattgtttaacttgaggatatttgcagatatgtgtatttttgaacttctgaagt

SEQ ID NO: 1933 - DNA, 821 bp, Euphorbia peplus
aatgataggcgtagggaaggcgaagcagtactctaatgtcctcgacaaacctctcagcaagggtaaacaagaggtcagtctgagtgcgtttgcgtttttgttttcggagcttgttcaatacaatcagactcaggttgataacattgctgaacttgaacggaggctggaggatgcagggtatgcagttggggctcgggttcttgaacttctttgccacagagagaagggaaatagaagggaaactcgattgttgggtattttatcatttgtacacagcacagtgtggaaggtgttgtttggaaaagtagctgattcactagagaaaggtactgaacacgaagacgaatatatgatcagtgagaaggagcttctcgtgaacagatttatttctatcccaaaggacatggggacgttcaattgtggagcatttgttgctggaatagtgagaggtgtcttggatggtgcaggtttcccagctgttgtaacagcacattttgtacctatggaaggacagcaacgacctcggacaaccattttgattaagtttgctgaagaggtactaagaagagaagcacgattaggaggttgatcattgtgccaagatttgttcatgcaaaccttctacagcgagtgaacaatagttaacaatattcacctagtatgtcaaactaattggtatcacccgccagtcctattatgacatatataaaatgtggcattatttggttaatatataactagtgatattctaaaagtaattactgcctcttcagttcagttgttgtaaagtatatattctttttgctttaaccgttacatgg

SEQ ID NO: 1934 - DNA, 989 bp, Zingiber officinale
tggttgcgggtcgtgcattagggattgtactcaaacgtaacagatctggccggatataaggcgtgagaagcgagagaaaccatgatcggcgcgggaaagatcaagcactacgcgaacctacttgagaaacccctcagtagaggccggcaggaggtcagtttgagcgcatttgcattcttgttctcagagttggtgcagtacaaccagacacaagttgataacattgccgagttggagagaaggctcgaagatgcaggctatgccgttggggctagagttcttgaacttctttgtcacagagaaaagggtaatagaagggagacaagactgcttgggattttatcgtttgtgcatagcactgtttggaaggtgctcttcggaaaggtggctgactcactcgagaaaggaactgaacatgaagacgagtatatgataagtgaaaaagagcttttagtcaatcggtttatatcgataccaaaggacatgggagcattcaattgtggggcatttgttgctgggattgtcaagggtgttctagatagtgctggtttccctgctgttgtgacagcacactttgtacctatggagggtcaacaacggccacgaacaacaattttgataaagtttgcagaagaggtactcaggagagaagcgaagctaggttaatggattggatgtttattgcaacatttaagggaaactcaagcatttcttgaatctacagcaaatataatctatgcagatatttctagtgacactatcgatattaattgtttttcttctctgcatgctgctgctgctgctggtatgattgcaattattaatctaagttccagtagagttgaggtattatttgcaacaatgggctctcatttctacttcccggtgctgaagactcgaggcttatattcgctgcaagtgtttgtttgtgcattcatgaaagtaccttgtgaggttttgcaatgaaaaaagtacaatttctccgcgtt

SEQ ID NO: 1935 - DNA, 911 bp, Humulus lupulus
aagagaataacttcatcacgcagcacaagacgtttaaacaattggcttccttttcgatccgcaccagcaccaccgcgatcaaagttccacctttgggaaggagaagaaaattttggttaaagaaggaagaggaggtgggaaaccatgatcggggtcgggaaggccaagcagtactcgaatgttcttgacaagcccctcagcaagggaaaacaagaggtcagcttgagtgcttttgcgttcttgttttcagagcttgtgcagtacaatcagactcaagttgacaacattgctgagttagaacggaggctggaggatgcaggctattctgttggtgctcgagttctagagctcctttgccatagagataagggaaacagaagggagacacgtttgttgggtattctatcttttgttcacagcacagtatggaaggtgttatttgggaaggttgccgattcacttgagaaaggcactgagcatgaagatgagtacatgattagtgagaaggagctcctcgtgaacagatttatttctattccaaaagacatgggcacatttaattgtggggcatttgttgctggaattgtaaggggtgttttggatagtgctggttttccagctgtggtgacagctcattttgtacctatagagggtcagcagcgacctcgtacaaccattttaataaaatttgctgaagaggtactaagaagagaagcaaggttaggttgagtgtgttgaagattatcattgtctttatatgccagtagttgttttcatggcaaaaaaggatgttgaatgtttatttttagctagtgattatcaaaagctaattgggtttttcttgtcaatcatgtattgatcatattttatgacaaattcaaatatcaaaatttatttactttactatatta

SEQ ID NO: 1936 - DNA, 746 bp, Scabiosa columbaria
aaaagaatgaagcataaaacattgagtgagaggcaattgaattgagttaagcttcagcgcagtgagtagtgattgatacgaacaaacaagatgatcggagtcggaaagaacaagcagtacacaaacatcctcgacaaacccctcagcaaaggcaaacaagaggtcagtttgagtgcatttgcgtttttgttttcggagctagttcagtataatcagacacaagttgacaacatcgccgatttagaacggagattggaggatgcagggtatgctgttggagctcgtgttttggaactactatgccatagagaaaaggggaaccgaagggagacacgattgttgggtattttgtcttttgtgcatagcacagtgtggaaagttttatttggaaaggtagcagattcattggagaagggcactgaacatgaagatgaatacatgatcagtgaaaaagagctgcttgtcaatagatttatttcaataccaaaggatatggggacatttaactgcggggccttcgttgctggaatagtaaggggtgtactggataatgcaggctttcctgctgtagtcacggctcactttgtaccgattgaaggacagcaacgacctcgaacgaccattttaataaaatttgctgaagaggttcttcgaagagaagcgagattaggatgatttgtatgtttgcttttgcttgtcgtctttgccgagaatctgcaacaatatggtctgcttagagtgagaga

SEQ ID NO: 1937 - DNA, 1027 bp, Daucus carota
aatattactcgtaggaagcaggaagaagcagcggcgtcgtttgattctacacaagtgaaagatcgaagaagcagccatcggaaaagatgatcggagtcggcaagaccaaacaatacgctaacgtcctcgacagacctatcagcaaaggcaaacaagaggtcagtttgagtgcgtttgcgtttttgttttcggagctggttcagtacaatcagactcaagttgataatattgcggaattggagcggaggttggaggatgcaggatatgctgtaggggcacgtgttttggaacttctttgtcacagagagaagggaaatagaagggagacgcgcttattgggtatattgtcttttgtgcacagtacagtatggaaggtgttgtttggaaaggtagctgactctcttgagaaaggcactgaacatgaagatgaatacatgattagcgaaaaggagctccttgtgaataggtttatttcagtaccaaaagatatgggaacatttaattgcggggcttttgtagcaggaatagtgaggggtgttctggatggtgcagggtttcctgctgtagtaacagcccattttgtaccagtggacgggcagcaacgacctcgaacaactattttaataaagtttgctgaagaggtactagtaagagaagcaagattaggatgacatgcgggtgaacttaatatgtcgttgtcctatgtttaactacctcgtcagcgtgccaaacttgcttggtggatggtagaagaaatggcgatacattgctgattttgtctcatatgtggcacgagtactgtcagatttatgagcttaagtgtcaaagatttatatttaaatttcagtgtaaaggaattacatattgaaccaacaaaagagcactgatgtttgtctgttatagagcttggcatcaagctgtgttttaggtatatgcgttgtttttgttggtattaatttctccggtaccggacgctgttcttgcattatatatatttcttaaaagatgatgattttctttcggatgc

SEQ ID NO: 1938 - DNA, 863 bp, Ricinus communis
ctaacactttctgtggaaagataaaaacaaacacagagcaaattcgaagctaaaagatatgatcggagtcggcaagatcaagcaatactctaatgtcctcgataaaccactcagtaagggcaagcaagaggtcagtttgagtgcatttgcatttctgttttccgagctcgtgcagtacaaccagacacaagttgataacattgctgaattagaaagaaggctggaggatgcaggttatgcagttggtgctcgagttcttgaacttctttgccatagggagaagggaaatagaagggaaactcgattgttgggtattttgtcttttgtacacaccacagtatggaaggtcttatttggaaaagtagctgactcccttgagaaaggcacagaacatgaggatgaatacatgatcagcgagaaagagcttctggtaaacagattcatttctattccaaaggacatggggacttttaattgcggagcatttgttgctggaatagtgaggggtgtcttggatagtgcaggttttccagcagttgtaacagctcattttgtaccaatggagggtcagcaacgacctcggacaaccatattgataaaatttgctgaagaggtactaagaagagaagcaaggctaggctaatatctatatgtagatttcatgatgttatgtttgtcaatgttttgcaaaaagaggcgatgattggtgaattttcagctgacttatgaaactaatcaggattgttatacctgccaatcctatcacatatacttggggcattattgcagtcctgtattcaatttatgtacactccttttcacggcacggttataatactgatctggtaaaagcagttgttgcc

SEQ ID NO: 1939 - DNA, 902 bp, Cichorium intybus
accaacaaagacttcttattggaccaacaagaagagttatatcaaaatagttttgaaaagcgatccaaacaccccctaaaaattggttgaacaagttttatggttactcaaacttgggaacagtgagtgaaagagggtttagaattcaggaaagccgagggagcaaatcgcctttgacatcgttactcttgctcggctactgaaaggataacagcgaagatgatcggagtagggaagattaagcagtacacaaatgttctggataaaccccttagtaaaggcagacaagaggttagcttaagtggatttgcttacttattctcagagcttgttcagtacaaccaaactcaggttgacaacatcggggaactagaaaggagattggaggatgctggttatgctgttggagtacgcgttttggaattactttgtcatagggaaaagggtaacagaagggagacacgtttgttgggcattttgtcttttgtacatagcactgtatggaaggtcctttttggaaaggtagctgactcgcttgagaaaggtaccgaacacgaagatgaatatatgattagtgaaaaggagctcctagtcaatcgatttatttcagtaccaaaagacatggggtcattcaactgtggtgcttttgttgctgggatagttaggggcgttttagacaatgcaggattcccggctgttgtcactgcccattttgttcccgttgacggtcaacaacgccctcggacaaccattttgataaaatttgctgaggaggtactacgtagggaagcaaggttaggatgatttttgttaaattgtttggctttgtattcatggaattattgcggttttttatgtaattgaagaatcaaagactataaacggttcgaaattaatttaaa

SEQ ID NO: 1940 - DNA, 884 bp, Cichorium intybus
acaagaagagttatatcaaaatagttttgaaaagcgatccaaacaccccctaaaaattggttgaacaagttttatggttactcaaacttgggaacagcgagtgaaagagggtttagaattcaggaaagccgagggagcaaatcgcctttgacattgttactcttgctcggctactgaaaggataacagcgaagatgatcggagtagggaagattaagcagtacacaaatgttctggataaaccccttagtaaaggtaggcaagaggttagtttaagtggatttgcttacttattctcagagcttgttcagtacaaccaaactcaggttgacaacatcggggaactagaaaggagattggaggatgctggttatgctgttggagtacgtgttttggaattactctgtcatagggaaaagggtaacagaagggagacacgtttgttgggcattttgtcttttgtacatagcactgtatggaaggtcctttttggaaaggtagctgactcgcttgagaaaggtaccgaacacgaagatgaatatatgattagcgaaaaagagctcctagtcaatcgatttatttcagtaccaaaagacatggggtcattcaactgtggtgcttttgttgctgggatagttaggggcgttttagacaatgcaggattcccggctgttgtcactgcccattttgttcccgttgacggtcaacaacgccctcggacaaccattttgataaaatttgctgaggaggtactacgaagggaagcaaggttaggatgatttttgttaacttgtttagctttgtattcatggaattattgcggttttttatgtaattgaagaatcaaagactataaacggttcgaaattaatttaaatttgtagc

SEQ ID NO: 1941 - DNA, 1039 bp, Petroselinum crispum
catacatcaacatatattagatacattaatttgtatgtatatatatatctttcccctcttcaaccttgttctttcaccatctcgtagtaaaccctttaaccaaacacatttgtagagagagagataataaaacagagcaataattaatcatcggagaagatgatcggagtggggaagaacaaacaatacgctaacatcctcgacagacctattagtaaaggcaaacaagaggtcagtttgagtgcatttgcgtttttgttttcggagcttgttcagtataatcagacgcaggttgataatattgctgaattagagcggaggttggaggatgcaggatatgctgttggggcacgtgttttggaacttctatgtcacagagagaagggaaatagaagggagacccgcttattgggtatattgtctttcgtgcacagtacagtatggaaggtgttgtttggaaaggtagctgactcgcttgaaaaaggcactgaacatgaagatgaatacatgattagtgaaaaggagctccttgtaaataggtttatttcagtaccaaaagatatgggaacattcaattgcggggcttttgtagcaggaatagtgaggggtgttctggacggtgcagggtttcctgctgtagtaacagcccattttgtaccagtggaaggccagcaacgacctcggacaaccattctaataaaatttgctgaagaggtacttgtaagagaagcaagactaggatgacatctgggtgaactgaaattgtcattgagctatgtttaaatacattgtcattggtggctacttgcttggtgggtggtggaagaaacggtgatacatggctgactttggtctcatacttgtggcataaatcagtaccgtcagatttgatctattgagctcaactgtcaaagatttatatttaatttcagtgtaaagaaactacaaattgaaccagcaacccaagactgaagctgttctaccatagaatttggtgtcttgttatgtttcgggcatcattaccgttggcgtcattttt

SEQ ID NO: 1942 - DNA, 834 bp, Ambrosia trifida
gtacccggggggggttggatcgtcacgccaaacacccccaaacccttttaccaaaacttaacaccttcattcataaccagatcaacaagatcagtgagtctacaagccagtaagggtttgtagttgaaacttaaggaaacaaatcaccaaggcaatcgaaaacaagatgatcggggcagggaagatgaagcaatacacaaatgtcctcgataaacccctcagtaaaggcagacaagaggtgagtttaagtggtttcgcttacttgttttcggagcttgttcagtataatcagactcaggttgataacattggggagcttgagaggagattggaggatgccggctatgctgttggagtacgagttttggagttactgtgtcacagggaaaagggtaataggagggagacacgcttgctgggcattttgtcttttgtacatagtacagtatggaaggtgctttttggaaaggtagccgactcactagagaaaggtacggaacatgaagatgaatatatgattagtgaaaaggagcttctagtcaacagatttatttcagtaccgaaagacatggggtcgttcaattgtggtgcttttgttgctggcatagtaaagggcgttttagacaatgcaggattcccggctgtggtgactgctcattttgttccagtggacggtcagcaacgacctcgaacaactattttgataaagttcgctgaggaggtacttcgaagagaagcaaggctgggatgatttgttgttatgcgtttgttggcgcgctttgcagtacttatatatacttcaaagaatcaaaatcgaaatgtaacaaaatttat

SEQ ID NO: 1943 - DNA, 934 bp, Brassica juncea
atcgaaccaaaaaccaaaccgggttaaaataaccagcaacaagcagcatctccagtttattttcccggaaatcaacaaaagttctgtgttgagggttcaagtagctgaaaaaggaagaagatgatcggagtggggaaaatgaagcagtactctaatgtccttgacaagccactcagcaaaggcaaacaagaggtgagcttgagcgcatttgccttcttgttctcggagctcgttcagtacaatcaaacccaggttgacaacattgctgagcttgaaagaagactagaggatgctgggtatgcagttggggctcgagtcttggagcttctttgcaaccgagagaagggaaaccgaagagagacacggttactaggaatcttgtcgtttgtccacagcaccgtgtggaaggtgttgtttgggaaggttgctgattcacttgaaaaaggaacagaacatgaagatgagtacatgatcagtgagaaggagcttctcgtcaacaggttcatatcgattccaaaagacatgggaacattcaactgcggggcgtttgtggccggcattgtgaagggagttctggataacgcagggtttcctgctgtggtaacggctcattttgtacccattgaaggacaacaacgccctcggactaccatcttgatcaagtttgctgatgaggtgcttaaaagagaggcacgactgagccaataagagcacacttgttgccacgatctgggaactatattggctttatgtgaactgttagtctggttttggatgatttataatagctttttgaatcgagttgcaaagcccttgtcatccgtgcattgatgtaaactatacataccttcctgttacaactgcagctgacgttacaacactttcttagccgcaaatagatatttttattgcaaggtttctatttaacttcatt

SEQ ID NO: 1944 - DNA, 1321 bp, Fagus grandifolia
tacattactcttacagagctccagttatacgggtgggcttttctcgatctgctccacctgatcgctctctctctcacacacgcacgcacagagcaaaaaggaagaagaagaagagaggattacgatgatcggagttgggaaggtcaagcagtactccaatgttctcgacaagcccctcagcaagggcaagcaagaggtcagtttgagtgcgtttgcgttcttgttttcggagcttgtgcaatacaatcagacgcaggtggacaatattgccgagctagaacgaaggctggaggatgcaggctatgctgttggggctcgagttttggaacttctttgccatagggataagggaaacagaagggaaacacgtttgctgggcattctttcatttgtacacagcacagtttggaaggtgttattcggaaaggtggctgactcacttgagaaaggcactgaacatgaagatgaatacatgatcagtgaaaaggagctccttgtgaatagatttatttcgattccaaaagacatggggacatttaactgtggggcatttgttgctggaatagtaagaggtgttttggatagtgctggttttccagctgttgtaacagctcattttgtgcccatggaaggtcagcaaaggcctcgaacaaccattttgataaaatttgctgaagaggtactacgaagagaagcaaggttaggttgatgtttgtgcctggatttattacatgtaatatttgtgatgctcagcaagaacatgatgactgtgttaatactctgcaatgacatggtgaaggatggtggatttttagctggtttgtcaaatttattatgattttggcctgccaattctgtcacttcagaaaattgaatacctaatattgttttgtgttgctgtatactctacttaatggcacagtaactattcttatctagaattagcattcaccatcactcagttgatgtagaaaaggaacgaatagaaaaaaaaaaaatagttactttcaatgtttatatgaactcaagctgattgtttttaaaaaaatatgttactttcaatgcccagatgcaaaaattgtaagtagtgccctggtgaggtaaagtggtacaatttaaaataaaaatgaaactgaagggacctttaaaacatatgagcaagatcaaagccactgtcgccgggatgttcaatcatgtataggttgttggaataagttggatagcaatagatagggagtggtgactttttctcccctatttaaatataggttgattctttttatttggactaaataaatatagcttgtatcttagtcccact

SEQ ID NO: 1945 - DNA, 1098 bp, Ricinus communis
caatttaatttcccacattttcccagctcccaaacagtactattgcataaccaaactcaaccaaccaaatagactttcctccgtttcgatctaacactttctgtggaaagataaaaacaaacacagagcaaattcgaagctaaaagatatgatcggagtcggcaagatcaagcaatactctaatgtcctcgataaaccactcagtaagggcaagcaagaggtcagtttgagtgcatttgcatttctgttttccgagctcgtgcagtacaaccagacacaagttgataacattgctgaattagaaagaaggctggaggatgcaggttatgcagttggtgctcgagttcttgaacttctttgccatagggagaagggaaatagaagggaaactcgattgttgggtattttgtcttttgtacacaccacagtatggaaggtcttatttggaaaagtagctgactcccttgagaaaggcacagaacatgaggatgaatacatgatcagcgagaaagagcttctggtaaacagattcatttctattccaaaggacatggggacttttaattgcggagcatttgttgctggaatagtgaggggtgtcttggatagtgcaggttttccagcagttgtaacagctcattttgtaccaatggagggtcagcaacgacctcggacaaccatattgataaaatttgctgaagaggtactaagaagagaagcaaggctaggctaatatctatatgtagatttcatgatgttatgtttgtcaatgttttgcaaaaagaggcgatgattggtgaattttcagctgacttatgaaactaatcaggattgttatacctgccaatcctatcacatatacttggggcattattgcagtcctgtattcaatttatgtacactccttttcacggcacggttataatactgatctggtaaaagcagttgttgccacagcagttgatgtaaagtatatattctctttaatgcttatatgataatgaatggttttggtcttatatgaatggttttggttgagttgaattgtgttgtgaatattgaatatgttgttcattgagacagcatatgatccttctc

SEQ ID NO: 1946 - DNA, 987 bp, Citrus clementina
gagtcgcccgtactccgagaagcggcaagcaaacaaaggatcatcgaaaagaaaatcgcgaggcgaaaacatgatcggagtagggaagatcaagcagtactcaaacgtcctcgacaaacccctcagcaaaggcaaacaagaggtaagtttgagtgcatttgcatttctgttctcggagcttgttcagtacaatcaaacgcaggttgacaatattgctgaactagagcgaaggttggaggatgcaggctatgctgtcggtgctcgagttctcgaactcctttgtcatagggataagggaaacagaagggagacaagattgctgggtattttgtcctttgtacacagcactgtttggaaggtcttatttggaaaggtagctgattcacttgagaaaggaactgaacatgaagacgaatacatgatcagtgagaaagagctccttgtaaacaggtttatttcaattccaaaagatatggggacatttaattgtggggcatttgttgctggaatagtaaggggtgttctggatagtgctggcttccctgcagtagtaacagcacattttgtgcctgttgagggacaacagcgtcctcggacaaccattttgataaagtttgctgaagaggtactacggagggaagcaaggctgggctgatactggcactgaagctatcctatttgatttgtttgaatgtttcgcaacagaatgatgaggctgtgtagctggactcacaaaacaatcaggatttttcatgacctgtcaattatatacttctgccaatatgaactgcttgtttctctggtataaatactgcgctatgcttattggcatgtagactattgaaagtagaagcagtctgccactctcgttgatgtaattaaatgtgataatcattaccactaccatcactgtttcatatgaactaaaatggattgcttaatctgaggatatgttgatttatgaaattgttattggcaaagccttaa

SEQ ID NO: 1947 - DNA, 856 bp, Vigna unguiculata
ggaaatctgtgttaacctaaaaagtgaagcaagaagaagatgatcggcgtcggaaaggccaagcagtacggtaacgtccttgacaagcccctcaccaggggcaagcaagaggttagtttgagtgcattcgcgttcttgttttcggagcttgttcagtacaaccaaacgcaggtcgataatattggggaactcgaacgaagactggaggatgctggatatgcggttggggcacgagttcttgagctgctttgccacagggataagggaaacagaagggagacacggctgttgggtattctttcttttgtacacagtacagtgtggaaagtactatttggaaaggtagctgattcactggagaaaggaaccgaacatgaagatgaatacatgattagtgaaaaagagcttctagtaaacaaattcatttctatcccaaaggacatggggacgtttaactgtggagcatttgttgctggaatagtacggggcgttttggacggtgccggatttccagctgtagtaactgcgcattttgtgcccatggaaggtcaacaacgaccacggacgacaattttgataaaatttgctgaagaggtgctacaaagagaagcaagattaggctgatatttatacaaggaatttttaattatgatatctgtaatgctgtacaccaccatagaaagatgtggaacttacaccactgcatgtgaaaaagtaatttaggatttttcattaccctattgatttttctgaactcgtgttttttattctgatgtatgttatggtcggaattatccttacacactgtacaaaaaatctcgtgttggtgttgatgctattattttcaatttctgtc

SEQ ID NO: 1948 - DNA, 1618 bp, Cucumis sativus
aaaagaaaatatcaaataaggtttgggtccaaaatcaattaagggaaagaaaagagaagaaaaggaaaggaaaggaaaaggaagacgaggccttcttcacgttcacctgacccctacggtttcaactgccatcttatccggcgacggcgaccgtctacgtgcagcggcctgacaccagatctgtgggtggaatacacctgctgtaatcgacgaacgaagaacagtacgccggcaacgccgctcctcagtcggccatttttctgtttcgagctacactagtgaactctggcggacgtttcgattggagcgattcatagtttagagatattcatatatcgtaagcttcagcaacgtcctttcaactgatcggtggccttcaaacgacactccagcaccctgccgctcgcgctcgacctctccaagagaacccgcggcttccattggcggagacgccttccggtagtggtaattctcaacgccaacggctcgatcggctctggatctgattacccacttcattttagcggcaaatctgtgagttggaaggattttggacactgttcagcaagattaaaggcttttgaacgagtttcgtagggacttccaagggccctgctcttaggaattagggaatcatgattggagttgggaagatcaagcaatattctaatgtcctcgaaaaacctctcagcaagggaaaacaggaggtgagtttgagtgcatttgcattcttgttctccgaacttgtgcaatacaatcagactcaagttgacaatattgctgagttagaacgaaggttggaggatgcgggctatgcagttggtgctcgagtattggaacttttttgtcaccgagagaagggaaatagacgggagacgcgattattaggcattctctcatttgtacacagcacaatttggaaggttttgtttggaaaggttgctgactcacttgagaaaggcactgaacatgaagatgagtacatgatcagtgaaaaggagctgcttgtgaatagatttatttcaattccaaaagacatgggtgcgtttaactgcggggcttttgttgctggcattgtcagaggtgtgctggacaatgctgggtttcccgctgttgtaacggcacattttgttccggtggagggccaacagcgaccacggacgactattttgattaaatttgcagaagaggtattagcaagagaagcaagattaggttgatatatggtttgaagtaaggttgggtattgttcttatgcttttagcattttgatattggagaacggtgaatttctttctggccattgaacacagaatttcacctgatatctctctgttgtgaagctgtaaggaaatttgtgctcttcaattaatctgtataattgatggcatcgattactttgttgcgagcaaaatgagctgtgaaactataaatggtttattcagcataaatgtaaaccgaagcaaattcaaaacctccctcccaattgcttttttcgtttaatctatcagtacttggacttatattaacttgttgtgtctaagctataagatttagatacaaattaattgtttgaattgtttttccattaagaatcattggtacaaagccattttct

SEQ ID NO: 1949 - DNA, 1126 bp, Cucurbita pepo
ttctctttgatcttccttcccctcttcggcgacagacgcggcggcgcgacagatccgcggccgcagctcgaatatctcctcgtttgtgaatccacgccagatttgcgacggtgacactcatatctgcgacactcacaccctcggtattagatctgcagtggcaaaccttttccaacttaaacatagtgttttacgcgtagtttccaccaacgcttccgagaattagggaatcatgatcggagttgggaaggtcaagcagtattctaatgtcctcgacagacctctcagcaagggcaaacaggaggtgagtttgagtgcatttgcattcttgttctccgaactcgtgcaatacaatcagactcaagttgacaacattgctgagttagaacgaaggttggaggatgctggctatgcagttggtgctcgagtattggaactgttttgtcatcgagagaagggaaatagacgggagacacgattgttaggaattctgtcatttgtacacagcacaatttggaagattttgtttggaaaggttgctgactcacttgagaaaggcactgagcatgaagatgagtacatgatcagtgagaaagagctgctcgtgaatagatttatttcaattccaaaagacatgggagcgtttaactgtggggcttttgtagctggcatagtaaaaggtgttctggacaatgctgggtttcctgctgttgtaacggcacattttgttccagtggagggccaacaaagaccacggacgactattttgattaaatttgcagaagaggtattagcaagagaagctagattaggttaatatcatctgaaggtaagcttttgacagctttgtgataatggagaatggggaatggtgaatttctttttagcccttcgaacaaataaagatttccacctgctatatccctgtaatgaagctgtaaggaactttggctcgtcaattaatttctttacttgatggcaaaatgatggcacaattgtgaaactataagatttagtagtattattgtaaaggtgtttatatgaacttcaaatggtttattcagcctcttggtgatatttgtgaactctgaatgtttgatcagaaccacattttaatcaaccaatt

SEQ ID NO: 1950 - DNA, 1216 bp, Eucalyptus grandis
aaaggaggagctaaatagtcgaagcagagagagagagagagagagagagagagctaagccggtggaaggaaggaaggacgagagaagctcttcatcgtcaccaccgccatcatcgtcaccaccaccgtcgtcggcgacgatgatcggagtcggcaaggccaagcagtactccaacgtcctcgacaagcctctcagcaagggcaagcaagaggtcagtttgagcgccttttctttcttgttctcggagcttgttcagtataaccagacccaggttgataatatcgcagagttagagcgcaggctagaggatgcaggctactccgtaggggctcgagttttggaacttctttgccacagagaaaagggaaataggagggaaacccgtctgttgggtattctttcttttgtacacagcacggtgtggaaggttttatttggcaaggtggctgattcacttgaaaaggggactgaacatgaagatgaatacatgattagtgagaaggagcttcttgtaaaccggtttatatctatccctaaagatatggggacttttaactgtggggcatttgtggctggaatagtgaggggtgttctggatggtgctggatttccagctgtcgtaacagcacactttgttcctgtcgaggggcaacaaagaccccggactacaatcttgataaagtttgcagaagaggtacttaggagagaagcgagactgggttgagttccttgcacattcctgcgttactttcatcgaatttggttcaattcatatggtcacgatggagaagttggctgctgcaaagtacttttcacttgctggacacactgtcatttccaatatacactgtttccagcttgacttgtgagtgagcattagatctagagtgataagtaatggcggtcttaccccagacacgattatttgaattatagcattccaattcatgttgttgctccaaaatgggatcgggtatatgttcaagcaatactggtgatgatacaaacgcagctcttgtattcggcagtcagcgccgacagcaagccatctgtaacgatatgttgaagctgactattgtatttcaatcggatttttgtatgtctgccttacatgagatatggttgtttcatgtaatcatcattttgtcatatatatgagagattgtgatccatagtattgaatgatatcatgatgcgatgacccgggcttctttga

SEQ ID NO: 1951 - DNA, 802 bp, Flaveria ramosissima
ttcatcatctttatttaggaatagatcagtgtagggggtagtagggtttggagtttgaactaaaagatgatcggggttgggaagatgaagcaatacacaaatgttctcgataaaccccttagcaaaggcagacaagaggttagtttgagtggatttgcttatttgttttcggagctagttcagtacaaccagactcaggttgacaacattggggaactagaaaggagattggaggatgctggctatgctgttggagtacgagttttggagttactgtgccacagggaaaagggtaacagaagggagacacgtttgttgggcattttgtcttttgtgcatagtaccgtgtggaaggtgctttttggaaaggtcgctgactcacttgagaaaggcactgaacatgaagatgaatatatgattagtgaaaaggagcttctagtcaatagatttatttcagtaccgaaagacatggggtcgttcaactgtggtgcttttgttgctgggatagtaaggggtgttttagacaatgcaggatttccggctgtcgtgactgctcactttgttccggtggacggtcaacaacgaccacgtacaactattttgataaaatttgctgaggaggtactacgaagagaagcaaggttagggtgatctcttgttatgcgttgacgggctttgtggtttggctgttgactgattgcagtacttatatgctttaaagaatcaaaatgtaacaaagtttatcaaaatttgtagctaccaagagttctttaacattcatcctaacaattgtatgacttct

SEQ ID NO: 1952 - DNA, 1114 bp, Panax ginseng
aagcagtggtatcaacgcagagtacatggggagaaccgaaaaacatatacgaaaattactaatcgacagttcagcgtcaaagaaattggtaggtctcaaacagtactacggccttcgtacttcttctttctcacacagttgcaggaaggaagagagagaggatgatcggagtggggaagatcaaacaatataccaacgttctcgataaacctgttagcaaaggcaaacaagaggtcagtttgagtgcatttgcatttttattctcggagcttgttcagtacaatcagactcaagttgacaacattgctgaattagagcggagactggaggatgcaggatatgctgttggggcacgggttttggaacttctttgccatagagagaagggaaacagaagggaaacacgcttgttgggtattttgtcttttgtccacagtacagtatggaaggtgttgtttggaaaggtagcagactcacttgagaaaggcactgaacatgaagatgaatacatgattagtgaaaaggagctccttgtcaataggtttatttcaataccgaaagacatgggcacatttaactgtggggcatttgttgctggaatagtaaggggtgttctggatggtgcagggtttcctgctgtagtaacagcccattttgtaccagtggaggggcagcaacgacctcggacaaccattttgataaaatttgctgaagaggtactacgaagagaagcaagattgggatgatgtttgcgtaggattgtcttctgttgtattgcccactgcagcattgtaattcatgttgaaattacttgcttgatggtgggagaaatcacgatcgacgtgtgacttttttcttgaacgtggcaaactatatactgccagcgccatatttactttactgcatctctttgaggggcaataactatagttggtccggggattatatttatatttcaatttcagcgtaaaagatactatatagtatcagtatgtgcattggttcctaatcctggagttgtatacatggggccggattatgtaagcatggaccattttctcgagcgctgtttagtttaatagaaagcagtcccaactctggggtgggggtgtgt

SEQ ID NO: 1953 - DNA, 901 bp, Ipomoea nil
attccacgcacgactcacaaacccctcgaagctgaaacaaagaagaaaaaaggcgcagaggtaggcgatctgcggacagtgaggatgataggagttgggaaaatcaagcaatacactaacgttctcgatagacctctcagcaagggcaaacaagaggttagtttgagcgcgtttgcattcttgttctcggagcttgttcagtacaatcagacccaagttgataacattgctgaattggaaagaaggttagaggatgcaggctatgctgttggggcacgagttctggaacttctctgccatcgagaaaagggaaatagaagggagacacggttgctaggtattttgtcctttgtgcacagcactgtgtggaaggttttgtttggaaaggttgctgactcccttgagaagggtactgaacatgaagatgaatatatgatcagcgaaaaggagctccttgtgaacagatttatctcaattcctaaagatatgggtgctttcaattgtggagcttttgttgcgggcattgtaaggggtgtacttgacaatgccggtttcccagctgttgtaactgcccattttgttccagtggaggggcagcagcgacctcggactaccattttgattaaattttctgatgaggttctacgaagagaagcaagactaggttgatgctcgttatgtcctattggttcaagatattctacaccagcgagagcgggtaactctaggaaaatggtgtaatttatcaggatcatttgaatcctaaaaagctgattgtcgactgtgacttgatccgtcattcgcgaaagttacaaaccaatcattatccagaaatgtgtgtagctgaactggagaaaactacactaatagttgtaatgcttgctagattgatacaggaggt

SEQ ID NO: 1954 - DNA, 1116 bp, Mimulus guttatus
cgaattcaaagaaaagggcaaaaaggaaaataggaaactggagagggagagagagagagagagagttgagctgaaaagcagtgatgataggagttgggaaaatcaagcaatattcgaacgtgctcgacagacccatcagcaaggggaaacaagaggttagtctgagtgcatttgcgttcttgttttccgagctcgttcaatacaatcagacacaagttgacaacattggagaattggaacgaaggttagaggatgctggttatgctgtcggagctagggttctcgaacttctctgtcacagggagaagggtaacagaagagagactcgactattgggtattttatctttcatacacagcacagtgtggaaagtcttgtttggaaaggttgccgactctctcgagaaaggcactgagcatgaagacgagtacatgatcagcgagaaggaacttctggtcaacagatttatttcgataccgaaagatatgggcgccttcaattgtggagcttttgttgctggaatagtgaggggagtgttgtataatgcgggttttccagctgtcgtaactgctcattttgtacccgtggatgggcaacaacgacccaggacaaccatattgattaaatttgctgaagaggtattacaaagggaagcgagattaggttaatgccgagctctgatttcccgaaaccaccggagaacaaattatgcgtgtgagaaaaaactataaagcacttcaaaatttctttcgatttctattcagcgattttggggctgattttagagattcatcgatattctgtgctgcttcttgtaatgataaataacttgacttgaaatttcataaacgtttgtggctcttataacgatgactcgagtgatgaaaattgcaaatatatgcgtaatttgctcgcagatttgtttggattcagagtttcgtaaaaaaaacgatgttcgatttctgcctcgaatttgatctgtgattttttcgaaattatggacagttaatggttataatgtgtagcaatgttttcgccatttgtgttttgttccaatttatcgaactcctctgttgtttgttcgacattgttgtttagagacttaaatccagaaaa

SEQ ID NO: 1955 - DNA, 1317 bp, Quercus alba
aaacaggcttcttctctcgatctgctgtacgtcctttcttcacacacacacacaaagaaagagaagattacgatgatcggagttgggaagatcaagcagtactcgaacgttctcgacaagcctctcagcaagggcaagcaagaggtgagtttgagtgcgtttgcgttcttgttttcggagcttgtccaatacaatcagacgcaggtggacaatattgccgagttagaacgaaggctggaggatgccggctatgctgttggggctcgagttttggaacttctttgccatagggataagggaaacagaagggaaacacgattgttgggcattctttcgtttgtacacagcacagtatggaaggtgttatttggaaaggtggctgactcacttgagaaaggcaccgaacatgaagatgaatacatgatcagcgaaaaggagctccttgtgaatagatttatttcaattccaaaagacatggggacatttaactgtggggcgtttgttgctggaatagtaagaggtgttttggatagtgctggttttccagctgttgtaacagctcattttgtgcccatggaaggtcagcaaaggcctcgaacaaccattttaataaaatttgctgaggaggtactacgaagagaagcaaggttaggttgatatatgtgccaggacttattacatgtaatgtttatgatgctcagcaagaacatgatgaatgtgttaatgctctgcaacaacatggtgaaggatggtgaattttttagctggtttgtcaaattaattatgattttcacctgccaattctgtcgcttgggccaaattgaattcctatcattgatttgtattgttgtatactctatttcatggcacagtaactatgtggatctagaattagcaattaccatcggtcagtcgatgtagaaaaggaacaaatgaaagaaaaaaaaattgttaatttctatgtttatatgaactcaagcagattgtttaagcagagagaaattgttttatgatttgtagttaagtgagaaacaaatagtcttactataaatctgtgtatatatgggcctgatctctgggtggatggatgtttgttcacatgcatgggatatcaagggcccgtttggtaaaagaatttgagtaatgttgtttgtattttttgaaatacgtgtgagtgaaaaaatgtgtggaaatgcgtgtaatgttagtttaaaaactaaaaacatgtgtttaagatgctttaccaaatgaggccttgaattcttgtatgcattgttgcaacaatggcagagcatagcttcattcccattgaagttt

SEQ ID NO: 1956 - DNA, 988 bp, Citrus sinensis
gagtcgcccgtactccgagaagcggcaagcaaacaaaggatcatcgaaaagaaaatcgcgaggcgaaaacatgatcggagtagggaagatcaagcagtactcaaacgtcctcgacaaacccctcagcaaaggcaaacaagaggtaagtttgagtgcgtttgcatttctgttctcggagcttgttcagtacaatcaaacgcaagttgacaatattgctgaactagagcgaaggttggaggatgcaggctatgctgtcggtgctcgagttctggaactcctttgtcatagggataagggaaacagaagggagacaagattgctgggtattttgtcctttgtacacagcactgtttggaaggtcttatttggaaaggtagctgattcacttgagaaaggaactgaacatgaagacgaatacatgatcagtgagaaagagctccttgtaaacaggtttatttcaattccaaaagatatggggacatttaattgtggggcatttgttgctggaatagtaaggggtgttctggatagtgctggcttccctgcagtagtaacagcacattttgtgcctgttgagggacaacagcgtcctcggacaaccattttgataaagtttgctgaagaggtactacggagggaagcaaggctgggctgatactggcaccgaagctatcctatttgattcgtttgaatgtttcgcaacagaatgatgaggctgtgtagctggactcacaaaacaatcaggatttttcatgacctgtcaattatatacttctgccaatatgaactgcttgtttctctggtataaatactgtgctatgcttattggcatgtagactattgaaagtagaagcagtctgccactctcgttgatgtaaattaaatgtgataatcattaccactaccatcactgtttcatatgaactaaaatggattgcttaatctgaggatatgttgatttatgaaattgttattggcaaagccttaa

SEQ ID NO: 1957 - DNA, 885 bp, Carica papaya
gggcttcagaatttccctaaacgaacttcattcgatttgatcaatcgacagagaaacagggagaaagtagagaggaaagtatgatcggagtagggaagattaagcaatactctaacgtcctcgacaagccgctcagcaagggtaaacaagaggtcagtttgagtgcctttgcgttcttgttctcggagcttgtgcagtacaatcagacacaggttgacaacattgctgaacttgaaagaaggctggaggatgcagggtatgctgttggggcccgagttctggaacttctttgccacagggagaagggaaacagaagggagactcgattgttgggtattttgtcttttgtacacagcaccgtgtggaaggttctttttggaaaggcagctgattcacttgagaaaggaactgaacatgaagatgaatacatgattagtgagaaggagctccttgtaaacagatttatttcaattccgaaagatatggggacatttaattgtggagcatttgttgctggaatagttaggggagttttggatggtgcaggttttccagcagttgtaaccgcccactttgtgccaatggaaggacaacaacgaccccgcactaccattttgataaagtttgctgaagaggtgttacgaagagaagccaggttaggttgatattaaatcatagtgtgttgtgcaacgacatgactgacaattgtcgcacatcggaaaacaaatccaagttcctacctggcagccgcggacgaatttgaactcattttaactaaatggcaagctctggtgcacttgaatcttccatcaactatatttgttgaatataatggttattacttttcgttgttcgtttatctaaaaacaaaatcttatcaccgtc

SEQ ID NO: 1958 - DNA, 1185 bp, Papaver somniferum
taaaccgattcacagaagctctttctcctctcaagtcataccatccagtattcccagattaaaatcagccgagtaccgaattcatccaaacttttgtgccgaaagtacaaatcgtttcgccccaactttttgtaattctggagaaatttttcgccctaatttattcactttttgtgattctgaagaaattttgccgccccaattttttgtgattctgaagctgattcgagcctagagaagaagaagatgatcggagtagggaagatgaagcagtatacaaacgttctcgacaaaccactcagcaaaggcaaacaagaggttagtttgagtgcatttgcattcttgttttcggagctagtacagtataatcagactcaagtcgataacattgccgagttagaacgaaggctagaggatgcggggtatgctgttggagcaagagttcttgaacttctttgccacagagataagggaaacagaagggagacgagattattggggattctgtctttcgtacatagtacagtatggaaggtcttatttgggaaggtagctgactcacttgagaaagggactgaacacgaagacgagtacatgatcagtgagaaagagcttcttgtgaatcggtttatatctgttcccaaagatatgggaacatttaattgtggtgcatttgtcgcgggcattgtaaggggtgttctggacagtgcaggctttccagctgtggtaactgctcattttgtaccaatggaaggccaacaacgaccgaggaccactattttgataaagttcaccgaggaggttctcagaagagaagctaggttgggctgagtttcagagatttgcaagggtgatcggatcaggcaatatatcctcctgcgacattatctgaattagctcgaaagctgtccacatttgaacatgggtagcaatcaatgcattccaagaaccactatattctattttatttattttagtgaaccggcatgtatattaaaactaggaaatcatggttgcatcccctgttgtcagacaattgaggatctgattcttatcacacagtgactgatagacatctacacacctggactctgttttcctagcatattttgctaacaagtcggtattacttctatttatatgtgacagtttaacatactcaagaacctaattgcactgtctggt

SEQ ID NO: 1959 - DNA, 1121 bp, Prunus mume
ctaccggtccagaccggcacaaagaggagcgagtcgagtgaaaatactgaatacagaagtgagttgcggtgtgtaaaagttgtgcttccgaaatcggatctgcatcaccaccaccatctctgtattcttcgaaattcttgaaatagaagaagaaaaggaagaggtggataagaatgattggggttgggaagatcaagcaatactctaatgtcctcgacaagcccctcagcaagggaaaacaagaggtcagtttgagtgcgtttgcattcttgttttcggagcttgtgcagtacaaccagacacaggttgacaacattgccgagttagaacgcaggctggaggatgcaggatatgctgttggggctcgagttctggagcttctttgccatagggataagggaaacagaagggagacaaggttattgggtatcctgtcttttgtgcatagcactgtgtggaaggtgttatttggaaaggtagccgattcccttgagaaaggcactgaacatgaagatgagtacatgattagtgagaaggagctccttgtgaaccgatttatttcgattccaaaagacatgggaacctttaattgtggagcatttgttgctggaattgtaaggggtgttttggacggtgctggttttccagctgtagtaacagctcattttgtaccagtggagggtcagcaacgacctcgaacaaccattttgataaaatttgctgaagaggtactacgaagagaagcaaggttaggttgatgctcgtggcaagactatcccattatagtttacccagtgcctctccatagtacaatgaagaaggttgaagcttacagctgcattgtcaagctaatgaaaattccacctctaaacttatcaatcagacttgtggcaattcaaattcccacattggttaattcactttgtaagctatggctcgatgctgatttgaaagtagctactattgtaagtgtggttcatctaaacaaggaaaggaaaagaaaaacagtttattttctgcgaattctgttgtttataggaactcgaatgactgttggccttgtcttgaaagaagcctcattttatcctcaaaatggttaacaaaccacgtctcgttgaaac

SEQ ID NO: 1960 - DNA, 956 bp, Prunus persica
gtgtgtaaaagttgtgcttccgaaatcggatctgcatcaccaccaccatctctgtattcttcgaaattcttgaaatagaagaagaaaaaggaagaggtggataagaatgattggggttgggaagatcaagcagtactctaatgtcctcgacaaacccctcagcaagggcaaacaagaggtcagtttgagtgcgtttgcattcttgttttcggagcttgtgcagtacaaccagacacaggttgacaacattgccgagttagaacgaaggctggaggatgcaggatatgctgttggggctcgagttctggagcttctttgccatagggataagggaaacagaagggagacaaggttattgggtatcctgtcttttgtgcatagcactgtgtggaaggtgttatttggaaaggtagccgattcccttgagaaaggcactgaacatgaagatgagtacatgattagtgagaaggagctccttgtgaaccgatttatttcgattccaaaagacatgggaacctttaattgtggagcatttgttgctggaattgtaaggggtgttttggacggtgctggttttccagctgtagtaacagctcattttgtaccagtggagggtcagcaacggcctcgaacaaccattttgataaaatttgctgaagaggtactacgaagagaagcaaggttaggttgacgctcatggcaagactatcccattatattttacccagtgcctctccatagtacaatgaagaaggttgaagcttacagctgcattgtcaagctaatgaaatttccacctctaaacttatcaatcagacttgtggcaattcaaattcccacattggttaattcactttgtaagctatggctcgatgctgatttgaaagtagctactattgtaagtgtggttcatctaaacagggaaaggaaaagaaaaacagtttattttctgcgaa

SEQ ID NO: 1961 - DNA, 955 bp, Carthamus tinctorius
attggtaaatcagcaaatagacagggaccgacctgtataggtgccgacggtggcacgtgtcaccgtatcgttcctccgttgcagtgtaaaggtcgtgaaagtgcaaccgtattaagttgctgtgtgccaccatatttgaaactgcaataaaaaaaacgatgcttcttgagttggttagtcacttcttttgtacaaaatcgcagccggaactggttgttgttggaattaaaccctaagtagagtggcaatcgggaagatgatcggagctgggaagatgaagcagtacgcaaatgtgctcgataagccccttagcaagggtagacaagaggtcggtttgagtgcatttgcttacttattctcagagcttgttcagtacaatcaaacccaagttgacaacattggagaccttgaaaggagattggaggatgctggctatgctgttggggcacgagttctggagttactttgccatagggaaaagggcaatagaagggagacaaggttgttaggcattttgtcttttatacatagtacagtatggaaggttttatttggaaaggtcgctgactcgcttgaaacaggcactgaacatgaagatgaatatatgatcagtgaaaaggagctcctggtcaatagattcatttctgtaccaaaggatatgggaaccttcaattgtggtgcttttggtgctgggatagtaaggggagttttagataacgcaggcttcccagctgttgttaccgctcattttgttcctgtggaaggtcaacagagacctcgcactaccatcttgataaagttcgctgaagaggtactacgaagagaggcaagattaggatgacatggcgttttggcttgatttttgcatatgatgtatgattgcaatacaaaaatcaaacataaagacttgagacagaatatggtctcacaataactctgatttttgaggtgaatt

SEQ ID NO: 1962 - DNA, 1062 bp, Sarracenia psittacina
ctattctactcctgtgaagcctactccgaagagagaaaaaagaggtaagaatattcgcaagggaggaggggaggatgatcggagtggggaagatcaaacagtatcccaatgtcctcgacaagcccctcagcaagggcaaacaagaggtcagtttgagtgcatttgcgttcttgttttcggagcttgttcagtacaatcaaacccaggttgacaatatcgcagaattggagagaaggttggaggatgcaggctatgctgttggtgctagggtgttagaacttctttgccatcgggagaagggaaatagaaaggaaacacgattgttgggcattttgtcattcgtacacagcactgtatggaaggtgttgtttggaaaggtagctgattcacttgaaaagggtactgaacatgaagatgaatatatgattagtgagaaggagctcctcgtgaatagatttatctcaataccgaaagacatggggacatttaattgtggagcatttgttgcaggaatagtaaggggtgttttggatagtgcaggtttcccggccgtagttacagcacattttgtacctgtagagggtcagcaacgacctcggacaacaattttaataaaatttgctgaagaggttctaagaagagaagcaaggttaggttgatgtttatgcaagattggttcgtttgatttcagtgttctacaacaatgtgctgaatgatggtgaaatttgttgctggttttttggaaccatttgggatgttttcatacaaattctgtctgttatgtgttacttatggccattttctttacttccaagttttcattccaaaatgtgtaaaagaatcatcattttcatgtaaatgtccccttcgtctcagcatcaatatttcaagctcaggtggactgtttaggaagtgatggattaatatataaaaatctagttgaaagagagcctatgttatgatccaaggtattggaaatcttcatttagggatgtaatttgagattgaagagatgaaccaaatgttctagtgtactactgctccttttgtgtttgtgcttgc

SEQ ID NO: 1963 - DNA, 962 bp, Triphysaria pusilla
agcttattgattcattcgcagacgattgcaactcgcacttccactccgaaccttgaaagtgcttcacgaagagagaagttgaaagaaatgatcggagttgggaagatgaaacaatattcaaatgttctcgacagaccccttggcaagggaaagcaagaggtcagtttgagtgcgtttgcattcttgttttcggagcttgttcagtacaatcagactcaagtagacaacatagcagagctggaaagaagattagaggatgctggctattctgttggagccagggttctggaacttctttgtcacagagagaagggtaacaggagggagacaaggctattgggtattttgtcttttatacacagcacagtatggaaggtcttgtttggaaaggtggccgactctcttgagaaaggcactgagcacgaagatgagtacatgatcagtgagaaggaacttcttgtcaacaggtttatttcaatacccaaagatatgggtgccttcaactgcggtgcatttgttgctggagttgtgaagggagtcttggataatgcaggttttccagcagtagtaacagctcattttgtacccgtggacgggcaacagagaccaaggacaacaattttaattaaatttgctgaagaggtactacaacgagaagcgagattaggctgacaatttactactgattccgaaatcaactttcatatatgctcactgtcggttgaaagaaatcatgttgttaccctgcaaagttggttggcttgcgacaatttcacttttaagtgctgacttgacaatatgttacatcgtattattgtatatttgataaaagcatgaagcttctcttagttgcacggcacaatgctgagggatatcatccgaattatgtgtggttgctggagtattatatatggactaagattatgttattatgtttgatcttgaaatccaaatgcagtatt

SEQ ID NO: 1964 - DNA, 1036 bp, Tripterygium wilfordii
atttttctttcaatttctcagcagcgaaacagatcgtcactgcactcgctcgggcacgatctgcaattttattggattggagccacaagtgttccggggtagacaagtagaaaggaaactatgatcggggtagggaagatcaagcaatactctaacgtgcttgataaaccccttagcaagggcaaacaggaggtcagtttaagtgctttcgcattcttgttctcagagcttgttcagtacaatcagacacaggttgacaacattgctgaattagaacggaggcttgaggatgctgggtatgctgttggtgctcgagttttagaacttctttgccatagggataaggggaacagaagagaaacaagattgttgggtattttatcttttgtacacagtaccgtatggaaggtgctatttggaaaggttgctgactcacttgaaaaaggcactgaacatgaagatgaatacatgatcagtgaaaaagagctccttgtgaatagattcatttcaattccaaaggacatgggtacatttaattgtggggcatttgttgctggaattgtaagaggtgttttggacagtgcaggttttccagcagtagttacagctcattttgtacccgtcgaaggtcagcaacgaccacgaacgaccattttgataaagtttgctgaagaggttctagtgagagaagcaaggttaggttgatgtttgtcgcagatcatcaccgtgtgttgcttttcaacacgctgcgacatattcaatgatgcgaatcttgaaccagtcagctgcaatcgtgaatttttacgagcaaatactgtcgatcatccttgtgggactttgagctctctttgatttattccaatatttgcacattaactcatagagattgttatttactgatagtgattatgaaaaaggtcgctgatgtagaataaatgttgcatcagttggtgtttcgatgggtttgaatggattgtttaactaaaggatattgacagataaatatgtatttaaactttacagtcagtcaagtgat

SEQ ID NO: 1965 - DNA, 998 bp, Valeriana officinalis
ctatacccccaaaaaaccagagacactgtctagtgtctctcggctctcatcgatcgattcaagatcttaagctcgttgcattcaaatcatcctatttcatacaaacccatagtgatctcttcttttccatcttttttttttcagtttgaactcccgatctgggagcgactaaaatcaggcagacaaaagagagacgatgatcggagtcggaaaagctaagcaatacgcaaacattcttgacaaacccctcagcaaaggcaagcaagaggtcagtttgagtgccttcgcattcctgttttcagagcttgttcagtataatcaaacccaagtggacaacattgccgaattagaacgaagattggaagatgctggatatgccgttggaacccgtgttttggaacttctttgccatagggaaaaggggaaccgaagggagacaagattattgggtatcttatcttttgtacacagcacagtgtggaaagttttatttggaaaggtagccgattcactggagaagggcactgaacatgaagatgaatacatgatcagtgaaaaagagttgcttgtcaatagatttatttcaattcccaaagatatgggaacgtttaactgcggggcatttgttgctggagtagtaaggggcgtactggataatgcaggctttcctgctgttgtaacagctcattttgtgcctgtggacgggcagcaacgccctcgaactaccatcttgataaaatttgctgaagaggttcttcgaagagaagcgagattaggatgaattgtgattttggtgtgtaatttctggccagaaaattctgcaacatattggtggagacaaaaggtcattttaaagaagatatttgtttgctggatttcggatgttaaagcttttactctttctttgtttacgaaaatcatttgaatgaatcagaaaagttataattcgatatgtatttgttgcaataacatcatcattagtaagtttgacaatttgg

SEQ ID NO: 1966 - DNA, 1501 bp, Citrullus lanatus
aaaagagggaaagaaaagaaaaggaaaagaagaggctcgttcacgttcagctgccccttgcggtttcaactgtcatcttatccggcgacgacaaccgtctacgtgcagcggcttgacagcagatccagtgggcggaatccacctgctgtaatcgacgaacgacgaacaggacgcgggcaacgctgcaccgttagatgcgtctcagtcgccccctgttatttttccgtttccagcgacagcagtgaacgctggcggaggtttcgatctgcgtgacccacaagctccagcaacgccttctcaactaactcgtggccttcaaacgacgctccagcaccgtgccgctcgcgcacgacctctcccagcgaaccctcggcctccattggcggcgactccttccggcagtggcaatccgcaacacccacggctcgattgtctctggatctgattacccactttgcttcggcggcgaatctgtgagttcgaaggatttcgcacactgtccagcaaggctaaaggtctttgagcgagttttgtggggacttccactaacgctgctcttaagaattagggaatcatgatcggagttgggaagatcaagcagtattctaatgtcctggacagacctctcagcaagggcaaacaagaggtgagtttgagtgcatttgcattcttgttctccgaacttgtgcaatacaatcagactcaggtcgacaatattgctgagttggaacgaaggttggaggatgcaggctatgcagtcggtgctcgagtattggaacttttttgtcatcgagagaagggaaatagacgggagacaagattattaggcattctgtcatttgtacacagcacaatttggaaggttttgtttggaaaggttgctgactcacttgagaaaggcactgagcatgaagacgagtacatgatcagtgagaaggagctgcttgtgaatagatttatttcaattccaaaagacatgggagcgtttaactgtggggcttttgttgctggcatagtaagaggtgttctggacaatgctgggtttcccgctgttgtaacggcacattttgttccagtggagggccaacagcgaccacggacgactattttgattaaatttgctgaagaggtattagcaagagaagcaagattaggttgatatcgtctgaagtaagcttgtgttatgtttgtatgcttttagcattgtgatattggagaatggtgaatttctttttggtccttaaacaaatagagattttcacctgatatatccctgttgtgaagctgtaaggcagtttgttctcttcaattaatctgtctaattgatggcaccgattattttgttgtgagaaaaatgagctgttaaactataagatttagaagttgtctatataggcttcaaatggtttattcagcctaatggtgatatttgtgaatttttaatcttgaacctaacccaattcacatcctaccaattgcttttttcgttaattctgtcagt

SEQ ID NO: 1967 - DNA, 637 bp, Brassica oleracea
tgtttagggttctgaaaagcgaagaagaagatgatcggagtagggaaaatgaagcagtactctaatgtccttgacaagccactcagcaaaggcaaacaagaggtgagcttgagcgcgtttgcgttcttgttctcggagctagttcagtacaatcaaacccaggttgataacattgctgaacttgaaagaagactagaggatgctgggtatgcagttggatctcgagttttggagcttctttgcaaccgagagaagggtaacagaagagagacacggttacttgggattttgtcttttgtccacagcaccgtgtggaaggtgttgtttgggaaggttgctgattcgcttgaaaaaggaacagaacatgaagatgagtacatgatcagtgaaaaggagcttctcgtcaacaggttcatttcgattccaaaagacatgggaacattcaactgcggggcgtttgtggccggcatagtgaagggagttctggataacgcagggtttcctgctgtggtaacggctcattttgtacccattgaaggacaacaacgtcctcggactaccattttgatcaagtttgctgatgaggtacttaaaagagaggcacggctaagccaatgagagcactttttgtacgagt

SEQ ID NO: 1968 - DNA, 672 bp, Brassica oleracea
gttctgggtagctgaaaaaggaagaagatgatcggagtggggaagatgaaactgtactcaaacgtactcgacaagccactcagcaaaggcaaacaagaggtgagcttgagcgcatttgccttcttgttctcggagctcgttcagtacaatcaaacccaggttgacaacattgctgagctggaaagaagactagaggatgctgggtatgcagttggagctcgagtcttggagcttctttgcaaccgagagaagggaaaccgaagagagacacggttactaggaatcttgtcttttgttcacagcaccgtctggaaggtcttgtttggaaaggttgctgattcacttgagaaaggaactgaacatgaagatgagtacatgatcagtgagaaggagcttctcgtcaacaggttcatatcgattccaaaagacatgggaacattcaactgcggggcgtttgtggccggcattgtgaagggagttctggataacgcagggtttcctgctgtggtaacggctcattttgtacccattgaaggacaacaacgtcctcggactaccattttgatcaagtttgctgatgaggtgcttaaaagagaggcacggctaagccagtgaggagaacttcgtgccacggcctggggactatgttagctttatgtgaactgcttgtgc

SEQ ID NO: 1969 - DNA, 996 bp, Chrysanthemum coronarium
catcagtagttttgggatcgttaaagccgttagtgactatttctcaactagccatttatatagttgaatcaaagatgatcggggcaggtaagatgaagcaatactcaaatgttgttgataaacccctcagcaaaggcagacaagaggtgagtttgagtggatttgcttttttgttttcggagcttgttcagtataaccagactcaggtcgataatattggtgaactcgagaggagattggaggatgctggctatgctgttggagtacgagttttggagttactttgtcatagggagaagggtaacagaagagagactcgtttgttgggcattttgtcgttcgttcatagtacagtatggaaggttctttttggaaaggtagctgactcgcttgagaaaggcactgaacacgaagatgaatatatgattagtgaaaaggagctcctagtcaatagatttatttccgtaccaaaagacatgggttcattcaactgtggtgcctttgttgcggggatagtgaggggtgttttggacaatgcaggattccctgctgttgtgacggctcattttgttccggtggatggtcaacagcgtcctcgaacaaccattttgattaaatttgctgaggaggtactgcgaagagaagcaagattaggataattttgtcaagtgttttctgtctttgtattgtggccatggactgattgcggtacgtatatactttgaagaatcaaaaaggaaaacgtatgagtttattaaaaaatttgtagcagcaagaactatgcttttatggaatttttagggtgataacatcatttcagtgtgttttagtacttatctctatatccatgaccagattcttttttagttggaattatctacatgtcaaatgtaatcgtagggatatggagttgctgtatgtcgataacctattttccaatttaaccaggccatatgaggccgtttgtagtagtgacatgactactataaaacccag

SEQ ID NO: 1970 - DNA, 1012 bp, Chrysanthemum coronarium
gtgtagtatgacaaaggggttggactttgagggaagccacagaacaccgttaaagtcgttagttagtaaagtacccaaaccgataacataatgataggagcagggaagatgaagcaatactcaaatgttcttgataaaccccttagcaaaggcagacaagaggtgagtttgagtgggttcgcttatttgttttcggagcttgttcagtacaaccagacccaggttgataacattggtgaactcgaaaggagattggaggatgctggctatgctgttggagtacgagttttggagttactttgccatagggaaaagggtaacagaagggagactcgcttgttgggcattttgtcgttcgttcatagtacagtatggaaggttctttttggaaaggtagccgactcgcttgaaaaaggcactgaacatgaagatgaatatatgattagtgaaaaggagctcctagtcaatagatttatttcagtaccaaaagatatgggttcatttaactgtggtgcctttgttgctgggatagttaggggtgttctggacaatgcaggattccctgctgttgtgacggctcattttgttccggtggatggtcaacaacgtcctcgaacaaccattttgattaaatttgctgaggaggtactgcgaagagaagcaagattaggataattttgtcaagtgttttctgcctttgtattttggccatggactgcttgtggtacgtatatactttgaagaatcaaaaaggaaaacgtatgagtttattaaaaaatttgtagcagcaagaactatgcttttatgggatttttagggtgataacatcatttcagtgtgttttagtacttatctctatatccatgaccagattcttttttagttggaattatctacatgtcaaatgtaatcgtagggatatggagttgctgtatgtcgataacctattttccaatttaaccaggccatatgaggccgtttgtagtagtgacatgactactataaaacccag

SEQ ID NO: 1971 - DNA, 669 bp, Echinochloa colona
cttccttcctttcctagcggcggcaaacagagcgagtggcgccgcccctctgcgggccgcttcgcccggcgacgagcatccgtcagtcgtccgcccctgccgataggaaggagaggacaagatgatcggcgtcgggaaggcgaagcagtacgccaacgtcctcgacaagcccctcagccgcggcaggcaggaggtcagtttgagtgcatttgcattcttgttctcagagttggttcagtacaaccaaacacaagttgacaacattgcggagctggaacggagactggaggatgctggttatgctgttggcgcaagggttcttgaacttctctgtcacagagagaaggggaatagacgagaaacacgacttctggggattttatcattcatccacagcactgtatggaaggtcctatttggaaaggtggctgattcacttgagaagggaacagaacatgaggatgaatacatgattagtgaaaaggagcttcttgttaacaggttcatttcggtgccaaaagatatgggagcattcaactgcggagcctttgtcgcaggagttgtaaagggtgtattagataatgctggctttcctgcagtagttactgcacactttgtgcctattgaaggccagcaaaggccaaggacaacaatcttgattaagtttgc

SEQ ID NO: 1972 - DNA, 894 bp, Allium cepa
aatcgagcctgtttgttggggtctcgccatgtcaattggaaatgccctaatacctcattcaccgtctcaattcacaactaattacattgatagacgtctccatttactcgattgataaaaagaattaaaaatcataaaagctgaattgatatagctagctacgaattttcttcgaggataggatgattggagttgggggaaaagtgaagcagtatagcaatgtccttgataaacctctaagcaaaggcaggcaagaggttagcttgagtgcatttgcgtttctgttttcagaaattgttcagtacaatcaaactcaagtcgacaatatatccgagttagagcgaagattggaagatgctggctatgctgttggagctagagtccttgaacttctttgccacagagataaaggtaacagaagggagacaagattattggggattctttccttcattcatagcaccgtatggaaagttctctttggaaagattgccgattcacttgaaaagggaacggaacacgaagatgaatacatgatcagtgaaaaggaacttcttgtcaaccgatttatttccataccaaaagatatggggacatttaattgtggagcctttgttgctggaatcgtaaagggtgttttagatagtgcaggttttcctgctgtagtaactgcacattttgttcctatggagggacaacaaagacctcgaactacaattttgatcaaatttgctgaagaggttcttgtaagggaagcaagatttggctgaaatatttgtggtttgttcctatcggatgatatttggcaataacgatcattcgaggagtttggtgaggcaaagtatcaagtgaatatttatttatgtaccatagaagcacagtaagcagcccggg

SEQ ID NO: 1973 - DNA, 1154 bp, Allium cepa
attcaccgtctcaattcacaactaattacattgatagacgtctccatttactcgattgataaaaagaattaaaaatcataaaagctggattgatatagctagctacgaattttcttcgaggataggatgattggagttgggggaaaagtgaagcagtatagcaatgtccttgataaacctctaagcaaaggcaggcaagaggttagcttgagtgcatttgcgtttctgttttcagaaattgttcagtacaatcaaactcaagtcgacaatatatccgagttagagcgaagattggaagatgctggctatgctgttggagctagagtccttgaacttctttgccacagagataaaggtaacagaagggagacaagattattggggattctttccttcattcatagcaccgtatggaaagttctctttggaaagattgccgattcacttgaaaagggaacggaacacgaagatgaatacatgatcagtgaaaaggaacttcttgtcaaccgatttatttccataccaaaagatatggggacatttaattgtggagcctttgttgctggaatcgtaaagggtgttttagatagtgcaggttttcctgcagtagtaactgcgcattttgttcctatggagggccaacaaagacctcgaactacaattttgatcaaatttgctgaagaggttcttgtaagggaagcaagatttggctagaatatttgtgatttgttgctatcggatgatatttggcaatagtgatcattcgtggagtttggagagataaactatcgggtgaatatttatttatgtatcatagaagcacactaagcggccgggtactatttttcattgccgacagcattatataccgctaatgcagttttattaaatttcgcggttttgttatttctaatgatgttatgccacaattacatctgtgcgttcgtatactgttttggaatgtaatgccagaaatgcatatttacactggtgtgtattccggtttgcgtttgattggttaggaacaatcatgaactttggtaatacgtattatcaagactgtttctttttaacctttttataaagaaaaaactgagaattctgaatggaaattgttctgttatcttatttcttgtggtacaggttgtagcctc

SEQ ID NO: 1974 - DNA, 1149 bp, Malus domestica
tctgtagaagttgtgcttccgaaaatccgatccacaacaccaccaactctgcttcttcgaatttcttcaaatccagaggaaaaaagaagagttggggaagaatgattggagcagggaagatcaagcagtactccaatgtcctcgacaagcccctcagcaagggcaaacaagaggtcagtttgagtgcgtttgcgttcttgttttcggagcttgtgcagttcaaccagacgcaggttgacaacatagctgagttagaacgaaggctggaggatgcaggatatgctgtaggggctcgagttctggagcttctttgccatcgggaaaagggaaacagaagggagacgcggttgttgggaatcctgtcttttgtgcatagcactgtttggaaggtgttatttggaaaggtagctgattcccttgagaaaggcactgaacatgaagatgagtacatgattagtgagaaggagctccttgtgaaccgttttatttcgattccaaaagacatgggaacctttaattgtggagcatttgttgccggaattgtaaggggtgttttggacggcgctggttttccagctgtggttacagctcattttgtaccagtggagggacagcaacgacctcgaacaaccatcttgataaaatttgccgaagaggtactacgaagagaagcaaggttaggttgatgttcgtggcacggtcatctcattgttagttttcccagcgcttctccgtaatccaacgaggaaggcggggacttacagatggattgtcgagctaatgaaattcgcacctctaaacttgcgggaattcggattcacacattggttaattcactgtgtaagctatggcacaatgatgatttgaaagtagctacaatttggtaagtgtggttttatcttgacaaggagagaagtagaaaaatgaacaacacttaattactgcaaattatgttgtttatagaaactcgaaagaacgacaggcttgtgcttaaaagaagcctcattttatcccctcgtgaggctttgagacatactccattgtaaatttgggttatgttggttatgtcgtgtggccgggtcctttcttttagttttaatgaaacaccttcggtattgttcacttttaacgaaaaattacatttttatc

SEQ ID NO: 1975 - DNA, 936 bp, Arabidopsis lyrata
aaaagacaaaccaggtcgaaataaacaaaaccaggtcgagattcttttcaccggaaaacttctgtgtttagggttctggtcagctcgttctcaccggagaatcgaaaaagatgatcggagtcgggaaaatgaagcagtactccaacgtccttgacaagcctctcagcaaaggcaagcaagaggtgagcttgaccgcatttgctttcttattctcggagctcgttcagtacaatcaaacccaggttgacaatatagctgaacttgaaagaagactagaggatgctgggtatgcagttggatctcgagttctagagcttctttgcaaccgggagaagggaaaccgaagagagacacggttactggggattctgtctttcgtccacagtacagtgtggaaagtgttgtttggaaaggttgctgattcacttgaaaaaggaacagaacatgaagatgagtacatgatcagtgaaaaggagcttctcgtcaacaggttcatttcgattccaaaagacatgggaacattcaactgcggggcgttcgtcgccggcatagtgaagggagttttggataatgctgggtttcctgctgtggtaacggctcattttgtacccattgaaggacaacaacgtcctcgaactaccattttgatcaagtttgctgaggaggtgcttaaaagagaggcacggctaagtcaatgagagcactatggtcacgagttgccatgatctgggaactattggctttatgtgaactgcttgtgcaaatctgctatctgtttttggatgactatataacattttgatttgagctgcaaagccattgtcccgtgcatggatgtaaacaacatacatatccttacaattgcaacttatgatacaacactttactagttttaagcactgtggatgcaaacatgtttatgtttttaccaattgc

SEQ ID NO: 1976 - DNA, 689 bp, Brassica juncea
atcaacaaaagttctgtgttgagggttcaagtagctgaaaaaggaagaagatgatcggagtggggaagatgaaactgtactcaaacgtactcgacaagccactcagcaaaggcaaacaagaggtgagcttgagcgcatttgccttcttgttctcggagctcgttcagtacaatcaaacccaggttgacaacattgctgagcttgaaagaagactagaggatgctgggtatgcagttggggctcgagttttggagcttctttgcaaccgagagaagggaaacagaagagagacacggttacttgggattttgtcttttgtccacagcaccgtgtggaaggtgttgtttggaaaggttgctgattcacttgaaaaaggaacagaacatgaagatgagtacatgatcagtgaaaaggagcttctcgtcaacaggttcatatcgattccaaaagacatgggaacattcaactgcggggcgtttgtggccggcatagttaagggagttctggataatgcagggtttcctgctgtggtaacggctcatttcgtacccattgaaggacaacaacgtcctcggactaccattttgatcaagtttgctgatgaggtgcttaaaagagaggcacgactgagccaataagagcacacttgttgccacgatctgggaactatattggctttatgtgaactg

SEQ ID NO: 1977 - DNA, 957 bp, Brassica rapa
taataaaacagattctttcgccggagaaacgtaaatttccccagagagaatctgtgtttagggttctgaaaagcgaagaagaagatgatcggagtagggaaaatgaagcagtactctaatgtccttgacaagccactcagcaaaggcaaacaagaggtgagcttgagcgcgtttgcgttcttgttctcggagctagttcagtacaatcaaacccaggttgacaacattgctgaacttgaaagaagactagaggatgctgggtatgcagttggatctcgagttttggagcttctttgcaaccgagagaagggtaacagaagagagacacggttacttgggattttgtcttttgtccacagcaccgtgtggaaggtgttgtttgggaaggttgctgattcacttgaaaaaggaacagaacatgaagatgagtacatgatcagtgaaaaggagcttctcgtcaacaggttcatttcgattccaaaagacatgggaacattcaactgcggtgcgtttgtggctggcatagtgaagggagttttggataacgcagggtttcctgctgtggtaacggctcattttgtacccattgaaggacaacaacgccctcggactaccattttgatcaagtttgctgatgaggtgcttaaaagagaggcacggctaagccaatgagagcactttttgtacgagttgccacatcatgttcttggagctgttggctttatgtgaactgcttgtgcaagttttacctgtatcttttggtttaacttaatactacaacattttaaattgagctgcaaagccttgtccgttgattgatgtaaactacatacgtaccctcttgttacaattccagctgattatacaacagtttaccagttttagaacagtgtatgcaaacatggttatgccaattgcgtaacaagagttaaaacatgacattatccagtgtagaag

SEQ ID NO: 1978 - DNA, 2241 bp, Brassica rapa
attttcccggaaatcaaaaaaaaaaattactgcgttctgagtagctgaaaaaagggaagaagatgatcggagtggggaagatgaaactgtactcaaacgtactcgacaagccactcagcaaaggcaaacaagaggtgagcttgagcgcatttgccttcttgttctcggagctcgttcagtacaatcaaacccaggttgacaacattgctgagcttgaaagaagactagaggatgctgggtatgcagttggagctcgagtcttggagcttctttgcaaccgagagaagggaaaccgaagagagacacgactactaggaatcttgtcgtttgtccacagcaccgtctggaaggtcttgtttggaaaggttgctgattcacttgagaaaggaactgaacatgaagatgagtacatgatcagtgagaaggagcttctcgtcaacaggttcatatcgagtccaaaagacatgggaacattcaactgcggggcgtttgtggccggcatagttaagggagttctggataacgcagggtttcctgctgtggtaacggctcattttgtacccattgaaggacaacaacgccctcggactaccatcttgatcaagtttgctgatgaggtgcttaaaagagaagcacggctaagccaatgagagcacattttgccacgatctggggactatgttgtctttatgtgaactgcttgtgcaaatctactggtctgtttttggatgatttataaaagcttttgaaatgagctccaaagccctgtagatgcattgatgtaaactacgtatacataccttcctgttatagttgcagcacttcttagccgatatctttttgtttcaaggtttctatttaacttcatttggttaccagtcaaatacacatcatcatgatactcataatttcatttctatcttcagcaattgagtatctgttttcatgaaaaagctaagaacctctcttcttacgcttagttcctagatacatatccagtagctaggttaccaaagccaatagacatatcaatataataagagcaaatcacaaagcaaagaaggtaacaagaacatggtttagttcaaacaaatcagttcctgccgagaggaagtgacctgcaagagtaagtctctctgaaatcagacttcttcttggaggaagtaaagagagaagcatagacttccttggtagcattaaccggcactgcatcccccgccttgaatttcttcacagtaacgccattcccattcacattcacatcatccatctgtctctttcccaccttcacacctgcatcaaccaccacagcaacaccgttcttgctcttctttgaagcacctttcttctccctcagctttgccttctcctcctccatcctctccctcaacaagcccacctcctcctccgtaccgtttaccacaatcttatccgaatctttaacatccgcatgacacaccaaacacgaacaagacttcacttccttcaacgccttcgcactcatcacatgcccacaccctctcagagcgaaaaacttatactttccgttaaattcaagccctgagaccggacactgaaacttagcactggtcgtgtctccatcgaaaccaaccacatccgcgagcttgatattcaccatatccttcaaacccttaatgtaagagaactgcttaggcaacctcttcaacaacagagcgttcaccaaagcttctttgttgaacaagttcccgaggagatcaatcacgcaaggctcagccagaggctcgttagacaaggcgcagttaagccatttagagagcctctgctcgttgggatcgaccttgtcaggcttcttctcagcgtacatgttgaggtagcaatcacgagactctgctcccgtcgcaccgccatctcctccacctccaaggaggcgagggtaaacagcgagcatggagacgggagggaggttagatgctttgatccgtgtagaggcgttcagaggcttctcatttagagcgacggagaagtctgataacgattgacgctgcgatgattcgagtaaggaagtgagagctgagagagttaacacagattgcgaagggtctaattgcagtgcgacggtttgttgagagtaaggagatttgacgatgatctgtcgccggaagtgcattgtggcggacttaggttttccgatcaatttggttggtgtttcagttttgagatcgaagagagagagaaagatgcgaaacaggaacacaagac

SEQ ID NO: 1979 - DNA, 1049 bp, Vaccinium corymbosum
atcgtgcactaccagcaatctggtactccccaaatcctacggagcgagagagagagagagagagagagagagagaaggatgatcggagtggggaagatcaagcaatactctaacgtcctcgacaagccgctcagcaagggcaaacaagaggtcagtttgagtgcattttcgttcttgttttcggagcttgttcagtataatcaaacccaagtcgacaacatcacagaattagaaagaaggttggaggatgcaggctattctgtcggtgcaagagtattagaacttctttgccaccgtgaaaagggaaacagaagggagacacgattgttgggcatcttgtcttttgtacacagcacagtatggaaagtgttgtttggaaaggtagctgactcacttgaaaagggcactgaacatgaagatgaatatatgattagtgagaaggagctccttgtgaatagatttatttcaataccgaaggacatgggcacgtttaattgtggagcctttgtggctggaatagttaggggtgttttggatagcgctggttttcctgcagtagtttcagcacattttgttcctgtagagggtcagcaacgacctcggacaaccattttaataaaatttgctgaagaggttctaaggagagaagcaaggttaggttgatgtctggtgcgattggttagctttgtgtttgattcacaacaatacagggaaggatgctgaaatttgttgctgttttatggaaacacattcaggatgtttgaatggaaatcctgtctattgtttgttgctttaaggccactcggattccttgcgagagttgttatcctcggatttattatgttgcagtacctttgtatcaaatcccagattgcgcaaaaaagcatcatttatttgcatagacagttttatgtaaaaggccatgctatacatgtaactgttgattgtttaagagtgattggtttaaaatccatgggaagtctccactttctttgtgagttgagaatgaacaaatgagccaattagaagtgtggcattgctcttttgac

SEQ ID NO: 1980 - DNA, 1931 bp, Theobroma cacao
acgcatagtcgcgctcggtgctcgcatagctcatagctgattcatttttcctgcgatttctcagcagccaaacagaaaataaaatttccttccagtagaaaatgatcggagtcgggaagatcaagcaatactctaacgtcctcgacaagcccctcagcaagggcaaacaagaggttagcttgagtgcatttgcattcttgttttcggagcttgttcagtacaatcaaacacaggttgataacattgccgaattagaaagaaggctggaggatgcagggtatgcagttggagctcgagttcttgaacttttgtgccatagggataagggaaataggagggagactcgattgttgggtattttatcttttgtgcacagcactgtctggaaggtgttatttggaaaggtggctgactcgcttgagaagggcactgaacatgaagacgaatacatgatcagtgagaaggaactccttgtgaacaagtttatttcaattccaaaagacatggggacttttaattgtggggcatttgttgctggaatagtgaggggtgttttggatagtgcaggatttccagcggtggtaacagctcattttgtacctatggagggacagcaaagacctcgaacaactattttgataaagtttgctgaagaggtattgcaaagagaagcgaggttaggttgattgctatgcctgggttatctttgagttgtccatgttctgctacactgggaatggaacaatgaacttctgctggtttgttaatctaacgaggatttcacctgccaatcacagtggcaaatctatattcctctctctgattaatgatggttgtgtattattctttatggcatcgtgggtactgatatgatagcaaaagattattgcaagtgcagttgatgtaaagtaaatgtcatcattactgttaagttttgtgttaatatgaactgaaatggattattactgaggagaatacgatttgaaggatttgttgctgactgatccctccattgaatgtaagagggtgagaatatcgctttactacgggcatcatattactacagattgtggaacatcatattaccacagtgacaaacaccctgcatctcttcatctctcttatttgccacaaacctcagctgcacctggccttgttgccggagatcgttgctggaaaaacgcctcacttttgtccttttctctgcccccctcaactgaagcatttttctctctcaaacatgttacctaaaatggaaaactcatctgtggagcatgagacggagaaccaaaagggagcttagagacaaaattaaggaagcaaccaccccgtacgtgaagaagcaagaatgaatatacatttatttcatcttcatatttttttgtgatggttcaattctctcttctttttttccatttatggttttgattctttcttttctttttcttctgttaattatggagattattattatgttggtaaggtttctctcttctaattatggaaatttgttagaggtatttggcactccccaaattcataacataaactaaaaaataaataaaaacaagaagagacaaaaaagaaattgtaaatggaaatcgaagaattaaagggacaactaaatgtgctggagtccatgggaggtggtaatggtaagggatcggaatgcagaaatgaggcgggacatggaagaagaatcgaaggaaaaggccgaggcattggaagattctggaatctttgctaatttgaagccagactttttgcattataggggttggatgggcatccgactcatcatcctacagttatcggagtcaagaaggtggaagaagccatttcaaaatgcatttaagaagagatatccaatgaatgaagcacctggaggaggctgccaagtttagccccattggcaggacattatccaggat

SEQ ID NO: 1981 - DNA, 718 bp, Brassica napus
ctgaaaaaggaagaagatgatcggagtggggaagatgaaactgtactcaaacgtccttgacaagccactcagcaaaggcaaacaagaggtgagcttgagcgcatttgccttcttattctcggagctcgttcagtacaatcaaacccaggttgacaacattgctgagcttgaaagaagactagaggatgctgggtatgcagttggtgctcgagtcttggagcttctttgcaaccgagagaagggaaaccggagagagacacggttactaggaatcttgtcgtttgtccacagcaccgtgtggaaggtcttgtttggaaaggttgctgattcacttgagaaaggaactgaacatgaagatgagtacatgatcagtgagaaggagcttctcgtcaacaggttcatatcgattccaaaagacatggggacattcaactgcggggcgttcgtggccggcattgtgaagggagttctggataacgcagggtttcctgctgtggtaacggctcattttgtacccattgaaggacaacaacgtcctcggactaccattttgatcaagtttgctgatgaggtgcttaaaagagaggcacggctaagccagtgaggagaacttcgtgccacggcctggggactatgttagctttatgtgaactgcttgtgcaaatctgctggtctgtttttggattataatagcttttgaatcgagctgcaaagccct

SEQ ID NO: 1982 - DNA, 800 bp, Brassica napus
gttctgagtagctgaaaaaagggaagaagatgatcggagtggggaagatgaaactgtactcaaacgtactcgacaagccactcagcaaaggcaaacaagaggtgagcttgagcgcatttgccttcttgttctcggagctcgttcagtacaatcaaacccaggttgacaacattgctgagcttgaaagaagactagaggatgctgggtatgcagttggagctcgagtcttggagcttctttgcaaccgagagaagggaaaccgaagagagacacgactactaggaatcttgtcgtttgtccacagcaccgtgtggaaggtcttgtttggaaaggttgctgattcacttgagaaaggaacagaacatgaagatgagtacatgatcagtgagaaggagcttctcgtcaacaggttcatatcgattccaaaagacatggggacattcaactgcggggcgtttgtggccggtatagtgaagggagttctggataacgcagggtttcctgctgtggtaacggctcattttgtacccattgaaggacagcaacgccctcgaactaccatcttgatcaagtttgctgatgaggtgcttaaaagagaggcacggctaagccaatgagagcacattctgccacgatctggggactatgttgtctttatgtgaactgcttgtgcaaatctactggtctgtttttggatgatttataaaagcttttgaaatgagctccaaagccctgtagatgcattgatgtaaactacatatacataccttcctgttacagtttcagcacttattagccga

SEQ ID NO: 1983 - DNA, 923 bp, Brassica napus
ggagaaaaaaaaaacaagaaagaatctgtgtttgtttagggttcagaaaagcgaagaagaagatgatcggagtagggaaaatgaagcagtactctaacgtccttgacaagccactcagcaaaggcaaacaagaggtgagcttgagcgcgtttgcattcttattctcggagctagttcagtacaatcaaacccaggttgacaacattgctgaacttgaaagaagactagaggatgctgggtatgcagttggatctcgagttttggagcttctttgcaaccgagagaagggtaacagaagagagacacggttactagggattctgtctttcgtccacagcaccgtgtggaaggtgttgtttgggaaggttgctgattcacttgaaaaaggaacagaacatgaagatgagtacatgatcagtgaaaaggagcttctcgtcaacaggttcatttcgattccaaaagacatgggaacattcaactgcggggcgtttgtggccggcatagtgaagggagttttggacaacgcagggtttcctgctgtggtaacggctcattttgtacccattgaaggacaacaacgtcctcggactaccattttgatcaagtttgctgatgaggtgcttaaaagagaggcacggctaagccagtgaggagaacttcgtgccacggcctggggactatgttagctttatgtgaactgcttgtgcaaatctgctggtctgtttttggattataatagcttttgaatcgagctgcaaagccctgtccgtgcattatacgtataccttcctgttacagttgcatccgatgatacaacactttcacagttcgcaattagattcttttgtttcaaggttatttatttaacttctatttgggtgtctgtacaaaaaacacgtcatgatgacaccacgggatagtag

SEQ ID NO: 1984 - DNA, 740 bp, Brassica napus
gagggaaagaatctgtgtttgtttagggttctgagaagcgaagaagaagatgatcggagtcgggaaaatgaagcagtactccaatgtccttgacaagcccctcagcaaaggcaaacaagaggtgagcttgagcgcgtttgcgttcttgttctcggagctagttcagtacaatcaaacccaggttgataacattgctgaacttgaaagaagactagaggatgctgggtatgcagttggatctcgagttttggagcttctttgcaaccgagagaagggtaacagaagagagacacggttacttgggattttgtcttttgtccacagcaccgtgtggaaggtgttgtttgggaaggttgctgattcacttgaaaaaggaacagaacacgaagatgagtacatgatcagtgaaaaggagcttctcgtcaacaggttcatttcgattccaaaagacatgggaacattcaactgcggggcttttgtggccggcatagtgaagggagttctggataacgcagggtttcctgctgtggtaacggctcattttgtacccattgaaggacaacaacgtcctcggactaccatcttgatcaagtttgctgatgaggtacttaaaagagaggcacggctaagccaatgagagcactttttgtcacgatctggggagctcttggctttgtgtgaactgcttgtgcaagtattgcctgtctgttttggtttaacgtatactataacattttgaa

SEQ ID NO: 1985 - DNA, 1052 bp, Centaurea maculosa
tttagagattttgatgattgtgttttggttcactttcacaccaactccccttgttgggaaggaattagatcagtctgaagtgaactagggcttggacttgaaggaagcaaatcgccattgagagaagataacggagaagatgatcggagctgggaagatgaagcagtacacaaatgttctcgataaaccccttagtaaaggcagacaggaggtcagtttaagtggatttgcccacttattttcagagcttgttcagtacaaccaaactcaggttgacaacattggggaactagaaaggagattggaggatgctgggtatgctgttggagtacgagttctggaattactttgccatagggagaagggtaacagaagggagacacggttgttggggattctgtcttttgtgcatagtacagtatggaaggtgctttttggaaaggtagctgactcgcttgagaaaggcactgaacacgaagatgaatatatgatcagcgaaaaggagctcctagttaatagatttatttctgtaccgaaagacatggggtcgttcaactgtggtgcttttgttgctgggatagtaaggggcgttttagacaatgcaggattcccggctgttgtgactgctcatttcgttccagtggacggtcaacaacgccctcgaacaaccattttgataaaatttgcagaagaggtgctacgaagagaagcaaggttaggatgatttttgtttgtactacggacatggatgctatatcagcgcattttatcctaatgtgcattcacttctcatccaatggtgaataaccacttctcatcggaacctgaccctatgtttaactgtctaagaatacttatcaaatttcatgttacgacagaaaaaaccttaacatcaatcaactgatggttttccaactctacaatttcaagtgatttggctttgaaagttatagtagttttatgtacaagatattgtatattgggttgttaataagaaagccttcaggcttcatgcctcaatcatatggattcaaaatgtacaaaggttgtct

SEQ ID NO: 1986 - DNA, 858 bp, Cichorium intybus
gaaaagatccaacaccccctaaaaattggttgaacaagtttatggttactcaaacttgggaacagtgagtgaaagagggtttagaattcaggaaagccgagggagcaaatcgcctttgacatcgttactcttgctcggctactgaaaggataacagcgaagatgatcggagtagggaagattaagcagtacacaaatgttctggataaaccccttagtaaaggcagacaagaggttagcttaagtggatttgcttacttattctcagagcttgttcagtacaaccaaactcaggttgacaacatcggggatctagaaaggagattggaggatgctggttatgctgttggagtacgcgttttggaattactctgtcatagggaaaagggtaacagaagggagacacgtttgttgggcattttgtcttttgtacatagcactgtatggaaggtcctttttggaaaggtagctgactcgcttgagaaaggtaccgaacacgaagatgaatatatgattagcgaaaaagagctcctagtcaatcgatttatttcagtaccaaaagacatggggtcattcaactgtggtgcttttgttgctgggatagttaggggcgttttagacaatgcaggattcccggctgttgtcactgcccattttgttcccgttgacggtcaacaacgccctcggacaaccattttgataaaatttgctgaggaggtactacgaagggaagcaaggttaggatgatttttgttaaattgtttagctttgtattcatggaattattgcggctttttatgtaattgaagaatcaaagactataaacggttcgaaattaatttaaatttgtagcgaaaaa

SEQ ID NO: 1987 - DNA, 864 bp, Cirsium arvense
gtgttttggttcataacttcacatcaactcccacttgttgggggaggaattagatcagtctgaagtgaactagggtttggacttgaaggaagcaaatcgccattgacagaagatgatcggagctgggaagatgaagcagtacacaaatgttctcgataaaccccttagtaaaggcaggcaggaggtcagtttaagtggatttgcctacttattttcagagcttgttcagtacaaccaaactcaggttgacaacattggggaactagaaaggagattggaggatgctgggtatgctgttggagtacgagttctggaattactttgccatagggagaagggtaacagaagggagacacggttgttggggattctgtcttttgtgcatagtacagtatggaaggtgctttttggaaaggtagctgactcgcttgagaaaggcactgaacacgaagatgaatatatgatcagcgaaaaggagctcctagttaatagatttatttctgtaccaaaagacatggggtcgttcaactgtggtgcttttgttgctgggatagtaaggggcgttttagacaatgcaggattcccggctgttgtgactgctcatttcgttccggtggacggtcaacaacgccctcgaacaaccattttgataaaatttgcagaggaggtgctacgaagagaagcaaggttaggatgatttttgtttgtactacggacatggatgctatatcagcgcagtttattctaatgtgcattcacttctcatccaatggtgaataaccacttctcatcggaacctgaccctatgtttaactgtctaagaatacttatcaaatttcatgttacgacagaaaaaaccttaac

SEQ ID NO: 1988 - DNA, 1023 bp, Cirsium arvense
tccggtcctacttaattgagctaatattggaaggataacaaaaattaattaagtttagttacttaaaaatattgaatcttgagtaaaatgaaatcgtttttagagattttgatgatttgtgtttttggttcacatcaaactccctcttgttggggaggaattagatcagtctgaagtgaactagggtttggacttgaaggaagcaaatcgccattgacagaagataacggagaagatgatcggagctgggaagatgaagcaatacacaaatgttctcgataaaccacttagtaaaggcaggcaggaggtcagtttaagtggatttgcttacttattttcagagcttgttcagtacaaccaaactcaggttgacaacattggcgaattggaaaggagattggaggatgctgggtatgctgttggagtacgagttctggaattactttgccatagggagaagggtaacagaagggagacacggttgttggggattctgtcttttgtgcatagtacagtatggaaggtgctttttggaaaggtagctgactcgcttgagaaaggcactgaacacgaagatgaatatatgatcagcgaaaaggagctcctagttaatagatttatttctgtaccgaaagacatggggtcgttcaactgtggtgcttttgttgctgggatagtaaggggcgttttagacaatgcaggattcccggctgttgtgactgctcatttcgttccagtggacggtcaacaacgccctcgaacaaccattttgataaaatttgcagaagaggtgctacgaagagaagcaaggttaggatgatttttgtttgtactacggacatggatgctatatcagcgcattttatcctaatgtgcattcacttctcatccaatggtgaataaccacttctcatcggaacctgaccctatgtttaactgtctaagaatacttatcaaatttcatgttacgacagaaaaaaccttaacatcaatcaactgatggttttccaactctacaatttc

SEQ ID NO: 1989 - DNA, 903 bp, Echinacea purpurea
cccgaccaaaaaagtaaattaaaaacatacatcacccccgattctattaatttacaaacacttttcatatttattcaggaacagatcaacaagatcagtctacaggctagtaagggtttgtacttcaaccttgaagaagcaaatcgccattcgaaaacgatgattggggcagggaagatgaagcaatacacaaatgtcctcgataaaccccttagtaaaggcagacaagaggtgagtttgagtggatttgcttacttgttttcggagcttgttcagtacaaccagactcaggttgacaacattggggagctagaaaggagattggaggatgccggctatgctgttggagtacgagttttggagttactgtgccacagggaaaagggtaacagaagggagacacgtttgttgggcattttgtcttttgtacatagtacagtatggaaagtgcttttcggaaaggtagccgactcacttgagaaaggcactgaacatgaagatgaatatatgattagtgaaaaggagcttttggtcaacaggtttatttcagtaccgaaagacatggggtcattcaactgtggagcttttgttgctgggatagtaaggggtgttttggacaatgcaggattcccggctgttgtgactgctcattttgtaccggtggatggtcaacaacgacctaggacaactattttgataaagtttgctgaggaggtacttcgaagagaagcaaggttaggatgatttgtttttatcgtttgttggtgtgagttgggagtacttatatacttcaaagaatcacaatgtaacaaagtatatctactatatgtagcaccaagaattataccttttttaccattcatcctagcaattgtatgacttaaaattctcagggaaggggag

SEQ ID NO: 1990 - DNA, 943 bp, Solanum melongena
taatctaggtacccaagggacagtagacaacaactacagcagtaagcgatctaggaagagttgaaggaagaagatgataggtgtagggaagatcaagcagtatacaaatgttcttgagagacccctcagcaaaggcaaacaagaggtcagtttgagtgcatttgctttcttattttcggagcttgttcagtacaatcagactcaagtggacaacattactgaattagagcgaaggttggaggatgctggttatgctgttggtgcacgtattttagaactcctctgccacagagaaaagggaaacagaagggagacacgactactgggtatattatcatttgtgcacagcactgtatggaaggttttgtttggaaaggttgctgactcacttgagaaaggcactgaacatgaagatgaatatatgattagtgagaaggagctccttgtcaacagattcatttcaattccaaaagatatgggtgctttcaactgtggagcttttgttgcgggtattgtaaggggagttctggacaatgcaggtttcccagcagtagtgacagctcattttgtccctgtggagggacagcaccgaccacggacaacaattttgataaaatttgctgaagaggttctaagaagagaagcaacactaggttgatgtttatttatcattatgtttggtgcaacaaaatgcttgaacaacattatgctgagatgacaaatgaaagatccttcgattgttctacacatcttaggttcatttcaatcctaagatcatacaattgccagttgtgacattactttctgtagtactatagttgacctgttcaacgcgtctgaggctcaccgcaataaattgtaccaaaacatcaagtattttctttctggtgtaaaatatttgcattttggaaggtgatttctggaaatttcatgttgatgaact

SEQ ID NO: 1991 - DNA, 999 bp, Panax ginseng
aaagaaattggtaggtctcaaacagtaaaaagactactacggccttcgtacttcttctttctcacacagttgcaggaaggaagagagagaggatgatcggagtggggaagatcaaacaatataccaacgttctcgataaacctgttagcaaaggcaaacaagaggtcagtttgagtgcatttgcctttttattctcggagcttgttcagtacaatcagactcaagttgacaacattgctgaattagagcggagactggaggatgcaggatatgctgttggggcacgggttttggaacttctttgccatagagagaagggaaacagaagggaaacacgcttgttgggtattttgtcttttgtccacagtacagtatggaaggtgttgtttggaaaggtagctgactcacttgagaaaggcactgaacatgaagatgaatacatgattagtgaaaaggagctccttgtcaataggtttatttcaataccgaaagacatgggcacatttaactgtggggcatttgctgctggaatagtaaggggtgttctggatggtgcagggtttcctgctgtagtaacagcccattttgtaccagtggaggggcagcaacgacctcggacaaccattttgataaaatttgctgaagaggtactacgaagagaagcaagattgggatgatgtttgcgtaggattgtcttctgttgtattgcccactgcaacattgtaattcatgttgaaattacttgcttgatggtgggagaaatcacgatggacgtgtgacttttttcttgaacgtggcaaactatatactgccagcgccagatttactttactgcatctctttgaagggcaataactatagttggtccggggattatatttatatttcaatttcagcgtaaaagatactatatagtatcagtatgtgcattggttcctaatcctggagttgtatacatggggccggattatgtaagcatggaccattttctcgagcgct

SEQ ID NO: 1992 - DNA, 902 bp, Vitis vinifera
tagacacctcaagagctgaattcaacaggttgggttcccctgtgattggaagagagagaagatgatcggagtagggaagatcaagcagtattctaacgtactcgataaacccctcagcaagggcaaacaagaggtgagtttgagtgcatttgctttcttgttttcggagcttgtccagtacaatcaagcacaggtcgataacattgctgaattggaaagaagactggaggatgcaggctacgctgttggggcccgagttctagaactcctttgccatagggataagggaaacagaagggagacacgactattgggtattctttcttttgtacacagtacagtatggaaggtgttatttgggaaggtagctgactcacttgagaaaggtactgagcacgaagatgaatacatgatcagtgagaaagagctcctggttaatagatttatctcaataccgaaagacatgggaacattcaactgtggtgcatttgttgctggcattgtaaggggcgttttggatagtgcaggttttccagctgtggtaacagctcactttgtacctatggagggtcaacaacgacctcggacaactattttgattaaatttgctgaagaggtactgagaagagaagcaagattgggttgatgcttgtgccaagatcatctttatgtaatattcatcagtgttccacaacagtataggatggggaaggatgaaacttttagcaggtttttcaaaaccagttgggatttgcagctgggctctatcattatattgggctgtgtgaaccttagttgccaaggagatttgatgtaaattgagtgtcatcatcatttgtcatcatctttatatgaactctaaatgattgttttaagtaacaaacaaatttcatactttccaa

SEQ ID NO: 1993 - DNA, 1069 bp, Carpinus betulus
tgcatactcacatctgagaaaaattaacaagtttactactacacacgcacggaggaagacgacgatgatcggagttgggaagatcaagcagtacaccaacgtcctcgacaagcccctcagcaagggcaagcaagaggtcagtttgagcgcgtttgcgttcctgttttctgagcttgtgcagtacaatcagacgcaggtggacaacattgccgagttagaaagaaggctggaggatgcaggctattcggttggggctcgagttttggaacttctttgccatagagataagggaaacagaagggaaacacgattgttgggcattctttcctttgtacacagcactgtatggaaggtgttatttggaaaggtggctgactcacttgagaaaggcactgaacatgaagatgaatacatgatcagtgagaaggagctccttgtgaacagatttatttcaattccaaaagacatggggacatttaattgtggggcatttgttgctggaatagtaaggggtgtattggacagtgctggttttcctgctgttgttacagctcattttgtgccgatggaaggtcagcaacgacctcggacaaccattttgataaaatttgctgaagaggtactgcaaagagaagcgaggttaggttaatgtttgtgccagatttattacgtgtaattttgtgatgatcagcaagaacatgatgaatagatggtgaaggatggtgagatattagctggtttgtcaaataaataggatttcacctgccagttctctcacttgggccaacttgaattcctatcattgatttctgttgctttacactcttacttcatgtcacaataactatgatgatatagaattagcaatcattattgttagttggcttagaaaaggaacaaaaggggaaaaagaaaatacatgtttattttcaatgttcataggtactaagaagagttttaaggagagaaaaagttcttgtatgccttgttgcaatttcaaagagcacagctttatttgttattgaagtgtggatcttgttatagtatattggaggagcgtctttcgaac

SEQ ID NO: 1994 - DNA, 1006 bp, Allium cepa
ttcttcgaggataggatgattggagttgggggaaaagtgaagcagtatagcaatgtccttgataaacctctaagcaaaggcaggcaagaggttagcttgagtgcatttgcgtttctgttttcagaaattgttcagtacaatcaaactcaagtcgacaatatatccgagttagagcgaagattggaagatgctggctatgctgttggagctagagtccttgaacttctttgccacagagataaaggtaacagaagggagacaagattattggggattctttccttcattcatagcaccgtatggaaagttctctttggaaagattgccgattcacttgaaaagggaacggaacacgaagatgaatacatgatcagtgaaaaggaacttcttgtcaaccgatttatttccataccaaaagatatggggacatttaattgtggagcctttgttgctggaatcgtaaagggtgttttagatagtgcaggttttcctgcagtagtaactgcgcattttgttcctatggagggccaacaaagacctcgaactacaattttgatcaaatttgctgaagaggttcttgtaagggaagcaagatttggctagaatatttgtgatttgttgctatcggatgatatttggcaatagtgatcattcgtggagtttggagagataaactatcgggtgaatatttatttatgtatcatagaagcacactaagcggccgggtactatttttcattgccgacagcattatataccgctaatgcagttttattaaatttcgcggttttgttatttctaatgatgttatgccacaattacatctgtgcgttcgtatactgttttggaatgtaatgccagaaatgcatatttacactggtgtgtattccggtttgcgtttgattggttaggaacaatcatgaactttggtaatacgtattatcaagactgtttctttttaacctttttataaagaaaaaactgagaattctgaatggaaattgtt

SEQ ID NO: 1995 - DNA, 969 bp, Lippia dulcis
aggagaaagaaagtaaaattaattacaatagcgagatagatcgaaacgccgtcgtttaaactgagtggcgcaactgctgcaagcctgcaacgcaaactctcaatcgacactgcgaaattgcataatagttggaggaagaaatgataggagttgggaaagcgaagcaatatgcaaacgtgctagatagacccattggtaaagggaaacaagaggtcagtttgagtgcgttcgccttcttgttttcggagcttgttcagtacaatcagattcaagttgacaacatagcagagttagaaagaaggttagaggatgcaggctatgctgttggagccagggttctggaactgctttgtcatagggagaagggtaacaggagggagatacggctattgggtattctgtctttcatacacagcacagtatggaaagtgttgtttggaaaggttgctgactctcttgagaaaggtaccgagcatgaggatgagtacatgatcagtgagaaggagcttcttgtcaacagatttatttcaattcccaaagatatgggcgcctttaactgcggagcatttgttgctggaattgtgaggggggtcttggataatgccggttttccggctgttgtaacagctcattttgtacctgtggatgggcagcaccgacccaggacaactattttgattaaatttgctgaagaggtactacaacgagaagcaagattgggttaacagaaggaggggaaattggagcaatggtggcattagcttttggttgcgagcatgtcggcaactcacatataatgaagtttatttcaaataggtgaatgttgagatgattgactatattacttgtgaagttgccgagggatttacagtatattgacttacaatatgattgttttgtgtttcgccacgaatttcttttgagacgatgcttcactcgaatttctagacaactagttacaaatgatca

SEQ ID NO: 1996 - DNA, 977 bp, Plantago ovata
ttcttgttttagatgcgaaaaattagcaactttttgatagctgagtagtcgagagagaagaagatgataggagttgggaaaatgaagcagtactccaacgtgcttgataagcccatgaccaaaggcaaacaagaggttagtttaagtgcttttgcctccttgttttcggagcttgttcagtacaatcagacccaagtcgacaacatcggggaactcgagagaagattagaggatgctggctatgctgttggagtaagagttctggaacttctatgtcaccgagaaaagggtaaccggagggagacacgcctcttgggtattttgtccttcatacacagtacagtgtggaaagtattgtttggaaaggtggccgattctcttgaaaaaggcaccgaacatgaagatgagtatatgatcagcgagaaagaacttcttgtgaataggtttatttccgtaccaaaagatatgggtgcttttaactgcggagcatttgttgctggaatagtgaggggagttttggataatgctggttttccagctgtcgtaacagcacattttgtacctgttgatgggcagcatcggcccaggacaaccattttgatcaaatttgctgaagaggttctacgaagggaagccagactgggttgatagtgacttgcagttaataccttaaatcgacatactttatctatatacctgcaatggagaacaaaccggttcgaagactcatcgcttatccgcaggttgagatgtaatctagcatttagtcgacaacattctcgtattgtgatgtgatgatgcgataactgtaccaaagaacttgtctgattacatgctatgttaattggtttgctactatttgacatatggatttgtatcgatgagtgtgtgtttcattatagagatgataaaatcaaaagctgcagcactttgtaggttgtattacaacttgtgccccaatacactttctgagccgt

SEQ ID NO: 1997 - DNA, 955 bp, Platanus occidentalis
atcggagtagggaagatcaagcaatactccaacgtcctcgataaacccctcagcaaaggcaaacaagaggtcagtctcagtgcattcgcgttcttgttttctgagcttgtgcagtacaaccagactcaggttgacaacatctctgagttagagcgaaggctagaggatgccggctatgcagttggagcaagagttctggaacttctttgccatagggataagggaaacagaagggaaacacgattgttgggaattttgtcctttgtacacagtacagtgtggaaggtgttatttggaaaggtggctgactcacttgagaaaggcactgaacatgaagatgaatacatgatcagtgagaaagagctccttgtgaaccgatttatttccataccaaaagacatgggatcatttaattgcggggcatttgttgctggaatagtaaggggtgtcttggatagtgcaggttttccagctgtagtcacggctcattttgtccctatggagggccagcagcgacctcgcactaccattttgataaagtttgcagaagaggtacttcgaagagaagcaaggttgggttaatgtttggaccgaggatagtgttaatcttgtcaaagattggaatataacagagatggtggattttatagttgattaattaaatataaaacaactccaacccggtcaagttctgctggtatttgttatcaatagttacccaaattctaatattctttggggctggtgtttttcttttccaaggtgcaaccgccaatgctgatcaagcagtttcattgcagtattagtttactgggtctttcacaagtgccagggttgttgggtgtaaattttattgtttctttcttcctccactcagttgttttatttactctggtgcattattttaccatgacccatatgattttcatggtcttaaataagaaacttaagtttg

SEQ ID NO: 1998 - DNA, 1103 bp, Populus trichocarpa
tacctcaacaggcccagacccataaaagacccgaggtccgctagctcaatacaaccgaaacggggcagcaacacagaagtcagaacagagcacaaccaattaccactcctccatgttcctgtaatttctcacctttcaaagtccaaacagaccatagtataatatatatatataaaaaaaaaatttcccgtagaaagaaagaaaatcaaaccctaaaaaaacatgatcggagtaggcaagatcaagcaatactctaacgtcctcgaaaaacctctcagcaaaggcaaacaagaggtgagtttgagtgcgtttgcatttttgttttcggaacttgtccagtataatcaaacacaggttgataacattgctgaattagagcgaaggctagaggatgcaggatatgctgtgggggctcgagttctggaacttctttgtcatagggacaagggcaacagaagggaaacacgattgttgggtattttgtcttttgtgcacagcactgtgtggaaagtgttatttggaaaggtagctgactcccttgagaaaggcactgaacatgaagatgaatacatgatcagcgaaaaggagctccttgtcaacagattcatttcaattccaaaggacatggggacatttaactgtggggcatttgttgctggaatagtaaggggtgttttggatagtgcaggttttccagctgtagtaacagctcattttgtacctatggagggccagcaacgacctaggacgaccattttgataaaatttgctgaagaggtactaagaagagaagcaagactaggttgatgtctgtacgaatatttcatcatgtaaccttcagtcttctgcaacaacatggtgacgaatagtgaacttttcagctggtttgtcaacaaacgaggattttcacctggcaatcctgtcagctatacttgtgactctattcaatttctgtctgatttttgtgtatgctcttcaaagcacggaaattttaatgatcttgtaaaagcaattattgccacttcagttgatgtgaagtaaacgatatccttttttcactgcacataagatcttagtcatgactgaatagacattttgttttt

SEQ ID NO: 1999 - DNA, 934 bp, Raphanus sativus
gggaaatttcctcagagagagaaaggtagaaagattgtgtgtctagggttctgaaaagcgaagaagatgatcggagtggggaaaatgaagcagtactctaatgtccttgacaagccactcagcaaaggcaaacaagaggtgagcttaagcgcatttgctttcttattctcggagctcgttcagtacaaccaaacccaggttgataacattgctgaacttgaaagaagactagaggatgctgggtatgcagttggatctcgagttctggagcttctttgcaaccgagagaagggaaacagaagagagacacggttactagggattctgtctttcgtccacagcaccgtgtggaaggtgttgtttggaaaggttgctgattcacttgagaaaggaacagaacatgaagatgagtacatgatcagtgaaaaggagcttctcgtcaacaggttcatttcgattccaaaagacatgggaacattcaactgcggagcgtttgtggccggcatagtgaagggagttctggataacgcagggtttcctgctgtagtaacggctcatttcgtacccattgaaggacaacaacgtcctcggactaccattttgatcaagtttgctgatgaggtgcttaaaagagaggcacggctcagccagtgagagagcaccttcgagttgccacgcacgatctgtttggctttatgtgaactgcttgtgcaagtcttgtctgtatggtttgtcttaagttatacttttaacgttttgaattgagctgcgacgccattgtccgttgattgatgtaaactacatacataccctcttgtttacaattctagctgatgatagaacagtttcctagttttagtacagtgtatgcaaacatggttatgtcaaagtgcgaaagaagaagagtaaagaaacatggcattatccattcccg

SEQ ID NO: 2000 - DNA, 844 bp, Raphanus sativus
ggaaatttcctcagagagagaaaggtagaaagattgtgtgtctagggttctgaaaagcgaagaagatgatcggagtggggaaaatgaagcagtactctaatgtccttgacaagccactcagcaaaggcaaacaagaggtgagcttgagcgcgtttgctttcttattctcagagctggttcagtacaatcaaacccaggttgacaacattgctgagcttgaaagaagactagaggatgctggttatgctgttggatctcgagttttggagcttctttgcaaccgagagaagggaaacagaagagagacaaggttactagggatcctgtctttcgtccacagcaccgtgtggaaggtgttgtttggaaaggttgctgattcacttgaaaaaggaacagaacatgaagatgagtacatgatcagtgaaaaagagcttctcgtcaacaggttcatttcgattccaaaagacatgggaacattcaactgcggagcgtttgtggccggcatagtgaagggagttctggataacgcagggtttcctgctgtggtaacggctcatttcgtacccattgaaggacaacaacgtcctcggactaccattttgatcaagtttgctgatgaggtgcttaaaagagaggcacggctcagccagtgagagcaccttcgtcgagttgccacgcacgatctgtttggctttatgtgaactgctagtgcaagtcttgtctgtatggtttggctttaaatatattgttaacattttgaattgagctgcaaagccattgtccgttgattgatgtaaactacatacataccctcttgttacaattctggctgatgatagaacag

SEQ ID NO: 2001 - DNA, 827 bp, Rosa hybrid cultivar
agaggaggagaatgatcggagtcgggaagatgaagcagtactctaacgtcctcgacaggcctctcagcaaaggaaaacaagaggtgagtttgagtgcttttgcgttcttgttttcggagctggtgcagtacaatcagacacaggttgacaacattgccgagctagaaagaaggctggaagatgcaggctatgctgttggagctcgagttctggagcttctttgccatagggataagggaaacagaagggagacacgactgttgggtatcctgtcttttgtgcatagcacagtatggaaggtgttattcggaaaggtagctgattcactagagaaaggcactgaacatgaagacgagtacatgattagcgagaaggaactccttgtgaatagatttatttcgattccaaaagacatgggaacatttaattgtggagcatttgttgctggaattgtaaggggtgttttggatggtgctggttttccagctgtggtaacagctcattttgtaccagtggaaggtcagcaacgacctcggacaaccattttgataaaatttgctgaagaggtactacgaagggaagcaaggttgggttgatgttaaggccacgatcatcatatcttacttttctctaaagctcctccttattatgattaaaaatggtggtcttacatttgggttgtcaagcgactttcacctcgaatcatatgaatcatacttgtgtaagctatttcacaatactgatttgaaagtagtgacaattgtaatttgtaagcgtagctgtgatccaatcaggagtgaaagtaaaaaaagaacaagaagagttta

SEQ ID NO: 2002 - DNA, 875 bp, Helianthus annuus
tttaacatacaaacaccccacttcttttaatttactaaaaacttttcatatttcttcgcaaccagatcaacaagatcagtctacgaactagtaagggtttgtagttctcacttgaggaagcaaatcaccattcgaaaacgatgatcggggcagggaagatgaagcaatacacaaatgttctcgataaaccccttagtaaaggcagacaagaggtgagtttaagtggatttgcttacttgttttcagagcttgttcagtataatcagactcaggttgacaacattggggagctagaaaggagattggaggacgcgggctatgccgttggagtacgagttttggaactgctgtgccacagggaaaagggtaacagaagggagacacgtttgttgggcattttgtccttcgtacatagcaccgtatggaaggtgctttttggaaaggtagccgactcacttgagaaaggtacagaacatgaagatgaatatatgattagtgaaaaggagcttctcgtcaacagatttatttcagtgccgaaagacatggggtcgttcaactgtggtgcttttgttgctgggatagtaaggggtgttttagacaatgcaggattcccggctgttgtgactgctcattttgttccggtggacggtcaacaacgacctcgaacaactattttgataaagtttgctgaggaggtacttcgaagagaagcaaggttgggatgatttgttgttatgtgtttgttggcgcgctttgcaatacttatatactttaaagaatcaaattgtaacaaagtttatctatctactatttgtagcaccaagagttactactctttttaacattcatcttagcaattgaatgacttttaaatt

SEQ ID NO: 2003 - DNA, 1006 bp, Tabernaemontana elegans
caagatctccagtctccacttcgtccctcgcgcacacagggtgattgaagtaaaattcagtgcggcagcaaacctaaggcctcaacgatcggacgatgataggagttgggaagatcaagcagtacagtaatgtcctagagagacccctaagcaaaggcaaacaagaggtcagtttgagtgcatttgcattcttattttctgagctggttcagtacaatcagacccaagttgacaacattgccgaattggaaaggaggttggaagatgcaggttatgccgttggggcacgggttctggagcttctttgccacagggaaaagggaaacagaagggagacaagactgctgggtattctgtcttttgtacacagcacggtgtggaaggtgttgtttggaaaggtggccgattcacttgagaaaggcactgaacatgaagatgaatacatgatcagtgagaaggaacttctggttaacagattcatatcaattcctaaagatatgggtactttcaattgcggagcttttgttgctggaattgtaaggggtgtcttggataatgcaggtttccctgctgtagtaacagctcattttgttcctgttgatgggcagcagcgaccacgaacaaccattttgataaaatttgctgaagaggtattgcgcagagaggcaagattaggttgaggattaactttctcgcccacaatgatattatattacaaaaaggatgaaggcatttgttggtttgagatacggagaacagtcacttgatttttggaactacattaatggatgtggctacttggatcatcccaggtttgccatcatccatggcatggcaaccataccgatcagcaagtactattgcagtcagttcagtgtaaaatgttgtcctatgataaaagtgcttttttggaaacttgtgtaatttatgagctttgaggaactttgtggagataatatagggatttgaagttgatgacattgaggttcaatacaaggttaatttt

SEQ ID NO: 2004 - DNA, 891 bp, Eutrema halophilum
cggaaaagcgtaattttcccagaaaacagaaaagactgtgtgtttagggttctgggtaagctgtaaaccgaagaagacgagggaagatgatcggagttgggaaaatgaagcagtactccaacgtccttgacaagcccctcagcaaaggcaaacaagaggtgagcttgaccgcatttgctttcttattctcggagctcgttcagtacaatcaaacacaggtcgacaatattgctgaacttgaaagaagattagaggatgctgggtatgcagttggagctcgagttctggagcttctttgcaaccgggagaagggcaaccgaagagagacacggttactcggaattctgtctttcgtccatagcaccgtgtggaaggtgttgtttggaaaggttgctgattcacttgaaaaaggaacagaacatgaagatgagtacatgatcagtgaaaaggaacttctcgtgaacaggttcatatcgattccaaaagacatgggaacattcaactgcggagcgtttgttgctggcatagtgaagggagttctggataacgcagggtttcctgctgtggttacggctcattttgtacccattgaagggcagcaacgtcctcggactaccattctgatcaagtttgctgatgaggtgcttaaaagagaagcacgactaagccaatgagaaagcacattttgtcacgagctgccacgatttgggaactattggctttttgtgaactgcttgtgcaattctgcatgtctgtctttttggataacttatatcaacattctgaattgtgcttgtgctgcaaagctcttgtccgtgcattgatgtaaactacatacagaccttcttcttacaattgcagctgataatacaacaaattcatagtttagca

SEQ ID NO: 2005 - DNA, 808 bp, Eutrema parvulum
cggaaaagcgtaattttccaagaaagcaaaaaaaagaaaagattttgtgtttagggttctgggtagtccgtccgcacctgaaaaccgaagaagatgatcggagtcgggaaaatgaagcagtactccaacgtccttgacaagcccctcagcaaaggcaaacaagaggtgagcttgaccgcatttgctttcttattctcggagctcgttcagtacaatcaaacccaggttgacaatattgctgagcttgaaagaagactagaggacgctgggtacgcagttggagctcgagttctggagcttctttgcaaccgagagaagggaaaccgaagagagacacggttactaggaattctgtcttttgtccacagcaccgtgtggaaggtgttatttggaaaggttgctgattcacttgaaaaaggaacagaacatgaagatgagtacatgatcagtgaaaaggagcttctcgtgaacaggtttatttcgattccaaaagacatgggaacattcaactgcggggcgtttgtggccggcatagtgaagggagttcttgataacgcagggtttcctgctgtagtaacagctcattttgtacccattgaaggacaacaacgtcctcggactaccattttgatcaagtttgctgatgaggtgcttaaaagagaggcacgactaagccaatgagagcacttcttgtcacgagttgggaactattggctttatgcgaactgcttgtgcaagtctgcatgtctgtttttggataacttatatagcattttgaattgagctgcagactcttgcccgtgcatta

SEQ ID NO: 2006 - DNA, 949 bp, Tripterygium wilfordii
gactgcgagtactctttctctaaatctgaagtgaactcagtcgaagctgatacggatccaaatcttctcttaagcaacgaaaagcagccaaacagatcgccactgcactcactcgggcccaatctgagattttcttggattggatccacaggtgttacgggtagacaagtagaaaagaaactatgatcggggtagggaagatcaagcaatactctaacgtgcttgacaaaccccttagcaagggcaaacaagaggtcagtttaagtgcttttgcattcttgttctcagagcttgttcagtacaatcagacacaggttgacaacatttctgagttagaacgaaggcttgaggatgctgggtatgctgttggtgctcgagttttggaacttctttgccatagggataaggggaacagaagagaaatgcgattgttgggtattttatcttttgtacacagtactgtatggaaggtgctatttggaaaggttgctgactcacttgaaaaaggcactgaacatgaggatgaatacatgatcagcgaaaaagagctcctcgtgaatcgattcatttcaattccaaaggacatgggtacatttaattgtggggcatttgttgctggaattgtaagaggtgttttggacagtgcaggttttccagcagtagttacagctcattttgtacctgttgaaggtcagcaacgaccacgaacaaccattttgataaagtttgccgaagaggttctagtaagagaagcaaggttaggttgatgattgtagcagggtattttcttgtcaacacactgcaacgtatttgcgaatggcaagtcttgaaccgggcagctgcaatcgtggatttttacgagtaaatcctgtcaatcatacttgtgggaatttgagctctctttgatttattttgatgtttgtgatttactgatagtgattattaaaaa

SEQ ID NO: 2007 - DNA, 700 bp, Vinca minor
gactgaagcgaatttacagtgccagcagctaacctaagtagtcttcgatcagacgatgataggagttgggaagatcaagcagtacagtaatgtcttagagaaaccattaagcaaaggcaaacaagaggtcagtttgagtgcatttgcattcttattttcggagatggttcagtacaatcagacccaagttgacaacattgctgaattggaaaggaggttggaggatgctggttatgctgttggggcacgggttcttgagcttctttgccacagggaaaagggaaacagaagggagacaagactgctgggtattttgtcttttgtacacagcacagtatggaaggtgttatttgggaaggtagctgactcactcgagaaaggcactgaacatgaagatgagtacatgatcagtgagaaggaacttctagtcaacagatttatatcaattcctaaagatatgggcactttcaattgcggagcttttgttgctggaattgtaaggggtgtcttggataatgcaggttttcctgcagtagtaacagctcattttgttcctgttgacgggcagcagcgacctcgaacaactattttaataaagtttgcggaagaggtgctgcgcagagaagcaagattaggttgaggtttatttttcaccacaaacttgtgttttcgacgtcattacaaaattggatgaaggcat

SEQ ID NO: 2008 - DNA, 670 bp, Juglans hindsii x Juglans regia
ggggtcgcacatcttggaagtccttgaatctgagaaaaaaatacagagagagaagaagctgaagagggacaaacgatgatcggagtagggaagatcaagcagtactccaacgttctcgacaagccccttgccaagggcaagcaagaggtgagtttgagtgcgtttgccttcttgttttcggagcttgtgcagtataatcagacacaggtggacaatatcgccgagttagaaagaaggctggaggatgcaggctatgctgtcggtgctcgagttttggaacttctttgccatagggataagggaaatagaagggaaacacgattgctgggcattctctcctttgtacacagtacagtgtggaaggtgttatttggaaaggtggctgactcgcttgagaaaggcaccgaacatgaagatgaatacatgatcagtgaaaaggagctccttgttaacagatttatttcgattccaaaagacatgggaacatttaattgtggggcgtttgtcgctggaatagtaaggggtgttttggacagtgctggttttccagctgttgtcacagctcattttgtgccaatggaaggtcagcagcgaccccggactaccattttgataaaatttgctgaagaggtactacgaagagaagcgaggttaggttaatgattgtgac

SEQ ID NO: 2009 - DNA, 854 bp, Zostera marina
agatcgaaaacgatttattgatcacggtttaattaccggaagaaagaagacgatgatcggagctggaaggacaaagcagtacgcgaatgtactcgataagccactcagcaagggaaggcaagaggttagtctcagtgccttttctttcttattctcggagatagtgcagtacaatcaaactcaagttgataacattgcagaactggagagaagactggaggatgcaggatatgcagttggtgccagggttcttgaacttctttgtcatcgagaaaagggaaatagaagagagacacgattgttaggtatcttatcctttgttcatagcacagtctggaaggtgctgtttggaaaggtagctgattctcttgaaaaaggtactgaacatgaagacgagtacatgatcagcgagaatgaactgcttgtgaacagatttatttctgtacccaaggacatgggagccttcaattgcggggcatttgttgctggaattgttaagggggttttggatggtgctggctttccagcagtagtgacggcccattttgtaccaatggaacaacaacagcgacctcggacaaccattcttataaagtttgctgaagaggttcttcgaagggaagcaaaactcggctaaagcttcggataatagaatttgctgtaaaactcataaaaaatagcttgcccatacctcttgaagttttgttgtcgctgattcatcaaatcatacatgtttgatttccatgtgttcaaccaaccaatcatgtatcaaaattattctgctgtgttataatcttgatttatttatatgtagcctttgaaatttgattccatgtttaaacttgcgttttaac

SEQ ID NO: 2010 - DNA, 830 bp, Taraxacum officinale
ggccgctcgattctctccgattagtaggtattatcgaggtcatttcttctttgcttcgctactgcgtacctattcaatttccctctatgatcttctactgcctggaaactcgagggaggatatcggcattaaaatcgttactctgactcggctactgagaggataacagagaagatgatcggagtagggaagattaagcagtacactaatgttctggataaaccccttagtaaaggcagacaagaggtgagtttaagtggatttgcttacttattttcagagcttgttcagtacaaccaaactcaggttgacaacattggggaactagaaaggagattggaagatgctggttatgctgttggagtacgagttttggaattactttgccatagggaaaagggtaacagaagagagacacggttgttgggcattttgtctttctacatagcacagtgtggaaggtgctatttggaaaagtagctgactcacttgagaaaggtactgaacatgaagatgaatatatgattagtgaaaaggagcttctagtcaatagatttatatcagtacccaaagacatggggtcttttaactgtggtgcttttgttgctggcatagtaaggggcgttttagacaatgcaggtttcccggctgttgtgacaactcattttgttcccgtggatggtcaacaacgccctcgcaccaccattttgatcaaatttgctgaggaggtactacgaagggaagcaaggttaggatgattgttgttataacttaaattgtgtggctttaaagaataaagacagattgtgagtttctatgtactactttga

SEQ ID NO: 2011 - DNA, 869 bp, Chrysanthemum coronarium
ctagtgatagtgataaaggagggggttggactttgagatatcgtggtcgtgaaaagatgatcggggcagggaagatgaagcaatactcgaatgttcttgataaaccccttagcaaaggcagacaagaggtgagtttgagtggatttgcttatttgttttcggagcttgttcagtataaccagactcaagtggataatattggtgaactcgagaggagattggaggatgctggctatgctgttggagtacgagttttggagttactttgccatagggaaaagggtaatagaagggagactcgtttgttgggcattttgtcgttcgttcatagtacagtatggaaggttctttttggaaaggtagctgactcgcttgaaaaaggcactgaacacgaagatgaatatatgattagcgaaaaggagctccttgtcaacagatttatttcggtaccaaaagacatgggctcatttaactgtggtgcctttgttgctgggatagtaaggggtgttttggacaatgcagggttccctgctgttgtgacggctcattttgttccggtggatggtcaacaacgtccccgaacaaccattttgattaaatttgctgaggaggtacttcgaagagaagcaagaataggataattttgtcaagtgttttttggctttgtattgtggccatggactgattgggtacgtatatactttgaagaatcaaaattgaaaaacatatgtgtttgtcaaaaacttgtagcagtaagaactatgtttttatggattttttagggtgacaacatcatttcagtgtgatttagtatttatctctatatcagtgaccaatttctttttagttatcgtagtgatatatggtcg

SEQ ID NO: 2012 - DNA, 719 bp, Chrysanthemum coronarium
gttttgggatcgttaaagtcgttcgtcactctttctcaactagccatttataagaccatttgaataaaagatgatcggggcaggtaagatgaagcaatactcaaatgttgttgataaacccctcagcaaaggcagacaagaggtgagtttgagtggatttgcttttttgttttcggagcttgttcagtataaccagacgcaggttgataatattggtgaactagagaggagattggaggatgctggctatgctgttggagtacgagttttggagttactttgccatagggaaaagggtaacagaagggagactcgcttgttgggcattttgtcgttcgttcatagtacagtatggaaggttctttttggaaaggtagctgactcgcttgaaaaaggcactgaacatgaagatgaatatatgattagtgaaaaggagctcctagtcaatagatttatttccgtaccaaaagatatgggttcattcaactgtggtgcctttgttgcggggatagtaaggggtgttttggacaatgcaggattccctgctgttgtgacggcccattttgttccagttgatggtcaacaacgtcctcgaacaaccattttgattaaatttgctgaggaggtacttcgaagagaagcaagaataggataattttgtcaagtgttttttggctttgtattgtggccatggactgattgggtacgtatatactttg

SEQ ID NO: 2013 - DNA, 1013 bp, Chrysanthemum coronarium
gtgtagtatgacaaaggggttggactttgagggaagccacagaacaccgttaaagtcgttagttagtaaagtacccaaaccgataacataatgataggagcagggaagatgaagcaatactcaaatgttgttgataaaccccttagcaaaggcagacaagaggtgagtttgagtgggttcgcttatttgttttcggagcttgttcagtacaaccagacccaggttgataacattggtgaactcgaaaggagattggaggatgctggctatgctgttggagtacgagttttggagttactttgtcatagggagaagggtaacagaagagagactcgtttgttgggcattttgtcgttcgttcatagtacagtatggaaggttctttttggaaaggttgctgactcgcttgagaaaggcactgaacacgaagatgaatatatgattagtgaaaaggagctcctagtcaatagatttatttccgtaccaaaagacatgggttcattcaactgtggtgcctttgttgcggggatagtgaggggtgttttggacaatgcaggattccctgctgttgtgacggctcattttgttccggtggatggacaacaacgtcctcgaacaaccattttgattaaatttgcggaggaggtactgcgaagagaagcaagattaggataattttgtcaaagtgttttctgcctttgtattttggccatggactgattgcggtacgtatatactttgaagaatcaaaaaggaaaacgtatgagtttattaaaaaatttgtagcagcaagaactatgcttttatggaatttttagggtgataacatcatttcagtgtgttttagtacttatctctatatccatgaccagattcttttttagttggaattatctacatgtcaaatgtaatcgtagggatatggagttgctgtatgtcgataacctattttccaatttaaccaggccatatgaggccgtttgtagtagtgacatgactactataaaacccag

SEQ ID NO: 2014 - DNA, 943 bp, Amsonia hubrichtii
tgactgaagcaaattacagtggcagcagcaaacctaagtgccccacgatcggaagatgataggagttgggaagatcaagcagtacagtaatgtcttagagagacctctaagcaaagggaaacaagaggtcagtttgagtgcatttgcattcttattttcggagctggttcagtacaatcagacccaagttgacaacattgctgaattggaaaggaggttggaagatgctggttatgctgttggggcacgggttctggagcttctttgccacagggaaaagggaaacagaagggagacaagactgctgggtattttgtcttttgtacacagcacagtgtggaaggtgttgtttggaaaggtagctgattcacttgagaaaggcactgaacatgaagatgaatacatgatcagtgaaaaggaacttctggtcaacagatttatatcaattcctaaagatatgggtactttcaattgcggagcttttgttgctggaattgtaaggggtgtcttggataatgcaggtttccctgctgtagtaacagctcattttgttcctgttgacgggcagctgcgacctcgaacaaccattttgataaaatttgccgaagaggtactgcgaagagaagcaagattgggttgagatttatttctcactacacctgtagtgtttacaatcacattgcaatacgatgaagaaatttgttcattaaaatactgagaagagtcgcgttgtgatttctggaactgcagcaatgtgtgtgtctatttggatcatcctagatttgccatcattcatggcctggtaaccatactgatcagcagttactgttgcagaagtttagggtaaaatgttgtcatatgataaggtaatttggtcgaaatttatgagctttgaggaacatattgagatacagggagttgaagctgagattgaattcaatat

SEQ ID NO: 2015 - DNA, 841 bp, Arabidopsis thaliana
tcttcagattctttcaccggaaaactaagaaaggttctgtgtttagggttctggttctgggaagctcgttctcaccggaaaaccgaagaatatgatcggagtcgggaaaatgaaacagtactccaacgtccttgacaagcctctcagcaaaggcaagcaagaggtgagcttgaccgcatttgctttcttattctcggagctcgttcagtacaatcaaacccaggttgacaatatagctgaacttgaaagaagactagaggatgctgggtatgcagttggatctcgagttctagagcttctttgcaaccgggaaaagggaaacagaagagagacacggttactgggaattctgtctttcgttcacagtactgtgtggaaagtgttgtttggaaaggttgctgattcacttgaaaaaggaacagaacatgaagatgagtacatgatcagtgaaaaggagcttcttgttaacaggttcatttcgattccaaaagacatgggaacattcaactgcggagcgtttgttgctggcatagtgaagggagttctggataacgcagggtttcctgctgtggtaacggctcattttgtacccattgaaggacaacaacgtcctcgaactactattttgatcaagtttgctgatgaggtgcttaagagagaggcacggctaagccaatgagagtactatggtcacgagtttccacgatctggaaactattggctttatgtgaactgcttgtgcaaatctgctatctgtttttggatgactatataacattttgaattgagctgcaaagccattgacccgtgcattgatgtaaacaacatacatatcctcttg

SEQ ID NO: 2016 - DNA, 822 bp, Artemisia annua
gggaagccagaaaacaaaacgccgttaaagtcgttagtaaactacccaaaaaaatgataggagcagggaagatgaagcaatactcaaatgttcttgataaaccccttagcaaaggcagacaagaggtgagtttcagtgggtttgcttatttgttttcggagcttgtccagtacaaccagactcaggttgataacattggtgaactcgaaaggagattggaggatgctggctatgctgttggagtacgagttttggagttactttgccatagggaaaagggtaacagaagggagactcgtttgttgggcattttgtctttcgttcatagtacagtatggaaggttctttttggaaaggtagctgactcgcttgagaaaggcactgaacacgaagatgaatatatgattagtgaaaaggagctcctagtcaatagatttatttccgtaccaaaagacatgggttcattcaactgtggtgcctttgttgcagggatagtaaggggtgttttggacaatgcaggattccctgctgttgtgacggctcattttgttccggtggatggtcaacaacgtcctcgaacaaccattttgattaaatttgctgaggaggtactgcgaagagaagcaagattaggataattttgtcaatgttttctgcctctgtattttggccatggactgattgtggtacgtatatactttgaagaatcaaaaaggaaaacgtataagtttatttaaagatttgtagcagcaagaactatgcttttatggaacttttagggtggtaacatcatttcagtgtgttttagtacttatctctata

SEQ ID NO: 2017 - DNA, 623 bp, Musa acuminata
aatcgagggaacgcgaaggggggaatagaggtgaggggagggaagaagccatgatcggtgtgggaaagatcaagcagtacaccaacgttctcgacaaacccctcagtagaggccggcaagaggtcagcttgagtgcattcgcatttttgttctcggaactggtgcaatacaaccagactcaagttgataatattgcagagttggagagaaggcttgaagatgctggctatgctgttggagcaagagttcttgagcttctttgtcatagagagaagggtaacagaagggagacacgtctgcttggaattttatcttttgtgcatagtactgtttggaaggtgctatttggaaaggtggcggactcacttgagaaaggaactgaacacgaagatgagtacatgataagtgaaaaagagcttttggttaaccgatttatatcagtaccaaaggacatgggagcattcaattgtggggcatttgttgctggaatcgtgaagggtgtcctagatggtgctggttttcctgctgttgtgacggcacactttgttccagtggatggtcaacaacgaccacgcactacaattttaataaagtttgcggaagaggtcagtaatacattattc

SEQ ID NO: 2018 - DNA, 1028 bp, Phaseolus vulgaris
gtgagggcagatgaaaaagaaaattgattgtaataagtgatgtttttctctaaaattttaaaatgttgaatataggacatagcgagaatgaccaaatcggcaaatctgtgttaacctaagcagagaagcaagaagaagatgatcggcgtcggaaaggtcaagcagtacggtaacgtcctcgacaagcccctcaacaagggcaagcaagaggttagtttgagtgcattcgcgttcttgttttcggagcttgttcagtacaaccaaacgcaggtcgataatattggggaactcgaacgaagactggaggatgctggatatgcggttggggcacgagttcttgagctgctttgccacagagataagggaaacagaagggaaacacggctgttgggtattctttcttttgtacacagtacagtgtggaaagtattatttggaaaggtagctgattcactggagaaaggaaccgaacatgaagatgaatacatgattagtgaaaaagagcttctagtaaacaaattcatttctatcccaaaggacatggggacgtttaactgtggagcatttgttgctggaatagtacggggcgttttggacggtgccggatttccagctgttgtaactgcgcattttgtgcccatggaaggtcaacagcgaccacggacgacaattttgataaagtttgctgaagaggtgttacaaagagaagcaagattaggctgatatttataccaagaatttttaattatgatatctgtaatgctgtacaccactgtagaaagatgtggaacttacaccactgcatgtgaagagtaatttaggattttcactaccctattaatttaccgtttgaactcgtgttttttattctgatgttatggtcggaattatccttaccgaattgcattgtacaaaaaatctcgtgttcgtgttgatgctattattttcaatttctctctcaccccttgtaataactgagcgtaaaaccaacgaaatgaaagcttgatttgctgccaagccgtggatca

SEQ ID NO: 2019 - DNA, 809 bp, Catharanthus roseus
ggtgactccagcaaattacggtgaagctgtaacctgaagtgctcgaccatcggacgatgataggagttgggaagatcaagcagtacagtaatgttttagagagaccactgagcaaaggcaaacaagaggtaagtttgagtgcatttgcattcttattttcagagctggttcagtacaaccagacccaggttgacaacattgccgaattagaaaggaggttggaagatgctggttatgctgttggaacacgggttctggagcttctttgccacagagaaaagggaaacagacgggagacaagacttctgggtattttgtcttttgtacatagcacagtatggaaagtgttgtttgggaaggtagctgactcacttgagaaaggcactgaacatgaagatgagtacatgatcagtgagaaggaacttcttgtcaacagatttatatcaattcctaaagatatgggcactttcaactgcggagcttttgttgctggaattgtaaggggtgtcttggataatgcaggtttccctgctgtagtaacagctcattttgttcctgttgatgggcagcagcgacctcgaacgaccattttgatcaaatttgctgaggaggtactgcgcagagaagcgagattaggttgaagtttatttttcattacatatgtttctaaatcattttatgaataggatgaaggcaattgttggttggaaataccaagaacaggcacactgtgatttctggaactgcatcgatggatgtagcaatcatcccagatttgctgtcatctattgcatggttacaaactatac

SEQ ID NO: 2020 - DNA, 1250 bp, Cicer arietinum
aacaaatttaggtatggtactagcgcgatcgagctcaattttttaaattattatattttaaaaaaaataaaaactttcctttcagaatccctaatcccttctctgcatctcgcacaagttgctctttccgatcacactatcctccgtccggccgctccttttcgctgccataacagtttcgaatccgatcaccgagaagcatcatataaggagcaagaggatgattggagtcggaaagatcaagcagtacggtaacgtcctcgataaaccccttgccaagggcaaacaagaggttagtttgagtgcatttgcattcttattctccgagcttgttcagtacaaccaaacgcaggttgacaatattggcgagctcgaacgaagactggaggatgctggatatgcagttggggctcgtgttcttgagctgctttgccacagagataagggaaacagaagggagacacggttgctgggtattctttcttttgtacacagtacagtgtggaaagtactatttggaaaggtagctgactcactggagaaaggaactgaacacgaagatgaatacatgatcagtgaaaaggaactccttgtaaacaaattcatttctatcccaaaggacatgggaacgtttaactgcggcgcatttgttgctggaatagttcggggtgttttggatggtgccggctttccagctgttgtaacagctcattttgtgcccatggaagggcaacaacggcctcggacaacaattttgataaaatttgcagaagaggtgttacgtagagaagcaagattaggctgatgtttataccgagttgtcaataagatatttgtaatgctgaacaccaatatgaaaagtattttaagattctgaccaacctgtccttttgatatgtgcttcaaactcgtttctgattctatcgtatgttatgctttgaagtcgagaattgttcttactcaggaattatatataatgtacaaaaaatcttttgttgtttaatttcaatatctcatcctgcatattgattgaggataactcagggatgtagtaaagtttgatttattagcaaactacgaaatatttatgtagtttgttgaatgtacattggtctcaagaaattctataagcaacctacttttagattatttcagtgttaaaccaaacataagctggctacgaagtaaagaatctgatacaagttctttattggcgagaggaaataatatacttccaaattatatacttc

SEQ ID NO: 2021 - DNA, 1156 bp, Gossypium hirsutum
cggaaaacaaaattttatttttccagtaggaaaatgatcggaaccgggaagattaagcagtatgccaacgtcctcgacaagcccctcggcaagggaaaacaagaggttagcttaagtgcgtttgctttcttgttttcggagcttgttcagtacaatcaaacacaggttgataacatttctgaattagaaacaaggctggaggatgcgggttacgcggttggggctcgagttctggaacttttatgtcatagggataagggaaatagaagagagacccgattgttgggtattttatcttttgtgcacagcactgtgtggaaggtgttatttggaaaggtggctgactcacttgagaagggcactgaacatgaagatgagtacatgattagtgagaaggaactcctagtgaacaggtttatttcaattccaaaagacatggggacatttcattgtggggcatttgttgccgggatagtgaaaggtgttttggagaatgcaggatttccggcagttgtaacagctcattttgttcctgtagagggtcagcaaagacctcgaacaactattttgataaagtttgctgaagaggtattgcggagagaagcaaggttaggttgattcgtatgcccaggttatcttgagttggccaatgtccatgttgtgcaacagtggcaaggaagcagtgaatttcagctggttcattgatctaatgaatatttcatctgccaatcacactggcaagtctgaatttcctttcttcgattaatgcttgttgtgtattattctttgtggcacagtgtttactggtatggtatcaaggattactgcaacaagtgcagttgatgtaaagtaacatgtcatcattactgtttaagtttcgtgttaatgtgacttcaaatgggttattaccaatgagaaacattagaatttggagtttggactccaaatctgttagatgtcaccttttgaggtaattacatgaactaattacattcaagtctttagttcatcatcattgtgtttgtgtacctttctgagatgtgccagcataagaaatctaatgtgtcagttgaattttctagggtagtaaagaaaattccaactgcacagcagaaatatatatgtaatctcggagagggtcctttaactaatagag

SEQ ID NO: 2022 - DNA, 1158 bp, Linum usitatissimum
ccacgcgtccgcggacgcgtgggaaacaacccctacatttctcaacagtttccgttttctctttgtcagctgccgaacagactccataactacatgagaaaattcgttcagtgattcgatctccgtctcctctaaattggaggataaatccgtggctattcctcataattgaagaagaaagatgataggagcaagcaagatcaagcaatactccaatgtcctcgacaaacccctaagcaagggcaagcaagaggttagtctgagtgcttttgcgtttttgttttcggagctcgttcagtacaaccaaacacaggttgacaatattgctgagttagaacgaaggttggaggatgcaggctacgctgttggagctcgagttcttgaacttctttgtcatagagaaaagggaaatagacgtgaaacacgacttctgggtatcttgtctttcgtacacagcacagtgtggaaggttttatttgggaaagtggctgattccttggagaagggaaccgaacatgaggatgaatacatgatcagtgagaaagagctccttgtcaacagattcatttccattccgaaagacatgggaacttttaactgtggcgcttttgttgctggaattgtgaggggtgtgttggatggtgcgggttttcctgcagttgtaacagcgcatttcgttcctatggaaggccagcaacgacctaggaccaccattctgataaaatttgcagaagaggtactaagaagagaagcaagattagtatgacaatacactaggaatgccgtcgtggggaatgtcgatggtgtatctttctttggcgttgtgcagtctgtatgctgcaagaacatttgcaagaaacttgacgaagctgggaattcttgctcggttggtcggatcttggcttgtttggtttatcagtggattttgttagagtgattattgattaccaactaaatttcatgtaaagtaagagggagggttctttagagctccagaattagattgttaaaacttggttacagagcaaagagactcgattatcagcctggggttttgcatggacgcaaaaattgtggtttctcccctcttccttcttggcggcggtggtgttagtacaggtcagaccaaaataccgatacagaagggtgaattagcgc

SEQ ID NO: 2023 - DNA, 1027 bp, Fraxinus spp
gacacaccggaatctacaaaattacacgtactggtaatcaaaactgtaaattgatcgagcaaatgataggagttgggaaaatgaagcagtacactaatgttctcgatcgacccctcagcaaaggcaaacaagaggttagtctgagtgggtttgcgttcttgttctcggagctcgttcagtataatcagactcaggtagacaacatagcagaattggaaagaaggttagaggatgcaggctatgctgttgggacccggattctggaacttctttgtcatagggaaaagggtaacagaagggagacacgactcttgggaattttgtcctttgtgcatagcacagtatggaaggtcttgtttggaaaggtagcagattcacttgaaaaaggaactgagcacgaagatgagtacatgatcagtgagaaagaactcctagtcaacagatttatttcaatacctaaagatatgggtgcattcaactgcggagcatttgttgctggaatagtgaggggagtcctggataatgcaggttttccagctgtggtaagtgcacattttgtacctatggaagggcagcaacgacctagaacaaccattttgataaaatttgctgaagaggtactacaaagagaagcaagactaggttgatacctgctctgatttttccccatgtccaatttgcttaatctgcaatcacaaggttcctgaatgagagaattttcgtgaaacaaataggatgttttcatgtaatacctaggtagcaatttgcgttttgtccaaaggcttgataatactttgtacttgaactgctggtcgagaattatattttcaatacattgaaaatgttgtaacgtgagatggtggtgactggtggaaaattatattattttgtgagctactaggggatttacatggcacattagatgttaaacttgacctatctacattcaatgcaggaattctatatattattgaacttgtttctatcttttcgtgttgattacatagtctgttaactattgttgtag

SEQ ID NO: 2024 - DNA, 1307 bp, Gossypium raimondii
agaaaggaaaatcaattagaccgacggttcaaatctgctttgcaacggtgaagttcacgcattcttgctcggtgttcgcatacctcatagctgattcaaaattttttccatttttcctgtaattttcttagcagccaaacggaaaacaaaattttatttttcaagtaggaaaatgatcggaaccgggaagattaagcagtatgccaacgtcctcgacaagcccctcggcaagggaaaacaagaggttagcttaagtgcgtttgctttcttgttttcggagcttgttcagtacaatcaaacacaggttgataacatttctgaattagaaacaaggctggaggatgcgggttacgcggttggggctcgagttctggaacttttatgtcatagggataagggaaatagaagagagacccgattgttgggtattttatcttttgtgcacagcactgtgtggaaggtgttatttggaaaggtggctgactcacttgagaagggcactgaacatgaagatgagtacatgattagtgagaaggaactcctagtgaacaggtttatttcaattccaaaagacatggggacatttcattgtggggcatttgttgccgggatagtgaaaggtgttttggagaatgcaggatttccggcagttgtaacagctcattttgttcctgtagagggtcagcaaagacctcgaacaactattttgataaagtttgctgaagaggtattgcggagagaagcaaggttaggttgattcgtatgcccaggttatcttgagttggccaatgtccatgttgtgcaacagtggcaaggaagcagtgaatttcagctggttcattgatctaatgaatatttcacctgccaatcacactggcaagtctgaatttcctttcttcgattaatgcttgttgtgtattattctttgtggcacagtgtttactggtatggtatcaaggattactgcaacaagtgcagttgatgtaaagtaacatgtcatcattactgtttaagtttcgtgttaatgtgacttcaaatgggttattaccaatgagaaacattagaatttggagtttggactccaaatctgttagatgtcaccttttgaggtaattgcatgaactaattacatttaagtctttagttcatcatcattgtgtttgtgtacctttctgagatgtgccagcataaagaaatctaatgtgtcagttgaattttctagggtagtaaagaaaattccaactgcacagcagaaatatatatgtagtctcggagagggtcctttaactaatagaggtgaaattgag

SEQ ID NO: 2025 - DNA, 1056 bp, Mesembryanthemum crystallinum
ctcacctagccttgacccgcgccccgtttcgatcgacggaaattccagtttctgggaggagagagaaaatacattacaatgatcggagttgggaagatcaaacaatactctaatgttctcgaaaaaccccttagcaggggcaaacaagaggtgagcttaagtgcctttgcgttcttattctcagagctcgttcagtataatcagacccaagttgataatattgctgaattagaaagaaggttagaggatgctgggtatgctgttggggcaagagttctggaacttctttgccacagagataagggaaaccgaagggagacacgtctgttgggtattctgtcatttgtacacagcacactgtggaaggtgttgtttgggaaggtggctgactcactagagaaaggcactgaacatgaagatgaatatatgatcagtgagaaagagctcctagtgaataggtttatatctataccaaaagatatgggaacattcaactgtggggcatttgttgctggtatagtgaggggtgtcttggacagtgcaggttttccagctgttgtaactgctcattttgtgccagtggaagggcagttgagaccaaggactaccatcttgataaagtttgctgaagaggtactaaaaagggaagcaagattaggttgatagctgtcagagagtacttagtcatcaaatttgttactacagaagactactctgtagcaacatgttgattggcagttgaagtagcctgttctggtgaatcgttttatacgcaagttctacttgcaagttctgcttgcgttctgtatttcaaggggtctgcatatcctatgtgatgcaagtctaactttacatgtaaaatcatgatatttcattttaacagtgtaatattcttgtattctgcaacttaagaaccaagacctagggcaagcctgttttggacctgataacagatttcagagcgatttatttgctcctgttcttccagacagctgattagcgttacatcagcctcactggtaacctcacctgagtaacataagcgccgcctttttg

SEQ ID NO: 2026 - DNA, 1015 bp, Nicotiana benthamiana
aacgaaatctgagtacctaaagaagagtaaacacagtagatacagagctgaccgatctgggaagaaccgaaagaagaaaatgatcggagtagggaagatgaaacagtacacaaatgtcttagaaagacccctcagtaagggcaaacaagaggtcagtttgagtggttttgcgttcttgttttccgagcttgttcagtacaatcagacccaagtggacaacattactgaattagagcgaaggttagaggatgctggatatgctgttggagcacggattttggaactcctctgccatagggaaaagggtaacagaagggagacaagattattgggcatactctcgtttgtgcacagcacagtatggaaggttttgtttgggaaggttgctgactcacttgagaaaggcactgaacatgaagatgaatacatgattagtgagaaggagctccttgtcaacagattcatttcaataccaaaagatatgggtgcattcaactgcggagcttttgttgcgggtattgtaaggggagttctggaaaatgcaggtttcccagcggtagtgacagctcatttcgtccctgtggaggggcagcagcgaccgcggacaacaatcttgattaaatttgctgaagaggtactaagaagggaagcgggactaggttgatgtttatttgtcatcatatttggtgcaaatttctcgaacgacattatgatgagatgacaaatgaaaattctcatttctatcctatgaagaatgctagttgtgccattattgctatagtagatttgtttaacacattctgaggttcaccaatttttttttttgggtgtaaaatattgcaattcgactgtgatttcgtgaaattacatgctattgaccagctgttggtggaaagttatttggcctacgttcgagttggagaagtcattgtcgttttagctttgtaaatattttatgttgtctggaaaattttgttttgctacattatcacctactataactttaaaacaagta

SEQ ID NO: 2027 - DNA, 965 bp, Cajanus cajan
aattttaaatcttgaatacatagcctaacaaaaatgaaagggtacccaaatctccgctaacctaagaaacagaagcaggaagaggatgatcggcgtcggaaagattaagcagtacggtaacgtcctcgacaagcccctcaccaagggcaagcaagaggttagtttgagtgcattcgcgttcttgttctcggagcttgttcagtacaaccaaacgcaggtcgacaacattggcgagctcgaacgaagactggaggatgctggatacgcagttggggcgcgggttcttgagctgctttgccacagagataagggaaacagaagggagacacggctgttgggtattctttcttttgtacacagtacagtgtggaaagtattatttggaaaggtagccgattcactggagaaaggaactgaacatgaagatgaatacatgattagtgaaaaggagctcctagtaaacaaattcatttctatcccaaaggacatgggaacgtttaactgtggagcatttgttgctggaatagtacggggcgttttggatggtgctgggtttcctgctgttgtaacagctcattttgtgcccatggaaggtcaacaacgaccacggacaacaattttgataaaatttgctgaagaggtgttacgaagagaagcaagattaggctgatgtttataccaagaattttcaattaagatatttgtaatgctgtacaccaatatagaaagatgtggaacttacacctctgcatgtgaaaaagtaacttaggattttcaccagcctaccctattgatttgtcctttgaactcgggcttttaattctaatgtatgttatgctttggagtcggggaattatccttactgaattacgttgtacaaaaaatctcgtgttgttgctattaatttcaatttctccacatccttaatataattgatggaataaaaatctcctatggaatctacg

SEQ ID NO: 2028 - DNA, 1157 bp, Chenopodium quinoa
aaataaaagacttgtttaatccctcctattttaatcgtattccctacaccccccaaaattacttctcactcaataccatcatcaaatcacctccccaaaatttcattaacgatattttcagattatttgacatttcctcaaacaaaggtggaagagagagaaattgtcttgtgaagaaagagagcagaaacaatgatcggagtagggaagatcaagcaatactcaaatgttctcgacaaacccttaagcaaaggaaaacaagaggttagcttaagtgctttcgccttcttgttttcggagcttgtacagtataatcagactcaggttgataatattgccgaactcgaacgaaggctagaagatgcaggctattctgtgggagcacgagttcttgaacttctttgccatagggataagggtaacagaagggagacacgcttgcttggtattttatcttttgtacacagcactgtttggaaggtgctgtttggaaaggttgctgattcactcgaaaagggtactgaacatgaagatgaatatatgatcagtgagaaagagctccttgtgaacaggtttatatcaatacctaaagatatgggaactttcaactgtggtgcatttgttgctggaatagtgaggggtgtcttggatagtgcaggttttccagctgttgtaactgctcattttgttccagtggaggggcagttgcggccaaggacgaccatattgattaagtttgctgaagaggtgcttagaagggaagcaagattaggttgatctctgttgacattacaggttgaggggcagttgaaatatcctgtccagttgatccatcttctctaaaagtcgcaagcttagttggcttcgtagtgtttcaaaggaggtttaaattctttccattgcagtcctgatgtttaaacagaagcatattttgtgttttttaactacataaagtgcaatttgtttttcatggaagacctcatatgtaggcagtttatggattgtcacttgtcagagtagctgctatttttgagaagctatttaaggtatgatacatttggcaaaacttgtctgtaatttatgacgtagcagaaatttgattattatgtcaaacagaatatattttgacaatagggctatatggagagaggaatgaa

SEQ ID NO: 2029 - DNA, 1160 bp, Chenopodium quinoa
aaaagacttgtttaatccctcctattttaatcgtattccctacaccccccaaaattacttctcactcaataccatcatcaaatcacctccccaaaatttcattaaagatcttttcagattatttgacatttcctcaaacaaaggtggaagagagagaaattgtgttgtgaagaaagagagcagaaacaatgatcggagtagggaagatcaagcaatactcaaatgttctcgacaaacccttaagcaaaggaaaacaagaggttagcttaagtgctttcgccttcttgttttcggagcttgtacagtataatcagactcaggttgataatattgccgaactcgaacgaaggctagaagatgcaggctattctgtgggagcacgagttcttgaacttctttgccatagggataagggtaacagaagggagacacgcttgcttggtattctatcttttgtacacagcactgtttggaaggtgctgtttggaaaggttgctgattcactcgaaaagggcactgaacatgaagatgaatatatgatcagtgagaaagagctccttgtgaacaggtttatatcaataccaaaagatatgggaactttcaactgtggtgcatttgttgctggaatagtgaggggtgtcttggatagtgcaggttttccagctgttgtaactgctcattttgttccagtggaggggcagttgcggccaaggacgaccatattgattaagtttgctgaagaggtgcttagaagggaagctagattaggttgatctctgttgacattacaggttgaggggcagttgaaatatcctgtccagttgatccatcttctctgaaagtcgcaagcttagttggcttcgtagtgtttcaaggaggtttaaattctttccattgcagtcctgatgtttaaacagaagcatattttgttattttttttaactacatcaagtgcaatttgtttttcatggaagacctcatatagtcatatgtaggcagtttatggattgtcacttgtcagagtagctgctattttgagaagctatttaaggtacgatacatttggcaaaacttgtctgtaatttacaacgtagcagaaatttgattattatgtcaaacagaatatattattatattttgacaacagggctatatggagg

SEQ ID NO: 2030 - DNA, 2070 bp, Chenopodium quinoa
gccacacacaaggccagcaagggtgccaaaaaactcaaggaagggcaacaaacaaccacccaagaattaaaaaaaaactaaactgtaaaagccaaccaaatttaataaaatcaaactttaattaacaaagcaaagtagaacgatagaacctttgatctaacaaatttacttttcactcaataccatcatcaaatcacctcccaaaatttcattaacgatcttttcagattatttgacatttcctcaaacaaaggtggaagagagagaaattgtgttgtgaagaaagagagcagaaacaatgatcggagtagggaagatcaagcaatactcaaatgttctcgacaaacccttaagcaagggaaaacaagaggttagcttaagtgcttttgcgttcttgttttcggagcttgtacaatataatcagactcaggttgataatattgccgaactcgaacgaaggctagaagatgctggctattctgttggagcacgagttcttgaacttctttgccatagggataagggtaacagaagggagacacgcttgcttggtattctatcttttgtacacagcactgtgtggaaggtgttgtttggaaaggttgctgattcacttgaaaagggcactgaacatgaagatgaatatatgatcagtgagaaagagctccttgtgaacaggtttatatcaataccaaaagatatgggaactttcaactgtggtgcatttgttgctggaatagtgcggggtgtcttggatagtgcaggttttccagctgttgtgactgctcattttgttccagtggaggggcagttgcggccaaggacgaccatattgataaagtttgctgaagaggtgcttagaagggaagcaagattaggttgatttctgttaaggttacaggttaaggggcaggtgaagtatcctgtccagttgatccatcttctctataagtcgcatgcgtagttggcttcctagtgtttcaaggaggtttacattcttttcattgcactcctgatgtttaagcagaagcatatttagttttcttactacatctagtgcaatatgtttttcatggaagacctcatctgtaggcagattaatggattgtcatttgtcagagtagcttctgtttttgagaagctatttaagggatgatacatttggcaaaagttgactgtaatttacgacgtaacagaaatttggttattatgtcaaatagaacatatttgacaacagggctatatggagagaagaatgaagtgttgtgcatctttaaatggaaagtgagggaggctttgttgctcatctttattttgcagtacatattgcttaggaacaattccagatggaaattggttcatctggttcaagtttgtatcgtatttggtcaaatcagatatattgtcgagtagtttagtctttttgatttttggatggggttaattttatcttgctgggatcatttaagccaggttatttagggctcagaaaatcaactcaattaaacacaagaatacgcaaattcaagaaaacaaatcgtattcattcactagcaaatatcaggtaaactgcgtataatttgagagacaagtagctaagttaatcactaatttgcattatcgtattgtatcaaacttccagagaagaataaacaaaataataacaaatgtacaagactaactgttattttacaatagttaatattaacttaacacaatactatcttatttcttgcttcgagtagtaggacaagtaggtgacaccgtaggcctacacgtaaacgttactactcgtgtacttacgtaactaacgtttaacggtaaaaccaaacctaagtagttacgaactaacgttacgtacgtaggacggtactacgacgtcgtaacggtacacggtacaacgacgtacgtacgtctacgtactaacggttaccgtaaacggtaacttaaaacgttaaaacctaaacgttactaacttctaagttacttattaccgtactaacttattaaccttattccgttcttaccgtagtcggtacggtcgggtacggacgtacgacggtacggagg

SEQ ID NO: 2031 - DNA, 861 bp, Carthamus tinctorius
attttgatgattgtgccttggttccatcaactactttctgtttggggaatagatcagagtaaaactagggcttggacttgagggaagctaaggaagcaaatcgccattgacagaagataacggagaagatgaccggagcagggaagatgaagcagtacacaaatgttctcgataaaccccttagtaaaggcagacaggaggtcagtttaagtggatttgcttacttattctcagagcttgttcagtataaccaaactcaggttgacaacattggtgaactagaaaggagattggaggatgctggatatgctgttggagtacgagttctggaattactttgccatagggagaagggtaacagaagggagacacggttgttgggcattctgtctttcgtgcatagtacagtatggaaggtgctatttggaaaggtagctgactcgcttgagaagggcactgaacacgaagatgaatatatgatcagtgaaaaggagctcctagttaatagatttatttctgtaccgaaagacatggggtcgttcaactgtggtgcttttgttgctgggatagtaaggggcgttttagacaatgcaggattcccagctgttgtgactgctcatttcgttccggtggacggtcaacaacgccctcgaacaaccattttgataaaatttgctgaggaggtgctacgaagagaagcaaggttagggtgatttttgtttgttttttggacatggatgctacgtatatactttgaataatgacgtgtcagatgttgattggacaaaaaaaagagaaagactaatgatttgtatttgagatggtattaatgactaggattctttttagttggaaatcaaa

SEQ ID NO: 2032 - DNA, 957 bp, Glycine max
ggtacctgaatatagcataggaaaaatgatcgggtagccaaatcaccgttaacctaagaaagagaagtagtagcagtagcagtaggaagaggatgatcggcgtcggaaagatcaagcagtacagtaacgtcctcgacaagcccctcaccaagggcaagcaagaggttagtttgagcgcattcgcgttcttgttctcggagcttgttcagtacaaccaaacgcaggtcgacaatattggcgagcttgaacgaagactggaggatgctggatatgcggttggggctcgagttcttgagctgctttgccacagagataagggaaacagaagggagacacggctgttgggtattctttcttttgtacacagtacagtatggaaagtattatttggaaaggttgctgattcactggagaaaggaactgaacatgaagatgaatacatgatcagtgaaaaggagctcctcgtaaacaaattcatttctatcccaaaggacatgggaacgtttaactgtggagcatttgttgctggaatagtacggggcgttttggatggtgctgggtttccagctgttgtaacagctcattttgtgcccatggaaggtcaacaacgaccgcggacaacaattttgataaaatttgctgaagaggtgttacaaagagaagcaagattaggctgatgtttataccaagaattttcaattaagatatttgtaatgctctacaccaatatagaaagaagtggaacttacacctatgcatgtgaaaaagtaatttaggattttcaccagcctaccctattgatttgtcctttgaacatgtcatgcttttcattctaatgtatgttatgctttggagttggggagttattctttctgatttacattgtacaaaaaatctcgtgttgttaatttccatttctctctcactcctaatataattgagcattaaactgaggaa

SEQ ID NO: 2033 - DNA, 973 bp, Nicotiana tabacum
ggaccactacacacactagatacagagcgatctgggaagaaccgaaggaagaaaatgataggagtagggaagatcaagcagtacacaaatgtcttagaaagacccctcagtaagggcaaacaagaggtcagtttgagtggttttgctttcttgttttcggagcttgttcagtacaatcagacccaagtagacaacattactgaattagagcgaaggttagaggatgctggctttgctgttggagcacggattttggaactcctctgccatagagaaaagggaaacagaagggagacacgactactgggtatactctcgtttgtgcacagcacagtatggaaggttttgtttgggaaggttgctgactcacttgagaaaggcactgaacatgaagatgaatatatgattagtgagaaggagctccttgtcaacagattcatttcaattccaaaagatatgggtgcattcaactgcggagcttttgttgcgggtattgtaaggggagttctggaaaatgcaggtttcccagctgttgtgacagctcatttcgtccctgtggaggggcagcagcgaccacgaacaacaattttgataaaatttgctgaagaggtactaagaagggaagcaagactaggctgatgtttatttgtcatcatatttggtgcaaaaatctcgaatgacattatgatgagatgacaaatgaaaattctcatttctatcctaagaagatccaatgccagttatggcattatttgctatagtagatttgtttaacacattctgagattcacagcaagcatttttctttttggtgtaaaatattgcaatttaaactgtgatttctggaaattacatgttgacgagctgttggtggaaagttttggcctaagttcgagttggagaggtcattgttgttttagctttgtaaatattttatattggctggaaaaatttgttttgcagcggccgcatg

SEQ ID NO: 2034 - DNA, 790 bp, Trigonella foenum-graecum
aaatcgggttaaccgaaaccaagcagaggagttagaatcattaagagaagaggaagatgatcggagtgggaaaggtaaagcagtacggcaacgttctcgataaacctcttaacaagggcaagactgaggttagtttgagtgcatttgcgttcttgttctctgagcttgttcagtacaaccaaacacaggttgacaatatcggcgaactcgaacgaagactggaggatgctggatatgctgttggggctcgtgttcttgagctgctttgccacagagaaaagggaaacagaagggagacacgattgttgggtattctttcttttgtacacagtacagtgtggaaagtactatttggaaaggtagctgactcactggagaaaggaactgaacacgaagatgaatacatgatcagtgaaaaggaactcctagtaaacaaattcatttctatcccaaaggacatgggaacgtttaactgtggcgcattcgttgctggaatagttcggggtgttttggatggtgctggctttccagctgttgtaacagctcattttgtgcccatggaaggtcaacaacgacctcggaccacaattttgataaaatttgctgaagaggttttacttagagaagcaagattaggctgatgtttatacggagaagtttcaattaagatatttgtaatgctgaataccaatatagtaagacgtggaactttcacctctgcgtgtgaaaagtatcttgggattctgaccagcctatcctttttgatatgtgcttcaaactcctttctcat

SEQ ID NO: 2035 - DNA, 934 bp, Trigonella foenum-graecum
gtgagatcaaatcgggttaaccgaaaccaagcagaggagttagaatcattaagagaagaggaagatgatcggagtgggaaaggtaaagcagtacggcaacgttctcgataaacctcttaacaagggcaagactgaggttagtttgagtgcatttgcgttcttgttctctgagcttgttcagtacaaccaaacacaggttgacaatatcggcgaactcgaacgaagactggaggatgctggatatgctgttggggctcgtgttcttgagctgctttgccacagagaaaagggaaacagaagggagacacgattgttgggtattctttcttttgtacacagtacagtgtggaaagtactatttggaaaggtagctgactcactggagaaaggaactgaacacgaagatgaatacatgatcagtgaaaaggaactcctagtaaacaaattcatttctatcccaaaggacatgggaacgtttaactgtggcgcattcgttgctggaatagttcggggtgttttggatggtgctggctttccagctgttgtaacagctcattttgtgcccatggaaggtcaacaacgacctcggaccacaattttgataaaatttgctgaagaggttttacttagagaagcaagattaggctgatgtttatacggagaagtttcaattaagatatttgtaatgctgaataccaatatagtaagacgtggaactttcacctctgcgtgtgaaaagtatcttgggattctgaccagcctatccttttgatatgtgcttcaaactcctttctcattctattgtatgttattatgaagttgggaattgctcttactgtcctgcattataatgtaaaaaaaatctcatgtttaatttcattattggtcttaccccacatatttgatttgaggataacttacagatgaagttaag

SEQ ID NO: 2036 - DNA, 1415 bp, Cucumis melo
gaggaagaggttcacttcacgttcagctgccccctacggtttcaactgccatcttatccggcgacggcgaacgtctacgtgcggcggcctgacactagatctgtgggttgaatccacctgctgtaatcgacgaacgacgaacagtacgccggaaacgccgctcctcagtcggcccctgttatttttctgtttcgagctacagcagtgaactctggcggacgtttcgatcctagcgattcatagtttagagatactcatgtatcgtaagcttcagcaacgcgttctcaactgatcggtggccttcaaacgacactccagcactgtgccgctcgcgctcgacctctcccagcgaacccggggcttccatcggcggagactccttccggtagtggtaatccccaacgcccacggctcgatcgactctggatctgattaccccacttcattttggcggcaaatctgtgagttggaaggattttggacactgttcagcaagattaaaaggcttttgaacgagtttcgtagggacttccaagggccctgttcttaagaattagggaatcatgattggagttgggaagatcaagcaatattctaatgtcctcgaaagacctctcagcaagggaaaacaggaggtgagcttgagtgcttttgcattcttgttctccgaacttgtgcaatacaatcagactcaagttgacaatattgctgagttagaacgaaggttggaagatgcgggctatgcagttggtgctcgagtattggaacttttttgtcaccgagagaagggaaatagacgggagacacgattattaggcattctctcatttgtacacagcacaatttggaaggtttgtttggaaaggttgctgactcacttgagaaaggcactgaacatgaagatgagtacatgatcagtgaaaaggagctgcttgtgaatagatttatttcaattccaaaagacatgggtgcgtttaactgcggagcttttgttgctggcatagtcagaggtgtgctggacaatgctggatttcccgctgttgtaacggcacattttgttccggtggagggccaacagcgaccacggacgactattttgattaaatttgcagaagaggtattagcaagagaagcaagattaggttgatatatggtttgaagtaagaagcttgggtattgttcttatgcttttagcattttgatattggagaatggtgaatttctttttggccattgaacaaatagataatttcacctcatatatctctgttgtggagctgtaaggaaatttgtgctcttcgattaatctgtataattgatggcaccaattactttgttgcgagaaaaatgagctgtgaaactataagattttgaagttgtatatgggcttcaaatggtttattcagcataaatgt

SEQ ID NO: 2037 - DNA, 900 bp, Tragopogon dubius
ttcggggggtttaaccaaaatctatggtgactcaaacttgggaataatgaagtagggtttggacttccgaaaagccgagggagcaaatcgccattgaaatcgttactcttgctcggcaactgagaggataacatcgaagatgattggagcggggaagatcaagcagtacacaaatgttctggataaaccccttagtaaaggcaggcaagaggtcagtttaagtggatttgcttacttattttcagagcttgttcaatacaaccagacacaagttgacaacattggggaactagagaggagattggaggacgctggttatgctgttggagtacgggttttagaactactttgccatagggaaaagggtaacagaagggagacacgtttgttgggaattttgtctttcgtacatagcacagtatggaaggtgctatttggaaaggtggctgactcgcttgagaaaggtactgaacacgaagatgaatatatgattagtgaaaaggagctcctagtcaataggtttatttcagtacccaaagatatggggtccttcaactgtggtgcttttgttgctgggtagtaaggggcgttctagacaatgcaggattcccagctgtagtgactgctcattttgttccggtggatggtcaacaacggcctcggacaaccattttgataaaatttgctgaggaggttctacgaagagaagcaaggctgggatgagtttcttaagttgtttggctgcctgactgattgtggtttattatatactcaaactactttaatttttgtctttttagaaccaatttttccttcattttgaccatatgttgtttatattgcataacatcatgaaaacaatctaccaaaattaaaatgttattacatgagttataaatt

SEQ ID NO: 2038 - DNA, 1058 bp, Amaranthus tuberculatus
ggcctcggatagtgtttactcaaatgatattcaagcacaaaattgtcagatctttgatgtcgccaccgaattgatcaacattttccgccattgttcctccagtttcgccacctctagtgacgcaagtcgccgatgcttctgtcgccgaatctgtcttaggtcatttttttatattgaaggctatttttgtaagagcttgaccacatttgttagacggaaaacacatatgtgccttgtctgagaaagagtgatcaacatgataggagcgggaaagatgaaacaatacactaacattcttgacaaacccttgagcaaaggaaaacaagaggtcagcttaagtgcctttgcctttttgttttcggagattgtacagtataatcagacccaggtggacaatattgctgaactagagcgaagactagaagatgcaggatatgctgttggagcacgagtgctggaacttctttgccatagggagaagggtaacagaagggaaacacgattacttggtattctgtcttttgtacacagtactgtgtggaaggtgttatttgggaaggttgctgactcccttgagaagggcactgaacatgaagatgaatatatgatcagtgaaaaggagcttcttgtcaacagatttatatctattcccaaagatatgggaacttttaactgcggtgcatttgtcgctggaatagtgaggggtgtcttagatggtgcaggtttcccagccgttgtaactgctcattttgttcccatggaagggcagatgcgtccaagaaccactatcttgataaaatttgcagaagaggtgctgaaaagggaagcaagattagggtaatctctgatagaatcatcgtttcgtgaaactgtcaaagatctgaaatgcaggttgagcaacagctaaaaacttattgctgcttccctgtatgaatctcatgaggctttacataatcttcgttatagctcgatgttagttaagcttgatctcttctggtattaaagtgaattttttgtatttattatcttgacaatgtaatagactttgtaaacaatta

SEQ ID NO: 2039 - DNA, 863 bp, Chrysanthemum coronarium
gtgtagtatgacaaaggggttggactttgagggaagccacagaacggcgttaaagtcgttagttagcgataacatgataggagcagggaagatgaagcaatactcaaatgttgttgataaaccccttagcaaaggcagacaagaggtgagtttgagtgggttcgcttatttgttttcggagcttgttcagtacaaccagacccaggttgataacattggtgaactcgaaaggagattggaggatgctggctatgctgttggagtacgagttttggagttactttgtcatagggagaagggtaacagaagagagactcgtttgttgggcattttgtcgttcgttcatagcacagtatggaaggttctttttggaaaggttgctgactcgcttgagaaaggcactgaacacgaagatgaatatatgattagtgaaaaggagctcctagtcaatagatttatttcggtaccaaaagacatgggctcatttaactgtggtgcctttgttgctgggatagtaaggggtgttttggacaatgcaggattccctgctgttgtgacggctcattttgttccagtggatggtcaacaacgtcctcgaacaaccattttgattaaatttgctgaggaggtacttcgaagagaagcaagaataggataattttgtcaagtgttttctggctttgtattgtggccatggactgattgggtacgtatatactttgaagaatcaaaaaggaaaaatcgtatgtgtttgtcaaaaacttgtagcagtaagaactatgtttttatggattttttagggtgacaacatcactccagtgtgatttagtacttgtccctatgtcagtgaccaatttcttttt

SEQ ID NO: 2040 - DNA, 855 bp, Chrysanthemum coronarium
ctctagtgatagtgataaaggagggggttggactttgagatatcgtggtcgtgaaaagatgatcggggcagggaagatgaagcaatactcgaatgttcttgataaaccccttagcaaaggcagacaagaggtgagtttgagtggatttgcttatttgttttccgagcttgttcagtataaccagactcaagttgataatattggtgaactcgagaggagattggaggacgctggctatgctgttggagtacgagttttggagttactttgccatagggaaaagggtaacaaaaaggagactcgtttgttgggcattttgtcgttcgttcatagtacagtgtggaaggttctttttggaaaggtagctgactcgcttgaaaaaggcactgaacacgaagatgaatatatgattagtgaaaaggagctcctagtcaatagatttatttcggtaccaaaagacatgggctcatttaactgtggtgcctttgttgctgggatagtaaggggtgttttggacaatgcaggattccctgctgttgtgacggcccattttgttccagttgatggtcaacaacgtcctcgaacaaccattttgattaaatttgctgaggaggtacttcgaagagaagcaagattaggatgattttgtcaagtgttttctggctttgtatttgcggtacgtatatactttgaagaatcaaaaaggaaaaacgtatgtgtttgtcaaaaacttgtagcagtaagaactatgttttatgaattttttagggtgacaacatcatttcagtgtgatttagtatttatctctatatcagtgaccaatttctttttagttatcgtagtgatatatggtcg

SEQ ID NO: 2041 - DNA, 880 bp, Chrysanthemum coronarium
gtgtagtatgacaaaggggttggactttgagggaagccacagaacaccgttaaagtcgttagttagtaaagtacccaaaccgataacataatgataggagcagggaagatgaagcaatactcaaatgttgttgataaacccctcagcaaaggcagacaagaggtgagtttgagtggatttgcttatttgttttccgagcttgttcagtataaccagactcaggtggataatattggtgaactcgagaggagattggaggatgctggctatgctgttggagtacgagttttggagttactttgccatagggaaaagggtaacagaagggagactcgtttgttgggcattttgtcgttcgttcacagtacagtatggaaggttctttttggaaaggtagctgactcgcttgaaaaaggcactgaacacgaagatgaatatatgattagtgaaaaggagctccttgtcaacagatttatttcggtaccaaaagacatgggctcatttaactgtggtgcctttgttgctggaatagtaaggggtgttttggacaatgcaggattccctgctgttgtgacggctcattttgttccagtggatggtcaacaacgtcctcgaacaaccattttgattaaatttgctgaggaggtacttcgaagagaagcaagaataggataattttgtcaagtgttttctggctttgtattgtggccatggactgattgggtacgtatatactttgaagaatcaaaaaggaaaaatcgtatgtgtttgtcaaaaacttgtagcagtaagaactatgtttttatggattttttagggtgacaacatcactccagtgtgatttagtacttgtccctatgtcagtgaccaatttcttttt

SEQ ID NO: 2042 - DNA, 975 bp, Trifolium pratense
aaaaacattgtaacaaagctttcgcttcttcttcctctgcgctccatcttccaggaacgatacgatacagcgctccctctttctctctcatcgtcgtcctctccgtcagtcacagtgacagcgccgttcaccaccgttacctctctccgaccttctcaaggaaaagaagaagatgatcggagtcggaaagatcaagcagtacggtaacgtcctcgataagccccttaacaagggcaagactgaggttagtttgagtgcatttgcgttcttgttctccgagcttgttcagtataatcaaactcaggttgacaatatcggcgagctcgaacgaagattggaggatgctggatatgctgttggggctcgtgttctggaactgctttgccacagagataagggaaacagaagggagacacgattgttgggtattctttcttttgtgcacagtacagtgtggaaagtactatttggaaaggtagctgactcactggagaaaggaactgaacacgaagatgaatatatgatcagcgaaaaggaactccttgtaaacaaattcatttctatcccaaaggacatgggaacatttaactgcggtgcatttgttgctggaatagttcggggtgttttggatggtgctgggtttcctgctgtcgtaacagctcattttgtgccaatggaaggtcaacaacgacctcggacaacaattttgataaaatttgctgaagaggtgttacgtagagaagcaagattaggctgatattcatacacagaattatcaattattatatttgtaatgctgaatgccgacaatatagaaatactgtgtgaaaagtgttttaggattctgacagcctacccttttgatatgtgcttcaaactcttttctcattctattgtatgttatgctttgaagttgggaattgttcttactgtactgaattataatgtacaaaatatctcatgtttaatttcatt

SEQ ID NO: 2043 - DNA, 937 bp, Trifolium pratense
cttcttcttcctctgcgctccatcttccaggaacgatacgatacagcgctccctctttctctctcatcgtcgtcctctccgtcagtcacagtgacagcgccgttcaccaccgttacctctctccgaccttctcaaggaaaagaagaagatgatcggagtcggaaagatcaagcagtacggtaacgtcctcgataagccccttaacaagggcaagactgaggttagtttgagtgcatttgcgttcttgttctccgagcttgttcagtataatcaaactcaggttgacaatatcggcgagctcgaacgaagattggaggatgctggatatgctgttggggctcgtgttctggaactgctttgccacagagataagggaaacagaagggagacacgattgttgggtattctttcttttgtgcacagtacagtgtggaaagtactatttggaaaggtagctgactcactggagaaaggaactgaacacgaagatgaatatatgatcagcgaaaaggaactccttgtaaacaaattcatttctatcccaaaggacatgggaacatttaactgcggtgcatttgttgctggaatagttcggggtgttttggatggtgctgggtttccagccgtcgtaacagctcattttgtgccaatggaaggtcaacaacgacctcggacaacaattttgataaaatttgctgaagaggtgttacgtagagaagcaagattaggctgatattcatacagagaattatcaattatgatatttgtaatgccgaatgccaatatagaaagacatggaactttaacttctgtgtgaaaagtattttaggattatgacaaccatacttttgatatgtgcttcaaacttgtttctcattctattgtatgctaattatgctttgaagttgggaattgttcttactgtactgaattataa

SEQ ID NO: 2044 - DNA, 845 bp, Trifolium pratense
cttcttcttcctctgcactccacatcttccaggaacgatacgatacagcgctctctctttctctctcatcgtcatcctctccgccagtcacagtgacagcgccgttcaccaccgttacgtctctccgaccttctcaagaaaaagaagaagatgatcggagtcggaaagatcaaacagtacggtaacgtcctcgataagccccttaacaagggcaagactgaggttagtttgagtgcatttgcgttcttgttctccgagcttgttcagtataatcaaactcaggttgacaatatcggcgagctcgaacgaagattggaggatgctggatatgctgttggggctcgtgttctggaactgctttgccacagagataagggaaacagaagggagacacgattgttgggtattctttcttttgtgcacagtacagtgtggaaagtactatttggaaaggtagctgactcactggagaaaggaactgaacacgaagatgaatatatgatcagcgaaaaggaactccttgtaaacaaattcatttctatcccaaaggacatgggaacttttaactgtggtgcatttgttgctggaatagttaggggtgttttggatggtgctgggtttccggctgtcgtaacagctcattttgtgccaatggaaggtcaacaacgacctcggacaacaattttgataaaatttgctgaagaggtgttacgtagagaagcaagattaggctgatattcatacagagaattatcaattacgatatttgtaatgctaaacgccgatatagaaaagatgtggaactttaacctctgtgtgaaaagtgttttaggattatgacaacc

SEQ ID NO: 2045 - DNA, 958 bp, Trifolium pratense
cttcttcttcctctgcactccacatcttccaggaacgatacgatacagcgctccctctttctctctcatcgtcatcctctccgtcagtcacagtgacagcgccgttcaccaccgttacctctctccgaccttctcaagaaaaagaagaagatgatcggagtcggaaagatcaaacagtacggtaacgtcctcgataagccccttaacaagggcaagactgaggttagtttgagtgcatttgcgttcttgttctccgagcttgttcagtataatcaaactcaggtcgacaatatcggcgagctcgagcgaagactggaggatgctggatatgctgttggggctcgtgttctggaactgctttgccacagagataagggaaacagaagggagacacgattgttgggtattctttcttttgtgcacagtacagtgtggaaagtactatttggaaaggtagctgactcactggagaaaggaactgaacacgaagatgaatatatgatcagcgaaaaggaactccttgtaaacaaattcatttctatcccaaaggacatgggaacatttaactgcggtgcatttgttgctggaatagttcggggtgttttggatggtgctgggtttccagccgtcgtaacagctcattttgtgccaatggaaggtcaacaacgacctcggacaacaattttgataaaatttgctgaagaggtgttacgtagagaagcaagattaggctgatattcatacacagaattatcaattattatatttgtaatgctgaatgccgacaatatagaaatactgtgtgaaaagtgttttaggattatgacaacctacccttttgatatgtgcttcaaactcttttctcattctattgtatgttatgctttgaagttgggaattgttcttactgtactgaattataatgtacaaaatatctcatgtttaatttcattgtctc

SEQ ID NO: 2046 - DNA, 830 bp, Vicia sativa
ctaaaatcgggtaaagtgaagaggagtgaggtgtttggtgtgcgaggatgatcggagtcggaaagataaagcagtacggcaacgtcctcgacaaacccctcaacaagggcaagacagaggtcagtttgagtgcatttgcgttcttgttctctgagcttgttcagtacaaccaaactcaggttgacaatatcggtgaactcgaacgaagactggaggatgctggatatgctgtcggggctcgtgttcttgagctgctctgccacagagataagggaaacaggagggaaacacggttgttgggtattctttcttttgtacacagtacagtatggaaagtactatttggaaaggtagctgactcattggagaaaggaactgaacatgaagatgaatacatgatcagtgaaaaggaactcctagtaaacaaattcatttctatcccaaaggacatgggaacatttaactgcggtgcattcgttgccggaatagtccggggtgttttggacggtgccgggtttccggctgtcgtaacagctcattttgtgcccatggaaggccaacaacgacctcggacaaccattttgataaaatttgctgaagaggtgttacgcagagaagcaagattaggctgatatttatactgagaattttcaattaagatatctgtaatgctgaacaccaatatagaaagatgtgaaaagaattttaggattctgacaagccttatgtacttcaaaatcatttctctttctattgtattgttatgctttgaagctgggaattttgtctactgtactaaagtttttatctgcttgctagctccagttcat

SEQ ID NO: 2047 - DNA, 1117 bp, Beta vulgaris
agaaaagaagtttctaaacgtaaccctccaaattccgatctatagaatttattgcgattgcaaaggaaattccatctctctctaccgattacagtccacattcatattcatccattcattccagtgtttcttttctatctaaaaagttcgatttcgaatttccagcatcaattcaaggaatgaaattgaagttttgttcttgacgattccataaaattgaagcttttttggagacatcacgcatttgttgagtgaaacatcacacaagacaatgatcggagtggggaagatgaagcaatacacgaatgttctcgataaacccgtaagcaaaggaaagcaggaggttagcttaagtgctttcgccttcttgttttcggagattgtgcaatataaccagacacaggtggacaatattgctgaactcgaacggaggctagaggatgcaggctatgctgttggggctcgagttctggaacttctttgccatagggagaagggtaaccgaagggagacacgcttgcttggtattctatcttttgtacacagcactgtgtggaaagtgttgtttggaaaggttgctgactcacttgagaagggcactgaacatgaagatgaatatatgatcagcgagaaagagctccttgtaaacaggtttatatctataccgaaagatatgggaactttcaactgtggcgcatttgtcgctggaatagtgaggggtgtcttggatagtgcaggatttcccgctgttgtaactgctcattttgttccagtggaggggctgttgcggcctagaaccactatcttgataaagtttgccgaagaggtactcaaaagggaagcaagattgggttgatgcctgttgaaactattggttcatcaaatttatcaatacaacaggctgaggagttgtcgaatcttgttcgagggaatcatattctccgaaactcctactttttgttgatccctggtttttcgaacggggtttacatttgtttcattgtgattccggtgttgaatttgcgcatgatctcttgttaatcaaaatacaaattattttagcgtcattatcccatggaggatcccgcatgttgtagttgtaggtaaaggaatggat

SEQ ID NO: 2048 - DNA, 781 bp, Lotus japonicus
ggatcacatgtgaggtgtgagaattggtgcaagcaagagaagagaagagaagaggaagagaatgatcggcgtcggaaagatgaaacagtacagtaacgtcctcgacaagcccctcaccaagggcaagcaagaggttagtttgagtgcgttcgcgttcttgttctctgagcttgttcagtacaatcaaacccaggtcgacaacatcggcgagctcgaacgaagggtggaggatgctggatatgctgttggggctcgagtactcgagctgctttgccacagagaaaagggaaacagaagggagacacggctgttgggtattctttcttttgtgcacagtacagtgtggaaagtattattcggaaaggtagctgactcgctggagaaaggaactgaacatgaagatgaatacatgatcagtgaaaaagagctcctagtaaacaaattcatttctatcccaaaggacatggggacgtttaactgcggagcatttgttgctggaatagtacggggtgtcttggatagtgccggatttccagctgttgtaacagctcatttcgtgcccatggaaggtcagcaacggcctcggacgacgattttgataaaattcgctgagggggtgttacgtagagaagcaagattaggctgatgtttataccaagaattttcaagatatttatgatgctgtacaccaatatagaatgatgtggaacttgcgtactttgcatgtgaacgcaacttagtattttcgacagccttattctaaactcttgtttttcattcc

SEQ ID NO: 2049 - DNA, 891 bp, Lupinus angustifolius
gagtaaaataaagctaggttattttgttgtccacataataagtaaagaacacagtgacgattgtgagaaagtacgaagaaggatatgatcggagtaggaaaaatgaagcaatatggtaacgttctcgataagcctctgaacaagggaaaacaagaggttagtttgagtgcatttgcgttcctattctctgagatggttcaatacaatcaaactcaggttgataatattggtgaactcgaacgcaggcttgaggatgctggttatgctgttggtgctagagttcttgagctcctttgtcatcgtgataagggaaacagaagggagacacggctgttgggtattctttcttttgtacacagtacagtgtggaaagtgttatttggaaaggtagctgactccctggagaaaggaaccgaacatgaagatgaatacatgatcagtgaaaaggagctcctagtaaacagattcatttctattccaaaggacatgggaacgtttaattgtggagcatttgttgctggaatagttcggggtgtcttggatggtgccgggtttccagctgttgtcacagctcattttgtgcccatggaaggtcaacaacgtcctcgaacaacgattttaataaaatttgctgaggaggtgttacttagagaaacaagattaggctgatgtttatactgagaattttcaactaagatatttgtaatgccacacaaatatggagatgtggaagtttgtcctatgaaatgtaatttaaaattctcaccaccctcttttgttgatctgccctttaaactcttgtgtttcattcttgtgtatgattatgcttggaagttgggaatcatccttatcaaattataatgcacaaaaatgtcgttatgtttctattga

SEQ ID NO: 2050 - DNA, 944 bp, Medicago truncatula
atataattcaaattaagaagaaaatactccgaaagaagatcaaatcgagttaacccaaagcaacaaagaagatgatcggagtgggaaaggtaaagcagtacggcaacgtcctcgataaaccccttaacaagggcaagactgaggttagtttgagtgcatttgcgtttttattctccgagcttgttcagtacaaccaaactcaggtcgacaatattggcgagctcgaacgaagactggaggatgctggatatgctgttggggctcgtgttcttgagctgctttgccacagagataaggggaacagaagggagacacgattgttgggtattctctcttttgtacacagtacagtgtggaaagtactatttggaaaggtagctgactcactggagaaaggaactgaacacgaagatgaatacatgatcagtgaaaaggaactcctagtaaacaaattcatttctatcccaaaggacatgggaacgtttaactgtggcgcattcgttgctggaatagttcggggtgttttggatggtgctggctttccagctgttgtaacagctcattttgtgcccatggaaggtcaacaacgacctcggaccacaattttgataaaatttgctgaagaggtgttacttagagaagcaagattaggctgatgtttatatgaagaattttcaattaagatatttgtaatgctgaacaccatatagaaagatatggaactttcacctatgcagtgttttaggattctgaccagcctatccttttgatatgtgcttcaaactcgtttctcattctattgtatgttatcctttgaagttggaaatagttcttactgtcttgaattataatgtacaaaatatctcatgtttaatttcaatatctgtcaacctgcatattgattgaggataactcacggatgaggtaaagcttgatttgccagt

SEQ ID NO: 2051 - DNA, 1117 bp, Olea europaea
actacgtcaacaaagaacgtactacgaacaactaacggacgtttcctaggaccgtccacgtcggtatcggaaaacgttactaaagaactaaacaactactctcccctcgaaggcagtggtagtcaacgacacgagtacgcgggggacgacaccagaatctacaaaattgcccgtactggtaatcaaaactgtaaatcgatcgagcaaatgataggagctgggaaaatgaagcagtacactaatgttcttgatcgacccctcagcaaaggcaaacaagaggttagtctgagtgggtttgcattcttgttctcggagctcgttcagtataatcagactcaggtagacaacatagcagaattggaaagaaggttagaggatgcaggctatgctgttgggacccggattctggaacttctttgtcatagggagaagggtaacagaagggagacacgactcttgggaattttgtcctttgtgcatagcacagtatggaaggtcttgtttggaaaggtagcagactcacttgaaaaaggaactgagcatgaagatgaatacatgatcagtgaaaaagaactcctagtcaacagatttatttcaatacctaaagatatgggtgccttcaactgcggagcatttgttgctggaatagtgaggggagtcctggataatgcaggttttccagctgtagtaagtgcacattttgtacctgtggaagggcagcaacgacctagaacaaccattttgataaaatttgctgaagaggtactacaaagagaagcaagactaggttgatacctgctctgacttttccccgtatccaatttgcctaatctgcaatcacaaggttcctgaatgacagagttttctggtgaaacaaataggatgttttcatgtaatacctgttgaggtagcaatttgtgttctatccaaaggcttgataatactttgtgcgcatttgaactgctgatcaagaagtatactttcaacacattgaaaatgttgtaatgtgagatggggactggtggaaaattatattattttgtgagctggtagagaatttacctggtgtataggatgttaaatttgacctatgcaaattcagtgcaggaattctgtg

SEQ ID NO: 2052 - DNA, 987 bp, Orobanche aegyptiaca
acgacggcgacttgcactcccggatttgggagaaccaaatgataggagttgggaaaatcaagcaatatacaaatgttctcgacagacccctgggcaaaggaaaacaagaggttagtttgagtgctttcgcattcttgttttccgagcttgttcagtacaatcagactcaagttgacaacataatagagctcgaaagaaggttagaggatgcaggctacgcagttggagccagagttctggaacttctttgtcacagagagaagggtaacagaagggagacaaggctattgggtattttgtctttcatccacagcacagtatggaaggccttgtttggaaaggtagctgactctcttgagaaaggtactgagcatgaagacgagtacatgatcagtgagaaggaacttcttgtcaacagatttatttcaatacccaaagatatgggtgccttcaattgcggtgcatttgttgcaggaatcgtgaggggagtattggataatgcaggtttcccagctgttgtaacagctcattttgtacctgtggatgggcaacacagatcgaggacaaccattttgattaaatttgctgatgaggtactacaacgagaagcgagattaggttgacactcaactaaagattctgaacatattatgccatatcgttggctgaacatcttgctgttatcgcctgcaatgtcgttgacattttttgacttgtggtgatttggcttcgaagtgcatggtttgacaatatcttaaatcatattattttataattaatggtgacatgaagcttctcttagttgtactgcacaacgttatgtgatttatatacgagagattgccgaggcattttacatggacttaaatgtaaaactatgttatgtttgaccttgaagtccaaatgcagcatttgttggattgtatggaagcttgtttgtgatcttttgtggacattagctttttgaattttaagacatccagtttg

SEQ ID NO: 2053 - DNA, 1287 bp, Phalaenopsis aphrodite
gtccgtatctttctctgggaggacgggacgatcaggggcgaaaaagcggtaggcgaggaggtggcgatcggcaagaggtcgctgggggagggcgtggaggaggaatcggattgtgaaggagaagaggaattcagaggaagagcctaccgcgaatgagcgagcaagccctaaatcttgttaaattatacctaaatctcagctaaatcttgcaaccagacagcctcaaggagtaaggatcaagtgccaccgttcacaaagtttttttacttttccagattgatattggatcagatctcttggcttcggatcgcattttgttggatccgagctatcgggagaagctatgatcggcgttggcggaaaaatcaagcagtactcaagcgtacttgacaaacccctcagcaagggtaggcaagaggttagtctgagtgcctttgcatttttgttttcagaactagtgcagtacaatcagactcaagttgacaatattgcggagttagagagaagattagaagatgcaggctatgctgttggagctagagttcttgaactcttttgccatagagaaaagggtaacagaagggagacacgacttttggggattttatctttcgtgcacaccacggtgtggaaagttctctttggaaaggttgccgactcacttgagaaagggaccgagcatgaggacgaatatatgattagtgaaaaagaacttctggtgaaccgatttatatccatacccaaagacatgggagcatttaactgtggtgcatttgtagctgggattgtaaggggtgttttagacaatgctggctttcctgctgtggtgacggcacattttgtacccatggaaggtcaacaacgaccaagaaccacaattttaataaagtttgctgatgaggtactgcgcagggaagccaagcttgtttgaacttctggttgttatggttttttttactaaacttaacaagaatttagctgtggaaaacctcttgatgtgctacaaaaatttcggcttgcctgatttgatttttctcttccttatctgatcagtattttttaatgataaagttgccaaggcttgaggaattcacaaagtttttaatttgtaacatctagatatcaatattgggatctattgtatacatcaatgtcataattgccattctcagttgacttttacctaatatatttgccattatggtacccctactgaaggggtccgtcttacatctttttgggaattcaatgtttttggtatatgaatttaattgctcgtactttatt

SEQ ID NO: 2054 - DNA, 1084 bp, Populus trichocarpa
acggttcaaaagttaaccaaaacggcaacacagagcttcaatagaccactaccagttctagttgcatagtctatcgctccttcattttcctgtgatttctcaccttccaaacagaccataataaattttcccggattcgatccaaaagaagatccatagaaaggaaattaaaccctaaaaaacatgatcggagtaggcaagatcaagcaatactctaatgtcctcgataaacccctcagcaagggcaaacaagaggtgagttcgagtgcgtttgcatttttgttttcggagcttgttcagtataatcaaacacaggttgataacattgctgaattagagcgaaggctagaggatgcaggctatgctgttggggctcgagttctggaacttctttgccatagggataagggcaacagaagggaaacacgattgttgggtattttgtcttttgtacacagcacagtgtggaaagtgttatttggaaaggtagccgattcccttgaaaaaggcactgaacatgaagatgaatacatgatcagtgagaaggagctccttgtcaatagattcatttcaattccgaaggatatggggacatttaactgcggggcatttgttgctggaatagtaaggggtgttttggatggtgcaggttttccagcagtagtaacagctcatttcgtgcctatggagggccagcatcgacctaggacaaccattttgataaaatttggtgaggaggtactaagaagagaagcaagactaggttaatgtttgtatgaatatttcatcatgcaaccttcggtcttcagcaacacggtgaagagcagtgaactcttcagctggaatcctgtcagctgtactttgtgacattattggatccctgtttgatttttgtgtatgctcttcagagcatggaaattttaatgatcttgtaaaagcaattattgccactccagttgatgtaaagtatacgatttcccttcttctcagctcatatgatcttggtcaggatgagctgagttgaataggttcatgaatacatttttatcggacttcctcaactccgctaagcttttcatcctct

SEQ ID NO: 2055 - DNA, 932 bp, Solanum tuberosum
gcgatctagagagagagttgaaggaagaagatgataagtgtagggaagatcaaacagtactcaaatgttcttgagagacccctcagcaaaggcaaacaagaggtcagtttgagtgcttttgctttcttgttttcggagcttgttcagtacaatcagactcaagtggacaacattactgaattagagcgaaggttagaggatgctggctatgctgttggagcccgaattttagaacttctctgccatagggaaaagggaaacagaagggagacacgactactgggtatattatcatttgtgcatagcacagtatggaaggttttgtttgggaaggttgctgactctctcgagaaaggcactgaacatgaagatgaatatatgattagtgagaaggagctccttgtcaacagattcatttcaattccaaaagatatgggtgctttcaactgcggagcttttgttgcgggtattgtaaggggagttcttgaaaatgcaggtttcccagcagtagtgacagctcattttgttcctgtggaggggcagcaccgaccccggacaacaattttgataaaatttgctgaagaggtactaagaagggaagcaacactaggttgatgttatttgtcattatatttggtgcaaaatgcttgaacaacattataatgagatgacaaatgaaagatcctttgattgttcaacacatcttaggttcatgtcaatcctaagatcatacaattgccagttgtgacaatattttctatagtactatagttgacttgttcaatgcatcttaggtttaccgcgataaattgtatcaaaacatcaagcatttacttctttggtgtaaaatatttgcactttggaaggtgatttctggaaattttatgttgttgatgagctatgagtagaaagttatttgagccagggaaaac

SEQ ID NO: 2056 - DNA, 934 bp, Glycine max
aggaaaaatgatcaggtagccaattcaccgttaacctaagaaagagaagtagctgtagtaataggaagaggatgatcggcgtcggaaagatcaagcagtacagtaacgtcctcgacaagcccctcaccaagggcaagcaagaggttagtttgagtgcattcgcgttcttgttctcggagcttgttcagtacaaccaaacgcaggtcgacaacattggcgagctcgaacgaagactggaggatgctggatatgcggttggggctcgagttcttgagctgctttgccacagagataagggaaacagaagagagacacggctgttgaatattctttcttttgtacacagtacagtgtggaaagtattatttggaaaggtagctgattcactggagaaaggaactgaacatgaagatgaatacatgatcagtgaaaaggagctcctagtaaacaaattcatttctatcccaaaggacatgggaacgtttaactgtggagcatttgttgctggaatagtacggggcgttttggatggtgccgggtttccagctgttgtaacagctcattttgtccccatggaaggtcaacaacgaccacggacaacaattttgataaaatttgctgaagaggtgttacgaagagaagcaagattaggctgatgcttataccaagaattttcaattaaaaatattttaatgctgtacaccaatatagaaagatttggaacttgcacctatggatgtgaaaaagtaatttaggattttcaccagcctaccctattgatttgtcaattgaactcatgcttttcattctaatgtatgttctgctttggagtcggggagttgttctttctgatttacattgtacaaaaaatctcgtgttgttaatttccatttgtctcactcctaatataattgagcatcaaactgaggaattg

SEQ ID NO: 2057 - DNA, 842 bp, Castanea mollissima
gggaagatcaagcagtactcgaacgttctcgacaagcctctcagcaagggcaagcaagaggtgagtttgagtgcgtttgcgttcttgttttcggagcttgtgcaatacaatcagacgcaggtggacaatattgctgagttagaacgaaggctggaggatgcaggctatgctgttggggctcgagttttggaacttctttgccatagggataagggaaacagaagggaaacacgattgttgggcattctttcgtttgtacacagcacagtatggaaggtgttatttggaaaggtggctgactcacttgagaaaggcaccgaacatgaagatgagtacatgatcagtgaaaaggagctccttgtgaatagatttatttcaattccaaaagacatggggacatttaactgcggggcgtttgttgctggaatagtaagaggtgttttggatagtgctggttttccagctgttgtaacagctcattttgtgcccatggaaggtcagcaaaggcctcgaacaaccattttaataaaatttgctgaggaggtactacgaagagaagcaaggttaggttgatatatgtgccaggacttaatacatgtaatgtttatgatgctcagcaagaacatgatgaatgtgttaatgctctgcaacagcatggtgaaggatggtgaattttttagctggtttgtcaaattaattatgattttcacctgccaattctgttgcttgggccaaattgaattcctgtcattgatttgtgttgctgtatactctatttcatggcacagtaactttgtggatctagaattagcaattaccatctgtcagtcgttgtagaaaag

SEQ ID NO: 2058 - DNA, 834 bp, Chrysanthemum coronarium
actttgagggaagccacagaacgccgttaaagtcgtttgttagtaaagtacccaaaccaataacatgataggagcagggaagatgaagcaatactcaaatgttgttgataaaccccttagcaaaggcagacaagaggtgagtttgagtggatttgcttatttgttttccgagcttgttcagtataaccagactcaagttgataatattggtgaactcgagaggagattggaggacgctggctatgctgttggagtacgagttttggagttactttgccatagggaaaagggtaacaaaaaggagactcgtttgttgggcattttgtcgttcgttcatagcacagtatggaaggttctttttggaaaggttgctgactcgcttgagaaaggcactgaacacgaagatgaatatatgattagtgaaaaggagctcctagtcaatagatttatttcggtaccaaaagacatgggctcatttaactgtggtgcctttgttgctgggatagtaaggggtgttttggacaatgcaggattccctgctgttgtgacggcccattttgttccagttgatggtcaacaacgtcctcgaacaaccattttgattaaatttgctgaggaggtactgcgaagagaagcaagattaggataattttgtcaagtgttttctgtctttgtattgtggccatggactgattgcggtacgtatatactttgaagaatcaaaaaggaaaaacgtatgagtttgtcaaaaaattgtagcagcaagaactatgtttttatggatgttttagggtgataacatcatttcagtgtgatttagtacttatctctata

SEQ ID NO: 2059 - DNA, 944 bp, Cichorium intybus
actaaaaatgcaaaaagaaaaggtttttgtggaggttcaacttctatcaaccgagcaaaatgcccaaattataaacgtcaaaaacatacttgtacaaaatagcaaccgacgatcaaaacgatttataaccaagaaactactccgaataccgaattgactctgagaagtgagtagagaagatgatcggagctgggaagatcaagcagtacacaaatgtgctcgacaaacccctcaacaagggtagacatgaggtcagtttgggtgcatttgcttacttattttcagagcttgttcagtacaatcaaacgcaagttgacaatattggagaactagaaaggaggttggaggatgctggatatgcagttgggacacgagttcttgaactactttgcaatagagaaaaaggtaatagaagggagacacgcttgttgggtattttgtctttcatacatagtactgtatggaaggttttattcggaaaggtagctgattcacttgaaaaaggcacagaacatgaagatgaatatatgatcagtgaaaaagagcttctagtcaatagatttatctctgtaccaaaggacatgggaagtttcaattgtggtgcttttgttgcaggggtagtaaggggagtgttagataattctggcttcccggctgttgttacggctcattttgtacctgtggaaggacaacaacgccctcgtacaacaattttgatcaaatttgctgaagaggtactacgaagagaagcaagattaggatgatcctaaatttgttgttttcatgaaaactaaacatgggatttgttgtggccttttttcatgggacaataactgatttttttttttaaagttgaatttaatgtgtcatattttacttattggattatgttggtttatgagaatttaaggagggaagtgttttggtgtaaactggagtttaag

SEQ ID NO: 2060 - DNA, 1026 bp, Amborella trichopoda
gaacattttgatatctaacttctctctatctgtccataattttgtgactggttgcaggaatcatctgacagtgagattgttcttggcatcaagatcactttagcaccagatccgagatttttcggctaaaaaaagggttttgattagagaactcaccatgatcggagtaggaaaagtcaaacaatacacaaatgttttggataagcccttgagcaaaggaaaacaagaggttagtttgagtgcatttgccttcttgttttctgagcttgtccaatataaccagactcaagttgataacattgctgagctagagagaaggttagaagacgcaggatatggtgttggtgtccgagtcctagaacttctttgccatagagataagggaaacaggagggagacgcgcttgctgggaattttgtcatttgtacacagtacagtgtggaaagtgttatttggaaaggtggccgattcccttgagaaaggcacagaacatgaagatgaatacatgatcagtgagaaagagctcttggtgaacagatttatttcgattcccaaggacatggggacattcaattgtggggcatttgttgctggcatcgttaggggtgtcctggacagtgcaggttttccagctactgtatctgctcactttgtgccaatggaggggcaacaacgacctaggacaactatattgataaaatttgcagaagaggtgctcacgagggaagctaggctcggctgaagtttgggaagtgcaatgacattcttgattatgtctattgctaatttgtttgagatcatttctgagcctgacatattcgtgattgcattttcctcattgtaaatccctttagaataccttttaatgtttcaattctgctgcaaagtactcttaaaaaaaaaaaagataaaaagaaatttttttttactccaaagtgaattcctttttatgcttcaaatctgctgcgtaactttgatgaggggctactgtttttccattttaaaggaaaaatatcattcgagggg

SEQ ID NO: 2061 - DNA, 970 bp, Aquilegia formosa
gaagtaagaagagcaagatgatcggagcagggaaagctaaacaatacgccaacgttgtagaaaaacccctcagcaaaggaaagcaagaggtcagtttgagtgcttttgcattgctgttttcagagcttgtgcagtataatcaaactcaagttgacaatattgcagagttggaaagaaggctcgaggatgcaggttatgctgttggagcaagagttttagaacttctttgtcatagggataagggaaacagaagagaaacacgactattggggatattatccttcgtgcacagtacagtgtggaaagtcttatttggaaaagttgctgactctcttgagaaaggcactgaacatgaagatgaatacatgattagtgagaaggagctccttgtgaatcggtttatatccgttccaaaagacatgggaacattcaactgtggggcatttgctgctggtattgtaaggggggtcttggatggtgcaggttttccagctgtagtaacagcacactttgtgccagtagagggtcaactacgaccgcggacgaccatattgataaagtttgctgaagaggtacttcgaagagaagccaaattgggttgatgcatgtacacattttaataaacaatcttcttgaagatccccaagcatgatgatagtggatactggatttccagctgattaatcaaacagaactcgacctctcaacatctggtgcttatggatactcaggcttcttgagtcaaatttgcttcaaaatcgttgatattgataagcaatattgttggagatataatgtaaatggtaatttaccataaactggggttgtattgacaccaataatttttagactagggttgtgtatgataaaactgaactaaaatgtatgaatgactgaactggccgacagtttgttgctgtttctaagttggataatatgtttggtaaaacttaagatggaatttttcatg

SEQ ID NO: 2062 - DNA, 951 bp, Centaurea maculosa
ggaattagatcagtctaaagtgagaactagggcttggacttgaaggaatcaaatcgccattgacagaagataacggaaaagatgattgggaagatgaagcagtacacaaatgttctcgataaaccccttagtaaaggcagacaggaggttagtttaagtggatttgcttacttattttcagagcttgttcagtacaaccaaactcaggttgacaacattggtgaactagaaaggagattggaggatgctggctatgctgttggagtacgagtcctggaattactttgccatagggagaagggtaatagaagggagacacgtttgttggggattctgtctttcgtacatagcacagtatggaaggtgctttttggaaaggtagctgactcgctcgagaaaggcactgaacacgaagatgaatatatgatcagtgaaaaggagctcctagttaatagatttatttctgtaccgaaagacatggggtcgttcaactgtggtgcttttgttgctgggatagtaaggggagttttagacaatgcgggattcccggctgttgtgactgctcatttcgttccggtggacggtcaacaacgccctcgaacaaccatattgataaaatttgctgaggaggtgctacgaagagaagcaaggttaggatgatttttgtttgtacttttggatatggatgctatatcagcgcgttttatcctaatgtgcattcacttctcatccaatggtgaataaccacttctcatcggaacctgaccttatgtttaactgttgaaagaatacttatcaaatttcatgttacgacggaaaaacccttacattaaatggaaacatcaatcaactgatggttttccaactctacaatttcaagtgatttcgctattgaaagttatagtagtttatgtagaagatatcgtacattgggttgttaaataagaaagc

SEQ ID NO: 2063 - DNA, 936 bp, Centaurea maculosa
aagtgagctagggcttggacttgaaggaatcaaatcgccattgacagaagataacggaaaagatgattgggaagatgaagcagtacacaaatgttctcgataaaccccttagtaaaggcagacaggaggtcagtttaagtggatttgcctacttattttcagagcttgttcagtacaaccaaactcaggttgacaacattggggaactagaaaggagattggaggatgctggctatgctgttggagtacgagttttggagttactttgccatagggagaagggtaatagaagggagacacggttgttgggcattctgtctttcgtacatagcacagtatggaaggtgctttttggaaaggtagctgactcgcttgagaaaggcactgaacacgaagatgaatatatgatcagcgaaaaggagctcctagttaataggtttatttctgtaccgaaagacatggggtcgttcaactgtggtgcttttgttgctgggatagtaaggggcgttttagataatgcgggattcccagctgttgtgactgctcatttcgttccggtggacggtcaacaacgccctcgaacaaccattttgataaaatttgctgaggaggtgctacgaagagaagcaaggttaggatgatttttgtttgtacttttggatatggatgctatatcagctcgttttatcctaatgtgcattcacttctcatccaatggtgaataaccacttctcatcggaacctgaccttatgtttaactgttgaaagaatacttatcaaatttcatgttacgatggaaaaacccttacattaaatggaaacatcaatcaaccgatggttttccaactctacaatttcaagtgatttcactattgaaagttatagtagtttatgtaaaagatatcgtatattgggttgttaataagaaagccttca

SEQ ID NO: 2064 - DNA, 909 bp, Chelidonium majus
aagatcaagcagtataccaacgtcctcgacaaacccctcagcaaaggcaaacaagaggttagtctgagcgcatttgccttcttgttttcggagcttgtgcagtataatcagactcaggtcgataacattgctgagttagaacgaaggctagaggatgcaggttatgctgttggagcaagagttcttgaacttctttgccatagggataagggaaacagacgggagacacgattattgggaattttgtcctttgtacacagtacagtatggaaggtcttatttgggaaggtggctgactcacttgaaaaaggcaccgaacatgaagacgaatacatgatcagtgagaaagagctacttgtcaatcggtttatatctgttccaaaagacatgggaacatttaattgtggggcatttgttgcggggattgtaaggggtgtattagacggtgcaggctttccagctgtagtaactgctcattttgtaccaatggaaggccaacaacgaccgaggaccactattttgataaaatttgcagaagaggtactccgaagagaagcgagattgggttgatatttggctgagaaattgaaattttggcaagttgaagatatcttgctcacccacacgactagtatgtaaattgtatgggggaaattataggtctgattgtttgaatcaagcacaagattttataccctgtcaggttctgcaggcatatgggtggtatttttatctccatgcaaccataaaaaaaaaaaaggaaaattcccatttcttcttgatgtttattatattaagtccctgtgggctgtttcatgttggaatcaattaatttctggaccaagtagaggccactgtcacttggtattttttttttgttgtcttctgtatgaattggaatagttgaaa

SEQ ID NO: 2065 - DNA, 824 bp, Cichorium intybus
gggacagcgacgatcaaaacgatttataaccaagaaacttctccgaataccgaattgactctgagaagtgagtagagaagatgatcggagctgggaagatcaagcagtacacaaatgtgctcgacaaacccctcaacaagggtagacatgaggtcagtttgggtgcatttgcttacttattttcggagcttgttcagtacaatcaaacgcaagttgacaatatcggagaactagaaaggaggttggaggatgctggatatgcagttgggacacgagttcttgaactactttgcaatagagaaaaaggtaatagaagggagacacgcttgttgggtattttgtctttcatacatagtactgtatggaaggttttattcggaaaggtagctgattcacttgaaaaaggcacagaacatgaagatgaatatatgatcagtgaaaaagagcttctagtgaatagatttatctctgtaccaaaggacatgggaagtttcaattgtggtgcttttgttgcaggggtagtaaggggagtgttagataattctggcttcccggctgttgttacggctcattttgtacctgtggaaggacaacaacgccctcgtacaacaattttgatcaaatttgctgaagaggtactacgaagagaagcaagattaggatgatcctaaatttgttgttttcatgaaaactaaacatgggatttgttgtggccttttttcatgggacaataactgatttttattttaaagttgaatttaatgtgtcatattttacttattggattatgttggtttatgagaatttaaggagggaagtgtttt

SEQ ID NO: 2066 - DNA, 646 bp, Guizotia abyssinica
gaacgtagcgttagtaattagtgacacactgagggtttggagcaatacgttactctttctcaacggagaagatgatcggagctgggaagatgaagcaatacgcaaatgttctcgataaacccctgagtaaaggccgacaagaggtcagtttgagtggatttgcttacttgttttcggagcttgttcagtacaaccagactcaggttgacaacattggggaacttgaaaggagattggaggatgctggctatgctgttggtgtacgagttttggaattactgtgccacagggaaaagggtaacagaagggagacacgtttgctggacattttgtctttcgtacatagcacagtatggaaggtgctctttggaaaggtagccgactcacttgagaaaggtactgaacatgaagatgaatatatgattagtgaaaaggagcttcttgtcaatagatttatttcagtaccaaaagacatggggtcgttcaactgtggtgcttttgttgctgggatagtaaggggtgttctagacaatgcaggattcccggctgttgtgactgctcattttgtcccggtggacggtcaacaacggcctcggacaactatcttgataaaatttgctgaggaggtactacgaagagaagcaag

SEQ ID NO: 2067 - DNA, 892 bp, Heritiera littoralis
ggctcgtgtatctcaaagctggctcattttttttcctgcagtttctttgcagccaaacagaagattaaaatttatttttccagtagaaaatgatcggagtcgggaagatcaagcaatactccaacatcctagacaagcccctcagcaagggcaaacaagaggttagcttgagtgcatttgcattcttgttttcagagcttgttcagtacaaccaaacacaggttgataacattgctgaattagaaagaaggctggaggatgcagggtatgcagttggggctcgagttcttgaacttttatgccatagggataagggaaatagaagggagactcgattgttgggtattttatcttttgtgcacagcactgtctggaaggtgttatttggaaaggtggctgactcacttgagaagggcactgaacatgaagatgaatacatgatcagtgagaaggaacttcttgtgaacaagtttatttcaattccgaaagacatggggacatttaattgtggggcgtttgttgctggaatagtgaggggtgttttggataatgcaggatttccagcagtagtaacagctcattttgtacctatggagggacagcaaagacctcgagcagctattttgataaagtttgctgaagaggtattgcgtagagaagcgaggataggttgattattatgcctgtgttgtcttcagctgtccatgttctgcagcactgggaaaggaacggtcaatttcaactgctttgttatttaccacccaatcacaccagccaatctgaatgtctttctctgattaatgatggttgtgtattgttctttatggtattggtacagtggttactgatatggtagcaaaagaattatttctaaatagctgttgatgtatag

SEQ ID NO: 2068 - DNA, 957 bp, Lactuca sativa
gagattagtaatggatatttgcaattaactcaaagaaaacatgagtaaatagtaaatactaaaaaatggcaacgcccaaattataaacttgaaaatacatacttgtaacaaaatagcaaccgacgatcaaaacgatttataaccagaaaactactcggaaatcggagtcgagtccgagaaagaaggagacgatgatcggagctgggaagatcaagcagtacacaaatgtgctcgacaagccccttagcaagggcaaacaagaggtcagtttgggtgcgtttgcttacttattttcagaacttgttcagtacaatcaaacacaagttgacaacattggagaactagaaaagagattggaggatgctggctatgctgttgggacacgagtacttgaactactttgcaatagagaaaagggtaatagaagggagacacggctgttgggcattttgtcttttatacatagtactgtatggaaggttttatttggaaaggtagctgattcacttgaaaaaggcactgaacacgaagatgaatatatgattagtgaaaaggagcttctagtaaacagatttatttctgttccaaaagacatgggatccttcaattgtggtgcttttgttgcaggggtagtaaggggagtgttggataatgctggcttcccggctgttgttaccgctcattttgttcctgtggatggtcaacaacgccctcggaccaccattttaatcaaatttgctgaagaggttctaagaagagaagcaagattaggatgattcttgtgttattacttattcgtattgtattatctttaaaaagtgatatttactacaatttgttttttttttattatcttaagaagtactagtataatttttgtttgttttccattgattgatttggaatgagaaaaaggattcaaaggatatatttgagtttcttttgttgttttcaagt

SEQ ID NO: 2069 - DNA, 974 bp, Nicotiana benthamiana
aatctgagtaccaaaagaagagtaaacgcactagatacagagcgatctgggaagagtcgaagcaagaaaatgataggagtagggaagatgaagcagtgcacaaatgtcctagaaagacccctcagtaagggaaagcaagaggttagtttgagtggttttgcattcttgttttccgagcttgctcagtacaatcagacccaagtggacaacattactgaattagagcgaaggttagaggatgctggatatgctgttggagcacggattttggaactcctctgccatagggaaaagggaaacagaagggagacacgattactgggtatactctcgtttgtgcacagcacagtatggaaggttttgtttgggaaggttgctgactcgcttgagaaaggaactgagcatgaagatgaatatatgattagtgagaaggagctccttgtcaacagattcatttcaataccaaaagatatgggtgcattcaattgcggatcttttgttgcgggtattgtaaggggagttctggaaaatgcaggtttcccagcggttgtgacagctcattttgtccctgtggaggggcagcagcgaccgcggacaacaattttaattaaatttgctgaagaggtactaagaagggaagcaagactaggttgatggttatttgtcatcatatttggtgcaaatttctcgaacgacattatgatgagatgacaaatgaaaattcctaagaggacccaatgccattttgtggcattatttgtcatagtggatttgctcaacacattctgaggttcacagcaagcatttttctttttggagtaaaatattgtaatttgaactgtggtttctggaaattattatacatgttgacgagctgttgtgcaaaattatttggcttaattcgagttggagaggtcactattgttttagctttgtacatgttttcagatattgtctggaaaaatttgttttgc

SEQ ID NO: 2070 - DNA, 964 bp, Solanum phureja
gtacccaaaacaagagtagacattacagtgctaagcgatctagagagagagagttaaggaagaagatgataagtgtagggaagatcaaacagtactcaaatgttcttgagagacccctcagcaaaggcaaacaagaggtcagtttgagtgcttttgctttcttgttttcggagcttgttcagtacaatcagactcaagtggacaacattactgaattagagcgaaggttagaggatgctggctatgctgttggagcccgaattttagaacttctctgccatagggaaaagggaaacagaagggagacacgactactgggtatattatcatttgtgcatagcacagtatggaaggttttgtttgggaaggttgctgactctctcgagaaaggcactgaacatgaagatgaatatatgattagtgagaaggagctccttgtcaacagattcatttcaattccaaaagatatgggtgctttcaactgcggagcttttgttgcgggtattgtaaggggagttcttgaaaatgcaggtttcccagcagtagtgacagctcattttgttcctgtggaggggcagcaccgaccccggacaacaattttgataaaatttgctgaagaggtactaagaagggaagcaacactagtttgatgtttatttgtcattatatttggtgcaaaatgcttgaacaacattatgatgagatgacaaatgaaagatcctttgattgttcaacacatcttaggttcatgtcaatcctaagatcatacaattgccagttgtgacattattttctatagtactatagttgacttgttcaatgcatcttaggtttaccgcgataaattgtatcaaaacatcaagcatttacttctttggtgtaaaatatttgcactttggaaggtgatttctggaaattttatgttgttgatgagctatgagtagaaagttatttgagacaagtt

SEQ ID NO: 2071 - DNA, 976 bp, Solanum lycopersicum
atccttcagtctcccttttcagtggaaaacgaaacgaaatctgagtatccaaaagaagagtagacattacagtgctaagcgatctgtagagagagttgaaggaagaagatgataagtgtagggaagatcaaacagtactcaaatgttcttgagagacccctcagcaaaggcaaacaagaggtcagtttgagtgcttttgctttcttgttttcggagcttgttcagtacaatcagactcaagtggacaacattactgaattagagcgaaggttggaggatgctggctatgctgttggagcacggattttagaactcctctgccacagggaaaagggaaacagaagggagacacgattactgggtatattatcatttgtgcatagcacagtatggaaggttttgtttgggaaggttgctgactcacttgagaaaggcactgaacatgaagatgaatatatgattagtgagaaggagctccttgtgaacagattcatttcaattccaaaagatatgggtgctttcaactgcggagcttttgttgcgggtattgtaaggggagttctggaaaatgcagggtttccagcggtcgtgacagctcattttgtccctgtggaggggcagcaccgaccacgaacgacaattttgataaaatttgctgaagaggtactaagaagggaagctacactaagttgatgttatttgtcattatatttggtgcaaaatgcttgaacagcattgtaatgagatgacaaatgaaagatcctttgattgttcaacacatcttaggttcatgtaaatcctaagatcatacaaattgcaagttgtgacattattttctatagtacaatagttgacttgttcaacacatcttaggtttaccgcgataaattgtatcagaacatcaagcatttacttttttggtgtaaaatatttgcacttcggaaggtgatttttggaaattttatgttgtttatga

SEQ ID NO: 2072 - DNA, 1203 bp, Fagopyrum esculentum
ccttttaatgtaaatagcaattttctccccaatctgtaatggtgtagttgacgggttcacaaattcccttcgtcattccgatttgctgtgatctttaagtcgagtacacctgcttgagcaactactcgatctcggaggatcttatcctttttatgatccactgttcattcggtataactgtataagtggttttagggctgatccaccgttcactcgatcggtggtttcgtgagcgttatcggagacggatttcggcgagtttcagaaccgccaccaattgaggaacgatgataggagcagggaagatgaagcagtactctaatatcctcgataaaccccttagcaagggcaaacaggaggtcagtttgagtgcatttgccttcttattttcagagcttgttcagtacaaccagactcaggtcgacaatattgctgagctcgagaggaggttggaggatgctggatacgcagttggtgctcgagttttagaacttctttgccacagggagaggggaaatagaagggaaacacgattattgggtattctatcatttgtacacagcactgtgtggaaggtgttatttggaaaggttgcagattccctggagaagggtactgaacatgaagatgaatacatgatcagtgagaaagagcttcttgtcaacaaatttatatccataccaaaagacatgggcaccttcaattgtggagcatttgttgctggaatagtgagggggtgttggatggtgcgggatttcctgctgttgttacagcccattttgttcctgtggatggtcaattgcgaccaaggacaaccattttgattaaatttgctgaagaggttctgattagagaggcaagattgggttgatagcaataaggatctcaaagttgctagagggtgtcatgttggacaacaaactaaacaaggctgtatatctgatccaattggttacgagcttgttgctaagaagatttgcagatattgaggctactagtctggttgtaatgctgtattttgttaagttgctcacgatgatttgacaatttgatgatattcagcaatcaaatgatgttctgacatttacagatggggcttgacatttagattatggtttatgaattatagatgttggtttgacaattatatgatctttgtcagtagtgacatcactaatggtgcaattaatatctattttctcc

SEQ ID NO: 2073 - DNA, 603 bp, Cirsium arvense
tcagatcaaaactacttggaatcaaccagagacagtatcgtgaagatgatcggagctgggaagatgaagcagtacgcaaatgtgctcgataagccccttagcaagggtagacaagaggtcagtttgagtgcatttgcttacttattttcagagcttgttcagtacaatcaaacccaagttgacaacattggagacctagaaaggagattggaggatgctggctatgctgttggtgcacgagtgctggagttactttgccatagagaaaagggaaatagaagggagacaaggttgttgggcattttgtctttcatacatagtacagtatggaaggttttatttggaaaggttgctgactcacttgagaaaggcactgaacatgaagatgaatatatgatcagtgaaaaagaactcctagttaatagattcatttctgtaccaaaggatatgggaaccttcaattgtggtgcttttgcagctgggatagtaaggggagttttagataacgcaggcttcccggctgtggtcacggctcattttgttcctgtggaaggtcaacaacgacctcggactaccatcttgataaagtttgctgaggaggta

SEQ ID NO: 2074 - DNA, 803 bp, Brassica oleracea
ggaaatcaaaagagcgttccgggtcctgaaaaacgaagaagatgatcggagtggggaagatgaaactgtactcaaacgtccttgacaagccactcagcaaaggcaaacaagaggtgagcttgagcgcatttgccttcttattctcggagctcgttcagtacaatcaaacccaggttgacaacattgctgaccttgaaagaagactagaggatgctgggtatgcagttggccctcgagtcttggagcttctttgcaaccgagagaagggcaaccggagagagacacggttactaggaatcttgtcttttgtccacagcaccgtgtggaaggtcttgtttggaaaggttgctgattcacttgagaaaggaactgaacatgaagatgagtacatgatcagtgacaaggagcttctcgtcaacaggttcatctcgattccaaaagacatgggaacattcaactgcggggcgtttgtggccggcatcgtgaagggacttctggacaacgcagggtttcctgctgtggtaacggctcattttgtacccattgaaggacaacaccgtcctcggactaccattttgatcaagtttgctgatgaggtgcttaaaagagaggcacggctaagccaatgagtgcactctttgtacgagttgccacatcatgttcttggagctgttgcctttatgtgaactgcttgtgcaagtcttgcctgtatgttttggtttaacgtatactataaccacttgaatcgagctgcaaagccttgtccgttgattgatgtaaactacatacgtaccctctcgtta

SEQ ID NO: 2075 - DNA, 1201 bp, Fagopyrum esculentum
acaactgctcaagcaactcaagttcaggcgatctcggacgagcttgctttttctgatccaccgctcacccggtattggtggttttcaggcctttttcccgatccacagctcactcggtattgatcgtttccggcgctttttactgatcaatcggtactgggacggatttcgagaggcgagttccagaatcaccaccaattgagaaacgatgataggagcggggaagatgaagcagtactctaatatcctcgataaaacccctcagcaagggcaaacaggaggtcagtttgagtgcatttgccttcttattttcagagcttgttcagtacaaccagactcaggtcgacaacattgctgagctcgagaggaggttggaggatgctggatacgcagttggtgctcgagttttagaacttctttgccacagggagaggggaaatagaagggaaacacggttattgggtattctatcatttgtacacagcactgtgtggaaggtgttatttggaaaggttgcagattccctggagaagggcactgaacatgaagatgaatacatgatcagtgagaaagagcctcttgtcaacaaatttatatccataccaaaagacatgggcaccttcaattgtggagcatttgttgctggaatagtgaggggggtgttggatggtgcgggatttcctgctgttgttacagcccattttgttcctgtcgacggtcaattgcgaccaaggacaactattttgataaaatttgctgaagaggttctgataagagaggcaagattgggttgatagcattaaggatcttaaagttgctagagagtgtcatgttggacaacaaactgaacaaggctctgtgtatgcctgatccaattggttacgagcttgttgctaagaagatttgcagatattgaggctactagtcaggttgtaatgctgtatttgttaagttgctgtcgatgatttgacaatttgatgatattcggcagtcaaatgatgttctgacatttacagatggggtttgacatctagattatggtttatgaattatagatgttggtttgacagttatatgacctttctcagtagtgacatcactaatggtgcagctaatatctatttccttcgtattgggagtatggcatgaatagacctgacaaatatatgaaatcgattgggtcgcatgtatgtacctaatt

SEQ ID NO: 2076 - DNA, 855 bp, Centaurea maculosa
ttttggttcacaacttcacatcacctccctcttcttgttggggaggaattagatcagtctaaagtgagaactagggcttggacttgaaggaatcaaatcgccattgacagaagataacggaaaagatgattggaagatgaagcagtacacaaatgttctcgataaaccccttagtaaaggcagacaagaggtcagtttaagtggatttgcttacttattttcagagcttgttcagtacaaccaaactcaggttgacaacattggcgaattagaaaggagattggaggatgctggctatgctgttggagtacgagttttggagttactttgccatagggagaagggtaacagaagggagacacgtttgttgggcattttgtctttcgtacatagcacagtgtggaaggtgctttttggaaaggtagctgactcgcttgagaaaggcactgaacacgaagatgaatatatgatcagcgaaaaggagctcctagttaatagatttatttctgtaccgaaagacatggggtcgttcaactgtggtgcttttgttgctgggatagtaaggggcgttttagacaatgcgggattcccggctgttgtgactgctcatttcgttccggtggacggacaacaacgccctcgaacaaccattttgattaaatttgctgaggaggtgctacgaagagaagcaaggttaggatgatttttgtttgtactttggatggatgctatatcagcacattttatcccaacgtacatccacttctcagccaatggtgaataaccacttctcattggaacccgaccctatgtttaactgtctaagcatacttatcaaatttcatgttacgacag

SEQ ID NO: 2077 - DNA, 1023 bp, Tropaeolum majus
ggaagagagagagagtagtgagaggattgggaagaaagtatgattggagttgggaagatgaagcaatactcaaatgtcctcgacaaaccagttagcaaaggaaagcaagaggtcagcttgagtggatttgcgttcttgttttctgaacttgttcaatacaatcagacccaggttgacaatattgccgagctagaaagaaggctggaggatgcgggatattctgttggggctcgagttctggaacttctttgccatagagagaagggaaacagaagagaaacacgattgttgggtattttgtcttttgtacatagcaccgtatggaaaattctttttggaaaggtagcagactcacttgaaaaagggactgaacatgaagatgaatatatgatcagtgagaaggagctccttgtaaatagatttatttcaattccaaaagatatggggacttttaattgcggtgcatttgttgctggtatagtaaggggagttttggaaagtgcaggttttccagcgattgttacagctcattttgtaccaatggaaggactacagagacctcgaactaccattttaataaaatttgctgaagaggtactacaaagagaagcaagattgggatgatacatgcgccgaggtgtaagtttatcattattctgtgacagaatgatggtagaggtcgcgaatctgctgctcctttctcgaactgatcagcatttctttcatcgaaccctgccaattgtacttctggctgttcaaactcctttattatgatattctttttctataaacggcagcgtgttatacttatatggcgcatcagctataaacccagtagtggtgtatgtgattgtatcgtcgcgattcaccggtttgttttagtgtaaggttagctgttgcccctcgatgttactttggcatttacttgtaatgaaaagattgtttaaatcagagtagaaatgaatttatgaattctagagtttgaaagattgcatgaaattcatctatggtctattgtacttt

SEQ ID NO: 2078 - DNA, 715 bp, Centaurea maculosa
cagtacacaaatgttctcgataaaccccttagtaaaggcagacaggaggtcagtttaagtggatttgcccacttattttcagagcttgttcagtacaaccaaactcaggttgacaatattggggaactagaaaggagattggaggatgctgggtatgctgttggagtacgagttctggaattactttgccatagggagaagggtaacagaagggagacacgtttgttaggcattttgtctttcgtacatagcacagtgtggaaggtgctttttggaaaggtagctgactcgcttgagaaaggcactgaacacgaagatgaatatatgatcagtgaaaaggagctcctagttaatagatttatttctgtaccgaaagacatggggtcgttcaactgtggtgcttttgtcgctgggatagtaaggggcgttttagacaatgcaggattcccagctgttgtgactgctcattttgttccggtggacggtcaacaacgccctcgaacaaccattttgataaaatttgcagaggaggtgctacgaagagaagcgaggttaggatgatttttgtttgtactttggacatggatgctatatcggcgcattttattctaatgtgcatccacttctcagctaatggtgaataaccacttctcattggaacctgaccctatgtttaactgtctaagaatacttatcaaatttcatgttacgacag

SEQ ID NO: 2079 - DNA, 613 bp, Castanea mollissima
tctcgatctgctgtacgtcctctcttcacacacacacacacacacacacacaaagatgatcggagttgggaagatcaagcagtactcgaacgttctcgacaagcctctcagcaagggcaagcaagaggtgagtttgagtgcgtttgcgttcttgttttcggagcttgtgcaatacaatcagacgcaggtggacaatattgctgagttagaacgaaggctggaggatgcaggctatgctgttggggctcgagttttggaacttctttgccatagggataagggaaacagaagggaaacacgattgttgggcattctttcgtttgtacacagcacagtatggaaggtgttatttggaaaggtggctgactcacttgagaaaggcaccgaacatgaagatgagtacatgatcagtgaaaaggagcttcttgtgaatagatttatttcaattccaaaagacatggggacatttaactgcggggcgtttgttgctggaatagtaagaggtgttttggatagtgctggttttccagctgttgtaacagctcattttgtgcccatggaaggtcagcaaaggcctcgaacaaccattttaataaaatttgctgaggaggta

SEQ ID NO: 2080 - DNA, 887 bp, Cleome spinosa
atcttaagcaaaacaatccccgagagagattttcccgagaaagaaaaattccagagaagaaaggaaggggggattgagagaagatgatcggaggtggggaagatgaagcagtactccaacgtcctcgacaagcccgtcagcaaaggcaaacaagaggtgagcttgagcgcatttgctttcctattctcggagctcgttcagtacaaccagacgcaggtcgacaatattgctgaacttgaaagaagacttgaggatgcgggatatgcagttggagctcgagttctagaacttctttgccacagggagaagggaaatcgaagggagacaaggttgcttggaattctgtcttttgtccatagcaccgtgtggaaggtgttgtttggaaaggttgctgactcgcttgaaaaagggaccgaacatgaagatgagtacatgatcagtgagaaggagctcctcgtgaacaggttcatttcgattccaaaagacatgggaacgttcaactgtggggcgtttgctgcggggatagtcaagggagttctggatggtgcaggctttcctgctgtagtaacagctcattttgtgcctatcgaaggacagcaacgccctcggaccaccattttgataaagttttctgaagaggtgctgaaaagagaggcggggctaggttgagttgaagccgccaagatctgtctcccttgaaattctgtcttgtgttgtctggtgagaaaactgttggattgtatcaactgttctgcctaatctgccacttttgggttggattgtaaagtagagaaatgtttttttctagttttagggattgatagctgattacacgcacaatggaacggtaacaaatacttgatatatctactctcaagcaaaatagc

SEQ ID NO: 2081 - DNA, 947 bp, Gossypium hirsutum
cgtactcgtagtacatacaaatcgatcgattcctgctcctcagatcgttaagaaatccgaagacccatatgctataacagacaatgattggagttgggaagataaagcaatactcaaacatccttgagaagcccctcagcaagggcaaacaagaggttagcttgagtgcctttgcatttttgttctctgagcttgttcagtacaatcaaactcgggttgacaacattgctgaattagaaagaaggctggaggatgcagggtatgctgttggggctcgagttcttgaacttttatgccatagggataaggggaatagaagggagacacgattgttgggtattttatcctttgtgcacagcactgtctggaaggtgttatttggaaaggtggctgactctcttgagaagggcactgaacatgaagacgaatacatgatcagtgagaaggacctccttgtgaacaagtatatttcaattccaaaagacatggggacctttaattgtggggcatttgttgctggaatagtgaggggtgttcttgatggtgcaggatttccagcagtagtaacagctcattttgtaccaatggagggactgcaaagacctcggacaactattttgataaagtttgctgaagaggtattgcaaagagaagcgagattaggttgattattatgcctggggttctcttgagttgtccatgtactgcaacatcgtgaatgaaacactgaacacttcggctgcttccttaatctaataacatggattagtgatggtttgtgtattatggcaacaatggtagaaaaagattattacatgtaaaagtaaaaatgtcatcattactgttagttttgtgttgatatgacctcaaatggattattaccgagattgtgtattttctttttaaatgaattttgttgcttcgaaatttgataatgaattatctat

SEQ ID NO: 2082 - DNA, 984 bp, Gossypium raimondii
ctcgtagtacatacaaatcgatcgattcctgctcctcagatcgttaagaaatccgaagacccatatgctataacagttttctagcagccaaacagaaaataatattttcttttcctgtagacaatgattggagttgggaagataaagcaatactcaaacatccttgagaagcccctcagcaagggcaaacaagaggttagcttgagtgcctttgcatttttgttctctgagcttgttcagtacaatcaaactcgggttgacaacattgctgaattagaaagaaggctggaggatgcagggtatgctgttggggctcgagttcttgaacttttatgccatagggataaggggaatagaagggagacacgattgttgggtattttatcctttgtgcacagcactgtctggaaggtgttatttggaaaggtggctgactctcttgagaagggcactgaacatgaagacgaatacatgatcagtgagaaggacctccttgtgaacaagtatatttcaattccaaaagacatggggacctttaattgtggggcatttgttgctggaatagtgaggggtgttcttgatggtgcaggatttccagcagtagtaacagctcattttgtaccaatggagggactgcaaagacctcggacaactattttgataaagtttgctgaagaggtattgcaaagagaagcgagattaggttgattattatgcctggggttctcttgagttgtccatgtactgcaacatcgtgaatgaaacactgaacacttcggctgcttccttaatctaataacatggattagtgatggtttgtgtattatggcaacaatggtagaaaaagattattacatgtaaaagtaaaaatgtcatcattactgttagttttgtgttgatatgacctcaaatggattattaccgagaatacgagtttgcttgttttgtgtattttctttttaaatgaattttgttgcttcgaaa

SEQ ID NO: 2083 - DNA, 724 bp, Arnica chamissonis
caatacacaaatgttctcgataaacctcttagtaaaggcagacaagaggtcagtttaagtggatttgcttacttattttcagagctggttcagtacaaccagactcaggttgacaacattggggaattagaaaggagattggaggatgctggctatgctgttggagttcgcgttttggaattactgtgccacagggaaaagggtaacagaagggagacacgtctgttgggcattttgtcttttgtacatagtacagtatggaaggtgctttttggaaaggtcgctgactcacttgagaaaggtactgaacatgaagatgagtatatgattagtgaaaaggagcttctagtcaatagatttatttcagtaccgaaagacatggggtcgttcaactgtggtgcttttgttgcgggggtagtaaggggtgttctagacaatgcaggattcccggccgttgtgactgctcactttgttccggtggatggtcaacaacgacctcggacaactattttgataaaatttgctgaggaggtactacgaagagaagcaaggttaggatgatttcttgttatgtgttggcgggctttgcgttttggtcgtggaccgattgcagtactttgaagaatcaaaatgtaacaaagtctatcatttgtagcaccatgactcctttaacattcttcctagcaaattgtatgatttttaaattgtcggattgttttagcac

SEQ ID NO: 2084 - DNA, 903 bp, Gossypium hirsutum
gtagcacatacaaatcgatcgattcctgctcctcagatcgttaagaaatctgaagacccatatgctataacagacaatgattggagttgggaagataaagcaatactcaaacatccttgagaagccccttagcaagggcaaacaagaggttagcttgagtgcctttacatttttgttctctgagcttgttcagtacaatcaaactcgggttgacaacattgctgaattagaaagaaggctggaggatgcagggtatgctgttggggctcgagttcttgaacttttatgccatagggataaggggaatagaagggagacacgattgttgggtattttatcctttgtgcacagcactgtctggaaggtgttatttggaaaggtggctgactctcttgagaagggcactgaacatgaagacgaatacatgatcagtgagaaagacctccttgtgaacaagtttatttcaattccaagagacatggggacctttaattgtggggcatttgttgctggaatagtgaggggtgttcttgatggtgcaggatttccagcagtagtaacagctcattttgtacccatggaggggctgcaaagacctcggacaactattttgataaagtttgctgaagaggtattgcaaagagaagcgagattaggttgattattatgcctggggttctcttgagttgtccatgtactgcaaaatcgtgaaggaaacactgaacactccggatgctttgttaatctaataacatggattagtgatggtttgtgtattatggcaacaatggtagaaaaagattattacatttaaaagtaaaaatgtcatctttactgctagttttttcttgatatgacctcaaatggattattaccgagaatacgagtttgcttgttttgtgg

SEQ ID NO: 2085 - DNA, 957 bp, Silene vulgaris
ggttgatgtttgctagttccgatcttttatcttaacgaccgatatagtagtcaccgaacttctactattgcgactgtgatcgtgaccgtgaccgcgaccgagaccgatattgtctccgaacttctattacagctcccctccctctctctttctcttccgacgccattttcagcgatcatctttttcacttttcagagcgtagtacgagggtggaggaatgatgatgaccaaaatgaaacagtattctaatgttctggagaaaccactcagcaaaggcaaacacgaggttagcttaagtgcatttgcctttttgttctcggagcttgtacaatttaaccagactcaggttgacaatatcactgagttagaaagaaggttagaagatgcaggctatgctgtaggggcaagagttctggaacttctttgccatagggaaaagggtaatagaagggagacccgcctactcggtattctgtcttttgtacacagcactgtgtggaaggtcctgtttggtaaggttgctgattcacttgagaagggcactgagcatgaagatgaatatatgatatccgagaaagagctccttgtgaacagatttatatcaataccaaaagatatgggaacattcaactgcggtgcatttgttgctggaatagtaaggggtgtcttggatggtgcgggtttcccagctgttgtgactgctcattttgtaccagtggaaggacaattgcgaccacgaaccactatcttgataaaatttgctgaagaggtactgagacgagaagcaagactagtctgatactgcttatgaaatgccaaagatcagcacgacagagtgaactatagcttcttcaaatgcttttgcttgattagaaaaaaaattagttaatgcttttcaatgcttggatgattgtcaaatgtcaaggaacaactgattgttctatgtgatgctactct

SEQ ID NO: 2086 - DNA, 769 bp, Utricularia gibba
acttggcagtactccaatgtgctcgacagacctctcggaaaagggaagcaagaggtcagtctaagtgcatttgcgttcttgttctccgagcttgttcagtataatcagacgcaggtggacaatattactgaattggaaaggaggcttgaggatgcgggttatgctgtcggagttagagttttggaacttctttgccatcgagagaagggtaatagaagggagacaagactattgggaatcttatcctttattcatagcacaatgtggaaggtcttgtttggaaaggtagctgactcacttgaaaaaggtactgagcatgaagatgagtacatgatcagtgagaaggaacttctggttaacagatttatttcaatacccaaggatatgggtgccttcaactgtggggcatttgttgctggaattgttaggggggttctggataattcaggcttccctgcggtggtaacagctcattttgttcccgtggatggtcagcagagacccagaacaaccattttgattaagtttgctgaagaggttctacagcgcgaggcaaggttgggctgacatggatttttgatcctgtgccactcctgaagtagatttgggaatgcctgttgagtgtggaaaccaggaagacttcgagttgtgtgtggctgctgtgtttggtgacaattgtaaaacgtcatgctatggatcactttttgtgcatgtaaactgacaagatatccgaagtgccttcagttggatgaaaggaattagcacatct

SEQ ID NO: 2087 - DNA, 967 bp, Cephalotaxus harringtonia
tggcaagcacataaatgccaatacggcaccggcctatatatcgacttagacgaatattttcttcaagacgaaaaacagctttaaccatttgtctctccgtttcaaaatattatcagaattcagagtgggttgaggatattgttccctatcaatgcacaggaagaataagacgacgacatgattggagtagggagaaataagcagtatgccaatgtgttggataagcctctcggcaagggcaagcaggttagtctcaatgctttttcattcttgttttcagagcttgtgcaatacaaccaaacttgtgttgacaatattgcagagttagaacgcaggcttgaggatgcaggttatggtgtggggctgagagtattggagctcctttgccacagagagaagggaaacagaagggagacaagattactgggcattctttcatttgtgcacagtacagtatggaagtctttgtttggcaaggtggccgactcccttgagaaaggaacagaacacgacgatgagtatatgatcagtgagagggaacttcttgtcaatagatttatatcagttcccaaggacatgggaaacttcaactgcggagcatttgttgcaggaatcgtaaagggtgtcttagacggagcaggttttccagcagtagtgacagcacattttgtcccggtggagggtcagcctcgaccccgaacaactattttaataaagtttgcagaagaggtacttctgcgggaagcaagattgagttaagactcgaaaagagtcctgaagatttttataatccttggtacaggacagggagtcccatatttttatcatggcttatggtgcctacgatagctatcagtttttgctacctttctcattatgctgtagctatgtattacgtattttcaagtttgattgaaactaaagggacaaccacattccaattttcttgtaaagttgaaactcaagt

SEQ ID NO: 2088 - DNA, 1148 bp, Cryptomeria japonica
tggcgtttcaaattcttatactcctgttagaaagcgaagtaagttgagaatactctttgctcgtctaatatcactgcaacaaagagcggaaacttaaaaaaagactaggaggaagaagaagatatgatcggagtaggaagacctaagcagtatggcaacgtgctagataagcctcttggcaagggcaagcaagaggttagtctcaatgctttttcattcttgttttcagagcttgtgcaatacaaccaaacccgagttgacaatattgcagaattagaacggaggcttgaggatgcaggttatggtgtgggtttgagagtattggagctcctatgccacagagagaagggaaacagaagggagacaagactactgggcattctttcctttgtgcacagcacagtatggaagtccttatttggcaaggtggccgactcccttgagaaaggaacagaacatgaagatgagtatatgatcagtgagagggaacttcttgttaatagatttatatcagttcccaaggacatgggaaatttcaactgtggagcatttgttgcaggaattgtaaagggtgtcttagatggtgcaggtttcccagcggtagtgacagcgcattttgtccctgtggagggtcagcctcgaccacgaacaactattttaataaagtttgcagatgaggtacttcaacgggaggcaagattgagttaaacctggaaaatagagtcagatttatagtgtcattgatatggacaagaaaccttggattttaatcttggtttctgttggcagcaggaactaccagtttttgctttctttcatgtcatgctgtagctagatattacatgttttcaagtttaattgaaactaaagagatatttactgtccaattttcttttaggttcaaaattcttattggggcatactttaaaattaaacaagaaagtttataaaggaaattgtactcgctaaagatattgcattaagcttccccagttgttgttttttaaatggactctctgcataatgtgacatttgaataacttctatttcattcataaatatgcttcagtaggcaaccttgacagcctattgtttgacatccaaaattaagtgggatgtatttgaaaaatggattgttcgatactttc

SEQ ID NO: 2089 - DNA, 1012 bp, Taxus baccata
aaaaactgtgtcgcgacaggcgatacctcgatttatagacaataagctgtttctccgatacatattacagcttttaacaatttgattgcccatttcaaacttgttactccgatcagaattcagagtgatttgaggatactcttcttttctgcacagtgtacaggaagaagaaagacggcgacatgattggagtagggagaactaagcagtatgcgaatgtgctagataagcctctcggcaagggcaagcaggaggttagtctcaatgccttttcattcttgttttcagagcttgtacaatacaaccaaacccgagttgacaatattgcagaattggaacgcaggcttgaggatgcaggctatggtgtgggcttgagagttttggagcttctttgccacagagagaagggaaacagaagggagacaagattattgggcattctttcatttgtgcacagtacagtatggaagtctttatttggcaaggtcgctgactctcttgagaaagggacagaacatgaagatgagtatatgatcagtgaaagggaacttcttgtcaatagatttatatcagttcccaaggacatgggaaacttcaactgtggagcatttgttgcaggagttgtaaagggtgtcttagatggagcgggttttccagcaatagtgacagcacattttgtcccagtggagggtcagcctcgacctcgaacaactattttaattaagtttgcagaagaggtacttcaacgggaagcaagattgagttaagacttgacaaagaaacctgaagatttttagaatccttggtacgggaccagggagtctcatatttttatcttggccgcagcaaccatcagcttttgctacctttcttattatccatagatagatattacatgttttcaagtttttattgaaactaaaggaacaatcagagccccattttcttgtggacttgagactaacagggtgtacatacacagaaattaactgagaaagttttaggaaaccgg

SEQ ID NO: 2090 - DNA, 1016 bp, Amaranthus tuberculatus
tgctaatgttcttgacaaaccattaagcaaaagggaaacaagaggtcagcttaagtgcctttgcctttttgttttcggagattgtacagtataatcagacccaggtggacaatattgctgaactagaacgaaggctagaggatgcgggatatgctgttggagcacgagttttggaacttctctgtcacagggaaaagggaaacagaagggagacccgcttgcttggaattctatcttttgtacacagcactgtttggaaggtgttatttgggaaggttgctgattcacttgagaagggaactgaacatgaagatgaatatatgatcagcgagaaagagctcctcgtgaacaggtttatatctataccaaaagatatgggaacattcaactgcggtgcatttgttgctggtatagtgaggggtgtcttggacaatgcaggtttcccagcagttgtaactgctcattttgttccagtggaagggcagttgcggccaagaaccactatcttgataaagtttgctgacgaggtactaaaaagggaagcaagattaggctgatctctgcagggtcatcaaatctgttagaagaggaagatgtggaagaagttagtaattgtccgttataggtaaaaggaacattcttagagagaaattcacaagatcagccatagtatttactatttagtagtatgcttgaccaacctcttcaggaatcaggagtgtttttagttcctgggaagctgatcagctgataattaacctccaatatttctgtaattctgttaattacaataataatacgatgttcaaccttttgattagccacgacatcccaactagtttagtcgatcacacgttgtcaaatctgttggacagatcgaggaactattaagattatcccgagtcatgatagttgcgagagtagtgatgctgtgtattgcctctactgaattgtaaaaacgaaattgttgctacttaccacttgacatcgaagcttaatacaaaccagctttgtag

SEQ ID NO: 2091 - DNA, 848 bp, Eschscholzia californica
agtcagggccgcataaatactttcttggagccataacaatcgaaacaaaaatttgtgtgaggctgccctaaatcaaatagatgtgccaaaatacaagtccaaattgagaatcgaactccatccagaaaggagtaaaattattgttcgagttattgtgagagagagagagagagagagagcttgactgaataaacgatgataggagtagggaagatcaaacagtataccaacgttctcgacaaacccatcagcaaaggcaaacaagaggttagtttgagtgcatttgccttcttgttttctgagctggtacaatataatcaaactcaggtggataacattgccgagctagaacgaagactagaggatgcgggttatgctgttggagcaagagttcttgaacttctttgccatagggataagggaaacaggagggagacacggttactgggtattttatccttcgtgcatagtacagtatggaaagttttatttgggaaggtagctgactcacttgagaaaggcacggagcatgaagacgagtacatgatcagtgagaaagagctccttgtgaatcggtttatatctgttccaaaggacatgggaacatttaattgcggggcatttgttgcgggaatcgtaaggggtgtcttggatagtgctggcttcccagctgtagtaactgctcattttgtaccaatggaaggtcaacaacgaccacggaccactatcttgataaagtttgctgaagaggtacttcgaagggaagcaagtattaggttgaaagttcagcaggagaattagacttaacctttcgtcgtttggaagatatccttctacaccggcatgac

SEQ ID NO: 2092 - DNA, 1138 bp, Amaranthus tuberculatus
gggacggaagtcacctcaccttgatcaatcatcctgctcctgcttgctgatttcccacttccggcggcattatttagaagagcttcactaaattcattacaacatattaattgagtgaagcaagtttgaggaagagaacgccatgattggagtggggaagatcaaacaatacgcaaacgtccttgacaaaccattaagcaaagggaaacaagaggtcagcttaagtgccttcacctttttgttttctgagcttgtacaatataatcagacccaggtggacaatattgctgaactagaacgaaggtgaaatgttgcataacacttactaataggctagaggatgcgggatatgctgttggagcacgagttttggaacttctctgtcacagggaaaagggaaacagaagggagactcgcttgcttggaattctatcttttgtacacagcactgtttggaaggtgttatttgggaaggttgctgattcacttgagaagggaactgaacatgaagatgaatatatgatcagcgagaaagagctcctcgtgaacaggtttatatctataccaaaagatatgggaacattcaactgcggtgcatttgttgctggtatagtgaggggtgtcttggacaatgcaggtttcccagcagttgtaactgctcattttgttccagtggaagggcagttgcggccaagaaccactatcttgataaagtttgctgacgaggtactaaaaagggaagcaagattaggctgatctctgcagggtcatcaaatctgttagaagaggaagatgtggaagaagttagtaattgtccgttataggtaaaaggaacactcttagagagaaattcacaagacagccatagtatttactatttagtagtatgcttgaccaacctcttcaggaatcaggagtgtttttagttcctgggaagctgatcagctgataattaacctccaatatttctgtaattctgttaattacaataataatacgatgttcaaccttttgattagccacgacatcccaactagtttagtcgatcacacattgtcaaatctgatggacagatcgaggaactattaagattatcccgagtcatgttagtgcgagtgtagtgatgctgtgtattgcc

SEQ ID NO: 2093 - DNA, 1315 bp, Pinus pinaster
tccgtatactctgcctatgttggccgaagtttgctggagtctgaaagacgcactgtgcctatgctggccgatgttttctgggattttatactgaaagacgcgtgaaagcgggaggcctttgagatctattgaacgaaggctggcagtgttgtctaagtcggaaggaccaatttgtaatcgtttcaatggcggtcggcggccattttatggaaaaactgaaacaaaaatggactgctcaagaggacgagaaatggggcgccagcatggaacggaaggagaggagagacctgattggagttggaagaacaaagcagtatgccaatgcactagagaagtcgctcggcaagggcaagcaggaggttagtctgaatgcatttgcattcttgttttcagaacttgtgcaatacaaccaaacccaggttgacaatattgctgaactagagcgcaggctagaggatgctggttatggtgtgggattaagagtactggagctactttgccacagagagaaggggaacaggagggagacacgattattgggcattctttcctttgtacacagtacagtatggaaatctttgtttggaaaggttgctgactcgcttgaaaaaggaacagaacatgaagatgagtatatgattagtgaaagggaacttcttgtcaatagatttatttcagtcccaaaggacatgggaaacttcaactgcggggcatttgttgcaggaattgtaaagggtgtcttagacggtgcaggttttccagcagtagtgtcggcacacttcgtgcctgtggagggccaacctcggcctcggacaactattttaataaagttttctgaagaggttcttcaacgggaagcaagattgggttagaattggatcaggaacccaaattgacaagagtccttggtgagagaatgtgtctcagatctcatcttggcttctgggtgcagtattattatggaacattttgctctcttcgacgatatgttccataggtgaatgttatgtattttgatgttcaattgtatgcagtgaaagcacaatctcatacttgagaccattacgggtggcatatagtgaaattgaattaattttttgaggtaattgggttctctgctgtacgcaatgttaagttcaaaaaagtaatgcttctcaatcttgcactcatctgaagttggtcatatggatttttctaagagaaagtcctattatatgaaatatttttttgttcgctcatttgtattatgcatactaaggatagaaagttgagaacctaaacattaatagagtgtccttgaaaaataatgtttcac

SEQ ID NO: 2094 - DNA, 558 bp, Platanus occidentalis
agcaatacaccaacgttctcgataaacccctcagcaaaggcaaacaagaggtcagtctgagtgcattttcgttcctgttttcggagcttgtgcagtacaatcagactcaggttgacaacatttctgaattagagcgaaggttagaggatgcaggctatgctgttggagcaagagttctggaacttctttgccatagggataagggaaacagaagggaaacacgattgcttggaattttgtcttttatacacagtacagtatggaaggtgttatttggaaaggtagctgactcactcgagaaaggcaccgaaaatgaagatgaatacatgatcagtgagaagagctcctggttaatcgatttatttccataccaaaagacatgggaacatttaattgcggggcatttgttgctggaattgtaaggggtgtcttggatggtgcaggttttccagctgtagtcacagctcattttgttcctatggagggccagcagcgacctcgcactaccattttgataaagtttgccgaagaggtacttaaaagagaagcaaggttggg

SEQ ID NO: 2095 - DNA, 588 bp, Actinidia deliciosa
tgttttttctctgcaaactcgcccaaaatccgaagaaaatgatcggagtggggaagatcaagcaatacaccaacgtcctcgacaaacccctcagcaagggcaaccaagaggtcagtttgagtgcattcgcattcttgttttcggagcttgtccagtacaatcaaacccaagttgataatatccccgaactagaaagaaggttggaggatgcaggctatgctgtcggggcaagggtgttggaacttctttgtcacagggaaaagggaaacagaagggagacacgattgttgggtattttgtcatttgtacacagcacagtttggaaggtgttgtttggaaaggtagctgactcacttgagaagggaactgaacatgaagatgaatatatgatcagcgagaaggagctccttgtgaatagatttatttcaataccgaaagacatggggacatttaattgtggcgcatttgttgctgggattgtaaggggtgtactggatggtgcaggctttccggctgtacttacagcacattttgtacccgcagagggtcagcaacgacctcggacaaccattttaattaaatttgctg

SEQ ID NO: 2096 - DNA, 956 bp, Podocarpus macrophillus
gataagagtagggagaacaaagcagtatgcgaatgtgctggacaagcctctcggcaagggcaagcaagaggttagtctcaatgcattttcgttcctgttttcagagcttgtgcaatacaaccaaacccgggtcgacaatattgcagaattagagcgcagacttgaggatgcaggttatggcgtggggttgagagtattggagcttctttgctacagagagaagggtaacagaagggagacaaggctactgggaattctttcatttgtgcacagcacagtatggaagtctttgtttggaaaggtggccgattcccttgagaaaggaacagaacatgaagatgagtatatgattagcgagaaggaacttcttgtcaatagatttatatccgttcccaaggacatgggaaacttcaactgtggagcatttgttgcaggaattgtgaagggtgtcttagatggtgcaggttttccagcagtcgtgacagcacattttgtaccaatggagggtcagcctcgtcctcgaacaactattttaataaagttttctgaggaggtacttcaacgggaggcaagactaagttagatttgaaaagtaaaattatttttatgatcaaatttttggagtggaattgggatttgctttttcttgtgccagcagcagccatcagtttttgctcccttttcattattctatagttggacaatatgacattctgaaattgattgggatgtatataaagtgacaatcgcattccagttctttgtaggattgagtgctgaaggggcatacactgaaagtaagtggagaagattacaaagagattggactgagcctcaagatattgagttgaaaagttcactcatagatttgcaggcttatccaaatattttcaaattcatcaaatgtattctgtgaagcattggtttgtgtgattcataaatataaaatataattt

SEQ ID NO: 2097 - DNA, 1329 bp, Picea glauca
gaagaaagagtttaattttgtttgacacaggtataaagacttccctgttggccgatctggagttatatgctgaaaaacgcactgtgcatatgctggccaatgttctccggggttatatgctgaaagacgcgtgaaagcgggagggctttgggatttattgaacgagggcttacagtgttgtcgtagtcggataggatctgttggtgatcgttttaatggcggtcggcgggcatttcatggaaaaactgaaacagaaatggaatgctcaagaggacgagaaatggggccccaacatagaacggaaggagaggagggacatgattggagttgggagaacaaagcagtatgccaatgcactggagaagtcccttggcaagggcaagcaggaagttagtctgaatgcattcgcattcttgttttcagaacttgtgcaatacaaccaaacccgggttgacaatattgctgaactagagcgcaggttagaggatgcaggttatggtgtgggattgagagtactggagctactttgccatagagagaaggggaacaggagggagacaagattattaggcattctttcctttgtacacagtacagtatggaagtctttgtttggaaaggttgctgactcccttgaaaaaggaacagaacatgaagacgagtatatgattagtgagagggaacttcttgtcaatagatttatttccgtcccaaaggacatgggaaacttcaactgtggggcatttgttgcaggaattgtaaagggtgtcttagacggtgcaggtttcccagcagtagtgtcggcacactttgtgcccgtggagggccagcctcggcctcggacaactattttaataaagttttctgaagaggttcttcaacgggaagcaagattgggttagacttggatcaggaacccaaattgagaagagtcctcggtgagagaatgtgtctcagattttcatcttagcttctaggtggagtattattaaggaacattttgcacccttcgacaatatggtccataggtgaatgttatgtattttgatgttcaattgaaggcagttaagacacaatctcatacttgagaccaatatgggtggcatatagtgaaattgaattaatgtttatgaggtaattgggttctttgccccaaatgatgttaacttaaaaaaaatatgcttctcattcttgcactcatccgaagttggtcatatggattttttcaagagaatgagtcctattatgtgaaatattttttcctcgctcatctgtattatgcctactttgaagtagacaacctaaacattagattgtgtgacatggatg

SEQ ID NO: 2098 - DNA, 1100 bp, Lotus japonicus
aagcttacctcacccaaatgaaaaaaggtttctgaccgagagagagagagagagagagagaaacaccaggaggttgattcacgagtttctgaatcgcataggtaaggacgcaacgcacagtagattgttccaaatgcagcattgtcgtcgttgaagcttaggtcagtttcacgattcactcttgagcacaacaacacactgtttcagtgttcacgaaatccttccgtccttcgtcgccggccgccaagcaagagaagagaatgatcggcgtcggaaagatgaagcagtacagtaacatccttgacaagcccctcaccaagggcaagcaagaggttagtttgagtgcgttcgcattcttgttctctgagcttgttcagtacaatcaaacccaggtcgacaacatcggcgagctcgaacgaaggttggaggatgctggatatgctgttggggctcgagtactcgagctgctttgccacagagaaaagggaaacagaagggagacacggctgttgggtattctttcttttgtgcacagtacagtgtggaaagtattattcggaaaggggagctcctttatcaaaatttctgactcgctggagaaaggaactgaacatgaagatgaatacatgatcagtgaaaaagagctcctagtaaacaaattcatttctatcccaaaagacatggggacgtttaactgcggagcatttgttgctggaatagtacggggtgtcttggatagtgccggatttccagctgttgtaacagctcattttgtgcccatggaaggtcagcaacggcctcggatgacgattttgataaaattcgctgaggaggtgttacgtagagaagcaagattaggctgatgtttataacaagaattttcaagatatttatgatgctgtgtacaccaatatagaatgatgtggaactttcatactttgcatgtgaaatgcaacgtaggattttcgacggcctttctctaaactcttgtttttcattccaatttatctcatgctttgtagtcaagaatttatccttactgtctaaattatgatgtacaaaaggaaaaagtctggtgtttgttaattaatttcaattct

SEQ ID NO: 2099 - DNA, 893 bp, Amaranthus tuberculatus
gggacggaagtcacctcaccttgatcaatcatcctgctcctgcttgctgatttcccacttccggtggcattattttgaagagcttcactggattcattacaacatattaattgagtgaagcaagtttgaggaagagaacaccatgattggagcagggaagatcaaacaatatgctaatgttcttgacaaaccattaagcaaagggaaacaagaggtcagcttaagtgccttcacctttttgttttctgagcttgtacaatataatcaaactcaggtggacaatattgctgaactagaacgaaggtgaaatgttgcataacacttactaataggctagaggatgcgggatatgccgttggagcacgagttttggaacttctctgtcacagggaaaagggaaacagaagggagactcgcttgcttggaattctatcttttgtacacagcactgtttggaaggtgttatttgggaaggttgctgactcacttgagaagggaactgaacatgaagatgaatatatgatcagcgagaaagagctgctcgtgaacaggtttatatctataccaaaagatatgggaacattcaactgcggtgcatttgttgctggtatagtgaggggtgtcttggacaatgcaggtttcccagcagttgtaactgcccattttgttccagtggaagggcagttgcgaccaagaaccactatcttgataaagtttgctgacgaggtactgaaaagggaagcaagattaggctgatctctgcagggttatcaaatctgttagaacaggaagatgtggaagaagttagtaattgtgtgttagagagtaattcacaagatcagccatagtatttactatttagtagtatgcttgaacagctgaacctcttcagg

SEQ ID NO: 2100 - DNA, 1509 bp, Pinus taeda
cggccgggggtttgagagcgatatcaagagtctaagactgtgcctatgctggtcgatgctttctgggattttatgctgaaagacgcgtgaaagcgggaggcctttgagatctattgaacgaaggcttgcagtgttgtctaagtccgaaggatcagtttgtaatcgtttcaatggcggtcggcggccatttcatggaaaaacttaaacaaaaatggactgctcaagaggacgagaaatggggcgccagcatggaacggaaggagaggagagacctgattggagttggaagaacaaagccgtatgctaatgcactagagaagtcgctcggcaagggcaagcaggaggttagtctgaatgcatttgcattcttgttttcagaacttgtgcaatacaaccaaacccaggttgacaatattgctgaactagagcgcaggctagaggatgctggttatggtgtgggattaagagtactggagctactttgccacagagagaaggggaacaggagggagacacgattattgggcattctttcctttgtacacagtacagtatggaaatctttgtttggaaaggttgctgactcgcttgaaaaaggaacagaacatgaagatgagtatatgattagtgaaagggaacttcttgtcaatagatttatttcagtcccaaaggacatgggaaacttcaactgtggggcatttgttgcaggaattgtaaagggtgtcttagacggtgcaggttttccagcagtagtgtcggcacacttcgtgcctgtggagggccagcctcggcctcggacaactattttaataaagttttctgaagaggttcttcaacgggaagcaagattgggttagaattggatgaggaacccaaattgacaagagtccttggtgagagaatgtgtctcagatttcatattggcttctgggtgcagtattattatggaacattttgctttcttcgacgatatgttccataggtgaatgttatgtattttgatgttcaattgtgtgcagtgaaagcacaatctcatacttgagaccattacggctggcatatagtgaaattgaattaatgtttttgaggtaattgggttctctgctgtacgcaatgttaagttcaaaaaagtatgcttctcaatcttgcactcatctgaagttggtcatatggattttttcaagagaaagtcctattatgtgaaatattattttgtcgctcatttgtattatgcatacttaggatggaaagttgagaacctaaacattcatagtgtccttgaaaaataggtttctcaaaaatgtgaactagtgatgaattgttttacactttccccggatgagctttagatatatatcattgaaaggctagatgaatttctgacttaaaaatatttactttagtttgtggggttgagtgattggtttctgaggatgctggaatattaagatttacaggcttctcgcttgctgttgtgtggagagaatattcttttgagtttagtctaac

SEQ ID NO: 2101 - DNA, 1185 bp, Cedrus atlantica
cggataggatcgattagtgagcgttttaatggcggtcggcggtgcttttaatggaaaaactgaaacaaaaatggagtgctcaagaggacgagaaatgggggccaacacggaacggaaggagaggagagatatgattggagttgggagaacaaaacagtatgccaatgcactggagaagtccctcagcaagggcaagcaggaagtgagcctgaatgcattttcattcttgttttcagaacttgtgcaatacaaccaaacccgggttgacaatattgctgaactagagcgcaggctagaggatgcaggttatggtgtgggattgagagtactggagctactttgccacagagagaaggggaacaggagggagacgagattattaggcattctttcctttgtacatagtacagtatggaagtctctgtttggaaaggttgctgattcccttgaaaaaggaacagaacatgaagatgagtatatgattagtgagagggaacttcttgtcaatagatttatttcagtcccaaaggacatgggaaacttcaactgcggggcatttgttgcagggattgtaaagggtgtcttagacggtgcaggtttcccagcagtcgtgtcggcacactttgtgcctgtggagggtcagcctcgtcctcggacaactattttaataaagttttctgaagaggttcttaagcgggaagcaaggatgggttagactgggatcgggaacccaaattaacaagagtccttggtgagagaatgtcttagatttttatcttggcttctaggtgaagtattattaaggaacatttttcatcctcaacagtatggtccataggtgaatgctatatattttgacattcaattggaggcagtgaagacacaatctcatgcttgagaccattataggtggcatatagtggaattgaattaatgtctatatgaggaattgggttctttgcctcaaatgatgttgaatttaaagaaaaatgcttctcaatcttgcagtcatccccagttggtcatatgaatattttccagagaatgagctgtattatgtgaaatatttttgcctcgctgatctgtattatgccttgcatactctggatggcaagtagacaaattaaacattagattgtgtgaaatggatgcctgggtgtctttgaaaaataattttctcgtaaa

SEQ ID NO: 2102 - DNA, 743 bp, Parthenium argentatum
cacaatttaggcgtgttacgactatattttttttagtttctatgtcgtcttctttaacgagtgcatcaagaggtcctgtccagcgcaacgcgcaggattaatactgatcaacaagaagatcagtcagtctatacaagccagtaagggtttgtgtagttcaaacataaaggaagcaaatcaccactcgaacaagatgataggggcagggaagatgaagcaatacacaaatgttctcgataaacccctcagtaaaggcagacaagaggtgagtttaagtggatttgcttacttgttttcggagcttgttcagtataatcagactcaggttgataacattggggagctagaaaggagattggaggatgccggttatgctgttggagtacgagttttggaattactgtgccacagggaaaagggtaacagaagggagacacgtctgttgggcattttgtctttcgtacatagtacagtatggaaggtgctttttggaaaggtagcagactcacttgagaaaggtactgaacatgaagatgaatatatgatcagtgaaaaggagcttttagtgaacagatttatttctgtgccgaaagacatggggtcattcaactgtggagcttttgttgctgggatagttaggggtgttttagacaatgcaggattcccggctgttgtgactgctcattttgttccggtggacggtcaacaaaggccccggacaacgattttgataaagttcgctg

SEQ ID NO: 2103 - DNA, 629 bp, Ocimum basilicum
gcttgcgaaatctccagctacgactgctgcaagtctgcaacacacagtctcagtcgaaaactacgaaatcgaaccaagagaaaaatgatcggagttggaaaaatgaagcaatatccgaatgtgctagacagacctgtcggtaaagggaaacaagaggtcagtttgagtgcgttcgcgttcttgttttcggagcttgttcagtacaaccagactcaagttgacaacatagcagagctagaaagaaggttagaggatgctggctatgctgtgggagcaagggttctggaactgctttgtcacagggagaagggtaataggagggagacacggctattgggaattttgtcattcatacacagcacagtatggaaagtgttgtttggaaaggtggctgactctcttgagaaaggcactgagcatgaagatgagtacatgatcagtgaaaaggagcttcttgtcaacagatttatttcaattcccaaagatatgggcgccttcaactgcggagcatttgttgctggaattgtgaggggagttttggataatgccggtttccctgccgtcgtaacagctcattttgtacctgtggacgggcaacagcgggcgaggacaaccattttgattaaatt

SEQ ID NO: 2104 - DNA, 1042 bp, Gnetum gnemon
ctctgccgttccagtcctccaagcctgattggaatcccaaatcagggaagaagaagtgtacgcgattcaactatagttgattctgcaaaagttttggttgttgcattaatagcagcagcgtggaatcatgataggcgtcggcagaacgaagcaatatgtacatgtgctggacaggcctttgggcaagggcaaacaggaggtcagcctgaatgcctttgcatttttattttcagagcttgtgcaatatagccaaaccaaggtggataatattgcagaattggaacacaggttagaggatgctggttatggtgttggtctgagagtcttggagctactttgtcacagagaaaagggtaataggagagagaccagattgcttgggatcctttcatttgttcacagcacagtttggaaatccttatttggaaaggttgctgactcccttgagaagggaacagaaaatgaagatgagtacatgatcagtgagaaggagcttcttgtaaaccggtttatttctgtccctaaagatatgggaaacttcaactgtggggcatttgttgcaggaatcgtaaagggtgtcttagatggtgctggattcccagcggcagtgtcagcacactttgtgccagtggaaggccaacctcgtcctcgaacaactattcttataaagttctccgaagaggttctacaacgtgaagctagattagggtaaatctgaattaaaggcaaaatggctggccatactcacgactcaaggggatcttacaagagttgtttttgtggtggctatcaagcatgttttttaattcgacgtgtagctgtgtattttgaactgtggccagcatcttcaaggagtagaagtacaataatcataaatatttgatgaatatgtaagttgaaccttgatagcaaaacatctttttgaatgagcaccactttctttggcacgaattttaaggattttagaaagtgggttatggaatttgatgtatttatattgtttgaaatgacaagtatgttttggaaatagtattgtccttgg

SEQ ID NO: 2105 - DNA, 1292 bp, Abies balsamea
ctgatgtttttacgaggttgtatttcaaaagacacccggaagttggagggttttgttatatattgaacgagggtttacagtgtcgtttactcgtcggataggattgcttggtgatcgttccaatggcggtcggcggcgctttcatggaaaaactgaaacaaaaatggaatgctcaagaggacgagaaatggggggccaacatagaacggaaggagaggagagatatgattggagttgggagaacaaagcagtatggcaatgcactggagaaatcccttggcaagggcaagcaggaagttagcttgaatgcatttgcgttcttgttttcagaaattgtgcaatacaaccaaacccgggttgacaatattgctgaactagagcgcaggctagaggatgcaggttatggcgtgggattgagagttctggagctactttgccacagggagaaggggaacaggagggagacgagattattaggcattctttcctttgtacatagtacagtatggaagtctttgtttggaaaggttgctgactcccttgaaaagggacggaacatgaagatgagtatatgattagtgagagggaacttcttgtcaatagatttatttcagtcccaaaggacatgggaaacttcaactgtggcgcatttgttgcgggaattgtaaagggtgtcttagacggtgcaggtttcccagcagtagtgtcagcacactttgtgcctgtggagggtcagcctcgtcctcggacaactattttaatcaagttttctgaagaggttcttaaacgggaagcaagattggtttagattcggatcaggaacccaaattgacaagagtcctcggtgtgagaatgagtatcagattttcatcttggcttctaggtggagaattgttaaggaacattgtgcaccgtctgataatatgctccataggtgattgctatatattttgacgttcaattggaggtagtgaagacacaatctcatacttgagaccattatgggtggcatgtagtgaatttgaattaatgtctgaggaattgggttctttgtctcaaatgatgttaaatttaaagtatgcttctcaatcttgcactcatcccaagttggccatatggattttttcgagagaatgagccatattatgtgaaatatttttgcctcgctgatctgtatcatgcattgcatactttggatggcaagtagacaaccaaaacattaaaattttgtagaaatggatgctattagtgactttggaaaatagattctcataaatgtagaacaagaacct

SEQ ID NO: 2106 - DNA, 590 bp, Nicotiana benthamiana
gcgggaaaatgaagcagtacacaaacgtccttgacagacccctcagcaagggcaagcaagaggtgagtttgagtggttttgcattcttgttttctgagcttgttcagtacaatcagacccaagttgacaatattactcaattggagactaggttagaggacgctggttatgctgttggagcacggattctagaactcctctgccacagggaaaagggaaacagaagagagacacgacttctcggtattttatcatttgtgcatagtacagtatggaaagttttgtttgggaaggtcgcagactcacttgagaaaggcaccgaacatgaagatgaatatatgattagcgagaaggagctccttgtcaatagatttatttctattccaaaagatatgggtgctttcaattgtggagctttcgttgctggaattgtaaggggtgtgctggaaaatgcaggtttccaagctgtggtgacagcacattttgttcctgtggaggggcagcagcgaccacgtacaaccattttaataaagtttgctgaagaggtagtcactttttatacgcatatttttacccattattaatatatt

SEQ ID NO: 2107 - DNA, 899 bp, Phalaenopsis aphrodite
atcagatctcttggcttcggatcgcattttgttggatccgagctatcgggagaagctatgatcggcgttaggcggaaaatcaagcagtactcaagcgtacttgacaaaccctcagcaagggtaggcaagagaactagtgcagtacaatcagactcaagttgacaatattgcggagttagagagaagattagaagatgcaggctatgctgttggagctagagttcttgaactcttttgccatagagaaaagggtaacagaagggagacacgacttttggggattttatctttcgtgcacaccacggtgtggaaagttctctttggaaaggttgccgactcacttgagaaagggaccgagcatgaggacgaatatatgattagtgaaaaagaacttctggtgaaccgatttatatccatacccaaagacatgggagcatttaactgtggtgcatttgtagctgggattgtaaggggtgttttagacaatgctggctttcctgctgtggtgacggcacattttgtacccatggaaggtcaacaacgaccaagaaccacaattttaataaagtttgctgatgaggtactgcgcagggaagccaagcttgtttgaacttctggttgttatggtttttttttactaaacttaacaagaatttagctgtggaaaacctcttgatgtgctacaaaaatttcggcttgcctgatttgatttttctcttccttatctgatcagtatttttttaatgataaagttgccaaggcttgaggaattcacaaagttttttatttgtaacatctagatatcaatattgggatctattgtatacatcaatctcatactttccattctcagttgacttgtacctaatatatttgccattatggtaccctactgaagg

SEQ ID NO: 2108 - DNA, 959 bp, Pseudotsuga menziesii
ttgaacggaaggagaggagagacacaattggagttgggagaacaaagcagtatgccaatgcactggagaagtcccttggcaagggcaagcaggaagttagtctgaatgcatttgcgttcttgttttcagaacttgtgcaatacaaccaaacccgggttgataatattgctgaactagagcgcaggctagaggatgcaggttatggtgtgggattgagagtactggagctactttgccacagagagaaggggaacaggagggagacgagattattaggcattctttcctttgtacacagtacagtatggaagtctttgtttggaaaggttgctgactcccttgaaaaaggaacagaacatgaagatgagtatatgattagtgagagggaacttcttgtcaatagatttatttcagtcccgaaggacatgggaaactttaactgcggtgcatttgttgcaggaattgtaaagggtgtcttagacggtgcaggtttcccagcagtagtgtcggcacactttgtgcctgtggagggccagcctcggcctcggacaactattttaataaagttttctgaagaggttcttcaacgggaagcaagattgagttagacttggactaggaacccaagttgacaagagccctcaatgagagaatgtctcagatttccatcttggcttctagggagagtattagtaaggagcattttgcatcctttgacaatacggtccatttgtgaatgttatgtgtttttgacattcaattggagttagtgaagacattttcatacttcagaccattctgggtggcatatagtgaaattgaattattgtttatgaggtaattgggtttgccccaaatgatgttaaatcaaagaaatatattcttctctatcttgcactcatcccaagttggtcatgtggatttttttcaagagaataagcctattttgtgaaatattt

SEQ ID NO: 2109 - DNA, 706 bp, Flaveria ramosissima
cagacaagaggttagtttgagtggatttgcttatttgttttcggagctcgttcagtacaaccagactcaggttgacaacattggggaactagaaaggagattggaggatgctggctatgctgttggagtacgagttttggagctactgtgccacagggaaaagggtaacagaagggagacacgtttgttgggcattttgtcttttgtgcatagtactgtgtggaaggtgctttttggaaaggtagctgactcacttgagaaaggcactgaacatgaagatgaatatatgattagtgaaaaggagcttctagtcaatagatttatctcagtaccgaaagacatggggtcattcaattgcggtgcttttgctgctgggatagtaaggggtgttttagacaatgcaggatttccggctgttgtgactgctcactttgttccggtggacggtcaacaacgaccacgtactactattttgataaaatttgctgaggaggtactaagaagagaagcaaggttaggatgatctcttgttatgcgttgatgggctttgtggtttggatattgactgattgcattacttatatgctttaaagaatcaaattgtaacaaagtttattaaaagttgtagcaccaagagttctttaacattcatcctagcaattgtatgacttctaaattctcagggaaggggtgttgttttactaca

SEQ ID NO: 2110 - DNA, 685 bp, Pisum sativum
taacaagggcaagactgaggttagtttgagtgcatttgcgttcttgttctccgagcttgttcagtacaaccaaactcaggttgacaatatcggcgaactcgaacgaagactggaggatgctggatatgctgttggggctcgtgttcttgagctactatgccacagagataagggaaacaggagggagacacggttgttgggtattctttcttttgtacacagtaccgtgtggaaagtactatttggaaaggtagctgactcattggagaaaggaactgaacacgaagatgaatatatgatcagtgaaaaggaactcctagtaaacaaattcatttctatcccaaaggacatgggaacatttaactgcggtgcattcgttgctggaatagtccggggtgttttggacggtgccgggtttccagctgttgtaacagctcattttgtgcccatggaaggccaacaacgacctcggacaaccattttgataaaatttgctgaagaggtattacgccgagaagcaagattaggctgatatttatactgagatttttcaattaagatatatctgtaatgctgaacgccaatatagaaagatgtggaactttcgcctctgcgtgtgaagagaattttaggattctgaccagcctatccttttgatatgtgtacttcaaaatcatttttcatt

SEQ ID NO: 2111 - DNA, 705 bp, Sequoia sempervirens
tgctagataagcctctgggcaagggcaagcaagaggttagtctcaatgcttttcattctgttttcagagctcgtgcaatacaaccaaacccgagttgacaatattgcagaactagaacggagacttgaggatgcaggttatggtgtggggttgcgagtattggagctcctatgccacagagagaagggaaacagaagggagacgagactattgggcattctttcatttgtgcacagcacagtatggaagtctttgtttggcaaggtggctgactcccttgagaaagggacagaacatgaagatgagtatatgatcagtgagagggaacttcttgtcaatagatttatatcagttcccaaggacatgggaaattttaactgtggagcatttgttgcaggaattgtgaagggtgtcttagatggtgcgggtttcccagctgtggtgacagcacattttgtccctgtggagggtcagcctcgaccacgaacaactattttaataaagtttgcagatgaggtacttcagcgggaggcaagattgagttaaacttggaaaagagactcagattctcagaatcattagtatggacagggaacctcagattttaatcttggtttctgttggcagctgcaactgcctgttttcaagtttaattgaaactaaagagatatttactgtccaattttcttttaggtttgaaattgt

SEQ ID NO: 2112 - DNA, 833 bp, Musa acuminata
gcaaatcgagggaccgcgaaagggggaatagaggtgaggggagggaagaagccatgatcggcgtgggaaagatcaagcagtacaccaacgttctcgacaaacccctcagtagaggccggcaagaggtttttgtcgatctgttcttgaaatggtcgctcgcaattcccgatctccacccagtagtcaagaaatcgtgcatcttcgcgcgatctcatgtcagcttgagtgcattcgcatttttgttctcggaactggtgcaatacaaccagactcaagttgataatattgcagagttggagagaaggcttgaagatgctggctatgctgttggagcaagagttcttgagcttctttgtcatagagagaagggtaacagaagggagacacgtctgcttggaattttatcttttgtgcatagtactgtttggaaggtgctatttggaaaggtggcggactcacttgagaaaggaactgaacacgaagatgagtacatgataagtgaaaaagagcttttggttaaccgatttatatcggtaccaaaggacatgggagcattcaattgtggggcatttgttgctggaatcgtgaagggtgtcctagatggtgctggttttcctgctgttgtgacggcacactttgttccagtggatggtcaacaacgaccacgcactacaattttaataaagttcgcggaagaggtgctcaggagggaatcaagactgggctgatcctctatggtgttatttagcaagttgaggcataccaaagcacttctgattacttctgcagctacttggatctttttcttgttgatgtgtgcaatctaactccca

SEQ ID NO: 2113 - DNA, 981 bp, Amorphophallus konjac
catttgcattcttattttcagagctggtgcagtacaatcaaacacaggttgacaatattgcagaattggaacgcaggctagaggatgcaggttatgctgttggtgcaagagtacttgagctcctttgccacagggagaagggaaacagaagggagacacggttgctggggatactatcttttgtacatagtacagtgtggaaggtgctctttggaaaggtggcggactcacttgaaaaaggcactgaacatgaagatgaatacatgatcagcgagaaggaactacttgtgaacagatttatttctgtccccaaagacatgggtgcattcaattgtggtgcatttgttgctgggattgtaaggggtgttctggacaatgctgggtttccagctgttgtgactgctcattttgtacctatggaaggacagcaacggcctcgtaccaccattttgataaagtttgctgaggaggtgcttcgaagggaagcgagactgggataacggtgtcctctgctgtctgtgtcaaggggacatgaaagtatcttcgagttgttccttgataatcagctgggtagatcgattttcactcggttacttaagatttttgctattactcttgttcagaggatattgctgcttttaaatcggagttttcacctccaaagaagtgagacagagaggtgttgtacatttattctattgtaatctatgtttgatattcagtaatgaagttgatgcattgtcatatttgaaggacagaacttcaaggaagttagatttcccgataaaatgcggataaaaatttaaaggctaactcgaagtgtggtttttaacgtcaaaccgttgtactgttttagaaactttttaaataaatgttcgtaccccttttacgaaagggggtaccggttgttagtacaaggaaatttcgaattctagtcttacaatttaattgcttttttccggtaaaatgtaagaagtcgta

SEQ ID NO: 2114 - DNA, 940 bp, Adiantum capillus-veneris
tcggtaacaagagagcactcttacaagaagcactcagatccaatcggcaggcatgataggacgaagcaagcagtacgttaatgttgtggacaagccccttggcaagggcaagcttgaggttagcttaaatgcatttgcatttctgttttcagagatggtgcagtacaatcaaactcgtgtagacaacattgctgaacttgagcacaggcttgaggatgcgggttatggtgttggcctcagaatgttagagttgctttgtcatagagagaagggaaatagaagagaggtaaggttgcttggcattctatcttttgttcacagcaccctatggaagtctcttttcgggaaggttgcagactctttggaaaaaggaactgaaaatgaagatgagtacatgatcagcgaaaaagagctacttgttaacaggtttatttctgttcccaaggatatgggagcttttaattgtggggcatatgttgcaggcatagtaaagggtgtgcttgatggctcgggcttcccagcaagggttacagcacacttcgtacctgtagaaggtcaaccacggccaaggacaacgattttgatcaagtttacggaagaggttttgcaaagagaggcccgtctcagctaataggagctgtggttaaccaccctcctattccttttcttcattggccccctccccctttccttttattgcccctatttgccattgtattgaagggtgtctgcaatgaaattaactctggcaggataacagagcttaaggtaagaggccaacttttatgtgcaatatggatcttgttcgtgaagcagaggcacgtgaacaatgatgaagaaatgtaaagattttggataatacaaagtctctctgatcacgggaagacaaatggactgaccctcttaaacttggtggaggcagaaaagcttttttgggtcc

SEQ ID NO: 2115 - DNA, 589 bp, Glycyrrhiza uralensis
gctgttgagtgtgggtttggtgtgtgagttggaaactggcacagcagtagcagcaagaggaagaggatgatcggcgtcggaaagatcaagcaatacagtaacgtcctcgacaagcccctcaccaagggcaagcaagaggttagtttgagtgcatttgcgttcttgttctcggagcttgttcagtacaaccaaacacaggtcgacaatattggcgagctcgaacgaagattggaggatgctggatatgctgttggggctcgagttcttgagctgctttgccacagagataagggaaacagaagggagacacgattgttgggtattctttcttttgtacacagtacagtgtggaaagtattatttggaaaggtagctgactcactggagaaaggaaccgaacacgaagatgagtacatgatcagtgaaaaggaactcctagtaaacaaattcatttctatcccaaaggacatgggaacatttaactgcggtgcatttgttgccggaatagttcggggtgttttggatggtgctgggtttccagctgttgtaacagcacattttgtgcccatggaaggtcaacaacgacctc

SEQ ID NO: 2116 - DNA, 933 bp, Fragaria vesca
ttttgatgcttgtttcaggtcagtttgagtgcatttgcgttcttgttttctgagcttgtgcagtacaatcagacccaagttgacaacattgctgagctagaaagaaggctggaagatgcaggctatgctgttggagctcgagttctggagcttctttgccatagggataagggaaacagaagggagacacgattattgggtatcctatcttttgtgcatagcacagtatggaaggtgttatttggaaaggtagctgactcacttgagaaaggcactgaacatgaagacgaatacatgattagtgagaaggaactccttgtgaacagatttatttcaattccaaaagacatgggaacctttaattgtggagcctttgttgctggaattgtaaggggtgttttggaaggtgctggttttccagctgtggtaacagctcatttcgtaccagtggaaggtcagcagcgacctcggacaaccattttgataaaatttgctgaagaggtactacgaagggaagcaaggttgggttgatgctgagtccacaatcatcatatcttacatctcgcttaagattccccttattatgattgaaagtagtgatctcacatctgggttgtcaaacaagtgacttttcacctcgaatcatacttgtgttagctatttcgcgatgctgatttgaaagtagcaacgattgtaatttgtaagcatagctgtgatccaatgaggagagaagtagaaaaagaacaaggaaagatacagttacagatgcgtataattttgttattggtaggaactttgatttatggccttgtggttaagctgcagaatgtggattagtacttcaatcaaccacaatatcttcttatgtatttaatctgtgttggtgcggaagattagagttggcttgttactgatattttttatttgcatctg

SEQ ID NO: 2117 - DNA, 1042 bp, Pteridium aquilinum
cagatcgagcaggcatgatagggcgaagcaagcaatacgttaatgttgtggacaggcccctcggcaagggcaagcttgaggttagcttgaatgcatttgcatttttattttcagagatggtgcagtataatcaaactcgtgtggacaacattgctgaacttgagcacaggctagaggatgctggttatggtgtcggtctgagaatgctagagttgctttgccatagagagaagggaaataaaagagaggtaaggttgctgggcattctttcttttgtacacagcaccctatggaagtctctttttggaaaggttgcagattctttggagaaaggaactgaaaatgaagatgagtatatgattagtgaaaaagatcttcttgttaacagattcatttctgtaccaaaggatatgggaactttcaattgtggggcatatgttgcaggtatagtgaagggtgttcttgatggctcaggctttccagcaagggtaacagcacattttgtacctgttgaaggtcaacagcgacctagaacgacaattttgatcaaatttgcggaggaggtgcttcaacgagaggctcgcctgggctagtaggagctttggcttgtgccaccaaaaggtgttcttttgtgttgtgaggatgctagcttatattcgtgcacctctcccggtaagattggtctgaagagcatgcaagccttttgctgaattcctagtgattatactcgactgtgggagcaggctcactaatgattgagaggcaatatttgagaggcaggagtggggtgattattatatggtgcattagaaaggaaaaaaataaagaggttgtggtgaaaaggtctactttgaaacaatcaatgaagtaatgtagagtaaagtgtagaaaagataatacagagtttattgccaaaagaatgcacagaagacaataccgtctctgttacttaaaatagtgtaaaccaattggattatggtgatgtggagaaaaattgttgcaatggttccaatgatatgtatgcgtgctagagaaaaaagaa

SEQ ID NO: 2118 - DNA, 1205 bp, Ceratodon purpureus
tgttgatcgatcaagtgttgcctcgactcgcacagcgttgatcggcttgcgcgctcttgcacagcgcctggatccgtggtgtagctgcttcggaagcgatgataggggtcggcagagccaagcagaacttgaacgttgtggacaggccgctcgggaagggcaaggccgaggtgagcctcagtgcgtttgcatttttgttttccgagctggtgcagtacaaccaagggaaagtggagaatatttcagatttggagcacaggctggaagaagccgggtatgcagttggcattcggatgcttgaattgttatgccacagagagaaggctaacaggagagagacaagagttctcggaattctttcatttgtccatagcactgtgtggaagtctctcttcggaaaggtggcagattcgttagaaaaaggtacggagcatgaagatgagtacatgataagcgaaaaggagcttattgtaaacaggtttgtttcggttccacaaggtatggggggcttcaattgtgggacgtttgtggctggtattgtcaagggagttttggatggagctggctttccagcaagggtaacagctcattttgttgcagttgagggccaagctcggccccgcacaaccatactgattaaatttgctgaagaggttgtgcagcgagatgcccgtcttggctgaggcgacatcttggagccgctgtcaagtccttcagcatcaaaacgtgaagtaaattactctcaactcaatggatacccgtttaggagggatttgtagcacaaatctgaagcttgctcgtaataggagcacctaatccgctgtttttgagccatgtagggcatctatccgcactcgactagggctacagtctcccaggctagtgctccactgttctccccttcgtcgaagagaggaaacgggctcggtatttaagctgactacttagcacttggttttccttagtttggtccaaaatgtggtccacttctacttcagtggccatgtcggtagtcctagctgctgagatagcagcactacatttaaacctagtcagcagaaagtgacgcggtttctgttcgcagaagcccagatttttcatgatgatatggtgctgatacggtgctgtccactgtcatctgaacttgtaatgaacagaattatcataaaagccgtgtataaacaatttcgcaatcagcggatttc

SEQ ID NO: 2119 - DNA, 991 bp, Physcomitrella patens
tgtcgatcgacacttgcgggattttgagtagattcacgtagatagttgagcggatcggagcggataggagaggagaggagagagtggagttggttacgatttgtgtggtttctggttgaggagcaatgataggggttggcagggcgaagcagaacttgaatgtggttgacaggcccctcgggaagggcaaatctgaggtaagcctcagtgcgtttgcattcttgttttcagagctggtgcagtacaaccaaggaaaagttgaaaatattgcagaattggaacacaggttggaagaggctggattcggagttggtatccgtatgcttgagttgctgtgccacagagataaggctaacaggagggagacgagagttctaggcatcctttcattcgttcacagcacagtttggaaatctctttttgggaaggtggcagattctttagaaaagggcacggaacatgaagatgagtacatgatcagtgagaaggagcttcttgttaacaggtttgtttcagttccaggaggtatgggaggtttcaattgtggcacatttgtagcgggtattgtgaagggagtgttggatggagctggctttcctgcaagagtaacagctcattttgttgccgtggagggccaagcgcggccccgcacaactatattaataaaatttgctgaagaggttgtgcagcgagatgcccgtcttgcctgaaggcaacatctgggagcttcgtcaagcctttgaatatttatgattaaatagcattggtcttaattgaacggaattttttttgcttgagatttgatactcaatacttaaaaagcttttctctagcgctgattttcttagttcctagggagctgctacgtatttgagtgaagcctcaatctgctctatatcattaaaaagggctgaacaggctcaacgttcaatcttttataccataatgtgcttgcgtaattttgaagtgggcgtattttgtttagcttcag

SEQ ID NO: 2120 - DNA, 2353 bp, Sorghum bicolor
ggttggtctaccagtctagcgctatctggcggctatcaacaacttcctagctcgctcgtcttgtatctgcatggacaggttcacatctcactggcacagccgaccccaaaccgcgcgcacccgtctcaaaagcaaaaacacccctcgcgtgctcaggcagcttcaaaaccatcatcaaacacccgttgcggcttgcgccagcgggcagcccgctctcctcacctcggctcctctcccgcagtcccacacactcccacgcgcattccgccgcgcggctcccgagagaaagaaagagagagagaggagatggccaggcacgccaagacggactccgacgtgacgagcctggcggcgtccacgccgccgcggtccccgcgtggccgcccggcctactacgtgctcagccccgccgcctcccacccggacgtccacgtcggcggcgtcgcggggaccaccccggccgagtcgccgctccactaccacttccaccaccaccaccgtggctcgagcggcggcgtcggcgacggcggagccggcgccgggggcggcggcatgcaccactcccgggagtcctccacggggcggctcctcttctccgaccagctccgctccggcggcgacgtcgccgccgtggtgagcgtcccctggcgccggctcgggcacggcggcagcggcgcgggcagcgtcggggacgacgacggcggcgcgtccctgacgcgcggcgggttcgcggactcgccgtggcggtgctacgcgctcggcgcgttcgcgttcgtcgccgtgttcgccttcttcctgctcgtgctctggggcgccagcaggtcgtacaagcctcatgtcgtcgtcaagagcgtggtgttcgagtcgtaccacatccagggcggcacggaccggacgggcgtcccgacgaagatgatgtcggtgaacgcgacggtgcggctgcgcttccgcaaccggggcaccttcttcagcctgcacgtcacggccacgccgttcctcctcttctacggcgacctcaccgtcgcctccggagacatggcggagttctaccagccgcggaagagcgggcggatggtgacggtgtccgtggtggggaagcaggtgccgctctacggcgcgggcgcgggcctgcacagcaagcccaacaacggccgcctcggcgccgcggtggtgcccgtcgagctcgacctcgtgctgcgcgcgcgcgcccacatcctcggcctcctcgtcaagtccaagttctaccgccgcgtgcactgccgcctccacatccacgaggcgcacctcggcaggcccgcacgcggcgtcgccgccggatgccagtaccacgacggcctccgatgatcgacatcattgggtcgggtccggctccggcagggttgttgaactgggactttcgatgtgggtccattgggtctgatgatggattcatgacaggaaaatgaacccgttctaatgtaacggggccgtcgacattctgggtgtagcttggctagtgtgacagtatattgcattataattaattcctctgccgaaaccatgaagaaccgcagtgactggtggctaatgcgaccagtattgctacgggcggcttccgttaatattctagttcccgtatcacgttcccgctctcccaatcgtgggagcgggggtctcccactctctctggaaactgccctatcaaagacatgtataaatacatttatattgtttatcaataaagtagatcctttcacttttactgtaggagcagttcgtaaaataagaacagggcgagttcgtcaaagaaggaaagcgaaaggtacaaagcctccaatgcagtatgttccttcgccgcaacttgcttatcaattaattactattttttaaaataaaaatgaaaagtgtaaaattgccttcaaaatcaaagtcacttcaaacaagtcagaaatgtgtgttaagatgtctggttcggttcgagtatagcaattaagctacatgtataatttatagggacgtaaaatacacttctcctttttttctagcatattataaaccactactgttctccaaattctcaaagcccacatgactctaggccgaaatgctaggcctactattgtctggtcgtgaagtcgtgaacagaagagaaaaggcccaagttgaaaactccgaacagagttgctgctcggactctgagtatgagtaggtcggttgcctgtttagtaccacatcgcgtggtttagctaacacacgcccaaaggaacctatatattgaggctgtgggcgttcaaataaactcatctttgcgcttggggcaatgacgcagctcatgaggtaataccgaggcgcgtcaattgctggttgaaaacta

SEQ ID NO: 2121 - DNA, 2482 bp, Zea mays
gtcgcgttcaacaacgcatcagcagagagtgtgctaaaaaggagccagtctcgcaggtcgagtgagatatggcgtcggagatgagcaagaacgtgaaggccctcgacgagcaggaggtcacctcgcagcactcgcgcgcccagaccagcgccgccgccgaggagcaacagcagcagcaggcggtggatccgctggcgcgacagtcgtccatcatgtcgctgacgctggaggagctgcagaactcgctgtgcgagccgggccgcaacttcgggtccatgaacatggacgagttcatggccaacatatggaacaccgaggagttccaggccgccacggccggctgcaacaaggagggcgcgtatcgggagccggtgcccgtggcgacgacgacgagcacagctgtacacaaacaaaagcttgaggcctcgagaagcacccaccaattgggagacgacggtgcacgaaacgaaatacacgactacacgagccgagaagaagtgagacgagccagtaggaaagcgccaagcaagcagcgccactgcaccaggagctgcaacgcaagcgcatccactcatcatcgtccccctgcccggtcgctccactcccctccccccgcgcgcacaaacaacagcagcccgatgtccgccgccgcgtcctctgccaccgcctgcttcctctccccgctcccgccgcctcgccgcccgcgtcatttcctcaggcacctcgcgcgcgccgcggtcaccaagcccgagcccgcctccgcctcctcgctcgccctcccctcgccgtggctttgggcccggcggctctgcgagctggtccccgccgaagccgggggccggcttctgtcgtcggccgcgggctccctcatcgtcgcgctcgcctcagcgtcgcttgtcctaggtgacaccggcgccgcctccgcgttcgtcgtctccacgccgcggaagctgcaggcggacgagctcgccaccgtgcgcctcttccaggagaacacgccatccgtagtctacatcaccaacctcgccgtcaggcaggacgcgttcacgctcgacgtgctcgaggtgcctcagggatccgggtccgggtttgtctgggataagagcggccatatcgtcaccaatttccatgtcatccgtggcgcgtcagacctgagggtgacacttgctgatcagtcagtgtatgaagcgcaagttgttggatttgaccaggacaaggatgttgctgttttgggtatcaaagcaccaaagaataaactaagacctatacctgttggtgtgtcagcagacctactggttggtcagaaagtgtatgccattggaaacccatttggccttgaccacactcttacaacaggtgttatcagtggattgcgtcgagaaatcagttcagccgccacaggacgtcctatacaagatgtgatacagaccgacgctgctatcaaccctggtaacagcggtggtccactccttgatagttctggaaacttgataggtgtaaacactgctatatactcgccctcaggagcatcatctggtgttgggttttccattccagttgacacagtcgggggcattgtggaccaactcataaaatttggcagggtgacaagacctattctgggaataaaatttgccccagatcaatccgtagagcagcttgggttgagtggagtgcttgtcttggatgctcctccaaacggaccagctggaaaagcgggtctgcaagcaaccaaacgagatccctatggccggcttatcctgggcgatataattacctctgtgaatggtacaaaggtgacaaacggaagcgacttgtataggatactggaccagtgcaaagttggagacacggtgaccgtggaggtcttgcgtggcgaccataaagagaagatccctgtggtcctggaaccgaaggctgacgaatcctagtactagtaaacccagcttcttcttctgtaccatagcatcagtttctcgctttggtgcagaggcgcaaacacacaaggcgtcttagcattttcgccctccacggggttcattcgctgtacataattcatgcatgtagatgttgttaccatctcttgtctggtggaaaaggggtatccagactccattccaggttgccgtcgtgtattatttaatacgatgctcatcagatgaccatccaggccggtcaagggacctgcaggccgatgattgaactcgctgatgtcacagatcaccaaacccgttttttgacgaaaaaaaaagattaattgtgtacgtaccactctgcttttacgaaattggctggttagttcaatttgatgccatgtggtgacatgaaaatgtactagtttcatgacatagttctaactaaaaattagaaactttaaactacgtgcccttagttcagtatcacttctcagttctatctatctctgtagtaattgataagatatttttagtgctacacaaggatagaattgaggagtggtaat

SEQ ID NO: 2122 - DNA, 1952 bp, Sorghum bicolor
tgccccgcaagcacaagcaacagcagcccaatggccgccgccgccgccgccgcgtcctcctctgccgccgcctgcttcctctccccgctcccgccgccacgtcgcccgcgtcatttcctcaggcacctcgcgcgcgccgcggccaccaagccggcgcccgcgcccgcgcccgcctccgcctcctcgccgtggccgtgggcgcggcggctcggctcgctggtccccggagagaccgcgggccggctgctgtcgtcggccgcgggctccctcatcgtcgcgctcgcctccgcgtcgctcgtcctcggcgacgccggcgcggcatccgcgttcgtggtctccacgccccggaagctgcaggcggacgagctcgccaccgtgcgcctcttccaagagaacacgccctccgtcgacgcgttcaccctcgacgtgctagaggtgccacaggggtccgggtcgggctttgtctgggataagagtggccacatcgtcaccaatttccatgtcattcgtggcgcgtcagacctcagggtcacacttgctgatcagtcagtgtatgaagcgcaagttgttggatttgaccaggacaaggatgttgctgttttgcgtatcaaagcaccaaaggataaactaagacctatacctgttggtgtgtcagcagacctactggttggtcagaaagtatatgccattggaaacccatttggccttgaccacactcttacaacaggtgttatcagtggattgcgtcgagaaatcagttcagctgccacgggacgtcctatacaagatgtgatacagactgatgctgctatcaaccctggtaacagtggtggtccactccttgatagttctggaaacttgataggtgtaaacacagctatatactcaccctcaggagcatcatctggcgttgggttttccattccagttgatacagttgggggcattgtggaccaacttataaaatttggcaaggtgaccagacctattttgggaataaagtttgcccctgatcaatctgtagagcagcttggattaagtggagtgcttgtcttggatgctcctccaaacggaccagctggcaaagcgggtctgcaatcaaccaaacgagatccctatggccggcttatcctgggtgatataattacctctgtgaatggtacaaaggtaacaaacggaagcgacttgtatcggatattggatcagtgtaaagttggggaaacggtgaccgtggaagtcttgcgtggcgatcataaagagaagatccctgtggtcctggaaccgaaggctgacgaatcctagtaaacccaggttcttctgtaccatagcctcagtttctcacttaggtgcagaggcgcaaatacacaaggcgtcttagcattttcgcctgccacgggattcgttcgttgtacataattcatgcctgtagatctcactctctctttgtctggtggaaaatgggtgtccaggttgccgtaatgccgtcgtccgcatttcctgtgtgcgctatagcatgtacgcatcctatagtgctttagagtttatagatggcctaccttattaatacgagatgttcatcagatgaccatccagggaagggaactgcaggtcgatgaatgaatgaacttgctgatatcacagatcacctaaacctttttgaccaaaaaaaaaatacgtgctggcttttatgctggagcagttggcatcgttgcaattgcaatcctaggtgcgatcccggaacacaacagggatcaatgtgatagctatgccgtgacccgtgacgtgccatagatcgctggggttactatcctacctacattatctagagcttgtcgtggaaatcgggaaaaaaacagttgcagaaaaggagaggactgaaggagatgtcccgttacgcgcgacaatatatctatctggagaaaaaaaaaaagggggggggggggggggggggg

SEQ ID NO: 2123 - DNA, 2124 bp, Panicum virgatum
actggcagccttgcaacgtcaggaagggaatgcacggattatccatcgaagtgctaatcttttatttttgattcaaatagaagtgctagtcttaggaacggtgaaaatctaaccgaccagatcgcgtaataactatgccatgtgcaatctatggaccaaagcttgagctgtcgagaagcatccaccatcatggaccacggggaggggaagcaccaacccgaagcagcacgaaccgagggtgaccgtgagcgagaccaaaattttgggaagagacccaccagccagtagcagagcgccaagcaagcgccgggcagcaacgcagcgcatccactcatcgtccgggagtccctccaccacagccactagccagcaaggccgcggctgcgctcgcccccgctccccttcccgcacgcacaagcgcgaccagatggccgccgccccgtcctcctctgccgccgcctgcttcctttcctccccgtgccccctgcctcgccgcccgcgccatttccccaggcacctcgcgtgcgccgcggcctccaagcacgcgcccgccgcttcctcctcccgctcgctcgccctcccctctcccgcgccgtggccgcggccgcggcggctagccgagctggtccccgccgaggcggcgggccggctgctgtcgtcggccgcgggctccctcatcgtcgcgctcgcctccgcggcgctgatcctcggcgacgcaggcgcggcctccgcgttcgtggtcgccacgccgcggaagctgcaggcggacgagctcgccaccgtgcgcctcttccaggagaacacgccctccgtcgtctacatcaccaacctcgccgtgaggcaggacgcgttcacgctcgacgtgctcgaggtgccgcaggggtccgggtcggggtttgtctgggataagagtggccatatcgtcaccaatttccatgtcatccgtggcgcgtcggacctcagggtcacacttgctgatcagtcagtgtatgaagcacaagttgttggatttgatcaggacaaggacgttgctgttttgcgtatcaaagcaccaatggataaactaagacctataccagttggtgtgtcagcagacctactggttggtcagaaagtatatgccattggaaatccatttggccttgaccacactcttacaacaggtgttatcagtggactgcgtagagaaattagttcagctgccacaggacgtcctatacaagatgtgatacagactgatgctgctatcaaccctggtaacagtggtggtccactccttgatagttcaggaaacttgataggtgtaaacactgctatatactcaccctcaggagcatcatctggtgttggtttttccattccagttgatacagttggaggcattgtggatcaacttataaaatttggtaaggtgacaagacctattttgggaataaaatttgcccctgatcaatctgtagagcagcttggattaagtggagtgcttgtcttggatgctcctccaaatggaccagctggcaaagcaggtcttcaatcaaccaaacgagatgcctacggtcggcttgtcctgggggatataattacctctgtgaatggtgcgaaggtaacaaatggaagcgacttgtaccggatattggatcagtgtaaagttggggaaacggtgactgtggaagtcttgcgtggtgaccataaagaaaagatccctgtggtccttgaaccaaagcctgatgaatcataggagaaaccaggttcatctgtatcatatgctcagctgcttacttaggtgcagagatgcaaattacaaggccttagcatttcgcctaccacgggattcattgtacataattcatacttgtaaatcaaactatctctggtctggtggaaaaggttatccatgttggcctcaatgctatagtgtgtcatgcttgttttttcttgggtcgcttcaatacagatgtcccatagatcatactcatatctgtctggtctggggcatgtatatacatcatacagttcttagatggcctaccttattaatactgtgttcatcagaggaccctctagagaagggaactgcagcttgatgaactttctgatatcacagatcacctaagcctttttgac

SEQ ID NO: 2124 - DNA, 1607 bp, Panicum virgatum
agccagcaaggccgcggttgcgctcgccccgctcccctcccgcacgaccagatggccgccgccccgtcctcctctgccgccgccgccgcctgcttcctctcttccccgtgccccctgcctagccgccagcgccattaccccaggcacctcgcgtgcgccgcggcctccaagcacgcgcccgccgcttcctcctcccgctcgctcgccctcccctcccccgcgccgtggccgtggccgcggcggctagccgagctggtccccgccgaagtggcaggccggctgctgtcgtcggccgcgggctccttcatcgtcgcgctcgcctccgcggcgctgatcctcggcgacgccggcgcggcctccgcgttcgtggtcgccacgccgcggaagctgcaggcggacgagctcgccaccgtgcgcctcttccaggagaacacgccctccgtcgtctacatcaccaacctcgccgtgaggcaggacgcgttcacgctcgacgtgctcgaggtgccgcaggggtccgggtcggggtttgtctgggataagagcggccacatcgtcaccaatttccatgtcatccgtggtgcgtcggacctcagggtcacacttgctgatcagtcagtgtatgaagcgcaagttgttggatttgatcaggacaaggacgttgctgttttgcgtatcaaagcgccaatggataaactaaggccgataccagttggtgtgtcagcagacctactggttggtcagaaagtatacgccattggaaatccatttggccttgaccacactcttacaacaggtgttatcagtggactgcgtagagaaattagttcagctgccacaggacgtcctatacaagatgtgatacagactgatgctgctatcaaccctggtaacagtggtggtccactccttgatagttcaggaaacttgataggtgtaaacactgctatatactcaccctcaggagcatcatctggtgttggtttttccattccagttgatacagttgggggcattgtggatcaacttataaaatttggtaaggtgacaagacctattttgggaataaaatttgcccctgatcaatctgtagagcagcttggattaagtggagtgcttgtcttggatgctcctccaaatggaccagctggcaaagcaggtcttcaatcaaccaaacgagatgcctacggtcggcttgtcctgggggatataattacctctgtgaatggtacgaaggtaacgaatggaagcgacttgtaccggatattggatcagtgtaaagttggggaaacggtgaccgtggaagtcttgcgtggtgaccacaaagagaagatccctgtggtccttgaaccaaagcctgatgaatcataggagaaaccaggttcatctgtatcatatgctcagctgcttacttaggtgcagagatgcaaattacaaggccttagcatttcgcctaccgcgggattcattgtacataattcaattttacagtgcttggagattttatgagccgttgatggatctagatctaatggtttaaaaataagaggaaccagttatgaagaactaaacatgtgggccaggaactaatattttgtgggccaggaacc

SEQ ID NO: 2125 - DNA, 1595 bp, Setaria italica
tccactcccctcccgcacaagcgcgaccagatggccgccgcctcctcctcctcctctcccaccgcctgcttcctctcccctccgtgcccgccgcctcgccgcccgcgccatttcctcaaacacctcgcgtgcgccgcggccacaaagcccgcgcccgccgcttcctcaaacacctcctcctcccgctcgctcgccctccccttgcccgcgcccacgccgtggccgtggccgccgcggtggctaggcgagctggtccccgcggaggcggcggggcggctgctgtcgtcggccgcgggctccctcatcgtcgcgctcgcctccgcggcgctgatcctcggcgacgccggcgcggcctccgcgttcgtggtcgccacgccgcggaagctgcaggcggacgagctcgccaccgtgcgcctcttccaggagaacacgccctccgtcgtctacatcaccaacctcgccgtgaggcaggacgccttcacgctcgacgtgctcgaggtgccgcaggggtctgggtcggggtttgtctgggataagagcggacacattgtcaccaatttccatgtcatccgtggcgcctcggacctcagggtcacacttgctgatcagtcagtgtatgaagcacaagttgttgggtttgaccaggacaaggatgttgctgttttgcgtatcaaagcaccaaaggataaactaagacctataccagtcggtgtgtcagcagacctactggttggtcagaaagtatatgccattggaaacccatttggccttgaccacactctgacaacaggtgttatcagtggactgcgtagagaaatcagttcagctgccacaggacgacctatacaagatgtgatacagactgatgctgctatcaaccctggtaacagtggtggtccactccttgatagttctggaaatttgataggtgtaaacactgctatatactcaccttcaggagcatcatctggtgttgggttttccattccagttgatactgttgggggcattgtggatcaacttataaagtttggtaaggtgaccagacctattttgggaataaaatttgcccctgatcaatctgtggagcagcttggattaagtggagtgcttgtcttggatgctccttcaaatggaccagctggcaaagcaggtctgcaatcaaccaagcgagatgcctacggtcgtcttatcctgggggatataattacttctgtgaatggtacgaaggtaacaaatggaagcgacttgtaccggatattggatcagtgtaaagttggggaaacggtgacggtggaagtcttgcgtggtgaccataaggagaagatccctgtgatccttgaaccaaagcctgatgaatcataggagaaaccaggttcttcgtactcatttcctcacttaggtgcagagacacaaatatacaaggcgttagcatttcgcctaccacgacccacgggatccattgtacataattcatgcttgtaaatctaactatctctggtctggtggaaaaggttatccaagttgccttgatgctatcgtgtatcatgcttgctttttcttcggcctcttcaatacagatgtgccatacatca

SEQ ID NO: 2126 - DNA, 1809 bp, Setaria italica
cgccaagcaagcgccgggcagcgacgcagcgcatccactcatcgattcgtccaaccccttccactgcaggccgcggctgcgctcgctccactcccctcccgcacaagcgcgaccagatggccgccgcctcctcctcctcctctcccaccgcctgcttcctctcccctccgtgcccgccgcctcgccgcccgcgccatttcctcaaacacctcgcgtgcgccgcggccacaaagcccgcgcccgccgcttcctcaaacacctcctcctcccgctcgctcgccctccccttgcccgcgcccacgccgtggccgtggccgccgcggtggctaggcgagctggtccccgcggaggcggcggggcggctgctgtcgtcggccgcgggctccctcatcgtcgcgctcgcctccgcggcgctgatcctcggcgacgccggcgcggcctccgcgttcgtggtcgccacgccgcggaagctgcaggcggacgagctcgccaccgtgcgcctcttccaggagaacacgccctccgtcgtctacatcaccaacctcgccgtgaggcaggacgccttcacgctcgacgtgctcgaggtgccgcaggggtctgggtcggggtttgtctgggataagagcggacacattgtcaccaatttccatgtcatccgtggcgcctcggacctcagggtcacacttgctgatcagtcagtgtatgaagcacaagttgttgggtttgaccaggacaaggatgttgctgttttgcgtatcaaagcaccaaaggataaactaagacctataccagtcggtgtgtcagcagacctactggttggtcagaaagtatatgccattggaaacccatttggccttgaccacactctgacaacaggtgttatcagtggactgcgtagagaaatcagttcagctgccacaggacgacctatacaagatgtgatacagactgatgctgctatcaaccctggtaacagtggtggtccactccttgatagttctggaaatttgataggtgtaaacactgctatatactcaccttcaggagcatcatctggtgttgggttttccattccagttgatactgttgggggcattgtggatcaacttataaagtttggtaaggtgaccagacctattttgggaataaaatttgcccctgatcaatctgtggagcagcttggattaagtggagtgcttgtcttggatgctccttcaaatggaccagctggcaaagcaggtctgcaatcaaccaagcgagatgcctacggtcgtcttatcctgggggatataattacttctgtgaatggtacgaaggtaacaaatggaagcgacttgtaccggatattggatcagtgtaaagttggggaaacggtgacggtggaagtcttgcgtggtgaccataaggagaagatccctgtgatccttgaaccaaagcctgatgaatcataggagaaaccaggttcttcgtactcatttcctcacttaggtgcagagacacaaatatacaaggcgttagcatttcgcctaccacgacccacgggatccattgtacataattcatgcttgtaaatctaactatctctggtctggtggaaaaggttatccaagttgccttgatgctatcgtgtatcatgcttgctttttcttcggcctcttcaatacagatgtgccatacatcatactcatatctgtctgttgtggagcatgtatacatcctacagttcttagatggcctaccctattaataccgtgttcattcagaggaccgtctagagaagggaactgcagcttgatgagcttactgata

SEQ ID NO: 2127 - DNA, 1415 bp, Avena sativa
gcctcctcctccgcagccactgcctgcttcctctccccgccgccgcgcccgcgggcgcgccatttcctctgtcacctaccgcgcgccgcggccaccaggacgagcccggcccgccccctcacgctcccggcctcgccgcccctgctccgcgacctggtggaccccgccgaagccgcgcggcggctgctggcgtcagccgcgggctccctggtcgtcgcgctcgcctccgcggccctgatccttggcgacccggggagcgcgtccgcgttcgtcgtcgccacgccgcggaagctccaggccgacgagctcgccaccgtgcgactcttcaaggacaacaccccctccgtcgtctacatcactaacctcgccgtcaggcaggacgccttcaccctcgacgtgctcgaggtgccgcaggggtccggctcgggcttcgtctgggacaagatcggccacatcgtcaccaatttccatgtcatccggggcgcctccgacctcagggtcactcttgctgatcagtcagtgtatgaagcgcaagttgtcggatttgaccaggacaaggatgttgctgttttgagtatccaagcgccaaaggataaactaagacctttaccagttggtgtgtcagcagacttactggtcggtcagaaagtatatgccatcggaaacccatttggccttgaccacactcttacaacaggtgtcattagtggattgcgtagagaaattagttcagctgcaacaggacgtcctatacaggatgtgatacagactgatgctgctatcaaccctggtaacagcggaggtccgcttctcgatagttctggaaacctgataggtgtaaatactgctatatactcaccttcaggagcatcatccggggttggcttttccattccagtggatacagttggtggtattgtggaccagcttatacagtttgggaaagtgacaagacctattctggggataaaattcgcccctgatcaatccgtggagcagcttggcttaagtggagtgctcgtcttggatgctcctccaaatggaccagctggcaaagcgggtctgcaatcaaccaaacgggacgcctacgggcggctcatcctcggggacataatcacctcagtgaacggtacaaaggtagggaacggaagcgacctgtaccgcatcctggatcagtgtaaagtgggagagacggtgatggtggaagtactgcgtggagatcacaaggagaagatcgccgtggtccttgagccgaagcctgacgagacatagcgaacgagaggtccattctggaatgtattctcacgtaggtcatgtaactaaaggctcgggtattatacgaggcgctagcaatgttcgcctgccgcggaactccctgtacataattcatgtttgtaaatttttctgtggcgaaa

SEQ ID NO: 2128 - DNA, 2463 bp, Oryza sativa
ctcatccagttctacgggaggccgcggctgctgctcctccccctccactgattccgcccttcctccaatggccgccgcctcctcctctgccgccgcctgcttcctctccccgtcccctcctccccccccgcgccaccattccatcaaacacctggcgtgcgccgcctccaggtcgccgtcgccggggccctcctcctcccgctccctcgccctcccttcgccttcggcttcggcttctccgtcgccgtggccgcggcggctccgcgacctgctccccgacgagaccggccggatcctgtcgtccgccacgggctccctcatcgtcgccctcgcctcggccgcgctgatcctcggcgacgccggctccgcctccgcgttcgtcgtcgccacgccgcggaagctgcaggccgacgagctcgccaccgtgcgcctcttccaggagaacacgccctccgtcgtctacattaccaacctcgccgtgaggcaggatgccttcacgctggacgtgctcgaggtgccgcaggggtccgggtcggggttcgtctgggacaagagcggccacatagtcaccaatttccatgtcatccgtggcgcgtcagatctcagggtcacacttgctgatcagacagtgtatgaagcgcaagttgttggatttgaccaggataaggatgttgctgttttgcgtattaaagcaccaacagataaattaagacctataccagttggtgtgtcggcagacttactggtcggtcagaaagtatttgccatagggaacccgtttggtcttgaccacactcttactacaggagtcatcagtggattgcgtagagaaatcagttcagctgcaacaggacgccctatacaggatgtgatacaaactgatgctgctatcaatcctggtaacagtggtgggccacttcttgatagctcaggaaacttgataggtgtaaacactgctatatactcaccttcaggagcatcatccggtgttggcttttccattccagttgatacagttggtggtattgtggatcagcttataaagtttggtaaagtaacaagacctattctagggataaaatttgctccagatcaatctgtagagcagcttggattaagtggagtgcttgtcttggatgctcctccaaatggaccagcaggcaaagcgggtctgcaatcgaccaagcgggattcctatggtcggcttatcctaggggacataattacttctgtgaatggaacaaaggtaacaaatggaagcgacttgtataggattctggatcagtgtaaagttggagagaaggtgactgtggaagtattgcgtggagatcaaaaggagaagatacccgtgattcttgaaccaaagccagatgaatcataatagtaagccacctccataggatccactctactgtttgtatgtccacatagatgcagaaatggaatatatacaagaaattagcattttcccctaccacggaattcgctgtacataattcatgcttgtaaattttctggcaaaaaaagaaaatccaatttggcttatttccttgtcattcatgcttctggtgtaaccgcctcagtagagacgtgtcatacgtgatgtctctgttttcctgtattttggtgaggaccatgtacagcagagactatatagtagaccccacactgctccgtaagtctacttaacatggcctaccgtatttacactgcattcatcactgggccatctatgaactaacaggttgatggtcgtactgatctcacatatcacctaaaaatcctttctgacagtagaatccatgcaggttttgctagagaagttgttttcatggccaatgcaatgcgttgggtagtctgcgatggcatggagattaatgtgatggttatgtcgtgatgtctaatacagcagtgtcaaccacacacgaccctgtcgtggattttggggatccatacggttgtggagaggcagggctgatgtttctgtaaacgcggcagggtaaccatcaaagaagtctctgaagatactttggcttcatggtcacacctctgcgaggattttgcatcaaaggcgtgaaaagatctgtgagcaacaagtgaaaaggatgcaatgttttagaaaggaagcaccgcagcaacaagcaacgaaaagctaatcatgttcattgcatgattaatttatatcagagaataaataaataaacaattaccagtacgaggattttcaagtgatactactacagtatccttgctgctctggacaagtagacagacgtcaggtccatcggtctgggcactgtttgcaaggacgaattaagagtaaagcttggtaaaggagagttggtgatcgaaggagatatctggaaaatgaccgttcatttgtagcatatggttgaaatctatggtgcatgcagcatggttcatagagtagttcagtatcagattatcatcagtacgtagtgg

SEQ ID NO: 2129 - DNA, 1766 bp, Avena sativa
ctcatctgcggagctccaggccgcggctgccgctgctgctctgctctcccccacaccagatggcctcctcctcctcctcctccgcagccactgcctgcttcctctccccgccgccgcgcccgcgcgcgcgcaatttcctcaggtacctcgcgcgcgccgcggccaccaggacgagcccggcccgccccctcacgctcccggcctcgccgcccctgctccgcgacctggtggaccccgccgaagccgcgcggcggctgctggcgtcagccgcgggctccctcgtcgtcgcgctcgcctccgcggccctgatccttggcgacccggggagcgcgtccgcgttcgtcgtcgccacgccgcggaagctccaggccgacgagctcgccaccgtgcgactcttcaaggacaacaccccctccgtcgtctacatcactaacctcgccgtcaggcaggacgccttcaccctcgacgtgctcgaggtgccgcaggggtccggctcgggcttcgtctgggacaagatcggccacatcgtcaccaatttccatgtcatccggggcgcctccgacctcagggtcactcttgctgatcagtcagtgtatgaagcgcaagttgtcggatttgaccaggacaaggatgttgctgttttgagtatccaagcgccaaaggataaactaagacctttaccagttggtgtgtcagcagacttactggtcggtcagaaagtatatgccatcggaaacccatttggccttgaccacactcttacaacaggtgtcattagtggattgcgtagagaaattagttcagctgcaacaggacgtcctatacaggatgtgatacagactgatgctgctatcaaccctggtaacagcggaggtccgcttctcgatagttctggaaacctgataggtgtaaatactgctatatactcaccttcaggagcatcatccggggttggcttttccattccagtggatacagttggtggtattgtggaccagcttatacagtttgggaaagtgacaagacctattctggggataaaattcgcccctgatcaatccgtggagcagcttggcttaagtggagtgctcgtcttggatgctcctccaaatggaccagctggcaaagcgggtctgcaatcaaccaaacgggacgcctacgggcggctcatcctcggggacataatcacctcagtgaacggtacaaaggtagggaacggaagcgacctgtaccgcatcctggatcagtgtaaagtgggagagacggtgatggtggaagtactgcgtggagatcacaaggagaagatcgccgtggtccttgagccgaagcctgacgagacatagcgaacgagaggtccattctggaatgtattctcacgtaggtcatgtaactaaaggctcgggtattatacgaggcgctagcaatgttcgcctgccgcggaactccctgtacataattcatgtttgtaaatttttctgtggcgaaaggaaagggaaaaaagaaagaaaggaacgagctgacttgacttgatgttcctgatctgctcgcgttgtgcaagtggtccagcagagatgcgtggtgtatcttatctgtttacatgtgtatgcgatgcatctagcatctaacctacctgtattttatcgctgaggccatgctgggaactgcaagttgtgctttgaaaatgaggactgaatgggatattggggtaccagaaagttgtattttctatgctcgctcgctatctggatctgatcgtagtttttaag

SEQ ID NO: 2130 - DNA, 3038 bp, Brachypodium distachyon
atgtgcagtctggactggcaaggccatggtgggggtgggggagagcaggagagttgcgtggacgcgcatttgctatgctttaggaaggaggaactcagcggcacaaaagtggccgacttaagaaaggttcttgttgggtcccttgatgatatggttctaatggatgctacacatatctttgatgacccaacagagagcacagttaatcataaggaaaacaacaagcatatgcgctgcttgcttgttgtgttggctgccacggaaacaaatactgtagaaaatgataaaggtttgcttcaagttgtagcgttaccagagcaaaatagagcgctttcattgttggatgttgctcaggatattgactccatgcgaccaacttctctctttaggtaccttgtaatgaatgatgtctttgggaagttgaggatgagcctatttggttacttcgtgggtgatgcagcaacagctaaagccattccattttgccgtgctcttgtttgtcttgcagtggatagcaaagatgcacggcttagagctttctggagtgacagaaacagctgtaatgctgaaactagttttgaagtgtggctacggtgccagaaggaaaactttcgagcaaaggcatattctgctactgctaaagaagttcccttgggaaacccatggcattgggagttggaatatgaatgtgagagatatctttctgcctatattgacatgttgcgagtgctggatgaaactgatcattttgcggagggatctgatcgtgcttatgatgttgtaagtcacctcaaacgaacttctgagatacctcctgaactttctaaatatgtggcacaatctgttgaagcgacttctccttcgttctgtattatatttctgggagcctacatttcatcccatgatacgtcaggccaacatggaaaaactttggatgtagttgatgggttaatggcaagggaagaatgcttagagccagttgcaccgcttattagagatttcccgcttcatttgcaaccttatgcacatgctttgattaagtctaagcttgaagagtctaagtactatgttgcagtaaatcaaataaggttgcatgaacagtttgatgagtttttggcctctagcaagttggactgtgatgtgtatcggttcatgttttcaaaggttactcttcctgttcagatagacgaagattgtatggaggttgttgtaaacaaggtgccaagtaagttttgggaattggagcctgctctaagaaaactatcttttgagcggagagcagacattgtacaagtggagactgaaatctacacctatcttgaatgcgcaggcgctgccaccactgcctgctgcttcctcgccccctccccgtctctcccgccgcagcgcccgcgccatttcctcaagcacctcgcgcgcgccgcggcgtcgaccaccaggcccgacgccacctcgcgctccctcgcgccccccgcttcgccgccgcctctgttggcggccccggcggaggcggcgcggcggacgctgaagtccgccgcggggaccctggtcgtcgcgctcgcctcggccgcgctgatcctcggggacgcggggggcggcgccgcgtccgccttcgtcgtcgccacgccgcggaagctgccggccgacgagctcgccaccgtgcgcctcttcaaggacaacacgccctccgtcgtctacatcaccaacctcgccgtgaggcaggatgccttcacgctggacgtgctcgaggtgccgcaggggtctgggtcgggcttcgtctgggacaagatgggccacgtcgttaccaacttccatgtcatccgaggcgcgtcggatctcagggttacgcttgctgatcagtcagtctatgaagcgcaagttgttggatttgaccaagacaaggatgttgctgttctgagtatccaagcaccaaaggataaactgaggcctttgccagttggtgtgtcagcagacttattggttggtcagaaagtatatgccataggaaacccatttggccttgaccacactcttacaacaggtgttatcagtggattgcgcagagaaattagttcagctgcaacaggacgtcccatacaggatgtaatacagactgatgcagcaatcaaccctggtaacagtggaggcccgcttcttgatagttctggaaacctgataggtgtaaatactgctatatactcaccttcaggggcatcatccggggtcgggttctccataccagtcgatacagttggtggcattgtggatcagcttataaagtttgggaaagtgacaagacctattctgggcataaaatttgcccctgatcaatctgtagagcagcttggattaagtggagtgcttgtcttggatgctcctccaaacggaccagctggcaaagcgggtttgcaatccaccaaacgggattcctacgggcggcttatcctcggggatataatcacttctgtgaacggcacgaaggtagctaatgggagcgatctgtaccggattttggatcagtgtaaagttggagagacggtgaccgtggaagtcttgcgtggagatcagaaggaaaagattgccgtgatccttgaaccaaagcccgacgaatcataatgaaccttttggaatgtattctcacataggtgcagagactcatatacaaggcattagaatgtttgcctacctcagaattccttgtaaataattcatgcttgtaaattgtctggtctaaactgataagaagaaaagagaaaatcgggttattgttcttgcggccatgcttgcgctccagtgcaatttttttttttcagtagagcagagatttgtttcaacagagatacaatgatgcatctgcttacttgtgtacttcacatattctatttgattgtttgtgcattaaaataccaacaatttggatttcgagatacttgatcacccgttggaacgtttcctctctcttgttcttaactccccgtgtggctcaaacaatcttatgtaaatccacgaagattaggtgtttatgccttggaggtgat

SEQ ID NO: 2131 - DNA, 7399 bp, Brachypodium distachyon
atgtgcagtctggactggcaaggccatggtgggggtgggggagagcaggagagttgcgtggacgcgcatttgctatgctttaggaaggaggaactcagcggcacaaaagtggccgacttaagaaaggttcttgttgggtcccttgatgatatggttctaatggatgctacacatatctttgatgacccaacagagagcacagttaatcataaggaaaacaacaagcatatgcgctgcttgcttgttgtgttggctgccacggaaacaaatactgtagaaaatgataaaggtttgcttcaagttgtagcgttaccagagcaaaatagagcgctttcattgttggatgttgctcaggatattgactccatgcgaccaacttctctctttaggtaccttgtaatgaatgatgtctttgggaagttgaggatgagcctatttggttacttcgtgggtgatgcagcaacagctaaagccattccattttgccgtgctcttgtttgtcttgcagtggatagcaaagatgcacggcttagagctttctggagtgacagaaacagctgtaatgctgaaactagttttgaagtgtggctacggtgccagaaggaaaactttcgagcaaaggcatattctgctactgctaaagaagttcccttgggaaacccatggcattgggagttggaatatgaatgtgagagatatctttctgcctatattgacatgttgcgagtgctggatgaaactgatcattttgcggagggatctgatcgtgcttatgatgttgtaagtcacctcaaacgaacttctgagatacctcctgaactttctaaatatgtggcacaatctgttgaagcgacttctccttcgttctgtattatatttctgggagcctacatttcatcccatgatacgtcaggccaacatggaaaaactttggatgtagttgatgggttaatggcaagggaagaatgcttagagccagttgcaccgcttattagagatttcccgcttcatttgcaaccttatgcacatgctttgattaagtctaagcttgaagagtctaagtactatgttgcagtaaatcaaataaggttgcatgaacagtttgatgagtttttggcctctagcaagttggactgtgatgtgtatcggttcatgttttcaaaggttactcttcctgttcagatagacgaagattgtatggaggttgttgtaaacaaggtgccaagtaagttttgggaattggagcctgctctaagaaaactatcttttgagcggagagcagacattgtacaagtggagactgaaatctacacctatcttgaatgtttgcaaggactctttgcgagtgaggaagtacgtatacaacagttaatccgctgttttactgcttgctcaagcggctcttattcctttatctgtccttttttcctactgagattctgaaatttttgtccctttttcatctgtccttttctttctgatgtagcatttggatggtattactttagttacttaacataaggtaaaatctttgtttaaatattgtactgattgttaataatcacacgccagagaataaggagatctatgggcgtggacgttttgaacttccctagatacacatgtgtgtttttacaaattatgaactttctgacggaggttgggattgggattgcgaggaatgttctgaacttccctcgatacacgagtgaacttccgttatatatatggtgaacttcccgacggtctctgaacatccgccgattgtaatttttgcccgtgtcagagaagaaggaggtctacgggcgtgaacgttctgaacttccatcgacagacgagtgaattttcattttatagaccttgaacttcattggtacaagatttttggccagaaagttttgctaatccagattaacaagactactacacccgattttttgcagcctgccagttaatgaacttccaaatctgaacatgtgaactaccacgaaaacaacatgtgaacttccctaccatgtgaggaagccgcccgcgtcaccggagaaaagaggtggtagccgaggccggtcgggggaggtagcgagtgacggcatcgcgggctccctcccgtcggcctccgccgccgcttgctcgcccgcgttggggaaggaggtggtagccggggccggtcgggggaggtggctcgcgcggccgtcgcgggctccctcgtgtcggcctccgccgccgctcgctagcccacaccgaaggaaggaggtggtagccgaggccggtcgggggaggtagcgcgtaacggcgtcgcgggctccctcgcgtcggcctcctccgccgctcgctcgcccgcgccggaggaagtcgggatcgggggttgtcgggtgtggggattgggggtggtcaggtgtgtctgtttaggaatagttcctacttaaggttaagtaggaagtgttgggaatatgccctagaggcaatcatgtatgatgtaattcccaatgtattcataaatattattaagttgtccttgtttgaacatctgatatgtatcattgaatatgtgatttgattgtggaactatgtattcatgttgttcatactaaattgtccttagtcattgaggttgtgctggacacataacctagactaatgtgaaaattggttgatgactcggttccacttgtcatgggcatggtgatgtcattccagcttacacggactcggctaaagagtttagcgagtcggactgacccatattgagatgcaacgagtaggtcgtcatttgcatgtatcaatcaatgtaatccttagacctgaggttatcgcacaatccgagttgtggatcaccaacttaggttctgtcaaacgttgttccgtaacagggcagttataaaggcagagttcaggttgactgagaatcaagctgtgtgatgtggataaccaagatgggattttgcccctccgactggagagatattctctgggccctctcgagtgatatgattcgggaagcatggccatgcgcgacttggttaactgttaaccgggtcgatcgactaagagttagtcggatgaatcatatatcacagatcgagaagagagttgaactattaaagggatgacgattaatcgcctatagttcgacaaggtatatcgtgaggcaaaagggactaagacgtatgtcacattggaaggtacgtcgtcatgactcgatggtacttgggagtcggcgcgttctgctaggagccgctaccgattgatcgattgtgagtcggactccaatcgtgtccaagtcgccatgagcctgtgggatcacacacttaagagcgggagcaagtatttggttgggttggacccgaactggaattgggctgacaatgcgagttggactcgcagggtggatgggccacaaggcttggagcccacttccactcgatatataagcaggggcgtgggatgcctaagggcacggtttttccactctcatgcgttgagaaccctagctcgattcagttcaaccgtcgcaccggacctagcagtccgccgccggagctcctcctcgcacgtgtggataccggcagaggtgctgtacgttcagcacgtcgacgatcgcgggattggatcggctggatcggatcgagggactgcactgcatcaaggcgccgcatcaatagtccgcaactgcgcgtctagtggtaatcctcgtggccttctacctcggctagatcttgggagttcgcgtaggaaaaattttgtttatcttgggagttcgcgtaggaaaaattttgtttatctctacgcgccccttcaggaagttaggtaggttcatatatatatatatatatatatatatatatatatatatatctcgttgatcatcgaagtcgactggtttgccttacattcgcgtacgggcctctctgccaattcctgatatgtaaggtttgtcctgtttgtgtcgcacgcttatgcatatattggaccacatacacgtcggcccatgtgaacaatgatgttcgtgggtatacaacctcgataagaaaaaaaaacaatcgttcgtccgcctcacgcatcctccctgacccaactcgctccctcaacctcctcttctctcttgaacaactttgatgggcgtatgttagtgacactttgctcaactttgtggcagtcacattttgctcaaccttttgtggcagccgcacttgcctaatgtttgttgtggcgatgtcagtcacaaaccaaacgtgtgtgaaagctcccaaagtgggatacaaggatgactattagggtgtgttcggaagcagtccaacttccaacttcttagaaatccgatgtggagcagtgtcgaacaggccaactccggaaagcttagatccgtgaagctagacaaatctgctgtacaaaacgcggagctacccttttgacgattcccagatcggcaaaacctggagcagcacaaaactacgagcgaattgccaccgccaagtgaataacgtttggttgggtcttttcttcctcgttcgagttgacaccgagcacaacgccgcctctgaacaaaccgggagggtctccatcgccgcccaatgcagcctcggtcctcgactccggccgccgccacactaaccctggcccgaggcactcccacggccagagatgccccgggccccatcctgcaccccggagcaacgcccagcccccttcagctccacggattgacgctcaggggtcgtgcaaccgccgggtcccgacctcctccgattgcagatccagccgccgttgtcgaaccagctccattgtagcagctcctccgagctcatcgtccctcacgggagatcctgaccaactcttaccgcaccaacccacgtacccatcgatccaactaacaaatcagttcaattcttccttcccctgttcttgaatgaattaatcttgaaatccgatcaaccaaatacaatcgatttgggacaatttgatgatttgcatcgggacgctggaatcacgagcttcgggcagcggtgccgtcgaaggggggtcgcggtggattttacatcgcatgacgaggaggacgcaccagccacgagcccaagtagtatgttggtattccttagcaggccaacccgatgagaatgggctttcggcccaattgaactcagagcagtgccgaacgtttttaactccgatcgggacgccagagtcgctgcgggaagctggatcgagggagtttcgtgaagccagaccgttcccgaacacgcccttaatgtgttatcaacatcatgatcaatcaagcaaagcagttaactggcatcacatcaacaacgatcatacatatcaaagtcgacgtacaacaaagtaaaaatacagtagcagaagcacacacaacaccatgagatcagaacacatgaaataagcatagcaccattgccaagttaagcatgcatgtgcactcgatctcaagccctcaagggagaaaccaaactgaagaggtgtactgtcggtcctcaaggtactggtacatgtatttggaggagctattgtcatccaagaaattgattcatcctccaagcgatttttcgttctaaatccttttgcacagattttactctgaatttttatcaccgtctaattaaccaagcatccctccaaatgcaaacgcaggcctgaactatcgagaagcatccaccgtagaccacaaaacacatggggaaagagcaggaaagaagcaacccgaagcaagacgaagacaccaccaatagcagcgctagtcaacaaaaaaaagcgtcgcaaaaagaatgacaataagcaaggactaaactcttttttttttgggaagtagcactagcagtagtagcgagcagagcagcgtgcgtatccacacatccgattcctccggaggccgcggctgctgctgttctccctccaccaaatcaaaaatggccgccgccggcgcaggcgcaggcgctgccaccactgcctgctgcttcctcgccccctccccgtctctcccgccgcagcgcccgcgccatttcctcaagcacctcgcgcgcgccgcggcgtcgaccaccaggcccgacgccacctcgcgctccctcgcgccccccgcttcgccgccgcctctgttggcggccccggcggaggcggcgcggcggacgctgaagtccgccgcggggaccctggtcgtcgcgctcgcctcggccgcgctgatcctcggggacgcggggggcggcgccgcgtccgccttcgtcgtcgccacgccgcggaagctgccggccgacgagctcgccaccgtgcgcctcttcaaggacaacacgccctccgtcgtctacatcaccaacctcgccgtgaggcaggatgccttcacgctggacgtgctcgaggtgccgcaggggtctgggtcgggcttcgtctgggacaagatgggccacgtcgttaccaacttccatgtcatccgaggcgcgtcggatctcagggttacgcttgctgatcagtcagtctatgaagcgcaagttgttggatttgaccaagacaaggatgttgctgttctgagtatccaagcaccaaaggataaactgaggcctttgccagttggtgtgtcagcagacttattggttggtcagaaagtatatgccataggaaacccatttggccttgaccacactcttacaacaggtgttatcagtggattgcgcagagaaattagttcagctgcaacaggacgtcccatacaggatgtaatacagactgatgcagcaatcaaccctggtaacagtggaggcccgcttcttgatagttctggaaacctgataggtgtaaatactgctatatactcaccttcaggggcatcatccggggtcgggttctccataccagtcgatacagttggtggcattgtggatcagcttataaagtttgggaaagtgacaagacctattctgggcataaaatttgcccctgatcaatctgtagagcagcttggattaagtggagtgcttgtcttggatgctcctccaaacggaccagctggcaaagcgggtttgcaatccaccaaacgggattcctacgggcggcttatcctcggggatataatcacttctgtgaacggcacgaaggtagctaatgggagcgatctgtaccggattttggatcagtgtaaagttggagagacggtgaccgtggaagtcttgcgtggagatcagaaggaaaagattgccgtgatccttgaaccaaagcccgacgaatcataatgaaccttttggaatgtattctcacataggtgcagagactcatatacaaggcattagaatgtttgcctacctcagaattccttgtaaataattcatgcttgtaaattgtctggtctaaactgataagaagaaaagagaaaatcgggttattgttcttgcggccatgcttg

SEQ ID NO: 2132 - DNA, 1373 bp, Echinochloa colona
gcccgcgccctcgccggggccgtggccgcggcggctcagcgagctggtccccgccgaggcggcggggcggctgctgtcgtcggccgcgggctccctcgtcgtcgcgctcgcctccgcggcgctcatcctcggcgacgccggcgcggcctccgcgttcgtggtcgccacgccgcggaagctgcaggcggacgagctcgccacagtgcgcctcttccaggagaacacgccctccgtcgtctacatcaccaacctcgccgtgaggcaggacgcgttcacgctcgacgtgctcgaggtgccgcaggggtccgggtcggggtttgtctgggataagagcggccacatcgtcaccaatttccatgtcatccgtggcgcgtcggacctcagggtcacacttgctgatcagtcagtgtatgaagcacaaattgttggatatgaccaggacaaggacgttgctgttttgcgtatcaaagcaccaaaggataaactaagacctataccagttggtgtgtcagcagacctactggttggtcagaaagtatatgccattggaaacccatttggccttgaccacactcttacaactggtgttatcagtggactgcgtagagaaatcagttcagctgccacaggacgtcctatacaagatgtgatacagactgatgctgcaatcaaccctggtaacagtggtggtccactccttgatagttcgggaaacttgataggggtaaacactgctatatactcaccttcaggagcatcatctggtgttggcttttccattccagttgatacggttggcggcattgtggatcaacttataaaatttggtaaggtgacaagacctattttgggaataaaatttgcccctgatcaatctgtagagcagcttggattaagtggagtgcttgtcttggatgctcctccaaatggaccagctggcaaagcgggtctgcaatcaaccaaacgagatgcctatggtcgacttatcctgggggatataattacctctgtgaatggcacaaaggtaacaaatggaagcgacttgtaccgaatattggatcagtgtaaagttggggaaacggtgaccgtggaagttttgcgtggtgaccagaaagagaagatccctgtgatccttgaaccaaagccagatgaatcataggaagccaagttcttctgtatcatttgctcactttaggtgcagagacccaaatataccaggcgttagcattttcgcctaccacgggattcattgtacataattcatgcttgtaaatctatctctggtctggtgtaaaaatttgtccaagttacctgctatcatgcttgttttttctccggtcgcttcaatacagatgtgccatacatcatacacg

SEQ ID NO: 2133 - DNA, 1654 bp, Triticum aestivum
ggcccccggccggccccctcgcgctcccggcctcgccacggaggccgctgcgcgacctggtgccgggccccgtcgccgaggccgcgcggcgggcgctggcggccgccgcgggacccctggtcgtggcgctcgcctccgccgcgctggtcctcggggacgccggggccgcgtccgcgttcgtcgtcgccacgccgcggaagctgcaggccgacgagctcgccaccgtgcgcctcttcaaggacaacaccccctccgtcgtctacatcaccaacctcgccgtcaggcaggacgccttcacgctggacgtgctcgaggtgccgcagggctccggctccggcttcgtctgggacaagctcggccacattgtcaccaacttccatgtcatccgtggcgcgtctgacctcagggtcacgcttgctgatcagtcggtgtatgaagcgcaagttgtcggatttgaccaggacaaggatgttgcggttttgagtatcgaagcaccaaaggataaactaagacctttaccagttggtgtgtcagcagacctactggttggtcagaaagtgtatgccattggaaacccatttggccttgaccacactcttacaacaggtgttatcagtggactgcgaagagaaattagttcagctgcaactggacgtcctatacaggatgtaatacagactgatgctgctatcaaccctggtaacagcggaggcccacttcttgatagttctggaaacctgataggtgtaaatactgctatatactcaccttcaggagcatcatctggggttggcttctccattccagttgatacagttggtggtattgtggatcagcttatacaatttgggaaagtgacgagacctattttggggataaaatttgcccctgaccaatctgtggagcagcttggattgagtggagtgcttgtcttggatgctcccccaaacgggccagctggcaaagcgggtctgcaatcaacgaaacgggatgcctacggacgacttatcctcggggacataattacttctgttaatggtactaaggttgcgaatggaagcgacctgtaccgtatcttggatcagtgcaaagtcggagagacggtgaccgtggaagtattgcgcggagataagaaggagaagatcgctgtggtccttgaaccaaagctcgacgaaacatagtgagtggtgtccttctcgggtgtattctcacgtaggtacaaggtattagcatgttggcctaccacggagctccttgcacataattgatgtttgtaaattgtctggtgtacaaagaaaggaaagaaaaatatcaatttggttcatcgatcatgccttatgtgcgctgttccagtacatgatctatctgcttacatatgctactctttgataccgctacatagtgtgacaataacatcaaatgtcagccgttagatatgctccattcattggataaagttttcatctcagaggatttctgacacgtgatcttttaattgaacccccattctatcatccattgtattctagaagcatctttttcccatgacaaggatctgattctaaaattagaggaatttggattttagagagttgggccctgcattcttcgcatagaaggaaataaaatatcgagaatgcattcccccctgctg

SEQ ID NO: 2134 - DNA, 1255 bp, Avena sativa
ggtggaccccgctgaggccgcgcggcggctgctggcgtctgccgcgggctccctcgtcgtcgcgctcgcctccgcggccctgatcctcggcgacccggggagcgcgtccgcgttcgtcgtcgccacgccgcggaagctccaggccgacgagctcgccaccgtgcgactcttcaaggacaacaccccctccgtcgtctacatcacaaacctcgccgtcaggcaggacgccttcacgctggacgtgctcgaggtgccgcaggggtccggctcgggcttcgtctgggacaagatcggacacatcgtcaccaatttccatgtcatccggggcgcctccgacctcagggtcactcttgctgatcagtcagtgtatgaagcgcaagttgtcggatttgaccaggacaaggatgttgctgttttgagtatccaagcaccaaaggataaactaagacctttaccagttggtgtgtcagcagacttactggtcggtcaaaaagtatatgccatcggaaacccatttggccttgaccacactcttacaacaggtgtcattagtggattgcgtagagaaattagttcagctgcaacaggacgtcctatacaggatgtgatacagactgatgctgctatcaaccctggtaacagcggaggtccgcttctcgatagttccggaaacctgataggtgtaaatacagctatatactcaccttcaggagcatcgtctggggttggcttttctattccggtggatacggttggtggtatagtggaccagcttatacagtttggaaaagtgacaagacctattctggggataaaatttgcccctgatcaatccgtggagcagcttggcctaagtggagtgctcgtcttggatgctcctccaaacggaccagctggcaaagcgggtctgcaatcaaccaaacgggatgcctacgggcggctcatcctcggggacataatcacctcagtgaacggtacaaaggtagggaacggaagcgacctgtaccgcatcttggatcagtgtaaagtgggagagacggtgacggtggaagtcctgcgtggagatcacaaggagaagatcggcgtggtccttgaaccgaagcctgacgagacatagcgaacgggaaggtccttccggaatgtattctcacgtaggtcatgtaactgaagactcgagtattatacaaggcgctagcatcatcttcgcctgccgcggaactccttgtacataattcatgtttgtaaattttctgtg

SEQ ID NO: 2135 - DNA, 1272 bp, Avena sativa
ggtggaccccgctgaggccgcgcggcggctgctggcgtctgccgcgggctccctcgtcgtcgcgctcgcctccgcggccctgatcctcggcgacccggggagcgcgtccgcgttcgtcgtcgccacgccgcggaagctgcaggccgacgagctcgccaccgtgcgactcttcaaggacaacaccccctccgtcgtctacatcacaaacctcgccgtcaggcaggacgccttcacgctggacgtgctcgaggtgccgcaggggtccggctcgggcttcgtctgggacaagatcggacacatcgtcaccaatttccatgtcatccggggcgcctccgacctcagggtcactcttgctgatcagtcagtgtatgaagcgcaagttgtcggatttgaccaggacaaggatgttgctgttttgagtatccaagcaccaaaggataaactaagacctttaccagttggtgtgtcagcagacttactggtcggtcaaaaagtatatgccatcggaaacccatttggccttgaccacactcttacaacaggtgtcattagtggattgcgtagagaaattagttcagctgcaacaggacgtcctatacaggatgtgatacagactgatgctgctatcaaccctggtaacagcgggggtccgcttctcgacagttctggaaatctgataggtgtaaatactgctatatactcaccttcaggagcatcgtctggggttggcttttctattccggtggatacggttggtggtatagtggaccagcttatacagtttggaaaagtgacaagaccgattctggggataaaatttgcccctgatcaatccgtggagcagcttggcctaagtggagtgctcgtcttggatgctcctccaaacggaccagctggcaaagcgggtctgcaatcaaccaaacgggatgcctacgggcggctcatcctcggggacataatcacctcggtgaacggtacaaaggtagggaacggaagcgacctgtaccggatcttggatcagtgtaaagtgggagagacggtgacggtggaggtactgcgtggagatcaaaaggagaagatcgccgtggtccttgaaccgaagcctgacgagacatagtgaacgggaggtcctttctggaacgcattctcacgtaggtcatgtaactaaagtctgagtcgagtatacaaggcgctagcatgttcgcctgccgcggaactccttgtacataattcatgtttgtaaatttttctgtggtgaaaaggaaaggaaaa

SEQ ID NO: 2136 - DNA, 1833 bp, Echinochloa colona
ccaaaatggccgctaggggccttggcctctccacctccttcctcgccggccacgacacgctcctccggcgccggcgcgggcggccggtgggccccgcggccgcttcgttccggccggtgacggcggagctcggcggcgtcgcgacggagctggggcggcagctggtggaggcggtgggcgtggggctcccctgcaccgtcatgcagtgcggcgacgtcatctaccgcagcacgctcccccacaacgacgggctcaccatcaccgcgccgggcgtcgccctcgcgctcgccgccgtgtcctatctctggtcgacccccggcgtcgcgccgggattcttcgacatgtttgtgctcgccttcgccgagcggctcttccgcccaaccttccgcaaggacgacttggtgctcgggaagaagcttggggagggcgcgttcggagtggtttgtaaggcatcactcgcgaaccccgaagcggcggagaagcaaggagatgtggttgtgaagaaggcaacagagtatggcgcagtggagatctggatgaatgagcgtgtcaggagggcttgcgctagtagctgtgcagattttctttatggatttcgcgagagcaaagcgaaaggtaagggagctgaagaatattggcttatttggcgttttgaaggcgaggatacactctatgatctcatgcaaagcaaggaattcccttacaatgtggagacaaagattcttggtggtgtccaggacttgccaaagggaatagcaagagagaataagatcattcaaacggtaatgagacaactcttatttgctcttgatggacttcattcgacggggattgttcacagagatgtaaaacctcaaaatgtgatattttcagagggatcacggaccttcaaaattattgatcttggagcagcagctgacttacgagtaggcatcaactacattcccaaagagttccttttggatccaagatatgctgcaccagagcaatatatcatgagcacacaaacgccgtccgctccttctgttccagttgcgacaactttgtctccagtcctatggcagctgaatcttcctgacagatttgacatatatagcttgggcctcatattcttacagatggcatttccttctttacgaactgacagcaatctcatacaattcaaccgccaactgaagaggtgtgattatgacttagaagcttggagggatctggttgaaccacgagcaaccgctgagcttcggaggggctttaacatcatggatttagacgatggtatcggatgggaactcctcacatcgatggtccggtacaaagcacggcaaaggatcagtgctaaggccgcattagcacacccatacttcaaccgtgaagggctgcttggcctctctgtcatgcaaaacgtacaactgcaactgttccgggcaacccagaaggactacagtgaagcagctcgatgggttatcggcctcatggcaaggtcaggaactgaagatgtggggggctttacagaagcacagcttcaagagcttagggaaataaagccaaagaaagacaacgcccagcggaacgtgctggcctccgtgctgcgcttgcagaggaagatcgtgagaacgatcaaagagagcatggacgagctgaccagccagcgcaaaagcatctggtggagccggtggataccgagggagtagtaggccggcacacctgtacattgtccgctgctcctgttcctgtataaaaacgccgcccgttagcactggtaacggtacattatactatactgcttacttcgtacatgctggtgactggtgagtaaaatttgtccgagaacga

SEQ ID NO: 2137 - DNA, 1880 bp, Echinochloa colona
agagacgccgaccacaccacgactaaaaatccaaaatggccgctagtggccttggcctcgccacctccttcctccccggccacgtcaccctcctccggcgccggcggccggtgggccccgcggccgcttcgttccggccggtgacggcggagctcggcggcgtcgcgacggagctggggcggcagctggtggaggcggtgggcgtggggctcccctgcaccgtcatgcagtgcggcgacgtcatctaccgcagcacgctcccccacaacgacgggctcaccatcaccgcgccgggcgtcgccctcgcgctcgccgccgtgtcctatctctggtcgacccccggcgtcgcgccgggattcttcgacatgtttgtgctcgccttcgccgagcggctcttccgcccaaccttccgcaaggacgacttggtgctcgggaagaagcttggggagggcgcgttcggagtggtttgtaaggcatcactcgcgaaccccgaagcggcggagaagcaaggagatgtggttgtgaagaaggcaacagagtatggcgcagtggagatctggatgaatgagcgtgtcaggagggcttgcgctagtagctgtgcagattttctttatggatttcgcgagagcaaagcgaaaggtaagggagctgaagaatattggcttatttggcgttttgaaggcgaggatacactctatgatctcatgcaaagcaaggaattcccttacaatgtggagacaaagattcttggtggtgtccaggacttgccaaagggaatagcaagagagaataagatcattcaaacggtaatgagacaactcttatttgctcttgatggacttcattcgacggggattgttcacagagatgtaaaacctcaaaatgtgatattttcagagggatcacggaccttcaaaattatcgatcttggagcagcagctgacttacgagtaggcatcaactacattcccaaagagttccttttggatccaaggtatgctgcaccagagcaatatatcatgagcacacaaacgccatccgctccttctgttccagttgcgacaactttgtctccagtcctatggcagctgaatcttcctgacagatttgacatatatagcttgggcctcatattcttacagatggcatttccttctttacgaactgacagcagtctcatacaattcaaccgccaactgaagaggtgtgattacaacttagaagcttggaggaatctggttgaaccacgagcaactgctgagcttcggaggggctttgacatcatggatttagacgatggtatcggatgggaactcctcacatcgatggtgcggtacaaagcgcggcaaaggatcagtgctgaggccgcattggcacacccatacttcaaccgcgaagggctgcttggcctttctgtcatgcaaaacgtacaaatgcaactgttccgggcaacccagaaggactacagtgaagcagctcgatgggttgtcggcctcatggcaaggtcaggaactgaagatgtggggggctttacagaagcacagcttcaagagcttagggaaataaagccaaagaaagacaacgcccagcggaacgtgctggcctccgtgctgcgcttgcagaggaagatcgtgagaacgatcaaagagagcatggacgagctgaccagccagcgcaaaagcatctggtggagccggtggataccgagggagtagtaggccggcacacctgtacattgtccgctgctcctgttcctgtataaaaacgccgcccgttagcactggtaacggtacattatactatactgcttacttcgtacatgctggtgactggtgagtaaaatttgtccgagaacgaccgcagtaacacgatgtatagct

SEQ ID NO: 2138 - DNA, 1932 bp, Sorghum bicolor
accaggaaaaaatcgggaaaaatccgaaatggccgctagtggcctcggcctctccacctcgttcctccccggccacgacaccctcctccggcgccggcgccggcggccggcgagcccctccaccgcgtcgttccggccggtgacggcggagctcggcggcgtcgcggcggggctgggccggcagctggtggaggcggtgggcgtggggctcccctgcaccgtcatgcagtgcggcgacgtcatctaccgcagcacgctcccccagaacgatgggctcaccatcacggcccccggcgtcgcgctcgcgctcgccgccgtgtcgtacctctgggccacgcccggcgtcgcgccggggttcttcgacatgttcgtcctcgccttcgccgagcgcctcttccgccctaccttccgcaaggatgacttcgtgctcgggaagaagcttggggagggcgcattcggggtcgtgtataaggcgtcactggcgaaccccgaagcggctaagaagcaaggggatgtggtcgtgaagaaggcaacagagtatggagcagtggagatttggatgaatgaacgtgtcaggagggcatgtgccagtagttgtgcggattttctttatggctttcgcgagaccaaaacaaagggtaagggagctgaagaatactggattatttggcgttttgaaggcgaggatacactttatgatctcatgcaaagcaaggaattcccttacaatgtggagacaaaaattcttggcaatgtccaggacttgccaaaaggtatagcgagagagaataagatcattcaaacggtgatgagacaactcttgtttgctcttgatggacttcattcgacagggattgttcacagagatataaaacctcaaaatgtgatattttcagagggatcacgaaccttcaaaattattgatcttggagcagcagctgacttacgggtaggaattaactatattcctaaagagttccttttggatccaaggtatgctgcaccagagcaatatattatgagcacgcaaaccccatctgctccttctgttccagttgcaacaactttgtctccagtcctgtggcagctgaatcttcctgacagattcgacatatatagcttggggctcatattcttgcagatggcattcccttcactacgaactgacagcagcctcatacaatttaatcgccaactgaagagatgcgactatgacttacaagcctggaggaatctggtggagccacgagcgactgctgagcttcggaggggctttgacatcatggatctagacaatggtatcggatgggaactcctcacgtcgatggtccggtacaaagcacggcaaaggaccagtgctgagggtgcattggcacacccatactttaaccgtgaggggctccttggcctctctgtcatgcaaaacgcacgactgcaactgttccgggcaacccagaaggactacagtgaagccgctcggtgggttatcggcctcatggcaaggtcaggaactgaagaagtgggaggctttacagaagcacagcttcaagagcttagggaaataaaaccgaagaaaggcaacgcccagcggaacgtgcttgcctccgtgctgcgcctgcagaagaagatcgtgaaaacgatcaacgagagcatggacgagctcgccagccagcgcaaaagcatctggtggagccggtggatacccagggaggagtaggccgccggccgccggcgcacctgtacattgtccacttttgctgtataaaacgtcgcccagtagcactggtgatggtatactacactatcctacggtacttcgtacagtacatgctgatgactggtgagtaaagtttgtctgaaaagatcggagtaacacggtgtatagctgtaaatatttgctattgaagcatcatgatttttgagatccctgtc

SEQ ID NO: 2139 - DNA, 2005 bp, Setaria italica
ttttttgaaccgcggaaagcaaaaatccaaaatggccgctagtggccttggcctcgccacctccttcctccccggccacgacaccctcctccggcgccggcgccggcggccggcgagccccgcggccgcctcgttccggccggtgacggcggagctcggcggcgtcgcgacggagctggggcggcagctggtggaggcggtgggcgtggggctcccctgcaccgtcatgcagtgcggcgacgtcatctaccgcagcacgctcccccggaacgacgggctcaccatcacggcccccggcgtcgcgcttgccctcgccgccgcgtcctacctctgggcgacccccggcgtcgcgccggggttcttcgacatgttcgtgctcgccttcgcagagcgcctcttccgccctaccttccgcaaggacgacttcgtgctcgggaagaagctcggggagggcgcgttcggggtcgtgtataaggcgtcactcgccaaccccgaagctgcggagaagcaaggggatgtggttgtgaagaaggcgacagagtacggtgcagtggagatttggatgaatgagcgtgtcaggagggcttgcgctagtagttgtgcggattttctatatggatttcgcgagagcaaagtgaaaggtaagggggctgaagaatattggattatttggcgttttgaaggcgaggatacactttatgatctaatgcaaagcaaggaattcccttacaatgtggagacaaagattcttggtggtgtccagaacttgccaaagggaataggaagagagaataagatcattcaaacggtaatgagacaactcttatttgctcttgatggacttcattcgacggggattgttcacagagatataaaacctcaaaatgtgatattttcagagggatcacgaaccttcaaaattatcgatcttggagcagcagctgacttacgagtaggaatcaactacattcccaaagagttccttttggatccaaggtatgctgcaccagagcaatacatcatgagcacacaaacgccatctgctccttctgttccagttgcaactactttgtctccagtcctatggcagctgaatcttcctgacagatttgacatatatagcttgggccttatattcttacagatggcattcccttctttacgaactgacagcagcctcatacaattcaaccgccaactgaagaggtgcaattacgacttagaagcttggaggaatctggtggagccacgagcaaccgctgagcttcggaggggctttgatatcatggatttggacgatggtattggatgggaactcctcacgtcgatggtccgttacaaagcgcggcaaaggatcagtgctgaggctgcattggcgcacccatacttcaaccgtgaaggccttcttggcctctctgtcatgcaaaacgtacggctgcaactgttccgggcaacccagaaggactacagtgaagcagctcgttgggttgtcggcctcatggcaaggtcaggaactgaagatgtgggaggctttacagaagcacagcttcaagagcttagggaaataaagccgaagaaaggcagcgcccagcggaacgtgctggcctccctgctgcgcgtgcagaggaagatcgtgagaacgatcaacgagagcatggacgatctcaccagccagcgcaaaagcatctggtggagccggtggataccgagggaggagtaggccggcgcacctgtacattgtccacttcttcttctgtataaaacgtcgcccaatagcattggtaatggtatgattgatatactatactgcttacttcgtatacttgctggtgactggtgagtacaatttgcctggaagactgcagtaacacgatgtatagatgtaaataatttgcatatgcacttaagcatcgcaatttttgagatccttgtcataagttcatcatgagcactcggctgggcgccggcctgattaacctgtgattggtgctgtcgtagctttctg

SEQ ID NO: 2140 - DNA, 1902 bp, Setaria italica
cgcggaaagcaaaaatccaaaatggccgctagtggccttggcctcgccacctccttcctccccggccacgacaccctcctccggcgccggcgccggcggccggcgagccccgcggccgcctcgttccggccggtgacggcggagctcggcggcgtcgcgacggagctggggcggcagctggtggaggcggtgggcgtggggctcccctgcaccgtcatgcagtgcggcgacgtcatctaccgcagcacgctcccccggaacgacgggctcaccatcacggcccccggcgtcgcgcttgccctcgccgccgcgtcctacctctgggcgacccccggcgtcgcgccggggttcttcgacatgttcgtgctcgccttcgcagagcgcctcttccgccctaccttccgcaaggacgacttcgtgctcgggaagaagctcggggagggcgcgttcggggtcgtgtataaggcgtcactcgccaaccccgaagctgcggagaagcaaggggatgtggttgtgaagaaggcgacagagtacggtgcagtggagatttggatgaatgagcgtgtcaggagggcttgcgctagtagttgtgcggattttctatatggatttcgcgagagcaaagtgaaaggtaagggggctgaagaatattggattatttggcgttttgaaggcgaggatacactttatgatctaatgcaaagcaaggaattcccttacaatgtggagacaaagattcttggtggtgtccagaacttgccaaagggaataggaagagagaataagatcattcaaacggtaatgagacaactcttatttgctcttgatggacttcattcgacggggattgttcacagagatataaaacctcaaaatgtgatattttcagagggatcacgaaccttcaaaattatcgatcttggagcagcagctgacttacgagtaggaatcaactacattcccaaagagttccttttggatccaaggtatgctgcaccagagcaatacatcatgagcacacaaacgccatctgctccttctgttccagttgcaactactttgtctccagtcctatggcagctgaatcttcctgacagatttgacatatatagcttgggccttatattcttacagatggcattcccttctttacgaactgacagcagcctcatacaattcaaccgccaactgaagaggtgcaattacgacttagaagcttggaggaatctggtggagccacgagcaaccgctgagcttcggaggggctttgatatcatggatttggacgatggtattggatgggaactcctcacgtcgatggtccgttacaaagcgcggcaaaggatcagtgctgaggctgcattggcgcacccatacttcaaccgtgaaggccttcttggcctctctgtcatgcaaaacgtacggctgcaactgttccgggcaacccagaaggactacagtgaagcagctcgttgggttgtcggcctcatggcaaggtcaggaactgaagatgtgggaggctttacagaagcacagcttcaagagcttagggaaataaagccgaagaaaggcagcgcccagcggaacgtgctggcctccctgctgcgcgtgcagaggaagatcgtgagaacgatcaacgagagcatggacgatctcaccagccagcgcaaaagcatctggtggagccggtggataccgagggaggagtaggccggcgcacctgtacattgtccacttcttcttctgtataaaacgtcgcccaatagcattggtaatggtatgattgatatactatactgcttacttcgtatacttgctggtgactggtgagtacaatttgcctggaagactgcagtaacacgatgtatagatgtaaataatttgcatatgcacttaagcatc

SEQ ID NO: 2141 - DNA, 2057 bp, Oryza sativa
gaatccaagaaaaaaaaaagaaagcaaaaatggccaccggtagccttggcctctccacctccttcctccccggccacgacaccctcctccgccgccgccggcggcggccgccggcgacgacggcggcgtcgttccgcccggtgacggcggagctcggcggggagctggggcggcagctggtggaggcggtcggggtggggctcccctgcacggtgatggcgtgcggcgacgtcatctaccgcagcacgctcccccgcaacgacgggctcaccatcaccgcccccggcgtggcgctcgccctcgccgccgcgtcctacctctggtccacccccggcgtcgcgccgggcttcttcgacatgttcgtgctcgccttcgccgagcgcgtcttccgccccaccttccgcaaggatgaattcgtgctcgggaagaagcttggggagggcgcgttcggagtcgtctacaaggcgtcgctggatgaccccaaagctgcggagaagcaaggtgctgtggttgtgaagaaggcaacagagtatggtgcggtagaaatatggatgaacgagcgtgtcaggagggcctgtgctagcagctgtgcagattttatttatggctttcgtgagagcaaagctaaaggtaagggagctgatgaatactggcttatttggcgttatgaaggtgaggatacactattcgatctcatgcaaagcaaggagttcccttacaatgttgagactaagattctaggagatgttcaagacctgccaaagggaatagcaagagagaataagattattcaaacagtaatgagacaactcttatttgctcttgatggccttcattcaacagggattgttcacagagacgtaaaaccccaaaatgtgatattttcggaaggatctcgtacgttcaaaattattgatcttggagcagcagctgatttgcgagtgggcatcaactatattcctagtgagttccttttagatccaaggtatgctgcaccggagcaatatataatgagcactcaaacaccatctgctccctctgctccagttgcaactgctttatctccagtcctttggcagttgaaccttcctgacagatttgacatatatagcctgggccttatattcttacaaatggcatttccatcattgagaacggacagcagcctcatacaatttaaccgccaactgaagaggtgcaactatgacttagaagcttggaggaatttggtagagccacgagctaccccggagctccggaggggctttgacatcttggatttagatggtggtattggatgggaacttctcacatcgatggtccggtacaaagcacggcaaaggactggtgctaaggctgcactggcgcatccatatttcaaccgcgaggggctccttggcctctctgtaatgcaaaacttgaggctgcaactgcttcgtgcaacccagaaggactacagtgaagcagcccgttgggtcgtcggcctcatggcaagatcaggaacagaagcagaaggaggttttacagaggcacaacttcaagagcttagggaaatcaaaccaaagaaaggtagtgcacggaggaacttgcttgcttccgtgctgcgtgtacagagaaaggtcgtgaggacaatcaacgaaagcatggatgagcttagcagccagagcaaaagcatttggtggagccggtggataccaaaggaggagtaggcagacgcagctctgtccctctgtgcatcgcccatttcttctgtagaaacctcgccatgtagcaatggtaatggtacagcctacttacttccctacctctggtgagtacaaatcgtcgttccatcggaaaaagaccacaatagcatataccgatgtccaaataggtgtacatatatttgacatggaaccaaaattttcagagacccttatgataagttcataacagatccactgtacttgattaacctgtgattgattgttgctcggggactgtgttcatcatgtggtagtacaagaaacccatggcacaggtggtcgtaatgattaatgaatcctcataataagtgg

SEQ ID NO: 2142 - DNA, 2170 bp, Triticum aestivum
aaaatacaagaaaaaaatagcaatggccaccagtagcagcctcggcctctccacctccttcctccccggccacgacacccgcctccgccggcgccgccgggcggcccccgccgcggcgtcgtcgttccggccggtggtggcgtcggcggagctcggggccgaggtggggcggcagctggtggaggcggtgggggtgggcctgccctgcaccgtgatggcctgcggcgacgtcatctaccgcagcacgctgccccacaacgacggcctcaccatcaccgcccccggggtcgcgctcgcgctcgccgccgcctcctacctctgggccacccccggcgtcgccccgggcttcttcgacatgttcgtcctcgccttcgccgagcgcctcttccgccccaccttccgcaaggacgacttcgtgcccgggaagaagctcggggagggcgcgttcggggtcgtgtacaaggcgtcgctggccgaccccaaagccgcggagaagcaaggtgatgtggtcgtgaagaaggcgacagagtatggcgcagtggagatttggatgaatgagcgtgtcaggagggcatgcgctagcagctgcgcggattttctttacggctttcgtgagagcaaaaccaaaggtaagggtgaggaatactggcttatttggcgctatgaaggcgaggacacgctttctgctctcatgcaaagcaaggagttcccttacaatgtcgagactaagattctcggaaatgttcaagatttgccaaagggaatagcgagagagaataagattgtccaaacggtgatgggacaactcttgtttgctctagatggacttcattcgacagggattgttcacagggacataaaaccccaaaatgtgatattttcagaagaatctcgtaccttcaaaattattgatcttggagcagcagctgatttacgagtgggcatcaactatattcctaaggagttccttttggatccaaggtatgctgctccggagcaatatatcatgagcacacaaacaccatctgctccctctgctccagttgcaactgctttatctccagtcctgtggcagctgaaccttcctgacagatttgacatatacagcttgggcctcatatacctgcagatggcatttccagcgttgagaaccgacagcagcctgatacaattcaaccgccaactgaagagatgcaactacgacctggaagcctggaggaacttggtggaaccacgagccaccccagacctccgcaggggcttcgacatcctggacttagatggtggtatcggatgggagctcctgacgtcgatggtccggtacaaagcgcggcaaaggaccagcgccaaggctgcgctggcgcatccctacttcaacagcgaagggctcctcggcctctcagtcatgcagaacctgaggctgcagctgttccgcgcgacccagaaggactacagcgaggccgcgcgatggatcatcggcctcatggcaaaatcgggaacggaggagggcggtggcttcacggaagcacagctccaagagctcagggagatcaagccgaagaaggacagcgcgcagcggaacgtgctggcgtcgatgctgcgggtgcagaggaagatcgtgaggacgatcagcgagagcatggacgagcttacgagccagcgcaagagcatctggtggagccggtggatccccagggaggagtaggcaggctcagctcgatcggtacatcgtccagttcttctgtgaaaaaggaaaaacgtcaccctgttgtagctacggcaatggtatatcctacttactactctctaccgctggtgagtacagatttgtccatgggaaacactgcgataaatatgcgtatatataccggtacgaagatagatatgtacatatatgttccacgcggaagcaaaggtctcgagacccttatgaagttatgatcataggtagattcatggctgctcgattgtgcttgcttggttatgatctcaggtcacttgtacctttggtgcctgctatgtactgtatatcattggcaatggcattgccagccttataaccgcagtcgtgctggagcatctccgaccatatgtcggttgactgcgcctgtatgtgtggtgatattctgcctggtgagtgaggaagctactaagagtgaagcctctcttt

SEQ ID NO: 2143 - DNA, 1879 bp, Brachypodium distachyon
acgaaaaaggaagagaaaatcgggaggaatggccactagcagccttggcctctccacgtccttcctccccggccacgacacccggcggcggcgccggccgccgcggggccccgccgcgtcgttccggccggtgacggcggagctcggcgcggaggtggggcggcagctggtggaggcggtgggcgtggggctcccctgcaccgtcatggcctgcggcgacgtcatctaccgcagcacgctcccccacaacgacgggctcaccatcaccgcccccggcgtcgcgctcgcgctcgccgccgcgtcctacctctgggccacccccggcgtcgccccggggttcttcgacatgttcgtgctcgccttcgccgagcgcctcttccgccccactttccgcaaggacgatttcgtgcccgggaagaagcttggggagggcgcgttcggggtcgtgtacagggcgtcgctgtctgaccccaaggcggcggagaagcaaggtgatgtggtcgtgaagaaggcaaccgagtatggcgcagtcgagatatggatgaatgagcgtgtcaggagagcatgcgctagcagctgtgcagattttgtttacggattttgtgagagcaaacctaaaggtaagggagctgatgattactggcttatttggcgttatgaaggcgaggccacgctttctgctctcatgcaaagcaaggagttcccttacaatgctgagacaaagattctaggaaatgttcaagatttgccaaaggggatagcgagagagaataggattattcaaacggtgatgcgacaactcttgtttgctcttgatggacttcattcaacagggattgttcacagggacataaaaccccaaaatgtgatattttcagaagaatctcgcaccttcaaaattattgatcttggagcagcagctgatttacgagtgggcatcaactatattcctaaggaattccttttggatccaaggtatgctgctccggagcaatatatcatgagcacacaaacaccttctgctccctctgctccagttgcaactgctttatctccagttctgtggcagctgaaccttcctgacagatttgacatatatagcttgggcctgatattcttgcagatggcatttccagcattgagaacagacagcagcctcatacaatttaaccgtcaactgaagagatgcaactatgacttagaagcttggagggatttggtagaaccacgagctgccccagatcttcggaggggctttgacatcttggatttagatggtggtatcggatgggagctcctgacgtcgatggtccggtacaaagcgcggcaaaggactagtgccaaggctgcacttgcacatccatatttcaacagtgaagggctcctcggcctctcggtcatgcagaacttgaggctgcagctattccgcgcaacccagaaggactacagcgaagcggctcgatgggtcgtgggcctcatggcgaaatcaggaacggaagcaggaggaggcttcacagaagcacagcttcaagagcttagggagatcaaaccgaagaaagatagtgccgagcggaacgtgctcgcttccatgctgcgcgtgcagagaaagattgtgagaacgatcaacgaaagtatggacgagctcaccagccagcgcaaaagcatctggtggagccggtggattcccagggaggagtagagatcaggcaggcgcagctctgtacattgtccagttcttctataaaagacgactcccattagctacgctaaattggtaaatggtatatatgccctgcttactttgtagcgttggtgagtacaaatttgcccgtcggaaacactatgataacatataccgacatgaagatagatgtacata

SEQ ID NO: 2144 - DNA, 1912 bp, Brachypodium distachyon
acgaaaaaggaagagaaaatcgggaggaatggccactagcagccttggcctctccacgtccttcctccccggccacgacacccggcggcggcgccggccgccgcggggccccgccgcgtcgttccggccggtgacggcggagctcggcgcggaggtggggcggcagctggtggaggcggtgggcgtggggctcccctgcaccgtcatggcctgcggcgacgtcatctaccgcagcacgctcccccacaacgacgggctcaccatcaccgcccccggcgtcgcgctcgcgctcgccgccgcgtcctacctctgggccacccccggcgtcgccccggggttcttcgacatgttcgtgctcgccttcgccgagcgcctcttccgccccactttccgcaaggacgatttcgtgcccgggaagaagcttggggagggcgcgttcggggtcgtgtacagggcgtcgctgtctgaccccaaggcggcggagaagcaaggtgatgtggtcgtgaagaaggcaaccgagtatggcgcagtcgagatatggatgaatgagcgtgtcaggagagcatgcgctagcagctgtgcagattttgtttacggattttgtgagagcaaacctaaaggtaagggagctgatgattactggcttatttggcgttatgaaggcgaggccacgctttctgctctcatgcaaagcaaggagttcccttacaatgctgagacaaagattctaggaaatgttcaagatttgccaaaggggatagcgagagagaataggattattcaaacggtgatgcgacaactcttgtttgctcttgatggacttcattcaacagggattgttcacagggacataaaaccccaaaatgtgatattttcagaagaatctcgcaccttcaaaattattgatcttggagcagcagctgatttacgagtgggcatcaactatattcctaaggaattccttttggatccaaggtatgctgctccggagcaatatatcatgagcacacaaacaccttctgctccctctgctccagttgcaactgctttatctccagttctgtggcagctgaaccttcctgacagatttgacatatatagcttgggcctgatattcttgcagatggcatttccagcattgagaacagacagcagcctcatacaatttaaccgtcaactgaagagatgcaactatgacttagaagcttggagggatttggtagaaccacgagctgccccagatcttcggaggggctttgacatcttggatttagatggtggtatcggatgggagctcctgacgtcgatggtccggtacaaagcgcggcaaaggactagtgccaaggctgcacttgcacatccatatttcaacagtgaagggctcctcggcctctcggtcatgcagaacttgaggctgcagctattccgcgcaacccagaaggactacagcgaagcggctcgatgggtcgtgggcctcatggcgaaatcaggaacggaagcaggaggaggcttcacagaagcacagcttcaagagcttagggagatcaaaccgaagaaagatagtgccgagcggaacgtgctcgcttccatgctgcgcgtgcagagaaagattgtgagaacgatcaacgaaagtatggacgagctcaccagccagcgcaaaagcatctggtggagccggtggattcccagggaggagtagagatcaggcaggcgcagctctgtacattgtccagttcttctataaaagacgactcccattagctacgctaaattggtaaatggtatatatgccctgcttactttgtagcgttggtgagtacaaatttgcccgtcggaaacactatgataacatataccgacatgaagatagatgtacatattttttacacggaagcaatattttctggacctt

SEQ ID NO: 2145 - DNA, 1897 bp, Avena sativa
gaaaaaaaagataaagaaaatggccacgagcagcagcctcggcctctcgacctccttcctccccggccacgacacccgcctccgccggcggcggcggctgccggcggggatccccgccgcgtcgttccggccggtggcggagctcggcgtggaggtggggcggcagctcgtagaggcggtgggcgtggggctcccctgcaccgtgatggcctgcggcgacgtcatctaccgcagcacgctgcctcacaacgacggcctcaccatcaccgcaggcggcaccgcgctcgcgctcgcagtcgcgtcctacctctgggccacccctggcgtcgccccgggcttcttcgacatgttcgtcctcgccttcgccgagcgactctaccgccccaccttccgcaaggacgatttcgtgcccgggaagaagcttggggagggcgcgttcggggtcgtgtacaaggcgtcgctgtctgaccccaaaatggctgagaagcaaggtgatgtggtcgtgaagaaggcaacagagtatggcgcggtagagatatggatgaatgagcgtgttaggagggcatgcgctagcagttgcgcggattttctctacggctttcgtgagaacaaagccaaaggtaagggagatgaatactggcttatttggcgctatgaaggtgaggacacactttctgctctcatgcaaagcaaggagttcccctacaatgttgagactaagattcttggaaatgttcaagatttgccaaagggaatagcgagagagaataagatcgttcaaacagtgatgagacaactcttgtttgctcttgatggacttcattcgacggggattgtgcacagggacataaaacctcaaaatgtgatattttcagaagagtctcgtactttcaaaattattgatcttggagcagcggctgatttacgagtcggcatcaactatattcctaaggagttccttttggatccaaggtatgctgctccggagcaatatatcatgagcacgcaaacaccatctgctccctctgccccagttgcaactgctctatctccagttctgtggcagctgaaccttcctgacagatttgacatatacagcttggggctcatatacttgcagatggcatttccagcattgagaactgacagcagcctgatacaatttaaccgccaactgaagagatgcaattacgacttggaagcttggaggaatctggtagaaccacgagctaccccagaccttcggagggggtttgacatcttggacttagatggtggtatcggatgggaactcctgacgtcgatggtccggtacaaagcgcggcaaaggaccagcgccaaggctgcattagcgcacccgtatttcaacagagaagggctcctcggcctctccgtgatgcagaacttgaggctgcaagtgttccgcgcaacccagaaggactatagtgaggcagctcgatgggtcgtcagcctcatggcgagatcaggaacagaggcagcaggagggttcacagaagcacagcttcaagatctcagggagatcaagccgaagaaagacagcgcgcagcgcaacgtgctcgcgtcgatgctgcgcgtgcagagaaaagtcattagaacgatcaacgagagcattggcgagcttgccggcgagagcaaaagcatctggtggagccggtggatccccagggaggagtaggcaggggggcagctcggctctgtacattgtccagttcttctgtaaaattctggtaacggaatgtcctactacttgcatcctagtttctaccgttggtgagtacagattggtccatcggaaacaccacgataaagccgataacatataccgcgatacgaagatagatgtatatatgtgtgtttcacatggaagcagagtttc

SEQ ID NO: 2146 - DNA, 1888 bp, Avena sativa
aaaaaatagatagagaaaatggccacgagcagcagccttggcctctcgacctccttcctccccggccacgacacccgcctccgccgccggcggcagcttccggcggggatccccgccgcgtcgttccggccggtggcggagctcggcgtggaggtggggcggcagctggtggaggcggtgggcgtggggctcccctgcaccgtgatggcctgcggcgacgtcatctaccgcagcacgctgcctcacaacgacggcctcaccatcaccgcaggcggcaccgcgctcgcgctcgcagtcgcgtcctacctctgggccacccctggcgtcgccccgggcttcttcgacatgttcgtcctcgccttcgccgagcgactctaccgccccaccttccgcaaggacgatttcgtgcccgggaagaagcttggggagggcgcgttcggggtcgtgtacaaggcgtcgctgtctgaccccaaaatggctgagaagcaaggtgatgtggtcgtgaagaaggcaacagagtatggcgcggtagagatatggatgaatgagcgtgttaggagggcatgcgctagcagttgcgcggattttctctacggctttcgtgagaacaaagccaaaggtaagggagatgaatactggcttatttggcgctatgaaggtgaggacacactttctgctctcatgcaaagcaaggagttcccctacaatgttgagactaagattctcggaaatgttcaagatttgccaaagggaatagcgagagagaataagatcgttcaaacggtgatgagacaactcttgtttgctcttgatggacttcattcgacggggattgttcatagggacataaaacctcaaaatgtgatattttcagaagagtctcgtactttcaaaattattgatcttggagcagcggctgatttacgagtcggcatcaactatattcctaaggagttccttttggatccaaggtatgctgctccggagcaatatatcatgagcacacaaacaccatctgctccctctgctccagttgcaactgctctatctccagttctgtggcagctgaaccttcctgacagatttgacatatacagcttggggctcatatacttgcagatggcatttccagcattgagaactgacagcagcctgatacaatttaaccgccaactgaagagatgcaattacgacttggaagcttggaggaatctggtagaaccacgagctaccccagaccttcggagggggtttgacatcttggacttagatggtggtatcggatgggaactcctgacatcgatggtccggtacaaagcgcggcaaaggaccagcgccaaggctgcattagcgcacccgtatttcaacagagaagggctcctcggcctctccgtgatgcagaacttgaggctgcaagtgttccgcgcaacccagaaggactacagtgaagcagctcgatgggtcgtgagcctcatggcgagatcaggaacagaagcagcaggagggttcacagaagcacagcttcaagatctcagggagatcaagccgaagaaagacagcgcgcagcgcaacgtgctcgcgtcgatgctgcgcgtgcagagaaaagtcattagaacgatcaacgagagcattggcgagcttgccggcgagagcaaaagcatctggtggagccggtggatccccagggaggagtaggcaggggggcagctcggctctgtacattgtccagttcttctgtaaaattctggtaacggaatgtcctactacttgcatcctagtttctaccgttggtgagtacagattggtccatcggaaacaccacgataaagccgataacatataccgcgatacgaagatagatgtatatatgtgtgtttcacatggaagc

SEQ ID NO: 2147 - DNA, 1987 bp, Avena sativa
agatagagaaaatggccacgagcagcagccttggcctctcgacctccttcctccccggccacgacacccgcctccgccgccggcggcggcttccggcggggatacccgcagcgtcgttccggccggtggcggagctgggcgtggaggtggggcggcagctggtggaggcggtgggcgtggggcttcccctgcaccgtgatggcctgcggcgacgtcatctaccgcagcacgctgcctcacaacgacggcctcaccatcaccgcaggcggcaccgctctcgcgctcgcagtcgcgtcctacctctgggccacccctggcgtcgccccgggcttcttcgacatgttcgtcctcgccttcgccgagcgactctaccgccccaccttccgcaaggacgatttcgtgcccgggaagaagcttggggagggcgcgttcggggtcgtgtacaaggcgtcgttgtctgaccccaaaatggccgagaagcaaggtgatgtggtcgtgaagaaggcaacagagtatggcgcagtggagatatggatgaatgagcgtgtcaggagggcatgcgctagcagctgcgcagattttctctacggctttcgtgagaacaaagccaaaggtaagggggatgaatactggcttatttggcgttatgaaggcgaggacacactttctgctctcatgcaaagcaaggagttcccctacaatgtcgagactaagattctcggaaatgttcaagatttgccaaagggaatagcgagagagaataagatcgttcaaacggtgatgagacaactcttgtttgctcttgatggacttcattcgacggggattgttcacagggacataaaacctcaaaatgtgatattttcagaagagtctcgtactttcaaaattattgatcttggagcagcggctgatttacgagtcggcatcaactatattcccaaggagttccttttggatccaaggtatgctgctccggagcaatatatcatgagcacgcaaacaccatctgctccctctgctccagttgcaactgctctatctccagttctgtggcagctgaaccttcctgacagatttgacatatacagcctggggctcatatacttgcagatggcatttccagcgttgagaactgacagcagcctgatacaatttaaccgccaactgaagagatgcaattacgacttggaagcatggaggaatctggtagaaccacgagctaccccagaccttcggagggggtttgacatcttggacttagatggtggtatcggatgggaactcctgacatcgatggtccggtacaaagcacggcaaaggaccagcgccaaggctgcattagcgcacccgtatttcaacagcgaagggctcctcggcctctccgtgatgcagaacttgagtctgcaagtgttccgcgcaacccagaaggactatagcgaggcagctcgatgggtagtcagcctcatggcgagatcaggaacagaagcagcaggagggttcacagaagcacagcttcaagatctcagggagatcaagccgaagaaagacagcgcgcagcgcaacgtgctcgcgtccatgctgcgcgtgcagagaaaagtcatcagaacgatcaacgagagcattggcgagcttgccggcgagagcaaaagcatctggtggagccggtggatccccagggaggagtaggcagggggcagctcggctctgtacattgtccagttttctgtaaaattctggtaatggaatgtcctactacttgcatcctagtagtttctaccgttggtgagtacagattggtctctcggaaacaccacgataaagccgataacatataccgcgatatgaagatagatgtatataatgtgtgtttcacatggaagcagagtttctgggacaccttatgaccatgataggctcatggctactccagtatgcttggttgttaatgtgtgatggctttgctgacctggaggcaccctttcat

SEQ ID NO: 2148 - DNA, 2165 bp, Avena sativa
gttcattttcgaaccacggaaaagaaagaaaaaaaagataaagaaaatggccacgagcagcagccttggcctctcgacctccttcctccccggccacgacacccgcctccgccgccggcggcggcttccggcggggatacccgcagcgtcgttccggccggtggcggagctgggcgtggaggtggggcggcagctggtggaggcggtgggcgtggggctcccctgcaccgtgatggcctgcggcgacgtcatctaccgcagcacgctgcctcacaacgacggcctcaccatcaccgcaggcggcaccgctctcgcgctcgcagtcgcgtcctacctctgggccacccctggcgtcgccccgggcttcttcgacatgttcgtcctcgccttcgccgagcgactctaccgccccaccttccgcaaggacgatttcgtgcccgggaagaagcttggggagggcgcgttcggggtcgtgtacaaggcgtcgctgtctgaccccaaaatggctgagaagcaaggtgatgtggtcgtgaagaaggcaacagagtatggcgcggtagagatatggatgaatgagcgtgttaggagggcatgcgctagcagttgcgcggattttctctacggctttcgtgagaacaaagccaaaggtaagggagatgaatactggcttatttggcgctatgaaggtgaggacacactttctgctctcatgcaaagcaaggagttcccctacaatgttgagactaagattcttggaaatgttcaagatttgccaaagggaatagcgagagagaataagatcgttcaaacagtgatgagacaactcttgtttgctcttgatggacttcattcgacggggattgtgcacagggacataaaacctcaaaatgtgatattttcagaagagtctcgtactttcaaaattattgatcttggagcagcggctgatttacgagtcggcatcaactatattcccaaggagttccttttggatccaaggtatgctgctccggagcaatatatcatgagcacgcaaacaccatctgctccctctgctccagttgcaactgctctatctccagttctgtggcagctgaaccttcctgacagatttgacatatacagcctggggctcatatacttgcagatggcatttccagcgttgagaactgacagcagcctgatacaatttaaccgccaactgaagagatgcaattacgacttggaagcttggaggaatctggtagaaccacgagctaccccagaccttcggagggggtttgacatcttggacttagatggtggtatcggatgggaactcctgacatcgatggtccggtacaaagcacggcaaaggaccagcgccaaggctgcattagcgcacccgtatttcaacagcgaagggctcctcggcctctccgtgatgcagaacttgagtctgcaagtgttccgcgcaacccagaaggactatagcgaggcagctcgatgggtagtcagcctcatggcgagatcaggaacagaagcagcaggagggttcacagaagcacagcttcaagatctcagggagatcaagccgaagaaagacagcgcgcagcgcaacgtgctcgcgtccatgctgcgcgtgcagagaaaagtcattagaacgatcaacgagagcattggcgagcttgccggcgagagcaaaagcatctggtggagccggtggatccccagggaggagtaggcagggggcagctcggctctgtacattgtccagttcttctgtaaaattctggtaacggaatgtcctactacttgcatcctagtttctaccgttggtgagtacagattggtccatcggaaacagcacgataaagccgataacatataccgcgatatgaagatagatgtatatatgtgtgtttcacatggaagcaggtttctgggacaccttatgatcatgagaggcccatggctactccaatgttcttggttattgatgtgtgatggctttgctgacctggaggcacccctttcatgctgtgcaaggttccgtgacaggtcagttgtgcccttggtgctatcattggcatcgccaaccatatgtcggtggactgcgcctttgtggcgactgtctgactggtgagtgatgaactaatgagtgaggtcggctgtatcatttaggt

SEQ ID NO: 2149 - DNA, 2074 bp, Lolium multiflorum
tcctccccggccacgacacccgcttccgccgccggcgccggacggcgggggtccccgccgcatcgttccgtccggcggcggagctcggggccgaggtggggcggcagctggtggaggcggtgggcgtggggctcccctgcaccgtgatggcctgcggcgacgtcatctaccgcagcacgctgccccacaacgacggcctcaccatcaccgcgggcggaaccgcgctcgcgctcgccgccgcgtcctacctctgggccacccccggcgtcgccccgggcttcttcgacatgttcgtcctcgccttcgccgagcgcctctaccgccccactttccgcaaggacgatttcgtgcccgggaagaagcttggcgagggcgcgttcggggtcgtgtacaaggcgtcgctaactgaccccaaagcggcggagaagcaaggtgctgtggtggtgaagaaggcaacagaatatggcgcagtagagatatggatgaatgagcgtgtcaggagggcatgtgctagcagctgcgcggattttctttacggctttcgtgagaaaaaagccaaaggtaagggagatgaatactggcttatttggcgctatgaaggtgaggacacactttctgctctcatgcaaagcaaggagttcccctacaatgttgagactaagattctcggaaatgttcaagatttgccaaagggaatagcgagagagaataagattgttcaaacggtgatgagacaactcttgtttgctcttgatgggcttcattctacagggattgtgcacagggacataaaaccccaaaatgtgatattttcagaagattcccgtactttcaaaattattgatcttggagcagcagctgatttacgagtcggcatcaactatattcctaaggagtttcttttggatccaaggtatgctgctccagagcaatatatcatgagcacacaaacaccatccgctccctctgctccagttgcaactgctctatctccagttctgtggcagctgaaccttcctgacagatttgacatatacagcttgggcatcatatacttgcagatggcatttccagcactgagaactgacagcagcctgatacaatttaaccgccaactgaagagatgtaactatgacttggaagcttggaggaatttggtagaaccacgagctactccagatcttcggaggggttttgacatcttggatttagatggtggtatcggatgggaactcctgacgtcgatggtccggtacaaagcgcggcaaaggaccagcgccaaggctgcattggcgcatccgtattttaacagtgaagggctcctcggcctctcagtgatgcagaacttgagcctgcaactgtttcgtgcgactcagaaggactatagtgaggcagctcgatgggtcgtcagcctcatggcaagatcaggaacagaagcagcaggagggttcacagaagcacagcttcaagacctcagggagatcaaaccgaagaaagacagtgctcagcgcaatgtgctcgcgtccatgctgcgcgtgcagagaaaagtcgttagaacgatcaacgagagcatgggtgagcttaccagccagagcaaaagcatctggtggagccggtggatccccagggaggagtaggcaggcacagctatgtacattgtccagttcttctgtagctatggtcatgatatatatttgtccatgggaaacactacgataaatatacgtatacggatacgaagatagatgtacatatatgtttcacatggaagcaaagttttcgagaccctgatggccttatacatgatcattattatatgttcatggatactccactgtgcttcggtgttgatgtttgatggcttgctgatctggaggtacccctatcatggggtgcaagattccatgacaggtcagttgtgctttgatactatcattggcatcgcaactatatgtcggtggactgcacctttgtggtgactgtctgactgatgagtgatgaagtaatgagtgaagtttatggctcagctgtatcatttggtccctatcttttgttgcatttatctgagtgtccc

SEQ ID NO: 2150 - DNA, 2113 bp, Panicum virgatum
atccgctgcttggctgcttcccctccccaccccggcgccgcgccaccatggccaccgccacggtgaccccgccgcaatgctggcgagggctccccgcttccgcgcgcgcacgcccgcctctctcctcccccctccgcgttcacccccttgccgctcccttccgtcccccgaggccccgcaccgccagcacggcagccagcggaagaggaaggcgatccgccctggcctgctccccgaggtgcacgctggggacggccggccccgctgggttcgaccctctggggctctacaaggagggcccgtcggggtctgaagcctcttcgcggtcgcccctgtcgaccttcttcggtatcctggcgccggtgtttgggagctccagcgggggtggcgccaggagggagaaggcgtcctatggccgaggagcagcagctgcaatcgaggatagctccattgacatcggtgacttcttcaagggtcctctacctgggaagttcctgaagctccttggttttttggccttgtctcgacttggtgtgtatatacccttgggtggggtgaaccgagaagcttttgctgggaaccttgaccagaacagcctgctgagcactttagattctttctccggtggtggtattggtcgtcttggaatatgctctcttggcattgtaccattcattaatgcacagattgtgtttcaacttcttgcacaactgtacccaaaattgcaagaccttcagcggaaagaaggggaagcaggaagaaagaaggttcttcaatatacaagatatgcctctgttggttttgcagttgtccaggctattggacaagtcctttatctccgtccttatgtgaatgacttcagcacagaatgggttctaacctcggtgacattattgacacttggatcagtctttactactttcattggtgaaagaatatctgatctgaaacttggaaacggaacatctcttcttatatttacaagtattatatcatatttgcctgcatcatttgggaggacagttgcacaggcatttcaagatgggaactatgttggacttatcacaatcatattgtcgttctttttgttagtccttggaattgtctatgtccaagaagctgaacgcaaaatacccctgaactatgcttctagatacagcagtcgaactgggggacttcaacgatctgcatatctaccatttaaggtcaacagttctggtgtcatgcctatcatattttcaacatcttcgctggctttgcctggtactttggcacggttcactggcttggagtttcttaagaaggctgccgtagcccttaatccaggaggatctctgtatcttccaaccaatgtattacttatagccttttttaattactattacacatttctccaattggatcctgatgatcttagtgagcaattgaagcggcaaggtgcttcaattcctcttgtgagaccagggaaaagcacagctgcttatattaaaacagttctcagtcgtatatctgtcctgggatctgcgtttcttgctgtgctagctgctggaccttctgtggttgaacaaataagtcacttgacggcattccggggatttgctggtacatcggtgcttatccttgttggatgtgcaactgacacagctcggaaagttcaagcagaaataatttcccagaaatataagaatatcgagttctatgatgttaaccgttttgaccaatagttgatctcactggtcgttcttttcaacctgtacttaaattttcaattatgtaattgagcatcggattcttagctaagcattttatcattgttcacttggatcttatttaaattctactgtgtatagcactgaaatctatacttgaagtacagaagcattcatctgtatactaacatagtaacatgtcaatacactcaaatcgtaaaactatgtgtttattattcaaaattcatgttgctgttaatgttaaatgaattttgtccttcagaaaaaggaacttaaattacgattccgttccatattttttgtgtgcctttattgcatcaactgaataatttgcttattggtcaagagttcattagaaaagatgacatagacaggttaaaaaa

SEQ ID NO: 2151 - DNA, 1931 bp, Oryza sativa
ccaaatccactcgtccgtctccctccacccatggcggccatggccaccccgcagcaatgctggctccccacccgcgcgcgcgctccccctcctcctcctccacgcgcaccctcctccgcgtcccccgtctccggagctcccgcctccctccgcttccgtgggcgccgcgccgcgtcggcgtcggcgtcggcggcgaggaggaggaggggagcctccctgccctgctcccccaggtgcgcgttggagacggctggccctggctttgaccccctagggctgtacaacgatgggccttcgaggaatgacacgcagtccccgctgtcgaacttcttcggagtactgtcgccggtgttcgggagctcgagcggcggcaggaaggagaagtcctatggacgaggagcagcagctgcaattgaagatagttccattgacattggtgacttcttcaagggtcctctacctgggaagttcttgaagctccttggttatttggccttgtctcgacttggtatttatatacctctgggtggagtgaaccgggatgctttcgctggtaatcttgaccagaacagtctactaggcactttggattctttttctggtggaggtattggccggcttggaatatgctcccttggcattgttccgtttatcaatgcacagattgtgtttcagcttcttgcacaactttatccgaaattgcaagatcttcagaaaaaagaaggggaggcaggaagaaagaaggttcttcagtatacaagatacgcatctgttggttttgcaattgtccaggctattggacaagttctttttcttcgtccttatgttaatgacttcagcacagaatgggtcctcacatccgtgacactactgacgcttggatcagtgtttacaactttcattggcgaaagaatatctgatttaaaactcggaaatggaacatctcttcttatatttacaagtataatatcgtatttacctgcatcgtttggaaggacagttgcacaggcatttcaagatgggaattatgttgggcttctgacaatcatattatcgttccttttcttagttcttgggattgtttatgtccaagaagccgagaggaaaattccgctaaattatgcttctcgatacagtagtcggagtggagggctccaacgatctgcatatctaccatttaaggtcaatagttctggtgtcatgcctataatattttctacatcttctttggctttgcctggtactttggcacgatttactggcttagactttcttaaaaaggctgccatatccctaaatccaggaggtgctttgtatattccaactaatgtactgcttatagcctttttcaattactattacaccttccttcaattggatcctgatgatcttagtgagcaattgaagcggcaaggtgcttcaataccgcttgtacggccaggaaaaagtacagctgccttcataaaaacagttcttagtaatatatctgtcctaggatctgccttccttgctgttttagctgctggaccatctgtggttgaacaaatcactcacttaacggcatttcggggatttgctggtacatcagtgcttatccttgttggatgtgcaacagacacagctcggaaagttcaggcagaaataatttcacagaaatataagaacattgagttctatgatgtcaaccgtttcgaccaatgattaatgacactgatcattcttttgaacttgtaccaaatgttctgttgtattataattgggtcatgtggtagcatttaagactgttcaattttatgcccgttttccttctatcgtgcatatcacttgtatgtttacttgaggagcagaaaccatacatccttatgtacataaatatattagaattatttacctcagaatatgaactttctaccatattgttcagacctcat

SEQ ID NO: 2152 - DNA, 3414 bp, Brachypodium distachyon
acccatcacccactcatctccttcctccgccacagtccccgcgccaccatggccacggcgaccccgcagcaatgctggctcccggccccggggtgcccacctaccatctcctctgtcctgtgcctgggctctctcaccagagcagccgcctcctcccacttcccgggacgccgcacggcatcagtaagaaggagaggaagaaccgccttcgcctgctccccgaggtgcacgctggagacggctggcccggcctttgatcctctagggctctacaaggacgacccttccgggtctgattaccagtctcccctgtcgactttcttcggcatcctgttgccggtgttcgggagctccagtggctccaggaacgagaagtcgtcctatggccgaggagcagcagccgcaatggaggatagttctattgacattggtgacttcttcaagggccctctacctgggaaatttctgaagctccttggttttttggttttgtctagaattggtgtgtatgtacctttgggtggagtgaaccgggaagcttttgcgggtaatcttgaccagaacagtctgcttggcactttagattccttttctggtggaggcattggtcggcttggaatatgctcccttggcattgttccatttatcaatgcacagattgtgtttcagcttcttgcacagctttacccaaaattgcaagatcttcagaaaaaagaaggggaggctggcagaaagaagattcttcagtatacaagatatgcatctgttggttttgcaattgtccaggctattgggcaagttctttttctccgtccttatgttaatgacttcagcacagagtgggtactaacatccgtgacattgttgacacttggatcggtgtttacaactttccttggtgaaacaatatccgagttaaaactagggaatggaacatctcttcttatatttacaagtataatatcatatttgcctgcatcatttggaaggacagttgcagagggattccaagcagggaattatgttggacttctcacaattatattgtcattctttttcttagttcttgggattgtctatgtccaggaagctgagaggaaaataccactgaactatgcttctcgatacagcagtcgaactggaggaccccaacgctcggcatatctaccttttaaggtcaatagttccggtgtcatgcccatcatattttctacatcttcattggctttgcctgctactttggcacgattcactggattagattttcttaaaaaggctgccattgctctaactccaggaggttctttttatcttccaactaatgtattgcttatagcctttttcaattactattacacctttcttcaactggatcctgatgatcttagtgagcaattgaagcggcaaggtgcttcaattccacttgtgcggccgggaaaaagtacagctgcattcattaaaactgttcttagtcgtatctctgtcctaggatcaggctttctggctgtactagctgctggaccatctgtagttgaacaaatctctcacttgacagcatttcgaggatttgctggtacatcagtgcttatccttgttgggtgcgcaaccgacacggctcggaaagttcaggcagaaataatttctcagaaatataagaacattgagttctatgatgtcaaaagttctgacaaatgattgatctcaccgatcattcttttgaacatataggaagtatttcttcttgtgatgctgttgtgaagctgaaagaaccatcaagatactgacttgttgtctcgttgacattgtcatcgaccaatgagaagaatgattcccgcctgctgttgagacctacttctgctatcttttgtcggttatggtgcctactcctcaaggctgggaaagtgtaagtggggtgacatggtgaaggcacagatgcagatgaaaggaactgggtctcagaagtcagcggggtcaagttggattgaacttgatgaagcattctgtgagttcacgttggggcacagaaaccactcagactcggaccagatacctgagatggttgataggctgagttcgcattttaaggatgttggctgcgttcccacagggcaatctcaagtaagcaagcaccagctccagtaaaaccttggcacctgcagtcaagaagatgctgtgacatggtatagaaccgtaaaatcgagagatctggcaaagcatttcagcatctgctcttctgccatcagcattcatctgggccatacattagcatttttctccagagaaggaaaatattggcagggctatgagtttggagatgtgcctaaccagaatatttaagttactgagtgaaatgtttggatctccagagtccatcaagttaatactggtccaagtggttcttttcaagagtcacctgatgctatcaagaagaaaaaaaagaaagaaatggctttgagatgtttcagaagttcgagacaattttaagtcaaaattttctgcaacatgcctgtcagtattgagaataaaataaacgtgcatgaaataatttccacagcaatccatattcaagatttgttgtttgaagaaacgtttcccaaatttacaattgcccacaaaacaattaagaccagaagttgacttcccttgttcttttcatggaagcacatgtaaattaaatgtatcctttagaaaaatcacagctgatgcaccctacaagcacacccccctctttgtttgactacttgtgtaccatcttgattcatcggagattactgaaaacatgtctcagcagaagttctgttcttttttatttctctgcgtgcgtgtgatataatgtgtgattcagctgccataacatataaacttctagccaccaccctctcctgcctcattgaatgtttttacaataccgtatatgtttaggttagaaagggaacacatcggattcagattagcatagaagaggtatttttgttcgggaaagaggtagatgtgagctgagtgcaatttatctgttcacagaaacatcctaaacctgtcagctgaggtcaggctcatcccggaccgagccccctgtggtggcttggcctcagcctcggcctctgttgcttctgttgtttcctttttccttgtgttttgttttcgttttgttccggcttgccggttgtactcacacatcttgcgtcttcttgatgaaaatgacacgccgcttggtgtgttcgagaaaaaaaatggtcagacctcatcctaaatgtagatgtgcctctcttcctagtgtaaaacagcaagttcctaaatgtttcttgttgcatgttgacacaccggacactgctagcctcatatattatctcttgtactaatccacaagcagacaaaaagacttgttgcaggttttgtgtgcacaccgcaacgaag

SEQ ID NO: 2153 - DNA, 2659 bp, Brachypodium distachyon
aacccatcacccactcatctccttcctccgccacagtccccgcgccaccatggccacggcgaccccgcagcaatgctggctcccggccccggggtgcccacctaccatctcctctgtcctgtgcctgggctctctcaccagagcagccgcctcctcccacttcccgggacgccgcacggcatcagtaagaaggagaggaagaaccgccttcgcctgctccccgaggtgcacgctggagacggctggcccggcctttgatcctctagggctctacaaggacgacccttccgggtctgattaccagtctcccctgtcgactttcttcggcatcctgttgccggtgttcgggagctccagtggctccaggaacgagaagtcgtcctatggccgaggagcagcagccgcaatggaggatagttctattgacattggtgacttcttcaagggccctctacctgggaaatttctgaagctccttggttttttggttttgtctagaattggtgtgtatgtacctttgggtggagtgaaccgggaagcttttgcgggtaatcttgaccagaacagtctgcttggcactttagattccttttctggtggaggcattggtcggcttggaatatgctcccttggcattgttccatttatcaatgcacagattgtgtttcagcttcttgcacagctttacccaaaattgcaagatcttcagaaaaaagaaggggaggctggcagaaagaagattcttcagtatacaagatatgcatctgttggttttgcaattgtccaggctattgggcaagttctttttctccgtccttatgttaatgacttcagcacagagtgggtactaacatccgtgacattgttgacacttggatcggtgtttacaactttccttggtgaaacaatatccgagttaaaactagggaatggaacatctcttcttatatttacaagtataatatcatatttgcctgcatcatttggaaggacagttgcagagggattccaagcagggaattatgttggacttctcacaattatattgtcattctttttcttagttcttgggattgtctatgtccaggaagctgagaggaaaataccactgaactatgcttctcgatacagcagtcgaactggaggaccccaacgctcggcatatctaccttttaaggtcaatagttccggtgtcatgcccatcatattttctacatcttcattggctttgcctgctactttggcacgattcactggattagattttcttaaaaaggctgccattgctctaactccaggaggttctttttatcttccaactaatgtattgcttatagcctttttcaattactattacacctttcttcaactggatcctgatgatcttagtgagcaattgaagcggcaaggtgcttcaattccacttgtgcggccgggaaaaagtacagctgcattcattaaaactgttcttagtcgtatctctgtcctaggatcaggctttctggctgtactagctgctggaccatctgtagttgaacaaatctctcacttgacagcatttcgaggatttgctggtacatcagtgcttatccttgttgggtgcgcaaccgacacggctcggaaagttcaggcagaaataatttctcagaaatataagaacattgagttctatgatgtcaaaagttctgacaaatgattgatctcaccgatcattcttttgaacatataggaagtatttcttcttgtgatgctgttgtgaagctgaaagaaccatcaagatactgacttgttgtctcgttgacattgtcatcgaccaatgagaagaatgattcccgcctgctgttgagacctacttctgctatcttttgtcggttatggtgcctactcctcaaggctgggaaagtgtaagtggggtgacatggtgaaggcacagatgcagatgaaaggaactgggtctcagaagtcagcggggtcaagttggattgaacttgatgaagcattctgtgagttcacgttggggcacagaaaccactcagactcggaccagatacctgagatggttgataggctgagttcgcattttaaggatgttggctgcgttcccacagggcaatctcaagtaagcaagcaccagctccagtaaaaccttggcacctgcagtcaagaagatgctgtgacatggtatagaaccgtaaaatcgagagatctggcaaagcatttcagcatctgctcttctgccatcaggtttgctctcttaagaactgctactatgttaacatgaaagcaggtgatgggaggcaccggaaaaacaccgccaattgccattgtagcattaggttggtcaaatagttcatagatcaatacttttaatgctttacttcacctggttaaacaaatccaaagcagcacatagattaggtcttgtataaataagagaagtgagtagaccccagattaaaagtcaagaagtgattttctatgtctattgtagcagcaacgtgattatattggaaaagtagatagttgagtgttttacaatttctccaaggaggaaaggatccttactccgatagttcatggatcagtacttttaatgcttcacttcatctgcttaaacaaatccaaagcagtgcgtgggattaggccttgtataaataag

SEQ ID NO: 2154 - DNA, 2027 bp, Leymus cinereus x Leymus triticoides
cgtccccgccccaccatggccacggcgacaccgcagcaatgctgccttccggcccgcgcgcgccctcctcccacctccgctcccctgcgcctacgctacctcaccagagcagcctcctccttccacttcccgggccgccgcacggcaacggcaagaaggagaggaagcgccgccttcgccttctcccccagatgcacgttggagacgggtggcccggccttcgatcctctaggcctctacagggaggacccgtccagttctgattatcagtctcccttctcgacatttttcggtgtcctgtctccagtgttcgggagctccagtggatccaggaaagagaagtcatcctatggccgaggagcagcagctgcaatggaggacagtactattgactttggtgacttcttcaagggtcctctacccgggaagtttctgaagctccttgggtttttggcattgtctcgacttggtgtgtatatacctttgggtggagtgaaccaggcagcttttgctggtaatcttgaccagaacagtctgctgggcactttagattctttttctggtggaggtattggccggcttggaatatgctccctcggcattgttccattcatcaatgcacagattgcgtttcagctccttactcagctttacccaaaattgcaagatcttcagaaaaaagaaggggaggcaggtagaaaaaagattcttcagtacacaagatatgcatctgttggttttgcaattgcccaggctatcgggcaagttctttttcttcgtccttatgttaatgacttcagcacagaatgggtactaacatctgtgactctattgacgcttggatcagtgttcacaactttccttggtgaaacaatatctgagttgaaactcgggaatggaacatctcttcttatttttacaagtataatatcctatttgcctgcatcatttggaaggacagttgccgagggatttcaagcaggcaattatgttggacttctcacaatcatattgtcattctttttcctagttcttgggattgtctatgtccaggaagctgagagaaaaataccactgaactatgcttctcgatacggcagtcgaactggaggaccccaacgttctgcatatctaccttttaaggtcaatagttccggtgtcatgcctatcatattttctacatcttcattggctttacctgctactttggcacgtttcactggcttagattttcttaaaaaggctgccatagccctaactccaggaggttctttttatcttccaactaatgtattgcttatagcctttttcaattactattacacttttcttcaattggatcctgatgatcttagtgagcaattgaagcgaccaggtgcgtcaataccccttgtgcggccaggaaaaagtacagctgcctttattaaaacagttcttagtcgtatctctgtcctaggctctgcctttctcgctgtactagctgctggaccatctgtggttgaacaaatctctcacttgacagcatttcggggatttgctggtacatcagttcttatccttgttggatgtgcaaccgacacggctcggaaagttcagacagaaataatttctcagaaatataaggacatcgagttctatgatgtcaaaagttctgacaaatgattatctttcgaacgtgtacttaaatattatctcgtataaatgattgttgtgtcatttgctagtatttcattattctttcccttttctcttcttctgtgtatcagttagatctcttctagaggatcagagttcggaaagcctgaatcagtatgtaaaagatactctatagctgtggaagctatacagctcatggatatttctgttgtggagtgatctgatgtgatctctgtaccctggagaagggattttaaactttcatctatattgcttcttaaaattttagaactaaagtgttggcgagtgatcaacatgtcagcagagagactgggaaacggagataatataatgttcttcaagtcaactca

SEQ ID NO: 2155 - DNA, 2072 bp, Triticum aestivum
acctaaaaacccaccatccactcgtctccttcctccgccatcgtccccgcggcaccatggccacggcgacaccacagcaatgctgccttccggcccgcgcgcgccctcctcccacctccactcccctgcgcctacgctacctcaccagagcagcctcctccttccacttcccgggccgccgcacggtaacggcaagaaggagaggaagagccgccttagccttctcccccagatgcacgttggagacgggtggcccggcctttgatcctctagggctctacagggaggacccgtccagttctgattatcagtctcccttctcgacatttttcggtgtcctgtctccagtgttcgggagctccagtggatccaggaaagagaagtcatcctatggccgaggagcagcagctgcaatggaggacagtactattgactttggtgacttcttcaagggtcctctacccgggaagtttctgaagctccttgggtttttggcattgtctcgacttggtgtgtatatacctttgggtggagtgaaccaagcagcttttgctggtaatcttgaccagaacagtctgctgggcactttagattctttttctggtggaggtattggccggcttggtatatgctccctcggcattgttccgttcatcaatgcacagattgtgtttcagctccttactcagctttacccaaaattgcaagagcttcagaaaaaagaaggggaggcaggtagaaaaaagattcttcagtacacaagatatgcatctgttggttttgcaattgcccaggctatcgggcaagttctttttcttcgtccttatgttaatgacttcagcacagaatgggtgctaacatctgtgactctattgacgcttggatcggtgttcacaactttccttggtgaaacaatatctgagttgaaactcgggaatggaacatctctccttatttttacaagtataatttcgtatttgcctgcatcatttggaaggacagttgcagagggatttcaagcaggcaattatgttggacttctcacaatcatattgtcattctttttcttagttcttgggattgtctatgtccaggaagctgagagaaaaataccactgaactatgcttctcgatacggcagtcgaactggaggaccccaacgttctgcatatctaccttttaaggtcaatagttctggtgtcatgcctatcatattctctacatcttcattggctttacctgctactttggcacgtttcactggcttagattttcttaaaaaggctgccatagccctaactccaggaggttctttttatcttccaactaatgtattgcttatagcctttttcaattactattacactttccttcaattggatcctgatgatcttagtgagcaattgaagcgaacaggtgcgtcaataccgcttgtgcggccaggaaaaaatacagctgcctttattaaaacagttcttagtcgtatctctgtcctaggatctgcctttctcgctgtactagctgctggaccatctgtggttgaacaaatctctcacttgacagcatttcggggattcgctggtacatcagtgcttatccttgttggatgtgcaaccgacacggctcggaaagttcagacagaaataatttctcagaaatataaggacatcgagttctatgatgtcaaaagttctgacaaatgattatcttccgaacatgtacttaaatataatctcgtataaatgattgttgtgtcatttggtagtatttcattattcttttccttttttctcttctgtgtatatcagttagatctcttctagaggatcagagttcggaaagcatcagtatgtaaaagatactctatagctgtggaagctttacagctcatggatatttctgttgtggagtgatctgatgtgatctctgtaccctggagaagggattttaaactttatctatattgcttcttaaaattttagaactaaagtattggcgagtgttcaacatgtccgtcgagagactgagaaacagagataatataacgttcttcaagccaactcaattattta

SEQ ID NO: 2156 - DNA, 1958 bp, Avena sativa
gcttcctccgccatcgtccccgcgccaccatggccacggcgacaccgcagaaatgctgccttcccgcccccgcgagccctcctccaatatccgctcgcctgcgcctgccctacctcgccaggggagcttcttcctgccacttcccgggacgccgcacggtaacggcaaggagaggaagaaccgccgtcgccttctcgtcaagatgcacgttggagatggctggcccagcctttgatcctctagggctctacaaggaggacccttccagctctgattatcagtctcccttatcgacattctttggcatcctgtctccggtgttcgggagcaccagtggctccaggaaggagaagtcatcctatggccgaggagcagcagctgcaatggaggatagtactattgacattggtgacttcttcaagggccctctacccgggaagtttctgaagctccttgggtttttggccttgtctcgacttggtgtgtatatacctttgggtggagtgaaccgggaagcttttgctggtaatcttgaccagaacagtctgctgggcactttagattctttttctggtggaggcattggccggcttggaatatgctcccttggcattgttccatttatcaatgcacagattgtgtttcagcttcttgctcagctttatccaaaattgcaagatcttcagaaaaaagaaggggaagcgggtagaaagaagatccttcagtacacaagatatgcatctgttggttttgcaattgtccaggctattgggcaagttctttttctccgtccttatgttaatgacttcagcacggaatgggtgttaacatctgtcacactattgacgcttggatcggtgtttacaactttccttggtgaaacaatatctgagttgaaactcgggaatggaacgtcacttcttatatttacaagtataatatcgtatttgcccgcatcattcggaaggacagttgcggagggttttcaagcagggaattatgttggacttctcacaatcatattatcattcttttttttagttcttgggattgtctatgtccaggaagcagagaggaaaataccattgaactatgcttctcgatacagtagccgagctggaggcccccagcgttctgcatatctacctttcaaggtcaatagttccggtgtcatgcctatcatattttctacatcttcattggctttacctgctactttggcacgattcactggcttagatattcttaaaaaggctgccatagccctaactccaggaggttctttctatcttccaactaatgtgatgcttatagcctttttcaattactattacacttttcttcaattggatcctgatgatcttagtgagcaattgaagaggcaaggtgcttcaataccgcttatgcggccaggaaaaaatacagctgcctttattaaaacagttcttagtcgtatctctgtcctaggatctgcctttctggctgtactagctgctggaccatctgtggtcgaacaaatatctcacctgacagcatttcggggattcgctggtacatcagtgctgatccttgttggatgtgcaaccgacacggctcggaaagttcaggcagaaataatttctcagaaatataagaacatcgagttctatgatatcaaaaattctgagcaatgattgatctcactgatcattcttttgaacatgtacttcaaagctatctcatataaatgattgttgtatcttctggtagcattccattttaattgttgtccttttcttcttctgtgtatatcacttagatctcttctagaggatcagggttcggaaagcatgcatcaatatgtaaaaagatgctcaaatgttgaagctgtggaagctacatctcatggataccctggaaaagggttttttaactgtcttccaaattccttcttaaattaaagaataaaattattggtt

SEQ ID NO: 2157 - DNA, 1682 bp, Avena sativa
cgtccccgcgccaccatggccacggcgacaccgcagaaatgctgccttcccgcccccgcgagccctcctccaatatccgctcgcctgcgcctgccctacctcgccaggggagcttcttcctgccacttcccgggacgccgcacggtaacggcaaggagaggaagaaccgccttcgccttctctccaagatgcacgttggagatggctggcccagcctttgatcctcagggctctacaaggaggacccttccagctctgattatcagtctcccttatcgacattctttggcatcctgtctccggtgttcgggagcaccagtggctccaggaaggagaagtcatcctatggccgaggagcagcagctgcattggaggatagtactattgacattggtgacttcttcaagggccctctacccgggaagtttctgaagctccttgggtttttggccttgtctcgacttggtgtgtatatacctttgggtggagtgaaccgggaagcttttgctggtaatcttgaccagaacagtctgctgggcactttagattctttttctggtggaggcattggccggcttggaatatgctcccttggcattgttccatttatcaatgcacagattgtgtttcagcttcttgctcagctttatccaaaattgcaagatcttcagaaaaaagaaggggaggcgggtagaaagaagatccttcagtacacaagatatgcatctgttggttttgcaattgtccaggctattgggcaagttctttttctccgtccttatgttaatgacttcagcacggaatgggtgttaacatctgtcacactattgacgcttggatcggtgtttacaactttccttggtgaaacaatatctgagttgaaactcgggaatggaacgtcacttcttatatttacaagtataatatcgtatttgcccgcatcattcggaaggacagttgcggagggttttcaagcagggaattatgttggacttctcacaatcatattatcattcttttttttagttcttgggattgtctatgtccaggaagcagagaggaaaataccattgaactatgcttctcgatacagtagccgagctggaggcccccagcgttctgcatatctacctttcaaggtcaatagttccggtgtcatgcctatcatattttctacatcttcattggctttacctgctactttggcacgattcactggcttagatattcttaaaaaggctgccatagccctaactccaggaggttctttctatcttccaactaatgtgatgcttatagcctttttcaattactattacacttttcttcaattggatcctgatgatcttagtgagcaattgaagaggcaaggtgcttcaataccgcttatgcggccaggaaaaaatacagctgcctttattaaaacagttcttagtcgtatctctgtcctaggatctgcctttctggctgtactagctgctggaccatctgtggtcgaacaaatatctcacctgacagcatttcggggattcgctggtacatcagtgctgatccttgttggatgtgcaaccgacacggctcggaaagttcaggcagaaataatttctcagaaatataagaacatcgagttctatgatatcaaaaattctgagcaatgattgatctcactgatcattcttttg

SEQ ID NO: 2158 - DNA, 1542 bp, Pennisetum glaucum
cgaccctctggggctctataaggacggcccgtcggggtctgattcttcctcttcgcggtcgcccctgtcgaccttctttggtatcctggcgcctgtttttgggagctccagcggtggtgggacaaggagggagaaccgaggagcagcagctgctatcgaggatagctccattgacattggtgacttcttcaagggccctctacctgggaagttcctgaagcttcttggtttcctggccttatctcggcttggtgtctatatacccttgggtggagtgaacagagaagcttttgccgggaatcttgaccagaacagcctgctgggcactttagattctttctctggtggtggtattggtcgtctaggaatatgctcccttggcattgtgccatttattaatgcacagattgtgtttcaactgcttgcacaactttacccaaaattgcaagaccttcaacggaaagaaggggaagcaggaagaaagaaggttctgcaatatacaagatatgcctctgttggttttgcaattgtccaggctatcggacaagttctttatctccgtccttatgtgaatgacttcagcacagaatgggttctaacatcggtgacattattaacacttggatcagtctttactacattcattggtgaaagaatatctgatttgaaacttggaaatggaacatctcttctgatatttacaagtataatatcatatttgcctgcatcatttgggaggacagtgtcacaagcatttcaagatgggaactatgttggacttctcaccatcatattgtcattctttttattagtccttgggattgtctatgttcaagaagctgaacgcaaaatacccctcaactatgcttctcgatacagtagtcgaactgggggacttcaacgatctgcgtatctaccatttaaggtcaacagttctggtgtcatgcctatcatattttctacatcttccctggctttgcctggtaccttggcacggttcactggcttggagtttcttaagaaggctgctgtagcccttgttccaggaggttctctgtatcttccaactaatgtattacttatagccttttttaattactattacacatttctccaattggatcccgatgatctaagtgagcaattgaagcggcaaggtgcttctatacctcttgtgagaccaggaaaaagtacagctgcttatattaaaacagttcttagtcgtatatctgtcttgggatctgtgtttcttgctgtgctagctgctggaccttctgtggttgaacaaataagtcacttgacggcattccggggatttgctggtacatcagtgcttatccttgttgggtgtgcaactgacacagctcggaaagttcaagcagaaataatttcccagaaatataagaatattgagttctatgatgtcaaccgttttgaccaatagttgatcttactggtcattcttttcaacctgtacttaacttttcgattgtgtaattgaatatgggatccttaactaagcaatttattatgcttcactct

SEQ ID NO: 2159 - DNA, 1187 bp, Saccharum officinarum
tcccattccaagtcccccgctcccggattcccgacgacgagctcagagctcctcctccccagccccagctcggtgctcgaagcgacagctgccgccatgtctgctgccaaccagctcgccgccctcatcgccaacatgttcgccacgggtttgcttgacgatcaattccagcagctccagttgctgcaggaccccagcgcccctaacttcgtgtccgaggtcgtcaccctcttctgccaggacggcgagcggatcatcggggagctggccaaacagctggacaagcccagcgtggattttgacagggtcgacgccttcgtgcatcagctcaagggtagcagtgctagtgttggcgcgctgaaggttaagaacacttgcatccagttccgcgaattctgtcagcagaagagcaaagatgggtgcctcaagacactggagacggtgaggattaacttctatgagctgcgtggcaagtttcagaccatgcttcagctggagcgtcaggtcaatggctttccccccaacaattaaaccagatggcggagtggagcttcatgttgggatgatgcatgcacctttcaagtctcagaacattctgaatgagctcctcagttggcttctgggaagcctgtaatagcttagcagcaggattagtgttgacaccaccgtagcagtagtcattgtcatcgtctttgtgtcatcgaagtagtagtcgtaagtgtctgctgggtgatggatctcctgcaagcagttgctggtggtctgtttactctgtagtagtcgctcttaataatctatctcttaggagtctgctagtggaacttggtggtgaaacaaaataaaatgctatggctattggttagtaataataggctgctgtgtttggtaacatgtgcgtgctgtgtgatgtgctatgtgaaagtgagcctgtcgttggatcatggtttgtatcaatgcagatttttcaggttggtggcgcgactgtcagggcatcaggggggcctgccctatcaatggttgttttgcttccccttgagttgttttcccttaacattctatgctcttatctagattctgtacagaatgtttagtcctttgttactcctttcttggccataatcttgacatgttcttctgatgcagctggagcggcagatccagggcttttcccccaagaagtaatcccg

SEQ ID NO: 2160 - DNA, 893 bp, Zea mays
ctctattcccattccaagtccccgctcttggattcccgacgacgagctcggagcttcttcttccctgctcggtgctcgtcgcaacagctgccgccatgtctgccgcgaaccagctcgccgctctggtcagcaacatgtacgccacgggtttgcttgacgatcagttccagcagctccagctgctccaggaccccagcgcccctgacttcgtctccgaggtcgtcacgctcttctgtcaggacggcgagcggatcatcgaagagctggccaaactgctggagaagcccaacgtggattttgacagggttgacgcctttgtgcatcagctcaagggaagcagtgcaaatattggtgctcagaaggttaagaacacttgcattcagttccgcgaattctgtcagcagaagagcagagatgggtgcctcaaggtactggagacaatgaggattaacttctatgagctgcgtggcaagtttcagaccatgcttcagctggagcgtcaggtcaatggctttccccccaacaagtaaaccagatggtggagtggaccttcatgttaggatgatgcttgcacctttcaagtttcagaacattctgaatgagctcctcaattggtttctgggaagtcttgtaatagcttagcagcaagattagcgttgacaccaccgtagcagtagtcattgtcgtcaagtagttgtcctaaatgtctgtgctgggttatggatctcctgcaagcagttgcaggcttgcagctgttctgtttactctagtagtttattttggagtagtcgctctcaataaatctgtcctaggagtctattggtggattattagtcagtcagtttctgggattcctggtggtgaagcaaaacaatgttatggctatcggttaa

SEQ ID NO: 2161 - DNA, 941 bp, Zea mays
gccaaatatgcagcggttccagtgcaggctgtgcagcctccctgagctgtgccaggaatcgcattccccctgtaatccactataaataggtctcaatcatccctcactagtcactcactctattcccattccaagcccccgctctcggattcccgacgacgagctcagagctcctcctctcctcccctgctcggtgttcgacgcaacagctgccgccatgtctgccgccaaccagctcgccgccctcgtcagcaacatgtacgccacgggtttgcttgacgatcagttccagcagctccagatgctccagaacgccagtactcctgacttcgtctccgaggtcgtcacgctcttctgccaggacggcgagcggatcatcggagagctggccaaactgctggagaagcccaacgtggattttgacagggttgacgcctttgtgcatcagctcaaaggaagcagtgcaagtattggtgctcagaaggttaagaacacttgcattcagttccgcgaatcctgtcagcagaagagcaaagatgggtgcctcaagacactggagacagtgaagattaacttctatgacctgcgtgacaagtttcagaccatgcttcagctgcagcgtcaggtcaatggctgtccccccagcaagtgaacaagatggtggagtggagcttcatgttgggatgatgcgtgcatctttcaagttccagaacattctgaataagctcctcaattggcttctaggaagtctgtaatagcttagcagcaagattagcgttgacaccaccgtagcagaagtcaatgtcgtcgtttttgtgtcaccgtcttagtcgtaagtgtccgtgctgggtgatggatctcctgcaagcagttgcaagtggtccatttactatgtagtagtggctctgaataatctatatcttagcaatgaatttggcaac

SEQ ID NO: 2162 - DNA, 1244 bp, Zea mays
gccgccatgtctgccgccaaccagctcgccgccctcgtcagcaacatgtacgccacgggtttgcttgacgatcagttccagcagctccagatgctccagaacgccagtactcctgacttcgtctccgaggtcgtcacgctcttctgccaggacggcgagcggatcatcggagagctggccaaactgctggagaagcccaacgtggattttgacagggttgacgcctttgtgcatcagctcaaaggaagcagtgcaagtattggtgctcagaaggttaagaacacttgcattcagttccgcgaatcctgtcagcagaagagcaaagatgggtgcctcaagacactggagacagtgaagattaacttctatgacctgcgtgacaagtttcagaccatgcttcagctgcagcgtcaggtcaatggctgtccccccagcaagtgaacaagatggtggagtggagcttcatgttgggatgatgcgtgcatctttcaagttccagaacattctgaataagctcctcaattggcttctaggaagtctgtaatagcttagcagcaagattagcgttgacaccaccgtagcagaagtcaatgtcgtcgtttttgtgtcaccgtcttagtcatttttcaggttggtggcgacgtcaggggagggcagccagccacagatagcaatgagacatgttgctgtagcgtcagattcagggcttttgccccaagaaataactcagttactcagagtggtggaattgatggagttggatgttgggatgatgcatacaatacatctttcagaatcaagggacgtgttcaatgagctcctcacttggcttctaggcttcaaccatctaggaagtctgtaacagcctagcagcaagattagctgttgacgcttttgtgtcactgtaatagtctgtcttaaatttataaggggtggagaagcaaagcatgttatggttaataatacctaaggtagtgtttgttcgaaagtatgatggaacggagccggtccactcttaatttgttgttgtttggattcttaatttgttgttgtttggattggttacatatacgagagtgatataaaaaaggaaaatcatgctccagctttccaaaatttcctggacggagccactccatttcaactggctcccaaacatgcttacttcgcggtctgctatatgaaagtgagtcaaagatttcgggttggtacttgtgtcgccaagcatcgcatcgtacacgtga

SEQ ID NO: 2163 - DNA, 919 bp, Setaria italica
acccctcagccttcactcgctgcgttcccctttcagttccccacacacaccccgctccccggttcccgacgagctcggagctccccctcccccgctcggtgctcaccgcgacagcagcagccatggacgccgccaaccagctgaccgccctcctcaacaacatgttcgccacgggtttgctggacgagcagttccagcagctgcagatgctccaggaccccagcgccccggacttcgtctccgaggtggtcacactcttctgccaggacggcgagcgcatcatcggcgagctcgccaagctgctggagaagcccactgtggattttgacagggtcgacgcgtttgtgcatcagctcaagggtagcagtgctagtgtcggcgcccagaaggtgaaaaatacatgtgttcagtttagggaggtctgccagctcaagagcagggatggatgcctgaagactttggacttggtaagaactgaattctatgatctgcgcggcaagtttcagactatgcttcagctggagaagcacatccaggggttcaagtgaacccaagttggggaacggagctgcatttcgggatgatgcctacaccgctcaagcttcagaacatgccggatgcgctcctcagctgcagcagattatgagctgacacctttctgtttccttagtctgtcgtcatcgtcttagtgttgttgttgtcgggtgatccatcttcctgcaagcagttgcaggtcgtctggtcactcctagtcctagtcaccatttcgtagtctcttaggtccccaaactgcctaccggtttgggctttaaatggtgtcaagctagtcggtcagtcagtcgtatcctagttgtgttatggtaaagcaaaacgatgctgtggttaatttgaatgaatctgctgcttattggtgatattt

SEQ ID NO: 2164 - DNA, 868 bp, Setaria italica
cccctttcagttccccacacacaccccgctccccggttcccgacgagctcggagctccccctcccccgctcggtgctcaccgcgacagcagcagccatggacgccgccaaccagctgaccgccctcctcaacaacatgttcgccacgggtttgctggacgagcagttccagcagctgcagatgctccaggaccccagcgccccggacttcgtctccgaggtggtcacactcttctgccaggacggcgagcgcatcatcggcgagctcgccaagctgctggagaagcccactgtggattttgacagggtcgacgcgtttgtgcatcagctcaagggtagcagtgctagtgtcggcgcccagaaggtgaaaaatacatgtgttcagtttagggaggtctgccagctcaagagcagggatggatgcctgaagactttggacttggtaagaactgaattctatgatctgcgcggcaagtttcagactatgcttcagctggagaagcacatccaggggttcaagtgaacccgagttggggaacggagctgcattttgggatgacgcctacaccgctcaagcttcagaacatgccggatgcgttcctcagctgcagcagattatgagctgacacctttctgtttccttagtccgtcgtcatcgtcttagtgttgttgttgtcgggtgatccatcttcctgcaagcagttgcaggtcgtctggtcactcctagtcctagtcaccatttcgtagtctcttaggtccccaaactgcctatcagtttgggctttaaatggtgtcaagctagtcggtcagtcagtcgtatcctagttgtgttatggtaaagcaaaacgatgctgtggttaatttgaatg

SEQ ID NO: 2165 - DNA, 937 bp, Festuca arundinacea
acattagtcctactcctactcctattcccgcagctccctcccattaaaacctccccgctagcttcgggtagccatggcggccgcgatgcaactcaacaccctcatgtccaacatgttcgccacgggtttgctggacgatcagttccagcagctgcagatgctccaggacccgagcgccccggacttcgttgccgaggtcgtcacgctcttctgcgaggacggcgagcggatcatcggcgagctcgccaaactgctggataagccagctgtggacttcgacaaggtggatgcttttgtgcatcagctcaagggcagcagtgcaagtgttggtgctcagagagtgaagaacacctgcattcagttccgtgagttttgtcaggggaagagcagagatgggtgcctgaagacactggatgctgtgaggaatgatttctatgatctgcgcagcaagtttcagaccatgcttcagctggagcagcaggtccaggcctccttctatcctaagcagtaagctcgaacaacagagtgggaatcgcatgttctgatggcactcctgcctttgaagtcgtagaacatgctcaactagcttttatcttggagtcgtttgcttctgtgtggtcgtccgtagcttcttagcagcaagctggtcatttagtgtcatcgatgtctctgttactgttggtagtgtcgttctgaattctcaatggtcaaataacaatcatctgccggcgctttgcggattgtcagtggttaatctggctgctcagttctagccagtttctaggtcgtaggtctgcagtgtaatcttgacatagtcgtgccttgttggtcggtggatcggctatggttgtatgttgtggagaacattgtgatgttattctaatcccaagttaatgttaaaaaaaagaaaaaaaaacaaaagtactctgcgttgata

SEQ ID NO: 2166 - DNA, 1196 bp, Lolium multiflorum
cgtgaatccaattccccacccaccctgtacaattcacaatcaatccactcctactcctattcccgcagcttcctctcccctttccttgctttgcttcctccccgctagctccagtcctcgtttcgggcagccatggcggccgcgatgcaactcaacaccctcatgtccaacatgttcgccacgggtttgctggacgatcagttccagcagctgcagatgctccaggacccgagcgccccggacttcgttgccgaggtcgtcacgctcttctgcgaggacggcgagcggatcatcggcgagctcgccaaactgctggataagccagctgtggacttcgacaaggtggatgcttttgtgcatcagctcaagggcagcagtgcaagtgttggtgctcagagagtgaagaatacctgcattcagttccgtgagttttgtcaggggaagagcagagatgggtgcctgaagacactggatgctgtgaggaatgatttctatgatctgcgcagcaagtttcagaccatgcttcagctggagcagcaggtccaggcctccttctatcctaagcagtaagctcgaacaacagagtgggaatcgcatgttctggcggcactgctgcctttgaagtcatagaacatgctcaactagcttttatcttggagtcgtttgcttctgtgtggtcgtccgtagcttcttagcagcaagctggtcatttagtgtcatcgatgtctctgttactgttggtagtgtcgttctgaattctcaatggtcaaataacaatcatctgccggcgctttgcggattgtcagtggttaatctggctgctcagttctagccagtttctaggtcgtaggtctgcagtgtaatcttgacatagtcgtgccttgttggtcggtggatcggctgtggttgtatgttgtggagaacattgtgatgttaatctaatgtaaagttactgtttgttgttgggaaaaatgtgtgtaccatgatacaacatacaacatacaattactcagttcaagttattttctatttgatcccaggtgggatttaacattattcgcgattttgtcccttatgattcttccagagtgcagaaatatcatgctggttccgtgttagcgatatggaaacagttcaataccaggaggaactgacgagggaacattgtcagcaacagaccacagttggcaggtaag

SEQ ID NO: 2167 - DNA, 3708 bp, Zea mays
caaaaaaagagctcggtgtcgcggggacaccgcccgtgcccgcggctcgctttaaggcggtcgcgcccgtgtcacggtcaaatgccgtcttcgttcttccacggagagagaggcagaggcaggcggccggtgcatgcatgccccgccctccctccgtgcgcccccgaagacctcctccgcccccggcgcggtgagctcgtgaccgcccggacggcacccgcctctccggtttgaggctcgctgcacgcactccaataaaacaaaagaagcaaccatggcgtccatttccccggaggacattggcggggacgtcaatctgtccaagatcccggtggaggaggtgttcaagacgctgaaatgcgaccgcaaggggctgtccagcacggagggcgagaaccggctcaggacgttcgggcccaacaagctggaggagaagaaggagaacaacctcctcaagttcctgggcttcatgtggaacccgctctcgtgggtcatggagatggcggccatcatggccatcgcgctcgccaacggcggcggcagggcgcccgactggcaggacttcgtcggcatcgtctcgctgctcttcatcaactccaccatcagctacatcgaggaggccaacgccgggaacgccgcggcggcgctcatggccgggctggcgcccaagaccaagctgctgagggacggcaggtgggaggagcaggacgcgtcgatcctggtgcccggtgacatcatcagcatcaagctcggcgacatcatccccgccgacgcgaggctgctcgagggggacccgctcaagatcgaccagtcggcgctcaccggtgagtcgctccccgtgaacaagcaccctgggcaggaggtcttctcgggctccaccgtcaagcagggggagatcgaggccgtcgtcatcgccaccggcgtgcgcaccttcttcggcaaggcggcgcacctcgtcgacagcaccaacaacgtcggccacttccagcaggtgctcacggccatcggcaacttctgcatcatctccatcgctgccggcatgctggtcgaggtcattgtcatgtacccgatccagcaccgcgcgtaccgcgacggcatcgacaacctcctcgtcctgctcatcggcggcatccccatcgccatgcccaccgtgctctcggtcaccatggccatcggttcccaccgcctgtcgcagcagggggccatcacgaagcgcatgacggccatcgaggagatggccggcatggacatgctctgtagcgacaagaccggcaccctcaccctcaacaagctcaccgtcgacaagtccctcatcgaggtgtactccaagggcgtcgacagggacatggtgctcctctacgccgcgagggcctcccgcgtcgagaaccaggacgccattgacacctgcatcgtcaacatgctcgccgaccccaaggaggcccgcgctggcatccaggaggtccacttcctccccttcaacccggtcgagaagcgcacggccatcacctacatcgacggcaacggcgactggcacagggtcagcaagggcgctcccgagcagatcatcgagctctgcaacatgggcgccgaggccgagaagaaggtccatgccttgatcgacgggtacgccgaccgcggcctccggtcgctcggcgtgtcgtaccagcaggtgccggagaagagcaaggagagcgccggcgacccgtggcagttcattggcctcctgcccctgttcgacccgccgaggcacgacagcgcggagaccatccgccgcgcgctccacctgggcgtcaacgtgaagatgatcaccggcgaccagctcgccatcggcaaggagaccggccgccggctcggcatgggcaccaacatgtacccctccaccacgctcctgggcgacaagaacaccacggtgaacggcatgcacatcgacgagctgatcgagaaggcggacggcttcgctggggtcttccccgagcacaagtacgagatagtgaagcggctccaggaccggaaccacatctgcggcatgaccggggacggcgtgaacgacgcgccggcgctgaagaaggcggacatcggcatcgccgtggacgacgcgacggacgcggcccggagcgcgtcggacatcgtgctgactgagcccgggctgagcgtgatcgtgagcgccgtgctgacgagccgctccatcttccagcgcatgaagaactacaccatctacgccgtgtccatcaccatccgcatcgtgctgggcttcctcctcatcgcgctcatctggaagttcgacttcgcgcccttcatggtgctcatcatcgccatcctcaacgacggcaccatcatgaccatctccaaggaccgcgtcaagccgtcgcccacccccgactcgtggaagctcaacgagatcttcgccaccggcatcgtgctcggcacctacatggccatcatcaccgccgtcttcttctacctcgcccacgacaccgacttcttcacggacgtgttcggcgtgaattcgatcaaggagaacgacagggagctgatggcggcgctgtacctccaagtaagcatcatcagccaggcgctcatcttcgtgacgcggtcccggagctggtcgttcgtggagcggccgggcttcctcctgctcttcgccttcttcgccgcccagctggtggcgacgtgcatcgcggtgtacgccgactgggacttctgccgcatccaggggatcggctgggcgtggggcggcgccatctggatgttcagcatcgtcacctacatcccgctcgacgtgctcaagttcatgatccgcgccgcgctcagagacaaggccacgggcaacaacgtccacaacaagtgatacgtttatctgggtgcttgtcgcggacggcgtttaggaacaaggactgcggcaagggccggcgatcgcgaggcacagtgggcggtagagcagagacactccacgggcctcaaccagctcgccaccacctcctcctccgaccttctaggcagcaaggactagcatgcagtccgagctcaccgaggaggcccgcaaaggtcgcaagatatacgtagctacagtcttctccggcgactagcccaccatctctagcgccgctgatgcggctgatctcgctggtctccagagaccgacggcgtccagcggtggccggaggagtcctgtgttcttcgtttccttaggtgtacttatgtgggttttggggtggcaagagagttttttttttgtgaactctggtgtatcggatcaagtgaatatgtacctacatgttgtgttcttaattctgcattgtacagctatacactatacaagggtacgggaatgctgaggtgtaacttccatgcaatatacttagttgtattcatctaatcatcaaactgccagcaactttttatttacttcacttatttggagttatgtgtaatggagtcatagtaggcctgtttgtttcgccataggttgctgcggactttcaaaacctattttcagtcggcttttataagaagcactttgataaaaaccgtccaaaatcacgtgaacataaaaccgatcaagtcttcacgaaagtaagaatccgccactttctagatcataaaccatataagctcatttatctctcccgcacgaaatcatcatgatactcagattattcatacaattagattctcttcacggtaagagtctcagaaaaaatcttcaga

SEQ ID NO: 2168 - DNA, 3815 bp, Setaria italica
tcgaacattccccaaatgactggagtatgatcgttcatgcggtggttcccctagaaatgctataagttggtaggtaagattttggcaaccacttaaattagtacttgtgtcattccgtgtgatgttttggacatcgacatgctctctagctagtagttaccaactttgagtgcatttatatggtaaacttgtaacaaatttgtaactttactatatttacagaaaatcaattggaatgaaaatcagtttgatcttctatatatgccttctcgttgcattgcatgcagtgcatacgctatgcagagccagcgcacgccgagaccagaggcgccccacgaaggccgggcagccaagagctgggcgtcgcgcgtcccgcgcccgccgcgccttataagacgcccgcgcccgcgccacggccaccgccgtcttcgtccatccacggagagagaggcagaggcaggcagctggtgcgtgccccgccctccctctccccgaagacctccgcccccggcactaccggccggacggcgtcgtcccgctcctctggctagaggttcgccgccacccaccccaacttgaataaaagaaaaggaagaaaaagaagcagccatggcgtccatctccccggacgacgtccgagatggaaacgtcgatctgtcgaagatgccggtggaggaggtgttcaagacgctcaagtgcgaccgcaaggggctctccggcgcggaggcggagggccggctcagggcgttcggccccaacaagctggaggagaagaaggagagcaagctgctcaagttcctgggcttcatgtggaacccgctgtcgtgggtgatggagatggcggccatcatggccatcgtgctcgccaacggcggcggcaagccgcccgactggcaggacttcgtcgggatcgtcacgctgctcatcatcaactccaccatcagctacatcgaggaggccaacgccggggacgccgcggcggcgctcatggcggggctggcgcccaagaccaagctgctgagggacggtcggtgggaggagcaggacgcgtccatcctagtccccggcgacatcatcagcatcaagctcggcgacatcatccccgccgacgccaggctgctcgagggcgacccgctcaagatcgaccagtcggcgctcaccggcgagtcgctgccggtgaacaagcacccggggcaggaggtgttctcgggctccacggtgaagcagggcgagatcgaggccgtcgtcatcgccaccggcgtgcacaccttcttcggcaaggcggcgcacctcgtcgacagcaccaacaacgttggccactttcaacaggtgctcacggccatcggcaacttctgtatcatctccatcgccgccggcatgctggtcgaggtcgtcgtcatgtactcggtccagcaccgcgcgtaccgcgacggcatcgacaacctcctcgtgctcctcatcggcggcatccccatcgccatgcccaccgtgctctccgtcaccatggccatcggctcccaccgcctctcccagcagggcgccatcaccaagcgcatgaccgccatcgaggagatggccggcatggacatcctttgcagcgacaagacgggcaccctcaccctcaacaagctcaccgtcgacaagtccctcatcgaggtctactccaagggcgtcgacaaggacatggtgctcctctacgccgcccgggcctcccgtgtcgagaaccaggacgccatcgacacctgcatcgtcaacatgctcgccgaccccaaggaggcccgcgccggcatccaggaggtccacttcctccccttcaaccccgtcgagaagcgcacggccatcacctacgtcgacggcaacggcgactggcacagggtcagcaagggcgcccccgagcagatcatcgagctctgcaacatgggcgccgacgccgagaagaaggtccacgccctcatcgacggctacgccgaccgcggcctccggtcgctcggcgtgtcgtaccagcaggtgccggagaagagcaaggagagcgccggcgagccgtggcagttcatcggcctcctgccgctgttcgacccgccgcggcacgacagcgccgagaccatccgccgcgcgctccacctgggcgtcaacgtcaagatgatcaccggcgaccagctcgccatcggcaaggagaccgggcgccgcctcggcatgggcaccaacatgtatccctccaccaccctcctcggcgacaagaacagcacggtgaacggcatgcccatcgacgagctcatcgagaaggccgacggcttcgccggcgtcttcccggagcacaagtacgagatcgtgaagcggctccaggaacggggtcacatctgcggcatgaccggcgacggcgtgaacgacgcgccggcactgaagaaggcggacatcgggatcgccgtcgacgacgcgacggacgcggcccggagcgcgtcggacatcgtgctgacggagcccgggctcagcgtcatcgtcagcgccgtgctcaccagccgctccatcttccagcgcatgaagaactacaccatctacgccgtctccatcaccatccgcatcgtgctggggttcctcgtcatcgcgctcatctggaagttcgacttcgcgccattcatggtgctcatcatcgccatcctcaacgacggcaccatcatgaccatctccaaggaccgcgtcaagccgtcgcccaagccggactcgtggaagctcaacgagatcttcgccaccggcatcgtcctcggcacctacatggccctcgtcaccgcgctcttcttctacctcgcccacgacaccaacttcttcagcgacgtgttcggcgtggcgtccatcaaggagaacgacagggagctcatggcggcgctctacctccaggtcagcatcatcagccaggcgctcatcttcgtgacgcggtcgcggagctggtccttcgtggagcggccggggtacctcctgctcttcgccttcttcgccgcgcagctcgtggcgacggcgatcgccgtgtacgccgactgggagttctgccgaatccaggggatcggatgggcgtggggaggcgccatctgggtcttcagcgtcgtcacctacatcccgctcgacgtgctcaagttcatgatccgctccgcgctcagaggccaggcctgcagcaaagaacagaacaaggcaagcctcgccgtcctccattgttattgccatcaacgaccatgatctcagttaaactgtccattgttggcttcaaccctgatctccgtgattgtcgtcttctccagtgaaacatttctaggtgcttgtctcgagcggagggcgttcgtgaacaaacactctgagctcgccgaggaggccgccaagcgcgccgaggtcgcaagactgggagctgaacgtggcggaggtgacggtggccggagagggagtcctgtgttcttcgtttcctccttaggtgtacaattttttgggtggattttttgagcggctagaggtttgtgaaactgtggtttatccgattgggtctgatcaagtaaatacgtacctacgtattgttgtgttcttaattctgtacagctatacattatacaacggtacgggaatggtgagggtgtaacgtccgtatacgatatacctaattgtacttaacatcttgtcagcaaatttttggttcactgacttctggttatgagtaatggacgtatactatttagtccaggcatgactaatcttaaacatttcctacaattccaaatccttaagaccatctgagctccaccacaacatactttacagtttactggcaagtgaatgcc

SEQ ID NO: 2169 - DNA, 3571 bp, Setaria italica
agtttgatcttctatatatgccttctcgttgcattgcatgcagtgcatacgctatgcagagccagcgcacgccgagaccagaggcgccccacgaaggccgggcagccaagagctgggcgtcgcgcgtcccgcgcccgccgcgccttataagacgcccgcgcccgcgccacggccaccgccgtcttcgtccatccacggagagagaggcagaggcaggcagctggtgcgtgccccgccctccctctccccgaagacctccgcccccggcactaccggccggacggcgtcgtcccgctcctctggctagaggttcgccgccacccaccccaacttgaataaaagaaaaggaagaaaaagaagcagccatggcgtccatctccccggacgacgtccgagatggaaacgtcgatctgtcgaagatgccggtggaggaggtgttcaagacgctcaagtgcgaccgcaaggggctctccggcgcggaggcggagggccggctcagggcgttcggccccaacaagctggaggagaagaaggagagcaaggtgctcaagttcctgggcttcatgtggaacccgctgtcgtgggtgatggagatggcggccatcatggccatcgtgctcgccaacggcggcggcaagccgcccgactggcaggacttcgtcgggatcgtcacgctgctcatcatcaactccaccatcagctacatcgaggaggccaacgccggggacgccgcggcggcgctcatggcggggctggcgcccaagaccaagctgctgagggacggtcggtgggaggagcaggacgcgtccatcctagtccccggcgacatcatcagcatcaagctcggcgacatcatccccgccgacgccaggctgctcgagggcgacccgctcaagatcgaccagtcggcgctcaccggcgagtcgctgccggtgaacaagcacccggggcaggaggtgttctcgggctccacggtgaagcagggcgagatcgaggccgtcgtcatcgccaccggcgtgcacaccttcttcggcaaggcggcgcacctcgtcgacagcaccaacaacgttggccactttcaacaggtgctcacggccatcggcaacttctgtatcatctccatcgccgccggcatgctggtcgaggtcgtcgtcatgtactcggtccagcaccgcgcgtaccgcgacggcatcgacaacctcctcgtgctcctcatcggcggcatccccatcgccatgcccaccgtgctctccgtcaccatggccatcggctcccaccgcctctcccagcagggcgccatcaccaagcgcatgaccgccatcgaggagatggccggcatggacatcctttgcagcgacaagacgggcaccctcaccctcaacaagctcaccgtcgacaagtccctcatcgaggtctactccaagggcgtcgacaaggacatggtgctcctctacgccgcccgggcctcccgtgtcgagaaccaggacgccatcgacacctgcatcgtcaacatgctcgccgaccccaaggaggcccgcgccggcatccaggaggtccacttcctccccttcaaccccgtcgagaagcgcacggccatcacctacgtcgacggcaacggcgactggcacagggtcagcaagggcgcccccgagcagatcatcgagctctgcaacatgggcgccgacgccgagaagaaggtccacgccctcatcgacggctacgccgaccgcggcctccggtcgctcggcgtgtcgtaccagcaggtgccggagaagagcaaggagagcgccggcgagccgtggcagttcatcggcctcctgccgctgttcgacccgccgcggcacgacagcgccgagaccatccgccgcgcgctccacctgggcgtcaacgtcaagatgatcaccggcgaccagctcgccatcggcaaggagaccgggcgccgcctcggcatgggcaccaacatgtatccctccaccaccctcctcggcgacaagaacagcacggtgaacggcatgcccatcgacgagctcatcgagaaggccgacggcttcgccggcgtcttcccggagcacaagtacgagatcgtgaagcggctccaggaacggggtcacatctgcggcatgaccggcgacggcgtgaacgacgcgccggcactgaagaaggcggacatcgggatcgccgtcgacgacgcgacggacgcggcccggagcgcgtcggacatcgtgctgacggagcccgggctcagcgtcatcgtcagcgccgtgctcaccagccgctccatcttccagcgcatgaagaactacaccatctacgccgtctccatcaccatccgcatcgtgctggggttcctcgtcatcgcgctcatctggaagttcgacttcgcgccattcatggtgctcatcatcgccatcctcaacgacggcaccatcatgaccatctccaaggaccgcgtcaagccgtcgcccaagccggactcgtggaagctcaacgagatcttcgccaccggcatcgtcctcggcacctacatggccctcgtcaccgcgctcttcttctacctcgcccacgacaccaacttcttcagcgacgtgttcggcgtggcgtccatcaaggagaacgacagggagctcatggcggcgctctacctccaggtcagcatcatcagccaggcgctcatcttcgtgacgcggtcgcggagctggtccttcgtggagcggccggggtacctcctgctcttcgccttcttcgccgcgcagctcgtggcgacggcgatcgccgtgtacgccgactgggagttctgccgaatccaggggatcggatgggcgtggggaggcgccatctgggtcttcagcgtcgtcacctacatcccgctcgacgtgctcaagttcatgatccgctccgcgctcagaggccaggcctgcagcaaagaacagaacaaggcaagcctcgccgtcctccattgttattgccatcaacgaccatgatctcagttaaactgtccattgttggcttcaaccctgatctccgtgattgtcgtcttctccagtgaaacatttctaggtgcttgtctcgagcggagggcgttcgtgaacaaacactctgagctcgccgaggaggccgccaagcgcgccgaggtcgcaagactgggagctgaacgtggcggaggtgacggtggccggagagggagtcctgtgttcttcgtttcctccttaggtgtacaattttttgggtggattttttgagcggctagaggtttgtgaaactgtggtttatccgattgggtctgatcaagtaaatacgtacctacgtattgttgtgttcttaattctgtacagctatacattatacaacggtacgggaatggtgagggtgtaacgtccgtatacgatatacctaattgtacttaacatcttgtcagcaaatttttggttcactgacttctggttatgagtaatggacgtatactatttagtccaggcatgactaatcttaaacatttcctacaattccaaatccttaagaccatctgagctccaccacaacatactttacagtttactggcaagtgaatgcc

SEQ ID NO: 2170 - DNA, 3578 bp, Sorghum bicolor
cctcccccgcgcgcccggaacgcctcgacgtccgcgcactctgagccagcgcacgccgagacgaaccagaggcgccccacgaaggccggggcacgggcagccaaaaaaagagcccggtgtcgcgggcgccccttccctccctataaggcggccgcgcccgtgttacggacaatgccgtcttcgtccatccacggagagagcggcagaggcaggcagctggtgcgtgcccctccctccctccgtgcgctccgaagaccaacgccgccgcccccggcgagacggcgcccgcccgccccgacggctagaggctcgccgcacgcactccaataaaagaaaaaaaaagaagcaaaccatggcgtccatctccccggagaccatcggcggggacgtcaatctgtccaagattccggtggaggaggtgttcaagacgctgaaatgcgaccgcaaggggctgtccagcacggagggcgagaataggctcaggacgttcggacccaacaagctggaggagaagaaggagaacaacctgctcaagttcctgggcttcatgtggaacccgctctcttgggtcatggagatggcggccatcatggccatcgcgctcgccaacggcggcggcaggccgcccgactggcaggacttcgtcgggatcgtctctctgctcttcatcaactccacaatcagctacatcgaggaggccaacgccgggaacgccgccgcggcgctcatggctgggctggcgcccaagaccaagctgctgagggacggcaggtgggaggagcaggacgcggcgatcctcgtgcccggtgacatcatcagcatcaagctcggcgacatcatccccgccgacgccaggctgctcgagggcgacccgctcaagatcgaccagtcggcgctcaccggcgagtcgctccccgtgaacaagcaccctgggcaggaggtgttctcgggctcaacggtgaagcagggtgagatcgaggccgtcgtcatcgccaccggcgtccgcaccttcttcggcaaggcggcgcacctcgtcgacagcaccaacaacgtcggccacttccagcaggtgctcacggccatcggcaacttctgcatcatctccatcgccgccggcatgctggtcgaggtcgtcgtcatgtacccgatccagcaccgcgcctaccgcgacggcatcgacaacctcctcgtgctgctcatcggcgggatccccatcgccatgcccaccgtgctctcggtcaccatggccatcggctcccaccgcctgtcgcagcagggggccatcaccaagcgcatgacggccatcgaggagatggccggcatggacatgctctgcagcgacaagaccggcaccctcaccctcaacaagctcaccgtcgacaagtccctcatcgaggtctactccaagggcgtcgacaaggacatggtgctcctctacgccgcgagggcctcccgcgtcgagaaccaggacgccatcgacacctgtatcgtgaacatgctcgccgaccccaaggaggcccgcgctggcatccaggaagtccacttcctccccttcaacccggtcgagaagcgcacggccatcacctacatcgacggcaacggcgactggcacagggtcagcaagggcgctcccgagcagatcatcgagctctgcaacatgggcgccgaggccgagaagaaggtccatgccctgatcgacgggtacgccgaccgcggcctccggtcgctcggcgtgtcgtaccagcaggtgccggagaagagcaaggagagcgctggcgagccgtggcagttcatcggcctcctgcccctgttcgacccgccgaggcacgacagcgcagagaccatccgccgcgcgctccacctgggcgtcaacgtgaagatgatcaccggtgaccagctcgccatcggcaaggagaccggccgccggctcggcatgggcaccaacatgtacccttccaccacgctcctgggcgacaagaacagcacggtgaacggcatgcacatcgacgagctcatcgagaaggccgacggcttcgcgggtgtcttccccgagcacaagtacgagatcgtgaagcggctgcaggaccggaaccacatctgcggcatgaccggcgacggcgtgaacgacgcgccggcgctgaagaaggcggacatcggcatcgccgtggacgacgcgacggacgcggcgcggagcgcgtcggacatcgtgctgacggagcccgggctgagcgtgatcgtgagcgccgtgctgacgagccgctccatcttccagcgcatgaagaactacaccatctacgccgtgtccatcaccatccgcatcgtgctgggcttcctcctcatcgcgctcatctggaagttcgacttcgcgcccttcatggtgctcatcatcgccatcctcaacgacggcaccatcatgaccatctccaaggaccgcgtgaagccatcgcccacacccgactcgtggaagctcgacgagatcttcgccaccggcatcgtgctcggaacctacatggccatcgtcaccgccatcttcttctacctcgcccacgacaccgatttcttcacggccgtgttcggcgtgcagtcgatcaaggagaacgacagggagctgatggcggcgctgtacctgcaagtgagcatcatcagccaggcgctcatcttcgtgacgcggtcccggagctggtcgttcgtggagcggccgggattcctcctgctcttcgccttcttcgccgcccagctggtggcgacgtgcatcgcggtgtacgccaactgggacttctgccgcatgcaggggatcggctgggcgtggggcggcgccatctggatcttcagcatcgtcacctacatcccgctcgacgtgctcaagttcatgatccgcgccgcgctcagaggcaaggccgcgggcagcaacgtccagaacaaggcaagctttttgcccactctcactcagcaaactgctccattgttgttgtcttgatcgtttgccttgccattgtcgcgtcgtcgtctccagtgatacgtgtcgtggtgcttgtctcgcgcggggacggcgttcacgaacaaggactgcggcaagagggcgagcgcgaggcacagtgggcggtagagcagaggacacactccacgggcctcaaccagctcgccacctcctccgacgttccacctcctccgagctcaccgagcaggccagccaaggtcgcaagacttgtggagctgcagacactcaagaggcgcgtcgagtcggtggcgaagctagcagaaggggatcggcgtcgatacctttccgtagagctacaccgtgtgaccgacggcgtccagcggtggccggagggggggagtcctgtgttcttcgttcgtttccttaggtgtacttatgtggttttttgggcggcaagagagctttttctgagatctggtgtgtctgatcaagtgaatatgtacctacgtattgttgtgttcttaattctacattgtacagctttacactacacaaaggtacgggaatgctgaggtgtaacatccatatacaatatacttagttctgttcatccaatcatcatatttccagtctttctttt

SEQ ID NO: 2171 - DNA, 3377 bp, Zea mays
cgtcttcaagcagcgcacggaccgaggcgaagggcaggcccggctccgtcccgttccatgaaggcctaacccgagcgggcaggcttttaagtagggcgcgagtgagagcgagcggccaatcggccgggagcgaagccagcgctagctgccgcctccctccccggtcctcgggtccgccgcgcgcgcgccggccgccaccaccgcacgacgccgaccaccacaattagctagcagcggcgtcgactaataaacgacaatggcgtccatctccctcgaggacgtccgcaacgagaccgtcgacctcgagaccgtcccggtgcaggaggtgttccagcacctgaaatgcagcaaggaggggctctccagcgccgagggagacaatcggctcaagatcttcgggcccaacaagctggaggagaagtcggagagcaagctgctcaagttcctgggcttcatgtggaacccgctctcctgggtcatggaggccgccgccatcatggccatcgtgctcgccaacggcgggggcaagccgcccgactggcaggacttcgtcggcatcgtcgtcctcctcttcatcaactccaccatcagcttcatcgaggagaacaacgccggcaacgcggcggccgcgctcatggcgggcctcgcgcccaaaaccaaggtgctcagggacggcaagtggaaggaagaggaggcgtccatcctcgtgcccggggacatcatcagcatcaagctgggtgacatcattcccgccgacgccaggctgctggagggcgacccgctcaaggttgaccaggcggcgctcacgggcgagtcgctgcccgtgaacaagcacccgggccagggggtcttctcgggctccacagtcaagcagggcgagatcgaggccgtcgtcatcgccaccggcgtgcacaccttcttcggcaaggcggcgcacctggtggacagcaccaacaacgtgggccacttccagctcgtgctcacggccatcggcaacttctgcatcatctccattgccgtcgggatggtcatcgagatcatcgtcatgtacccgattcagcaccgcgcgtaccgcgatggcatcgacaacctcctcgtcctgctcatcggcggcatccccatcgccatgcccaccgtgctctccgtcaccatggccatcggctcccaccgcctgtcccagcagggcgccatcaccaagcgcatgaccgccatcgaggagatggccggcatggacgtgctctgcagcgacaagaccggcaccctcaccctcaacaagctcaccgtcgacaagaccctcatcgaggtgtgcggcaagggcgtcgacaaggacatggtgctcctctacgccgccagggcctcccgcgtcgagaaccaggacgccatcgacacctgcatcgtcggcatgctcgccgaccccaaggaggcccgcgccggcatcaaggaggtccacttcctccccttcaacccggttgagaagcgcacggccatcacctacatcgacggcaacggcgactggcacagggtcagcaagggcgcccccgagcagatcatcgagctgtgccggatgagcaaggatgccgagaagaagatccacgccctcatcgacggctacgccgaccgcggcctccgctccctgggcgtgtcgtaccagctggtccccgagaagagcaaggagagcgccggcgagccgtggcagttcatcggtctcctcccgctgttcgacccgccgcggcacgacagcgcggagaccatccgccgcgcgctccacctgggcgtgaacgtgaagatgatcaccggcgaccagctggccatcggcaaggagacggcgcggcgcctgggcatgggcagcaacatgtacccgtccaccaccctgctgggcgacaacaagaccggcgagatgggcggcctgaacatcgacgagctgatcgagaaggccgacgggttcgcgggggtgttcccggagcacaagtacgagatcgtgaagcggctgcaggaccggaagcacatctgcggcatgaccggggacggcgtgaacgacgcgccggcgctgaagaaggcggacatcggcatcgcggtggacgacgcgacggacgcggcccggagcgcgtcggacatcgtgctgacggagcccgggctgagcgtgatcgtgagcgccgtgctcaccagccgcgccatcttccagcgcatgaagaactacaccatctacgccgtgtccatcaccatccgcatcgtgctgggcttcctgctcgtcgcgctggtctggaagttcgacttcgcgcccttcatggtgctcatcattgccatcctcaacgacggcaccatcatgaccatctccaaggaccgcgtgaagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggcggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtgtaaactcgactcagtttttttatttgcttttttttgcagacaaatacaaaccacacacatatatatatttgtaaagattcgttcgtattttcattttcaccgggaagatttgtaactgtcctcctccctccttgtaagttgctcctgtaaactcttcctgaattcatggcgtgtcgttgtagcaatcaccacttcctccctgtgaatgcccacagcgtgtcttggtgaaagcatgtatgtatgaatattggagtatatgttactactc

SEQ ID NO: 2172 - DNA, 3476 bp, Sorghum bicolor
agcagcgcgcggaccgaggcgaagggcaggcccggctccgtcccgttccatgaaggcctaacccgcgcgggcaggctttagtagggcgcgagtgagcgcgagcggccaaccgggagcgaagccagcgctagctgccgcctccctccctcgggtccgccgcgcgccggccgccaccaccgcacgacgccggcgccgatcgacccccgacgaccgccgacgccgctccacccattagctagctagctagcagaagcagcaacaacatcatcatcgactaataaacaaccatggcgtccatctccctcgaggacgtccgcaacgagaccgtcgacctcgagaccgtcccggtgcaggaggtgttccagcacctgaaatgcagcaagcaggggctctccagcgcggagggcgagaaccggctcaagatcttcggtcccaacaagctggaggagaagtcggagagcaagctgctcaagttcctgggcttcatgtggaacccgctctcctgggtcatggaggcagccgccatcatggccatcgtgctcgccaacggcggagggaagccgcccgactggcaggacttcgtcggcatcgtcgtcctcctcttcatcaactccaccatcagcttcatcgaggagaacaacgccggcaacgcggcggccgcgctcatggcgggcctcgcgcccaagaccaaggtgctcagggacggcaagtggaaggaggaggacgcgtccatcctcgtgcccggtgacatcatcagcatcaagctcggtgacatcatccccgccgacgccaggctgcttgagggcgacccgctcaaggtcgaccaggcggcgctgaccggcgagtcgctgcccgtcaacaagcactcggggcagggtgtcttctcgggctccaccgtgaagcagggagagatcgaggccgtcgtcatcgccaccggcgtgcacacattcttcggcaaggcggcgcacctggtggacagcaccaacaacgtgggccacttccagctcgtgctcacggccatcggcaacttctgcatcatctccatcgccgtcgggatggtcatcgagatcatcgtcatgtacccgatccagcaccgcgcgtaccgcgacggcatcgacaacctcctcgtcctgctcatcggcggcatccccatcgccatgcccaccgtgctgtccgtcaccatggccatcggctcccaccgcctgtcccagcagggcgccatcaccaagcgcatgaccgccatcgaggagatggccggcatggacgtgctgtgcagcgacaagaccggcacgctcaccctcaacaagctcaccgtcgacaagaccctcatcgaggtgtgcggcaagggcgtcgacaaggacatggtgctcctctacgccgccagagcctcccgcgtcgagaaccaggacgccatcgacacctgcatcgtcggcatgctggccgaccccaaggaggcccgcgccggcatcaaggaggtccacttcctcccctttaaccccgtggagaagcgcacggccatcacctacatcgacggcaacggcgactggcacagggtcagcaagggcgcccccgagcagatcatcgagctgtgccggatgagcaaggacgccgagaagaagatccacgcggtcatcgacggctacgccgaccgcggcctccgctccctgggcgtgtcgtaccagcaggtgcccgagaagagcaaggagagcgccggcgagccgtggcagttcatcggtctcctgccgctgttcgacccgccgcggcacgacagcgcggagaccatccgtcgcgcgctccacctgggcgtgaacgtgaagatgatcaccggcgaccagctggccatcggcaaggagacggcgcggcgccttggcatgggcagcaacatgtacccgtccaccaccctgctgggcgacaacaagggcggcgagatgggcgggctgaacatcgacgagctgatcgagaaggcggacgggttcgcgggggtgttcccggagcacaagtacgagatcgtgaagcggctgcaggaccggaagcacatctgcggcatgaccggcgacggcgtgaacgacgcgccggcgctgaagaaggcggacatcggcatcgcggtggacgacgcgacggacgcggcccgtagcgcgtcggacatcgtgctgacggagcccgggctgagcgtgatcgtgagcgccgtgctcaccagccgcgccatcttccagcggatgaagaactacaccatctacgccgtgtccatcaccatccgcatcgtgctgggcttcctcctcgtcgcgctcgtctgggagttcgacttcgcgcccttcatggtgctcatcatcgccatcctcaacgacggcaccatcatgaccatctccaaggaccgcgtgaagccgtcgccgacgccggactcgtggaagctcaaggagatcttcgccacggggatcgtgctcggaacctacatggcgctcgccacggcgctcttcttctacctcgcgcacgacaccgaattcttcagcgagaccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggaggagccatctgggcgttcagtgtcgtcacctacttcccgctggacgtgctcaagttcgccatccgctacgcgctctccggcaaggcctggaacaacatcaacaacaagacggccttcaccaaccgcaccgactacggcaagggcgagcgggaggcgcagtgggccaccgcgcagaggacgctgcacggcctcaaccaggccaccgccacctccgacctcttcggcgacaaccagggctaccgagagctgtccgagctcgccgaccaggccgccaagcgcgccgaggtggccaggctcagggagctgcacacgctcaagggccacgtcgaatccgtcgtcaagctcaagggcctcgacattgacaccattaatcagagctacaccgtgtaaactcaaactcaggtttcttttggattagacacatacatacacacacatattatttgtaaagattcgttcgtattttcatttacaccgggaagatttctaactgtcctcctccctccttgtaagttgctcctgtaaactcttcctgaattcatggcgcgtcgttgtagcaatcaccacttcctccctgtgaatgcccacaggccacagcgtgtcttggtgaaagcatgtatgattattactactaaactccacacattgtctgtcctacactcctggtgatgcagacaacatatttcgcatttcagaattgattgacgagtttacacagcacaa

SEQ ID NO: 2173 - DNA, 3208 bp, Oryza sativa
aactaataaacccgtcctcccctcccccccatggcctccatctccctcgaggacgtccgcaatgagaccgtcgacctcgagacgatcccggtggaggaggtgttccagcacctgaaatgcagcaagcaggggctgtcggcagcggagggacagaacaggctcaacatcttcgggccaaacaagctggaggagaagacggagagcaagctgctcaagttcttgggtttcatgtggaatcccctctcctgggtcatggaggccgccgccatcatggccatcgtcctcgccaacggcggcgggaggccgcccgactggcaggacttcgtcggcatcgtcgtcctcctcgtcatcaactccaccatcagtttcatcgaggagaacaatgccgggaacgccgccgcggcgctcatggccggcctcgcgcccaagaccaaggtgctcagggacgggaaatggcaggagcaggacgcgtccatcctcgttcccggcgacatcatcagcatcaagctcggcgacatcatccccgccgacgcgcggctgctcgagggcgacccgctcaaggtcgaccaggcggcgctcaccggcgagtcgatgcccgtcaacaagcacgccgggcagggcgtcttctccgggtccaccgtcaagcagggcgagatcgaggccgtcgtcatcgccaccggcgtgcacaccttcttcggcaaggcggcgcacctggtggacagcaccaacaacatcggccacttccagctcgtgctcacggccatcggcaacttctgcatcatctccatcggcgtcggcatgataatcgagatcatcgttatgtacccgatccagcaccgcgcgtaccgcgacggcatcgacaacctgctcgtcctgctcatcggcggcatccccatcgccatgcccaccgtgctgtccgtcaccatggccatcggctcccaccggctgtcgcagcagggcgccatcaccaagcggatgaccgccatcgaggagatggccggcatggacgtgctctgcagcgacaagaccgggacgctgacgctcaacaagctcaccgtcgacaagacgctgatcgaggtgtacgggcgggggctggacaaggactcggtgctcctgtacgcggcgagggcgtcccgcgtcgagaaccaggacgccattgacacatgcatcgtgggcatgctcgccgaccccaaggaggcccgcgccggcatcaaggaggtccacttcctcccgttcaaccccgtcgagaagcgcacggccatcacctacatcgacggcaatggcgaatggcacaggatcagcaagggcgcgccggagcagatcatcgagctgtgcaagatgagcaaggacgccgagaagaaggtgcacacgctgatcgaccagtacgcggaccgcggcctccggtcgctgggcgtgtcgtaccagaaggtgccggagaagagcaaggagagcgagggcgagccatggcagttcgtcggcctcctgccgctgttcgacccgccgaggcacgacagcgcggagaccatccgccgcgcgctgcacctcggcgtgaacgtgaagatgatcaccggcgaccagctcgccatcgggaaggagacggcgcggcggctcgggatgggcaccaacatgtacccgtcgacgacgctgctgggcgacaagagcagcgagatgagcggcctccccatcgacgagctgatcgagaaggccgacggcttcgccggcgtgttcccggagcacaagtacgagatcgtgaagcgcctccaggaccggaagcacatctgcggcatgaccggcgacggcgtgaacgacgcgccggcgctgaagaaggccgacatcggcatcgccgtcgacgacgccacggacgccgcccggagcgcgtcggacatcgtgctcacggagccggggctcagcgtcatcgtcagcgccgtgctcacctcccgcgccatcttccagcggatgaagaactacaccatctacgccgtctccatcaccatccgcatcgtcctcggcttcatgctcgtcgccctcctctggaagttcgacttcgccccattcatggtgctcatcatcgccatcctcaacgacggcaccatcatgacaatctccaaggaccgtgtcaagccgtccccgaccccggactcgtggaagctcaaggagatcttcgccacgggcatcgtgctcggcacgtacatggcgctcatcaccgccctcttcttctacctcgcgcacgacaccgacttcttcacagagacgttcggggtgaggtcgatcaagacgaacgagaaggagatgatggcggcgctgtacctgcaggtgagcataatcagccaggcgctcatcttcgtgacgaggtcgcggagctggtcgttcgtggagaggccaggggcgctgctggtgatcgcgttcctggcggcgcagctggtggcgacgtgcatcgcggtgtacgcggagtgggagttctgcaagatgcaggggatcgggtgggggtggggaggggcgatctgggcgttcagcgtggtgacctacttcccgctggacgtgctcaagttcatcatccggtacgcgctgagcgggcgggcgtggaacaacatcaacaacaagacggcgttcgtgaacaagaacgactacgggaagggggagcgggaggcgcagtgggcgacggcgcagaggacgctgcacgggctcaaccagtcgtccaccagctccgacctcttcaacgacaagaccggctaccgcgagctctccgagatcgccgagcaggccgcaaagcgagccgaggtcgccagactgagggagttgcacacgctcaaggggcacgtagagtcggtggtgaagctcaaggggctcgacatcgacacaatccaacagagctacaccgtgtaacatacagcatgccatcgatgtgttgttgttgttgttcatacctgtgttttactcctccccatctgcaagttatttggagatgggggtttcgacttgtgttttgacatagatgtttcttcccttctttgtattttgttaacagggaatagttcccgatacaacaggtggtgcacttttgagtatagtcaagttatttgtaagattttggctttaagccggtttttttggcaatgttattgttcccattgcagatttgcagtctatcaactttgcctcaactcagtctgtatactactgtttagtcaatcatcatcagttttgaccc

SEQ ID NO: 2174 - DNA, 3476 bp, Brachypodium distachyon
cagggaccgcgaggcccttccttccatgaaggaccccccctcccagctccctccgcgcgccgcgctagcacgccccacacatagaaagtgagctccacagccccccctgccgggagcttgctcgcttcagatcccatccttcaccccttccttcttccgtctgcctccttccccgcgcgccacctcccccattgattcttcccattgattgacaacaagaacaagaagaacaagaagaagaggagctgcaatctagcttgagaggcttggaggcgcacggcgcgcaggccgccatggcgtccatctcgctggaggacgtccggaacgagacggtggacctggagacgatcccggtgcaggaggtgttccagcacctgaaatgcagcaagcagggcctctccgcctcggaggccgagaaccggctcaggatctttggccccaacaagctggaggagaagacggagaacaagctgctcaagttcctgggcttcatgtggaacccgctgtcgtgggtcatggaggccgccgccatcatggccatcgtgctcgccaacggcggcggcaagccccccgactggcaggacttcgtcggcatcgtcgtcctcctcttcatcaactccaccatcagcttcatcgaggagaacaacgccggcaacgccgcggccgccctcatggccggcctggcccccaagaccaaggtgctccgtgacgggaagtggctcgagatggacgcctccatcctcgtccccggggacatcatcagcatcaagctcggtgacatcatccccgctgacgccaggctgctggaaggcgacccgctcaaggttgaccaggcggcgttgaccggcgagtccatgccggtcaacaagcacgccgggcaaggggtcttctcggggtccacggtgaagcagggcgagatcgaggccgtggtgatcgcgaccggggtgcacaccttcttcggcaaggcggcgcatctcgtggacagcacaaacaacgtgggacacttccagctcgtgctcaccgccattggcaacttctgtatcatctccattgccgctggcatgctggtggaggttgtcgtgatgtacccgatccagcaccgggcgtaccgggacggcatcgacaacctccttgtgctgctcatcgggggcatcccgatcgccatgcccaccgtgctgtccgtcaccatggcaatcggctcgcaccggctgtcgcagcagggcgccatcaccaagcggatgacggccatcgaggagatggccggcatggacgtgctctgcagcgacaagacgggcacgctcacgctcaacaagctcaccgtcgacaagtcgctcatcgaggtctgcggcagggggatcgacaaggacaccgtgctgctctacgcggccagggcgtcccgcgtcgagaaccaggacgccattgacacgtgcattgtcggaatgctggccgatcccaaggaagccagggccgggatccaggaggtgcatttcctgcccttcaaccctgtggagaagcgcacggccattacctacatcgacggcaatggcgactggcacaggatcagcaagggcgcgccggagcagatcatcgagctctgcaggatgcccaaggaggccgagaagaggatccacagcctcatcgacagttacgccgaccgtgggctcaggtccctcggcgtgtcgtaccagcaggtgcccgccaagaacaaggacagccccggggagccatggcagttcacgggcctcctgccgctcttcgatcctccgaggcacgacagcgcggagaccatccgccgcgcgctgcacctgggcgtgaacgtcaagatgatcacgggagaccagctggccatcggcaaggagacggcgcggcggctcggcatgggcaccaacatgtacccgtccacgacgctgctgggggacaagagcacggagatgagcgggctccccatcgacgagctgatcgagaaggccgacgggttcgcgggggtgttcccggagcacaagtacgagatcgtgaagcggctgcaggaccggaaacacatctgcggcatgaccggggacggcgtgaacgacgccccggcgctgaagaaggccgacatcggcatcgccgtggacgacgccacggacgccgcccggagcgcgtcggacatcgtgctcacggagcccgggctgagcgtcatcgtgtcggcggtgctcaccagcagggccatcttccagaggatgaagaactacaccatctacgccgtgtccatcaccatccggatcgtgctgggattcatgctcgtcgcgctgctctggaagttcgacttcgcgccattcatggtgctcatcatcgccatcctcaacgatggcaccatcatgaccatctccaaggaccgcgtcaagccgtccccgaccccggactcgtggaagctcaaggagatcttcgccaccggcgtcgtcctcggcacctacatggccctcgtcaccgtcctcttcttctacctcgcacacgacaccgacttcttcaccgagacgtttggggtgaggtcgatcaaggagaacgagaaggagctgatggcggcgctgtacctgcaggtgagcataatcagccaggcgctcatcttcgtgacgaggtcgaggagctggtcgttcgtggagcggccggggttcctgctgctggcggcattcctggcggcgcagctggtggccacgtgcatcgcggtgtacgccaactgggagttctgccggatgcaggggatcggttggggttggggcgcctccatctgggccttcagcatcgtcacctacatccccctcgacgtcctcaagttcatcatccgatacgcgcttagcggcagagcatggaacaacatcaacaacaaggcaagcagaagccagcctcgctagccgccgtcgcaaaatttccttaacgatttttctcctcacctcacctcagtgctctgcatgaacagacggcgttcacgaataagagcgactacggcaaggtggagagggaggcgcagtgggcgacggcgcagaggacgctgcacgggctgaaccagcccagcaacaactccgacctcttcaacgacaactcgggctaccgcgagctgtccgagatcgccgagcaggccgccaagcgcgccgaggtggccaggctcagggagctgcacacgctcaaaggacacgtcgagtcggtggtcaagctcaaggggctcgacatcgagacgatcaaccagagctacacggtatgatccacgacgacgaccaccgccgtcgatggacacagaaacagatatatatgcttctactcttttttttttctttttttttgggccccctctgccggtttgtcgacgagccggacagggaggggaagttgattctaagggttgttattttgacctagacttcgttggctatatttgtaatttttgcagtggggaacagttgccctcttgagtatgtatagaatatgtacgattttgggttcat

SEQ ID NO: 2175 - DNA, 3360 bp, Setaria italica
gtcttcaagcagcgcacggaccgaggcgtgagggcagggcccggctccgtcccgttccatgaaggcctaacccgcgcgggcaggctcttagggcgagtgagagcgagcggccaaccgggagagcgagcgagcgagccgcctctccctccctcgtgtccgcgcgcggccgccgctaccaccacaccatccatcccttccccgccgctggcacctccacccatcaccatccccttttcatcaactaataaaacagcatggcgtccatctccctcgaggacgtccgcaacgagaccgtcgacctcgagaccgtcccggtccaggaggtgttccagcacctgaaatgcagcaagcaggggctctccagcgcggaggccgagaaccggctcaagatcttcggccccaacaagctggaggaggtgtcggagagcaagctgctcaagttcctgggcttcatgtggaaccctctctcctgggtcatggagtccgccgcgctcatggccatcgtcctcgccaacggcggcggcaagcctcccgactggcaggacttcgtcggcatcaccgtcctcctcttcatcaactccaccatcagcttcatcgaggagaacaacgctgggaacgccgcggcggcactcatggcgggcctcgcgcccaagaccaaggtcctcagggacggcaagtggaaggaggaggacgcctccatcctcgtccccggcgacatcatcagcattaagctcggcgacatcatccccgccgacgccaggctgctagagggcgacccgctcaaggtcgaccaggcagcgctcaccggcgagtcgctgccggtgaacaagcacccgggccagggggtcttctcgggctccacggtgaagcagggcgagatcgaggccgtcgtcatcgccaccggcgtccacaccttcttcggcaaggcggcacacctggtggacagcaccaacaacgtcggccacttccagctcgtgctcacggccatcggcaacttctgcatcatctccatcgccgtcggcatggtcatcgagatcatcgtcatgtaccccatccagcaccgcgcctaccgcgacggcatcgacaacctcctcgtcctgctcatcggcggcatccccatcgccatgcccaccgtgctctccgtcaccatggccatcggctcccaccgcctctcacagcagggcgccatcaccaagcgcatgactgccatcgaggagatggccggcatggacgtgctgtgcagcgacaagacgggaaccctcaccctcaacaagctcaccgtcgacaagactctcatcgaggtgtgtggcaagggcgtcgacaaggacatggtgctcctctacgccgccagggcctcccgcgtcgagaatcaggacgccatcgacacctgcatcgtcagcatgctcgccgaccccaaggaggcccgcgccggtatcaaggaggtccacttcctccccttcaaccccgtcgagaagcgcacggccatcacctacgtcgacggcaacggcgactggcacagggtcagcaagggcgccccggagcagatcatcgagctgtgcaggatgagcaaggacgccgagaagaggatccacgccctcatcgacagctacgccgaccggggcctccgctccctgggcgtgtcgtaccagcaggtgccggagaagagcaaggagagcgccggcgacccgtggcagttcatcggcctgctgccgctgttcgacccgccgaggcacgacagcgccgagaccatccgccgcgcgctccacctcggcgtcaacgtcaagatgatcaccggcgaccagctggccatcggcaaggagacggcgcggcgcctgggcatgggcagcaacatgtacccctccaccaccctgctgggcgacaacaagaccggcgagatgggcgggctcaacatcgacgagctgatcgagaaggccgatgggttcgccggggtgttcccggagcacaagtacgagatcgtgaagcggctgcaggaccggaagcacatctgcggcatgaccggggacggcgtgaacgacgcgccggctctgaagaaggccgacatcgggatcgccgtggatgacgcgacggacgcggcccggagtgcgtcggacatcgtgctgacggagcccgggctgagcgtgatcgtgagcgccgtgctcaccagccgcgccatcttccagcgcatgaagaattacaccatctacgcggtgtccatcaccatccgcatcgtgctggggttcctcctcgtggccttggtctgggagttcgacttcgcgccgttcatggtgctcatcatcgccatcctcaacgacggcaccatcatgaccatctccaaggaccgcgtgaagccgtccccgaccccggactcgtggaagctcaaggagatcttcgccaccggcatcgtgctgggcacctacatggccctcaccacggcgctcttcttctacctcgcccacgacaccgacttcttcaccaagaccttcggcgtccgttccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggcgccgccatctgggtgttcagcatcgtcacctacttcccgctggacgtgctcaagttcggcatccgctacgcgctcagcggcaaggcctggaacaacatcaacaacaagacggccttcaccaacaggacggactacggcaagggcgagcgggaggcgcagtgggcgacggcgcagaggacgctgcacgggctcaaccaggccaccaccagctccgacctcttcggcgacaccaacagctaccgcgagctgtcggagctcgccgagcaggccgccaagcgcgcggagatggcaaggctcagggagctgcacacgctcaaggggcacgtcgagtcggtggtcaagctcaaggggctcgacatcgacaccatccagcagagctacaccgtgtaagaagataagccgccgtatgcgtctctttgagtcttaatttgttacccctgcaagtgagagagatctgagcgctggttacgtgtttacttcagtcagtcaggtttctaccaccgttcagcgttgtgtttcttgtatgtaacctgtaaactcttcctgaattcatctcgtattgtagcagtcatcaccacttgttcccctgtgaatgcacacatcctgtcttgctactacatactgtattgcttcagggcac

SEQ ID NO: 2176 - DNA, 3302 bp, Setaria italica
cggaccgaggcgtgagggcagggcccggctccgtcccgttccatgaaggcctaacccgcgcgggcaggctcttagggcgagtgagagcgagcggccaaccgggagagcgagcgagcgagccgcctctccctccctcgtgtccgcgcgcggccgccgctaccaccacaccatccatcccttccccgccgctggcacctccacccatcaccatccccttttcatcaactaataaaacagcatggcgtccatctccctcgaggacgtccgcaacgagaccgtcgacctcgagaccgtcccggtccaggaggtgttccagcacctgaaatgcagcaagcaggggctctccagcgcggaggccgagaaccggctcaagatcttcggccccaacaagctggaggaggtgtcggagagcaagctgctcaagttcctgggcttcatgtggaaccctctctcctgggtcatggagtccgccgcgctcatggccatcgtcctcgccaacggcggcggcaagcctcccgactggcaggacttcgtcggcatcaccgtcctcctcttcatcaactccaccatcagcttcatcgaggagaacaacgctgggaacgccgcggcggcactcatggcgggcctcgcgcccaagaccaaggtcctcagggacggcaagtggaaggaggaggacgcctccatcctcgtccccggcgacatcatcagcattaagctcggcgacatcatccccgccgacgccaggctgctagagggcgacccgctcaaggtcgaccaggcagcgctcaccggcgagtcgctgccggtgaacaagcacccgggccagggggtcttctcgggctccacggtgaagcagggcgagatcgaggccgtcgtcatcgccaccggcgtccacaccttcttcggcaaggcggcacacctggtggacagcaccaacaacgtcggccacttccagctcgtgctcacggccatcggcaacttctgcatcatctccatcgccgtcggcatggtcatcgagatcatcgtcatgtaccccatccagcaccgcgcctaccgcgacggcatcgacaacctcctcgtcctgctcatcggcggcatccccatcgccatgcccaccgtgctctccgtcaccatggccatcggctcccaccgcctctcacagcagggcgccatcaccaagcgcatgactgccatcgaggagatggccggcatggacgtgctgtgcagcgacaagacgggaaccctcaccctcaacaagctcaccgtcgacaagactctcatcgaggtgtgtggcaagggcgtcgacaaggacatggtgctcctctacgccgccagggcctcccgcgtcgagaatcaggacgccatcgacacctgcatcgtcagcatgctcgccgaccccaaggaggcccgcgccggtatcaaggaggtccacttcctccccttcaaccccgtcgagaagcgcacggccatcacctacgtcgacggcaacggcgactggcacagggtcagcaagggcgccccggagcagatcatcgagctgtgcaggatgagcaaggacgccgagaagaggatccacgccctcatcgacagctacgccgaccggggcctccgctccctgggcgtgtcgtaccagcaggtgccggagaagagcaaggagagcgccggcgacccgtggcagttcatcggcctgctgccgctgttcgacccgccgaggcacgacagcgccgagaccatccgccgcgcgctccacctcggcgtcaacgtcaagatgatcaccggcgaccagctggccatcggcaaggagacggcgcggcgcctgggcatgggcagcaacatgtacccctccaccaccctgctgggcgacaacaagaccggcgagatgggcgggctcaacatcgacgagctgatcgagaaggccgatgggttcgccggggtgttcccggagcacaagtacgagatcgtgaagcggctgcaggaccggaagcacatctgcggcatgaccggggacggcgtgaacgacgcgccggctctgaagaaggccgacatcgggatcgccgtggatgacgcgacggacgcggcccggagtgcgtcggacatcgtgctgacggagcccgggctgagcgtgatcgtgagcgccgtgctcaccagccgcgccatcttccagcgcatgaagaattacaccatctacgcggtgtccatcaccatccgcatcgtgctggggttcctcctcgtggccttggtctgggagttcgacttcgcgccgttcatggtgctcatcatcgccatcctcaacgacggcaccatcatgaccatctccaaggaccgcgtgaagccgtccccgaccccggactcgtggaagctcaaggagatcttcgccaccggcatcgtgctgggcacctacatggccctcaccacggcgctcttcttctacctcgcccacgacaccgacttcttcaccaagaccttcggcgtccgttccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggcgccgccatctgggtgttcagcatcgtcacctacttcccgctggacgtgctcaagttcggcatccgctacgcgctcagcggcaaggcctggaacaacatcaacaacaagacggccttcaccaacaggacggactacggcaagggcgagcgggaggcgcagtgggcgacggcgcagaggacgctgcacgggctcaaccaggccaccaccagctccgacctcttcggcgacaccaacagctaccgcgagctgtcggagctcgccgagcaggccgccaagcgcgcggagatggcaaggctcagggagctgcacacgctcaaggggcacgtcgagtcggtggtcaagctcaaggggctcgacatcgacaccatccagcagagctacaccgtgtaagaagataagccgccgtatgcgtctctttgagtcttaatttgttacccctgcaagtgagagagatctgagcgctggttacgtgtttacttcagtcagtcaggtttctaccaccgttcagcgttgtgtttcttgtatgtaacctgtaaactcttcctgaattcatctcgtattgtagcagtcatcaccacttgttcccctgtgaatgcac

SEQ ID NO: 2177 - DNA, 2780 bp, Panicum virgatum
aatcaaactgtcgtttatttacgagcgtatgaatggctgtttctcctttagtttgatctcctatatatgtcgtctctgtcgcagaatcgcatgcagttcaagtcgagttgcatgcagggccagcgcacgcagggaaccagaggcgccccacgaaggccgggcagccaagagctcggcgtcgcggcccgcgcccgccgcgccttataagacggacgcgcccgcgccacgggcatcgccgtcttcgtccatccacgcggagagagcggcagaggcaggcagccggtgcgtgcccctccctccctccgtgcgccccgaagacctccgcgcccggcgcggcgagctcgcgaccggccggacggcgtgccgctcctctggctagaggctagccccgccgcacgcccacccccttcaataaaagaaaagaggaaaaagaagcagccatggcgtccatctccccggaggacgtccgcaatgggaacgtcgatctgtccaagatgccggtggaggaggtgttcaagacgctcaagtgcagccgcaaggggctgtccagcgcggagggggagggccggctcaaggcgttcggccccaacaagctggaggagaagaaggagagcaagctgctcaagttcctgggcttcatgtggaacccgctgtcgtgggtcatggagatggcggccatcatggccatcgtgctcgccaacggcggcggcaagccccccgactggcaggactttgtcgggatcgtgtcgctgctcatcatcaactccaccatcagctacatcgaggaggccaacgccggggacgcggcggcggcgctcatggcggggctggcgcccaagaccaagctgctgagggacggcaggtgggaggagcaggacgcgtcgatcctggtgcccggcgacatcatcagcatcaagctcggcgatatcatccccgccgacgcgaggctgctcgagggcgacccgctaaagatcgaccagtccgcgctcaccggcgagtcgctgccggtgaacaagcaccccgggcaggaggtgttctccggctccacggtgaagcagggcgagatcgaggccgtcgtcatcgccaccggcgtgcacaccttcttcggcaaggcggcgcacctcgtcgacagcaccaacaacgtcggccacttccagcaggtgctgacggccatcggcaacttctgcatcatctccatcgccgccggcatgctggtggaggtcgtcgtcatgtacccgatccagcaccgcgcgtaccgcgacggcatcgacaacctcctcgtgctgctcatcggcgggatccccatcgccatgcccactgtgctctccgtcaccatggccatcggctcccaccgcctgtcgcagcagggggccatcaccaagcgcatgaccgccatcgaggagatggccggcatggacatcctctgtagcgacaagaccggcaccctcaccctcaacaagctcaccgtcgacaagtccctcatcgaggtgtactccaagggcgtcgacaaggagatggtgctcctctacgccgcgagggcctctcgcgtcgagaaccaggacgccatcgacacctgcatcgtcaacatgctcgccgaccccaaggaggcccgcgccggcatccaggaggtccacttcctccccttcaacccggtggagaagcgcacggccatcacctacatcgatggcaacggcgactggcacagggtcagcaagggtgctcccgagcagatcatcgagctctgcaacatgagcgccgaggccgagaagaaggtccacgccctgatcgacggatacgccgaccgcggcctccggtcgctcggcgtgtcgtaccagcaggtgccggagaagagcaaggagagcgccggcgacccgtggcagttcatcggcctcctgccgctgttcgacccgccgaggcacgacagcgcggagaccatccgccgcgcgctccacctgggcgtgaacgtgaagatgatcaccggcgaccagctagccatcggcaaggagaccgggcggcggctgggcatgggcaccaacatgtacccctcgaccaccctcctgggcgacaagggcagcacggtgaacggcatgcccatcgacgagctcatcgagaaggccgacgggttcgccggcgtgttcccggagcacaagtacgagatcgtgaagcggctccaggaccggaggcacatctgcggcatgaccggcgacggcgtgaacgacgcgccggcgctgaagaaggcggacatcggcatcgccgtggacgacgcgacggacgcggcccggagcgcgtcggacatcgtgctgacggagcccgggctgagcgtgatcgtgagcgccgtgctgacgagccgctccatcttccagcgcatgaagaactacaccatctacgccgtgtccatcaccatccgcatcgtgctcggcttcctcctcatcgcgctcatctggaagttcgacttcgcgcccttcatggtgctcatcatcgccatcctcaacgacggcaccatcatgaccatctccaaggaccgcgtgaagccgtcgcccaagccggactcgtggaagctcaacgagatcttcgccaccggcatcgtgctcggcacctacatggccctcgtcaccgccctcttcttctacctcgcgcacgacaccgacttcttcacggacgtgttcggcgtgacgtccatcaaggagaacgacggggagctcatgtcggcgctctacctccaggtgagcatcatcagccaggcgctcatcttcgtgacgcggtcccggagctggtccttc

SEQ ID NO: 2178 - DNA, 3504 bp, Brachypodium distachyon
ccacggagagaggaggcaggcacagccaggcagcgcttgcccccgccctccctccgcccatcccaacaaggcctcccccctcgcgggtgagcgccggcgccacctccacatccccgacctgcctctaggctgactactgttgctacctctaaataagacaaataataatcagccatggcgtccatctccctcgaggaggtccgcaacgagaccgtcgacctggtacgtgcccagttaatcgcattgcattgcaaattttgcaattctttcttcgttttgattttgatgtgttgtgcagtcgacggtcccggtggaggaggtcttcaagacgctgaaatgcgaccggaaggggctgacggaggcggagggggccaacaggctgaagctgttcgggcccaacaagctggaggagaagaaggagagcaaggtgctcaagttcttggggttcatgtggaacccgctgtcgtgggtcatggagatcgccgccatcatggccatcgcgctcgccaacggcggcggcaggccgcccgactggcaggacttcgtcggcatcgtctccctcctcttcatcaactccaccatcagctacatcgaggaggccaacgccggggacgccgcggccgcgctcatggccggcctcgcgcccaagaccaagctgctcagggacggccgctgggaggagcaggacgcggccatcctcgtccctggtgacatcgtcagcatcaagctcggtgacatcatccctgctgacgccaggctgctcgagggtgacgcgcttaagatcgaccagtcggcgctaacgggcgagtcaatgccggtcaacaagtacgccgggcaggaggtgttctcgggctccacggtgaagcagggcgagatcgaggccgtcgtcatcgccacgggcgtgcacaccttcttcggcaaggcggcgcacctcgtggacagcaccaacaatgtcggccacttccagcaggtgctcacggccatcggcaacttctgcatcatctccatcgccgccgggatgctggtggagatcctggtcatgtacccgatccagcaccgcgcgtaccgggacggcatcgacaacctcctggtgctgctcatcggcgggatccccatcgccatgcccaccgtgctgtccgtcaccatggccatcggctcgcaccggctgtcgcagcagggcgccatcaccaagcgcatgacggccatcgaggagatggccggcatggacgtgctctgcagcgacaagaccggcacgctcacgctcaacaagctcaccgtcgacaagtccctcatcgaggtctgctccaagagcgtcgacaaggacatggtgctcctctacgccgcccgcgcgtcccgcgtcgagaaccaggacgccatcgacacctgcatcgtcaacatgctcgccgaccccaaggaggcccgcgccggcatccaggaggtccacttcctccccttcaaccccgtggacaagcgcacggccatcacctacatcgacggcaacggcgactggcacagggtcagcaagggcgcgcccgagcagatcatcgagctctgcaacatggcaccggaggccgagaagaaggtgcacgcgtcgatcgaccagtacgccgaccgcggcctccggtcgcttggcgtgtcgtaccagcaggtcccggagaagaacaaggagagcgccggggagccgtggcagttcatcgggctgctcccgctgttcgaccctcctaggcacgacagcgccgagaccatccgccgcgcgctccacctgggcgtgaacgtcaagatgatcacgggcgaccagctcgccatcggcaaggagaccggccggcggctcggcatgggcaccaacatgtacccgtccacggcgctcctgggcgacaagaacagccccgtgaacgggctccccatcgacgagctcatcgagaaggccgacgggttcgcgggggtgttcccggagcacaagtacgagatcgtgaagcggctgcaggacaagaagcacatcgtgggcatgacgggggacggcgtgaacgacgcgccggcgctgaagaaggccgacatcggcatcgccgtggacgacgcgacggacgcggcccggagcgcgtcggacatcgtgctgacggagcccggcctgagcgtgatcgtgtcggccgtgctcaccagccgggccatcttccagcggatgaagaactacaccatctacgccgtgtccatcacgatccggatcgtgctggggttcctgctggtggcgctcatctggaagttcgacttcgcgccattcatggtgctcatcatcgccatcctcaacgacggcaccatcatgacgatctccaaggaccgcgtgaagccgtcgccgacgccggactcgtggaagctcaacgagatcttcgccacgggggtggtcctgggcacttacatggcgctggtcaccgtgctcttcttctacctggcgcacgacacggacatcttcacggagacgttcggggtgcggccgatcagggacaacgacagggagctcatggcggcgctgtacctccaggtgagcatcatcagccaggcgctcatcttcgtgacgcggtcgaggagctggtccttcgtggagcggccggggttcctcttgctcttcgccttcttcgcggcgcagctggtggccacggccatcgctgtgtacgccgactgggacttctgcgggatgcaggggatcgggtggtcgtggggcggcgccatctgggcgttcagcgtcgccacctacatcccgctggacgtgctcaagttcatcatccgctactcgctcagcggcaaaggctgggacaacgtccagaacaaggcaagcacgcgtgatcacagcttccatgagatagatagatactaacaagagtcttgagatcgggcgcttgatcttgattgatttctctcattttttgttgttggccgtacctcccagtgagacgtttcttgcgggtatgtatgtttgttgcatggtcccttaattggcgctgcagacggcgttcaccaacaagaaggactacgggaaaggggagcgggaggcgaagtgggcggtggaccagaggacgctccatgggctcaaccagccggcagcctccgacatcctcaacaccaaggaggagctctccgccatcgccgagcaggccgccaagcgcgccgaggtcgccaggctccgggagctgcacacgctcaagggacacgtcgagtcggtggtcaagcagaaggggatcgacatcgacaccattcagcagagctacaccgtctgatcgatgatgatccactttagcggtggcggtcgccggtcgggtagggatttgaaaggagggtggtttcggtcgggtaattcgttgatcgtctttgtgtggttggaagagcagcttgtactacctatttatgcatctctctctgaacttgctgcatatgtgttttcttctgctctgtatccatccgtaatacaattgtgcgggaatggtgcgtttgcatgagcagattgtcttcgctttt

SEQ ID NO: 2179 - DNA, 2880 bp, Musa acuminata
aagatggcgaccgacttggagcagatcaagaatgagagcgtcgatctggagagcatcccggtggaggaggtgtttgcgcagctgaaatgtagccgggagggtctcacctctgccgaaggggagcagcggctccagatctttggcctgaacaagctcgaggagaaacaggaatgcaaggtcctcaagttcctgggcttcatgtggaacccgctgtcttgggtcatggagatcgccgccatcatggccatcgccttggctaacggagggggcgagccaccggactggcaagatttcgttggtatcgttgtcctcctcatcatcaactccaccatcagcttcatcgaggagaacaacgctgggaatgccgccgccgcactcatggctggcctcgcccccaagactaaggtgctgagggatggcaagtggtcggagcaggaggcagcgatcctggtccccggtgatatcatcagcatcaagctaggcgacatcgtccccgccgacgcccgactcttggaaggtgatccgctcaagatcgaccagtccgccctcaccggcgagtccctccccgtgacgaagcaccccggcgatgaggtcttctccggctccacctgcaagcaaggagagatcgaggccatcgtcattgccaccggagtgcacaccttcttcggcaaggcagcccacctcgtcgacagcaccaacaacgtcggtcacttccagaaggtgttgacggccatcggaaacttctgcatctgctcgatcgcggtcgggatgctcatcgaggtcatcgtcatgtacccgatccagcaccggaggtacagggacggcattgacaacctcctggtgctcctcatcggtggcattcccatcgccatgccgaccgtgctgtcggtcaccatggccatcggatcccaccggttgtcggagcagggagcgatcaccaagaggatgaccgccatcgaggagatggccggcatggacgtgctgtgcagcgacaagaccggaacgctcaccctcaacaagctcaccgtcgacaagaccttgatcgaggtgtttgtgagtggcctggacaaggattcagtggtcctgtatgctgctatggcttccagggtcgagaaccaggacgccatcgatgcttccattgtggggatgttagctgaccccaaggaggcacgtgcagggatccaggaggtccatttcctgccattcaatccggtcgacaagcgcaccgcaatcacctacatcgactccaatggcaagtggcaccgatcgagcaagggtgcacccgagcagatcattgatctctgcaacatgaaagacgatgccaagaagaaggtgcatgccatgatcgacaagttcgccgaacgtggccttcgcgctctgggtgtggcgaggcaggaggtgcctgaggcaaacaaggagagcgccggcgatccatggcagttcataggcctcttgcccctctttgatcctccgaggcacgacagcgccgagaccatccgccaagccctccacctcggcgttaacgtcaagatgatcaccggcgaccaacttgccattggcaaggaaactgggcgtcggctcggcatgggaaccaacatgtacccgtcctccacgcttcttggcgataagaacgacgacgtcaccggcctccccattgacgagctcatcgagaaggccgatggctttgctggagtcttcccagagcacaagtacgagatcgtgaagaggctgcaggacaggaagcacatctgcggcatgacaggggacggtgtcaacgacgcaccagctctgaagaaggcggacatcggcatcgctgtggcggacgcgacggacgccgcccgcagcgcgtcggacatcgtgttgacggagccggggctgagcgtgatcgtgagcgcggtgctgacgagccgcgccatcttccagcggatgaagaactacaccatctacgccgtctccatcaccatccgtatcgtgctcggcttcatgctcatcgccctcatctggcagttcgacttctcccccttcatggtcctcatcatcgccatcctcaacgacggcaccatcatgaccatctccaaggacagggtgaagccctcccccttgcccgactcatggaagctccgggagatctttgccaccggagtcgtcctcggagcgtaccttgccataatgaccgtcgtcttcttctggctcgcacatgccaccgacttcttccctgagaagtttggtgtgaggccgatcaaggacaaccaagaggagctgacggcagcactctacctccaggtcagtatcatcagccaggcactcatcttcgtcaccaggtcgaggagctggtccttcgtcgaacgtcccgggtttctgctggtcgccgccttcgtcgccgcccagctggtggcgacggtcatcgccgtgtatgcgtcgtggagcttcgcaagaatccagggcatcgggtggggatgggctgggatcatctggctcttcagcttgatcacctacttccctctcgacatcctcaagttcatcatccgctacgctctcagcggcaaggcctgggacaaccttctccagaacaagaccgcgttcaccacgaagaaggattacgggaggggcgagagggaggcgcagtgggctctggctcagcgcaccctccatggcttgcagcccgcggacacctccgacctcttcaacgacaagagcagctacagggagttgtctgagatcgccgagcaggcgaagaggcgcgccgaggttgcccggctgagggagctccacacgctaaaaggccacgtcgagtctgtggtgaagctaaaggggctggacatcgagacgatacagcagcactacactgtctaaaccatggaagataacatatagagacag

SEQ ID NO: 2180 - DNA, 2320 bp, Panicum virgatum
atctccccggaggacgtccgcaatgggaacgtcgatctgtccaagatgccggtggaggaggtgttcaagacgctcaagtgcagccgcaaggggctctccagcgcggagggggagggccggctcagggcgttcggccccaacaagctggaggagaagaaggagagcaggctgcttaagttcctgggcttcatgtggaacccgctgtcgtgggtcatggagatggcggccatcatggccatcgtgctcgccaacggcggcggcaagccccccgactggcaggacttcgtcggcatcgtctcgctgctcatcatcaactccaccatcagctacatcgaggaggccaacgccggggacgccgcggcggcgctcatggcggggctcgcacccaagaccaagctgctgagggacggccggtgggaggagcaggacgcgtcgatcctggtgcccggcgacatcatcagcatcaagctcggcgacatcatccccgccgacgcgaggctgctcgagggcgacccgctcaagatcgaccagtccgcgctcaccggcgagtcgctgccggtgaacaagcaccccgggcaggaggtgttctccggctccacggtgaagcagggcgagatcgaggccgtcgtcatcgccaccggtgtgcacaccttcttcggcaaggcggcgcacctcgtcgacagcaccaacaacgtcggccacttccagcaggtgctgacggccatcggcaacttctgcatcatctccatcgccgccggcatgctggtcgaggtcgtcgtcatgtacccgatccaacaccgcgcctaccgcgacggcatcgacaacctcctcgtgctgctcatcggcggcatccccatcgccatgcccaccgtgctctccgtcaccatggccatcggctcccaccggctgtcgcagcagggcgccatcaccaagcgcatgaccgccatcgaggagatggccggcatggacatcctctgcagcgacaagaccggcaccctcaccctcaacaagctcaccgtcgacaagtccctcatcgaggtctactccaagggcgttgacaaggagatggttctcctctacgccgcgagggcctcccgcgtcgagaaccaggacgccatcgacacttgcatcgtcaacatgctcgccgaccccaaggaggcccgcgccggcatcaaggaggtccacttcctccccttcaaccccgtggagaagcgcacggccatcacctacatcgacggcaacggcgactggcaccgggtcagcaagggcgctcccgagcagatcatcgagctctgcaacatgggcgccgacgccgagaagaaggtgcacgccctcatcgacgggtacgccgaccgcggcctccggtcgctgggcgtgtcgtaccagcaggtgccggagaagagcaaggagagcgccggcgacccgtggcagttcatcggcctgctgccgctgttcgacccgccgcggcacgacagcgcggagaccatccggcgcgcgctgcacctgggcgtgaacgtgaagatgataaccggcgaccagctggccatcggcaaggagacggggcggcggctgggcatgggcaccaacatgtacccctccaccaccctcctgggcgacaagggcagcacggtgaacggcatgcccatcgacgagctgatcgagaaggcggacgggttcgccggcgtgttcccggagcacaagtacgagatcgtgaagcggctccaggaccggaagcacatctgcggcatgaccggcgacggcgtgaacgacgcgccggcgctgaagaaggcggacatcggcatcgcggtggacgacgcgacggacgcggcccggagcgcgtcggacatcgtgctgacggagcccgggctgagcgtgatcgtgagcgccgtgctgacgagccgctccatcttccagcgcatgaagaactacaccatctacgccgtgtccatcaccatccgcatcgtgctggggttcctcctcatcgcgctcatctgggagttcgacttcgcgcccttcatggtgctcatcatcgccatcctcaacgacggcaccatcatgaccatctccaaggaccgcgtcaagccgtcgcccaagccggactcgtggaagctcaacgagatcttcgccaccggcatcgtgctcggcacctacatggccctcgtcaccgccctcttcttctacctcgcgcacgacaccgacttgttctcggacgtgttcggcgtggcgtccatcaaggagaacgacggggagctcatgtcggcgctctacctccaggtgagcatcatcagccaggcgctcatcttcgtgacgcggtcccgga

SEQ ID NO: 2181 - DNA, 2928 bp, Musa acuminata
ctaccagcctcacatccttcttctaggaggatggccaccggttacactggagtcggcaccaagtccgtgtccctggaggacatcaagaacgagagcgtcgatcttgagaaggttcccgtgagcgaggtctttgagcatctgaaatgtaaccaggaagggctcaccgccgaggagggcgaggaccgactgcagatctttggccccaacaagctcgaggagaagacggagagcaagttcctcaagttcttaggattcatgtggaatccgctgtcgtgggtcatggagatcgctgccatcatggcaatcgtcttggctaacggagggggtgagccaccggactggcaggacttcgtcggaatcgtcgttctcctcatcataaactccaccatcagcttcatcgaggagaacaacgcaggcaatgccgccgccgccctcatggctggcctcgcccctaagactaaggtgctgagggatgggaagtggtcggagcaggaggctgcgatcctcgtccccggtgacatcatcagcatcaagctgggtgatatcatccctgccgacgcccgcctcctcgagggtgacccgctcaagatcgaccagtcggcgctcaccggcgagtccctccctgtgaccaagaacccaggcgatgagatcttctccggttccacatgcaagcaaggagagatcgaggccgtcgtcatcgccaccggcgtccacaccttctttggaaaggccgcccacctcgtcgacagcaccaacaacgtaggccacttccagaaggtgctcaccgccattggaaacttctgcatctgctcgatcgccttcggcatgctcgtggagatcatcgtcatgtacccgatccagcaccggcgatacagggacggcatcgacaacctcctggtgctgctcatcggcggaattcccatcgccatgcccactgtgctgtcggtgacgatggccatcgggtcccaccgtctgtcagagcaaggggcaattaccaagaggatgactgccatcgaggagatggccggcatggacgtgctttgcagtgataagactggtacccttaccctcaacaagctcaccgtcgacaagagcctgatcgaggtgttcgtgaaggacatggataaggatacggtagtcctgtacgctgcaagggcctccagggttgagaaccaggacgccattgatgcctgcattgtcgggatgctggccgaccccaaggaggcacgagctggaatccaggaactccactttctgcccttcaatccagtagagaagcgcactgccatcacatacgtcgattcgaaaggcaaatggcatcgcgcgagcaaaggcgctcctgagcagatcattgacctctgcaacatgaaagaggacgcccggaagaaggtccatgccatgatcggcaagttcgccgaccgcggcctccgcgctctgggtgtggcaaggcaggaggtgcccgaggcgagcaaggagagtgccggcgctccatggcaattcatgggtctgttgcccctcttcgatcccccgaggcatgacagtgccgagaccatccgccgtgcgctcaacctgggtgtcaatgtcaagatgatcacgggcgaccagcttgccattgccaaagagacagggcgtaggctcggcatgggcaccaacatgtatccgtcctccaccctcctcggcgagaagaacgatgacaccaccggcctccccatcgatgacctcatcgagaaggctgatggctttgccggagtcttccccgagcacaagtacgagatagtgaggaggctacaggagaagaagcacatctgtggcatgacaggggacggcgtcaacgacgcaccagctctgaagaaggcagacatcggcatcgcagtggcagacgcgacggacgccgcacgcagtgcttcggacatcgtgctcacggagcccggtctgagtgtgatcgtgagcgcagtgctgacgagccgcgccatcttccagcggatgaagaactacaccatctacgccgtctccatcaccatccgcatcgtgctcggcttcatgctcgtcgccctcatctggcgcttcgacttctcccccttcatggtcctcgtcatcgccatcctcaacgatggcaccatcatgaccatctccaaggaccgagtcaaggcctcccctctgcccgactcatggaagctccgggagatcttcgccaccggcatcgttctcggtgcttaccttgcaatcatgaccgtggtcttcttctacgttgctcacgacaccgatttcttctccgaagcgttcggtgtgaggtcaatcaaggaccacagtgatgagatgaccgcagcgctgtatctgcaagtgagcatcatcagtcaagcactcatcttcgtcacccggtcgaggagttggtccttcgtggagcgccccggtctcttgctagtctttgccttcatcgctgcccagttggtggctactgtcatcgcggtgtatgcctcgtgggggtttgccaggatccagggcatcggatgggggtgggctggggtcatttggctctacagcctcatcacctacttccctctcgacgttctcaagttcatcattcgctacgctctgagtggaagagcctgggacaactttctccagaacaagacggccttcacctcgaagaaggattacgggaagggtgagagagaggcacagtgggcgctggctcagcgcaccctgcatggcctacagctgcccccagacacctcgggcctgttcgacgacaacaacaactacagggagttgtctgagatcgcggagcaggccaagaggcgagccgaggttgcaaggcttcgggagctgcacacgctcaaggggcatgtcgagtccgtggtgaagcttaagggactggacatcgagggcatgccgcagcattacactctgtgaggagctgccgccgga

SEQ ID NO: 2182 - DNA, 3178 bp, Musa acuminata
cccctccctcgctttcctcaccgcctatgaagcagtagtgagagcgcagagaataagagcaaggagagaggacgaacaaagtagtagcccatgcctctcctgctctccccgtacctcttccagtagctctcggcctccaacaaccagcacaactttgcacagaaacctaaaaaaacaaatagcacaagatggcgaccgccggcggtgatggctccatctccctggagcagatcaagaacgagtcggtcgacctggagagaatcccggtggaggaggtgtttgcgcagctgaaatgtagccgcgaggggctctcctctcccgaaggggagcagcggctccaaatctttggccctaacaagctcgaggagaaaacggagagcaagttcctcaagttcttgggcttcatgtggaacccgctctcttgggtcatggagatcgccgccatcatggccatcgcgttggataacggagggggtgagccaccagattggcaggacttcattggaatcgttgtcctcctcctcatcaactccaccatcagcttcatcgaggagaacaacgctggaaacgccgccgcagccctcatggctggcctcgctcccaagactaaggtgttgagggacgacaagtggtccgagcaggaggcggctatcctcgtccccggcgatatcatcagcatcaagctcggtgacatcatcccggccgatgcccgcctcttggagggcgatcctctcaaaatcgaccagtctgctctcaccggcgagtccctccccgtgacgaagcaccccggcgacgaggtcttctcgggttccacctgcaagcaaggcgagatcgaggccatcgtcatcgccaccggcgtccacaccttcttcggcaaggccgcgcacctcgtcgacagcaccaacaacgtgggtcacttccagaaggtgctgacggccatcggaaacttctgcatctgttccatcgccatcggtatgatcatcgagatcatcgtcatgtaccccatccagcaccggaggtatcgcgacggcatcgacaacctcctggtcctgctcatcggtggcattccgatcgccatgcccaccgtgctgtcggtcaccatggccatcggatcccaccggttatcagagcagggagccatcaccaagaggatgaccgccatcgaggagatggctggcatggacgtgctctgcagcgacaagaccggcacgctcaccctcaacaagctcaccgtcgacaagagcttgatcgaggtgtttgtgagtggcctggataaggattcggtggtgctgtatgctgcaagggcgtctagggttgagaaccaggacgccatcgatgcttccattgttaacatgctggctgaccctaaggaggcacgtgcagggatccaggaagtccattttctgccatttaatccagtcgacaagcgcactgccatcacctacatcgactccaatggcaagtggcaccgatcaagcaagggcgcacctgagcagatcatcgacctctgcaacctgagagatgatgcgaagaagaaggtccacagcatgatcgacaagttcgccgagcgcggtcttcgcgctctcggtgtggcgaggcaggaggttcccgaggccaacaaggaaagcgccggcggtccgtggcaattcatgggcctgttgcccctcttcgaccctccaaggcacgacagtgccgagaccatccgccgtgccctcgacctcggcgtcaacgtcaagatgatcaccggcgaccagcttgccatcggcaaggagactgggcgcaggcttggcatgggaaccaacatgtatccttcctcgacccttcttggcgagaagaacgacgacgtcagtggcctccccatcgacgagctcatcgagaaggccgatgggtttgccggagtcttccctgagcacaagtatgagatcgtgaagaggctgcaggacaggaagcacatctgcggcatgacaggggacggcgtcaacgacgcaccggcgctgaagaaggcggacatcggcatcgcggtggcggacgcgacggacgcggcgcgcagcgcgtcggacatcgtgctgacggagcccgggctcagcgtcatcgtcagcgcggtgctgacaagccgcgccatcttccagcgcatgaagaactacaccatctacgccgtctccatcaccatccgtatcgtgctcggcttcatgctcatcgccctcatctggcgcttcgacttctcccccttcatggttcttatcatcgccatcctcaacgacggcaccatcatgaccatctccaaggacagggtgaagccttcccccctgcccgactcatggaagctccgggagatcttcgccaccggaatcgtcctcggcacctacctcgccctgatgaccgtcgtcttcttctggctagctcacgacaccgacttcttccccgaaaagttcggcgttaagccgatcagagacaacctcaatgagttgacggcagcactctacctgcaagtgagcatcatcagccaggcgctcatcttcgtcaccaggtcgcggagctggtccttcgtcgagcggcccggcctgctgctggtcaccgcatttatcgccgcccagctggtggcgacggtgatcgcggcgtacgcatcatgggggtttgccaggattcagggcatcgggtggggatgggcagggatcatctggctcttcagcttggtcacctacttccctctcgacgtcctcaagttcatcatccgctacacgctcagcggcaaggcctgggacaaccttctcgagaacaagacggcattcaccacgaagaaggattacgggcggggcgagagggaggcgcagtgggctctggcgcagcgcaccctgcacggcctgcagccggcggacacccccggactcttcaatgacaagagcagctacagggagctgtcggagatcgcggagcaggcaaagaagcgcgccgaggttgcccggctaagggaactgcacacgcttaaaggccacgtcgagtcggtcgtgaagctcaagggattggacattgagacgatacagcagcactacaccgtataaagcaaagcatatatataaatatatatatgcataaagagacatgaaagtgctgttttttctatttgtatgcgtggagattatgtgacgtcttatgatatgccagactaaattgatcgatc

SEQ ID NO: 2183 - DNA, 3131 bp, Musa acuminata
agagaataagagcaaggagagaggacgaacaaagtagtagcccatgcctctcctgctctccccgtacctcttccagtagctctcggcctccaacaaccagcacaactttgcacagaaacctaaaaaaacaaatagcacaagatggcgaccgccggcggtgatggctccatctccctggagcagatcaagaacgagtcggtcgacctggaaagaatcccggtggaggaggtgtttgcgcagctgaaatgtagccgcgaggggctctcctctcccgaaggggagcagcggctccaaatctttggccctaacaagctcgaggagaaaacggagagcaagttcctcaagttcttgggcttcatgtggaacccgctctcttgggtcatggagatcgccgccatcatggccatcgcgttggataacggagggggtgagccaccagattggcaggacttcattggaatcgttgtcctcctcctcatcaactccaccatcagcttcatcgaggagaacaacgctggaaacgccgccgcagccctcatggctggcctcgctcccaagactaaggtgttgagggacgacaagtggtccgagcaggaggcggctatcctcgtccccggcgatatcatcagcatcaagctcggtgacatcatcccggccgatgcccgcctcttggagggcgatcctctcaaaatcgaccagtctgctctcaccggcgagtccctccccgtgacgaagcaccccggcgacgaggtcttctcgggttccacctgcaagcaaggcgagatcgaggccatcgtcatcgccaccggcgtccacaccttcttcggcaaggccgcgcacctcgtcgacagcaccaacaacgtgggtcacttccagaaggtgctgacggccatcggaaacttctgcatctgttccatcgccatcggtatgatcatcgagatcatcgtcatgtaccccatccagcaccggaggtatcgcgacggcatcgacaacctcctggtcctgctcatcggtggcattccgatcgccatgcccaccgtgctgtcggtcaccatggccatcggatcccaccggttatcagagcagggagccatcaccaagaggatgaccgccatcgaggagatggctggcatggacgtgctctgcagcgacaagaccggcacgctcaccctcaacaagctcaccgtcgacaagagcttgatcgaggtgtttgtgagtggcctggataaggattcggtggtgctgtatgctgcaagggcgtctagggttgagaaccaggacgccatcgatgcttccattgttaacatgctggctgaccctaaggaggcacgtgcagggatccaggaagtccattttctgccatttaatccagtcgacaagcgcactgccatcacctacatcgactccaatggcaagtggcaccgatcaagcaagggcgcacctgagcagatcatcgacctctgcaacctgagagatgatgcgaagaagaaggtccacagcatgatcgacaagttcgccgagcgcggtcttcgcgctctcggtgtggcgaggcaggaggttcccgaggccaacaaggaaagcgccggcggtccgtggcaattcatgggcctgttgcccctcttcgaccctccaaggcacgacagtgccgagaccatccgccgtgccctcgacctcggcgtcaacgtcaagatgatcaccggcgaccagcttgccatcggcaaggagactgggcgcaggcttggcatgggaaccaacatgtatccttcctcgacccttcttggcgagaagaacgacgacgtcagtggcctccccatcgacgagctcatcgagaaggccgatgggtttgccggagtcttccctgagcacaagtatgagatcgtgaagaggctgcaggacaggaagcacatctgcggcatgacaggggacggcgtcaacgacgcaccggcgctgaagaaggcggacatcggcatcgcggtggcggacgcgacggacgcggcgcgcagcgcgtcggacatcgtgctgacggagcccgggctcagcgtcatcgtcagcgcggtgctgacaagccgcgccatcttccagcgcatgaagaactacaccatctacgccgtctccatcaccatccgtatcgtgctcggcttcatgctcatcgccctcatctggcgcttcgacttctcccccttcatggttcttatcatcgccatcctcaacgacggcaccatcatgaccatctccaaggacagggtgaagccttcccccctgcccgactcatggaagctccgggagatcttcgccaccggaatcgtcctcggcacctacctcgccctgatgaccgtcgtcttcttctggctagctcacgacaccgacttcttccccgaaaagttcggcgttaagccgatcagagacaacctcaatgagttgacggcagcactctacctgcaagtgagcatcatcagccaggcgctcatcttcgtcaccaggtcgcggagctggtccttcgtcgagcggcccggcctgctgctggtcaccgcatttatcgccgcccagctggtggcgacggtgatcgcggcgtacgcatcatgggggtttgccaggattcagggcatcgggtggggatgggcagggatcatctggctcttcagcttggtcacctacttccctctcgacgtcctcaagttcatcatccgctacacgctcagcggcaaggcctgggacaaccttctcgagaacaagacggcattcaccacgaagaaggattacgggcggggcgagagggaggcgcagtgggctctggcgcagcgcaccctgcacggcctgcagccggcggacacccccggactcttcaatgacaagagcagctacagggagctgtcggagatcgcggagcaggcaaagaagcgcgccgaggttgcccggctaagggaactgcacacgcttaaaggccacgtcgagtcggtcgtgaagctcaagggattggacattgagacgatacagcagcactacaccgtataaagcaaagcatatatataaatatatatatgcataaagagacatgaaagtgctgttttttctatttgtatgcgtggagattatgtgacgtcttatgatatgccagactaaattgatcgatc

SEQ ID NO: 2184 - DNA, 2863 bp, Ananas comosus
tggcggcggcggcggcagcgtcggcgagcttcttggaagagatccgcaatgagagcgtggacctcgagcggattccgatcgaggaggtgttcgagcagctgaaatgctcgcgggaggggctcagctcggccgagggcgagcagcggctccagctgttcgggcccaacaagctcgaggagaagaaggagaacaagttcctcaagttcctgggcttcatgtggaatccgctgtcgtgggtcatggagatcgccgcgatcatggccatcgccctcgccaacggcggaggaagacctccggattggcaagactttgtcggcatcgtcgtcctcctcgtcatcaactccaccatctccttcatcgaggagaacaacgcgggcaatgctgccgccgctctcatggccgggctcgcgcctaaaactaaagtgttgagggacgggaggtggtcggagcaggaggcggcgatcctcgtccccggcgacatcatcagcatcaagctcggcgacatcatcccggccgatgccaggttgctcgagggcgaccccctcaagattgaccaatcggccctcaccggcgagtcgctccccgtgacgaagagccccggggacgagatcttctccgggtcgacgtgcaagcagggcgagatcgaggccgtcgtcatcgccaccggcgtccacaccttcttcggcaaggccgcccacctcgtcgacagcaccaacaatgttggccactttcagaaggtgttgacggccatagggaacttctgcatatgctctatcgcggtgggtatgctgatcgagatcgtggtgatgtacccgatccagcaccggcggtacagggaggggatcgacaacctgctggtgctgctgatcggcgggatcccgatcgcgatgccgacggtcctgtcggtgacgatggcgatcgggtcgcaccggctctcggagcaaggggcgatcacgaagcggatgaccgccatcgaggagatggccgggatggacgtgctctgcagcgacaagaccggaacgctcaccctcaacaagctcaccgtcgacaagaccatgatcgaggcgttcgtgaaggacattgacagagatacggtggtgctctacgcggcgagagcttcaagagtggagaatcaggacgctatcgatgcttccattgtcggcatgctcgcagatcccaaggaggcacgcgccgggattcaggaggtccacttcctgcccttcaacccggtcgagaagcgcactgccatcacctacatcgactccgccggcaagtggcaccgcatcagcaaaggcgcccccgaacagatcattgacctctgcaacttgagagaagatgcgcggaagcgggtccacgggatcatcgacaagttcgccgaccgcggcctccgcgcgctggccgtggcgcggcaggaggtccccgaggccgccaaggagagcgcgggtgggccgtggcagttcgtcgcggtgctgccgctcttcgacccgccgcgccacgacagcgcggagaccatccgccgcgcgctcaacctcggcgtcaacgtcaagatgatcaccggcgaccagctcgccatcgccaaggagaccgggcggcgcctcggcatggggaccaacatgtacccgtcgtcgaccctcctcgccgacaagaaggacgacctcgccggcgggctgccggtcgacgagctaatcgagaaggccgacggcttcgccggagtcttcccggagcacaagtacgagatcgtgaggcggctgcaggagcggcggcacatctgcgggatgacgggggacggggtgaacgacgcgccggcgctgaagaaggcggacatcgggatcgccgtggcggacgcgacggacgcggcgcggggggcgtcggacatcgtgctgacggagcccgggctgagcgtgatcgtgagcgcggtgctgacgagccgcgccatcttccagcgcatgaagaactacaccatctacgccgtctccatcaccatccgcatcgtgctcggcttcctgctcatcgccctcatctggcgcttcgacttctcccccttcatggtcctcatcatcgccatcctcaacgacggcaccatcatgaccatctccaaggaccgcgtcaagccctcccccctccccgactcctggaagctgcgcgagatctttgccaccggcgtcgtcctcggcgcttacatggctgtcatgaccgtcgtcttcttttggattgcccacgacaccgacttcttcccacaaatctttggagtgaggtcgatcagggagcatgaggacgaacttatgtcggcactgtacctccaggtgagtataatcagccaggcgctcatcttcgttacgaggtcgaggagctggtcctttatcgagcgccccggtctcttgctcgtcaccgctttcatcgccgcgcagctggtggctaccgcggtcgcagtgtacgcgacctggggcttcgccaggatccagggcatcggatggggctgggccggagtgatctgggtctacagcctcgtcacctacttccctctcgacattctcaagttcattattcgctacgctctcagcggcaaggcctgggacaaccttatccaaaacaagacggccttcaccaacaagaaggactacgggaggggcgagagggaggcgcagtgggcgctggcgcagcgcactctgcacgggctccagccgccggacgcctccggcttctttagcgacaagagctacagggagctgtcggagatcgcggagcaggccaagaggcgcgcggaggtcgccaggcttagggagctgcacacgctgaaggggcacgtcgagtcggtggttaagctcaaggggctcgacatcgagaccatccaacagcactacac

SEQ ID NO: 2185 - DNA, 2965 bp, Cocos nucifera
tcccggtcgaggaggtcttcgagcagctgaaatgcagcagggaagggctcacctcagccgagggggagcagcgtctccagatatttggccccaacaagctcgaagagaagaaggagagcaagctgctcaaattcttggggttcatgtggaacccgctctcctgggtcatggagattgccgccatcatggccatcgtcttggccaacggtggaggtcagcctccagattggcaagacttcgtcggcatcgtcgtcctcctgatcatcaactccaccatcagtttcatcgaggagaacaacgccgggaatgccgcagccgccctcatggccgggcttgcccccaagaccaaggtgttaagggacggcaagtggtccgagcaggaggctgctatgctcgtcccgggtgatatcatcagcatcaagcttggcgacatcgtcccggctgatgcccgactcctggaaggagatcccctcaagatcgaccagtctgccctcaccggtgagtccctccccgtgaccaagaacccaggcgacgaggtcttctcgggctccacctgcaagcagggtgagatcgaggccatcgtcatcgccaccggcgtccacaccttcttcggcaaggctgctcaccttgtggacagcaccaacaatgtgggccatttccagaaagtgctcacagccatcggcaacttctgcatctgctcgatcgccctcggcatgctcatcgagatcatcgtcatgtacccgatccagcaccgcaggtacagggatggcatcgacaacctcctggtgctcctcattggtggtatccccattgccatgcccaccgtgctgtcggtcaccatggccatcggatcccaccggctttcggagcaaggtgccatcaccaagaggatgactgccatcgaggagatggccggcatggacgtgctgtgcagcgacaagaccggcaccctcaccctcaacaagctcaccgtcgataagaacttggtcgaggtgttcgtcaaggacatggacaaggacacggtgcttctgtatgccggcagggcttccagggtcgagaaccaggacgctattgatgcttccattgttggaatgctggccgaccccaaggaggctcgagctggaatccaggaggtccacttcctgcccttcaatcctgtggacaagcgcactgcgatcacctacgtcgactccgacggcaggtggcacagggcgagcaagggtgcccccgagcagatcattgatctctgcaacatgaaagaggatgcgaagaaggaggtccacgagatcatcgacaagtttgccgaccgtggccttcggtcccttggtgttgctaggcaggaggtacctgaagccaacaaggagagcgctggtggtccgtggcaattcgtgggtcttctgcctctcttcgaccccccaaggcatgacagcgcggagaccatccgccgtgccctccacctcggtgtcaacgtgaagatgataaccggcgaccagctcgccattggcaaggaaactggacgcaggcttggaatgggcaccaacatgtacccctcgtccacccttctcggagataagaacaccgagatcaccggtctccccatcgatgagctcatcgagaaggctgatggtttcgccggagtcttccctgagcacaagtatgagatcgtgaagaggctgcaggagaggaagcacatctgcggcatgaccggagatggtgtgaacgacgcccccgcactgaagaaggcggacattggcatcgccgtggcggatgcgaccgacgcggcccgcagcgcgtcggacatcgtgctgacggagcccgggttgagcgtgatcgtgagcgctgtactgacgagccgtgccatcttccagcgcatgaagaactacaccatctacgccgtgtccatcaccatccgtatcgtgctcggcttcatgctcatcgccctcatctggcgcttcgacttctcgcccttcatggtcctcgtcatcgccattctcaatgacggcaccatcatgaccatctccaaggaccgcgtcaagccttcccccgtccccgactcatggaagctgaaggagatctttgccaccggagtagtcctcggtgcctacatggcggtcatgaccgtcgtgttcttctggattgcccacgataccgatatcgtcaccgagaagtttggattgaagccgatcagagacaacaccgatgagctcacggcagctctgtacctccaagttagtattattagtcaagctctcatcttcgtcacccggtccaggagctggtccttcatcgagcgccctggtgtcttgctggtcaccgccttcatcgccgcgcagctggtggctacggtcatcgctgtgtacgcgtcatggggctttgctaggatccaaggcattggatggggttgggcagcattcgtctgggtatacagcgtcatcacctacatccctctcgacatcctcaagttcatcacccgctatgttttgagcggcaaggcctgggacaaccttctccagaacaagacggccttcacctcaaagaaggattacggaagaggcgagagggaggcacaatgggctatggctcagcgcaccctgcatggcctccagtccccggacacctcgggtctcttcaacgacaagaacggctacagagagctgtctgaaatcgcagagcaggccaagaggcgcgcggaggttgccaggctaagggagctgcacacgctcaaggggcatgtggagtctgtcgtgaagctcaagggactggacatcgagacgatccagcaacactacacggtttaaaggaggaaggaggcgatatattaattgagagtcttgtggatggagggatgatattctaattgcaccccccccccccccccccccccccccccccccccccccccccccccccccccccccccccccccccccccccccccccccccccccctctctttctctctaca

SEQ ID NO: 2186 - DNA, 3204 bp, Musa acuminata
cgcctcacgaagagagccgctcgtctgcatctatgcaggcgagaaagagagggagagaaaactcgagagcatccatatctttcgtgctctcctcccccttcctcgtcttatagacgctcgaagccctcttcttcctcctcctcagcaagcagtgcagcgctgaaggaaggaaacaataacgtaagatggcgaccgacggctacggatccatctccctggaggagatcaggaacgagaccgtggatttggagagtatcccggtggaggaggtatttacgcagctaaaatgtagtcaggaggggctcaccaccgccgaaggggagcagcgactccacatctttggcctcaacaagctcgaggagaagaaggagagcaagttcctcaagttcttgggcttcatgtggaaccccctttcttgggtcatggagatcgccgccatcatggccatcgtgttggataacggagggggtgagccaccagattggcaggatttcattggcatcgtcgtcctcctgatcatcaactccaccatcagcttcatcgaggagaacaacgctggaaatgccgcggcagctctcatggccggcctcgctcccaagaccaaggtgttgagggatgggaagtggtcggagcaggaagcggcgatcctcgtccctggtgatatcatcagcatcaagctcggtgacatcatcccggctgatgcccgactcttggagggcgatccgctcaagatcgaccagtccgccctcaccggcgagtccctccctgtgaccaagatgcccggcaatgaggtcttctcgggctccacctgcaagcaaggagagatcgaggccatcgtcatcgctaccggagtgcacaccttcttcggcaaggctgcccacctcgtcgacagcaccaacaacgtgggtcacttccagaaggtgctgacggccatcgggaacttctgcatctgctcgatcgcaatggggatgatcatcgagatcatcgtcatgtacccgatccagcaccggcggtaccgggacggcatcgacaacctcctggtgctgcttatcggtggaattcccatcgccatgcccaccgtgctatcggtcaccatggccatcggatcccaccggttgtcggagcagggagcgatcaccaagaggatgaccgccattgaggagatggccggcatggatgtgctgtgcagcgacaagaccggaactctcaccctcaacaagctcagtgttgacaggaacttgatcgaggtgtttgtaaacggcttggatagggacacagtggtcctgtacgctgcgagggcttctagggtcgagaaccaggacgcgatcgatgcttccattgtcggaatgctggctgaacctaaggaggcacgagcagggatcgaggaggtccatttcttgccgttcaatccggttgacaagcgcactgcaattacctacatcgactctgacggcaagtggcaccggtcgagcaagggtgcgcctgagcagatcattgacctctgcaacctgaaggatgatactaagaagaaggtccatgccatgatcgataagttcgccgagcgcggccttcgcgctctgggtgtggcgaggcaagaggttcctgaggcgaccaaggcgagcgccggcgatccatggcagttcatgggtctcttgcccctcttcgaccccccgaggcacgacagtgcggagaccatccgccaagccctccaccttggtgtcaatgtcaagatgatcaccggcgaccagctcgccatcgccaaggaaacagggcggcggcttggcatgggaaccaacatgtatccgtcctccacgcttcttggcgaaaagaccgacgacgtcaccggcctccccatcgatgacctaattgagaaggctgacggctttgctggagtcttccccgagcacaagtatgagatcgtgaggaggttgcaggagaggaagcacatctgtggcatgacaggagacggggtgaatgacgcaccagctctgaagaaggccgacatcggcatagcggtggcggacgcgacggacgctgcccgtagtgcctcggacatcgtcttgacagagccagggctcagcgtcatcgtgagcgcggtgctgacgagccgtgccatcttccagcgcatgaagaactacaccatctacgccgtgtccatcaccatccgcatcgtgctcggcttcatgctcatcgccctcatctggcaattcgacttctcccccttcatgatcctcgtcatagccatcctcaacgacggcaccatcatgaccatctccaaggacagggtcaagccttcccccttgcctgattcatggaagctccgggagatcttcgccaccggaatcgtcctcggtgcctacctcgccataattaccgtcgtcttcttctggctcgttcatgacaccgacttcttccctgagaaatttggagtgaagtcgatcagggacaacaacaacgagctgacggcagctctctacctccaagtgagtatcataagtcaggcgctcatcttcgtcaccaggtcgaggagctggtccttcgtcgaacgccctggttttctgctggtcaccgccttcctcgctgcgcagctggtggccaccgtcatcgccgtgtacgcgtcgtggggcttcgctaggatccaaggaatcggatggggatgggcagcgatcatctggatcttcagcttggtcacctacttccctctcgacgtcctcaagttcattatccgctatgctctgagcggcagggcctgggacaaccttctccagaacaagacggcattcaccacgaagaaggattacgggagggaagagagggaggcgcagtgggctctggctcagcgcaccctccatggcctgcaggtcccggacacctcagccctcttcaacgacaataacagctacagggagttgtctgagatcgctgatcaggcgatgaggcgcgccgaggttgcccggctgagggaactaaacacgctgaaagggcacgtcgagtccgtggtgaagctaaagggactggacattgacacaattcagcagcactacactgtgtgaagcaaaagacaaggggaatatgaatatgccgccatcggggtatagaattcttgtggtgttcttactaggaggaggaatgactgcatttatgtgatggtttttttgaattatctcaagaagaagttttgcccaatattctcggttgaaacac

SEQ ID NO: 2187 - DNA, 2982 bp, Cyclamen graecum
atagcagggttgatctgaaagtgagggtgtgaaaaggcaaaaaagttagaaaagaggttgagggagaaactactctctttcaatctctaatcctgcgtacatcatggcctctcagtccgagctctccttggaacaaattaaaaacgagctcgtggatcttgaaaatgtgcctatagaagaggtgtttgtgcagctaaaatgctccagggaaggtttgacctcagacgaaggcgatcgtaggctcgaacttttcggacccaacaagctcgaggagaaaaaggaaagcaaggttctgaagtttttggggtttatgtggaatcccttgtcatgggtgatggagtgtgctgctatcatggccatagccttggcaaatggaggggggaaggcacccgattggcaagactttgttgggatagtggttttgttgattataaactcgacaattagtttcattgaagagaacaatgcaggcaatgctgcagctgcccttatggctggtcttgctcccaaaaccaaggttttgagagatgggaaatggagcgagcaggaggccgcgatcttggtgccgggagacctcatcagcgtcaagctcggcgacatcatcccagccgacgcccgtctcctcgaaggcgatccattaaagatcgaccagtcggcactgacaggcgagtccttgccagttaccaagtatccggggaatgaggtgttctccgggtccacttgcaagcaaggggagttagaggccgtcgttattgccacgggggttcacacattcttcgggaaggctgcccatctcgtcgacagcaccaaccaagtcggacacttccagaaggtgttgactgcgattggtaacttctgcatctgttcgattggcatcgggatgctggtagagatattggtaatgtacccgatccagggcagagcgtacagacagggaattgacaacctgttggtgctcctcatcggaggtattcccattgccatgcccacggtcttgtccgtgaccatggccatcgggtcccacaggctatcccaacagggggctattaccaagaggatgaccgcgattgaggaaatggctgggatggatgtcctttgcagtgataagaccggaaccctcaccctgaacaagctcacggtcgacaagaccttgatcgaggtgttcgccaaagacttggataaggactctgttgtcttgcttgccgctagggcctccagaatcgaaaaccaggacgctattgatgcttcaatcgtcggaatgttgggtgaccccaaggaggcaagagccgggctcaccgaggtgcactttctgcccttcaacccggtagataagcgcactgccattacctacatagacaacgacggcaactggcacagatgcagcaagggtgctcctgagcaaatcattgaactctgcaatctcaaaggaaatgcgaagaataaatcccttgctatcatcgacaactacgccaaccgtgggctccgttctctcggtgttgcaagacagactgtttcggagaaatctaaggagagtgccggagatccatgggaattcgtcggtcttttgcccctcttcgaccccccaagacacgacagtgcagaaaccatccgcagggctcttgatctcggtgtcaatgtcaagatgattactggcgatcagcttgctattggaaaagaaaccgggcgtaggcttggaatgggcacaaacatgtacccatcgtcgtcccttcttggccagtgcaaggacgagtctatcacaggcatccccatcgatgagctcattgagaaggctgatggatttgccggggtctttcctgagcacaagtacgagatcgtgaagaagctgcaagagagaaaacatatttgcggtatgaccggagatggtgtgaacgatgccccagctctaaagaaagccgacattggtatcgccgtggctgatgctacagatgctgccaggggagcatccgacatagtcctgactgagccaggcctcagcgtgatcgtgagcgcggtcctaaccagcagagccatcttccagaggatgaagaactacacaatctatgccgtatctatcaccatccgtatcgtgatgggtttcatgctcatcgccctcatctggaagttcgacttctcgcctttcatggtcctgattattgccatcttgaacgacggaaccatcatgaccatttccaaggatagagttaagccatctccattgcccgactcgtggaagctcaaggagatcttcgccacaggtgttgtccttggaacctatctggctatcatgaccgtggtctttttctggctcgcagctgacactgacttcttctcgaacactttcggtgttagatcactcaggggaaatgtagatgagctcaccgctgctctctaccttcaagtgagtatcgtgagccaagctctcatcttcgtaaccaggtcacgtgggtggtcgtttgtcgaacgccccggtgtcttgctcgtcactgcctttttcctagctcaactggttgccactttaattgctgtatatgcacactgggattttgctcgcattcacggatgcggatggggatgggccggagtcatttggcttttcagccttattacctatttccctctcgatgtcctcaagttcatcattcgatatgcgttgagcgggaaggcatgggataccatgatcgaacataagactgctttcacaaccaagaaggattacggtagaggtgcgagagaagcacaatgggccatggctcaacgtacccttcacggtctccaatctgctgagggttacaacgacgaacaccacaacgagtctgaactagccgatcaggccaaaaagcgtgccgaagttgccaggttaagggagctccacacattgaagggacatgttgaatcagtggtgaagcagaagggattggatatcgataccattcaacagcactacactgtgtaaagccaaggatcagggcgaaaagacttcga

SEQ ID NO: 2188 - DNA, 3169 bp, Vitis vinifera
gaaagacccagctctgtgcttgattgcctcatatggaggaggaagagggagtctgctaaaagagactgcccttcctgagaagcaaattatcagaagaaggaggagaagaagctcctcttttgggagacttgatctctctaatctaggcttcttcttcttcttcttcttcttcttcttcttcttcttcttcactcaccatggcttctacaatgtccttggaagagatcaagaatgaatctgtcgaccttgaacgaattcccatcgaggaagtgttcgagcagctgaaatgtaccaaagacggtttgacatcagaggaaggggagcacaggctccaaatctttggccacaacaagcttgaagaaaagaaggagagcaagattctcaagttcttgggctttatgtggaatcctctgtcgtgggttatggagtgcgctgctattatggccattgttttggcaaatggagggggaaagcctccggattggcaagattttgtgggtatcactgtgttgctcattatcaactcaaccatcagtttcattgaagaaaacaatgcaggcaatgctgcagccgctctaatggcgggtctcgctcctaaaaccaaggtcttgagagatggaaagtggagtgagcaagaggcagctatccttgtaccaggagatgtgattagcattaaattgggagatattgtcccagccgatgcccgtctcctggaaggagatcctctcaagatcgaccagtctgccctcactggtgagtcccttcccgtgacgaagaacccaggtgatgaggttttctctggttccacctgcaagcaaggtgaaattgaggctgtggttattgccaccggtgtccacaccttctttggcaaggccgcccaccttgttgacagcaccaaccaagttggccacttccaaaaggtgttgaccgccattggtaacttctgtatctgctccattgctgtgggtatgcttgtggagattgtggtgatgtaccctatccagcaacggaagtacagagaggggattgacaatcttctggtgcttctcattggaggaattccaattgccatgccaacagttttatccgtgacaatggctattggatcccaccggctatcagaacaaggcgccatcaccaagaggatgactgctattgaagagatggctggcatggatgtactctgcagtgacaagaccggaaccctcaccctcaacaagcttaccgtggacaagaccctcattgaggtattcccaaaggacatggacaaggacagtgttgtcttgctggccgctagggcttctagggttgaaaaccaggacgccattgatgcttccattgttggaatgttgggagatccaaaggaggcaagggcagggatcacagaggtccatttccttcccttcaacccagtggacaagcgcactgctataacctatattgatgccaatggtgattggcacagatgtagcaagggtgcgcctgaacagataattgacctttgtgagctcaaaggagacgtaaaggacaaggctcactccatcattgacaattatgctgaccgcggtctacgttctttggcagttgctcgacagaccataccagagaaaaccaaggagagtgccggcaagccatgggagttcgttggtcttttgcctctctttgatcctcccaggcatgatagtgcagaaaccatccgcagggccctcaaccttggtgtcaatgttaaaatgatcactggtgaccagcttgccattggtaaggagactggtcgtaggcttggcatgggcaccaacatgtatccctcatcctccctcctcggccagagcaaggacgagtccattgctaccatccctgttgatgagctcattgaaaaggccgatggctttgctggagtcttccctgagcacaagtacgaaattgttaagaagctccaagagagaaagcacatttgtggaatgacgggagatggtgtgaatgatgccccagcactgaagaaggcagacattggcattgctgtggcagatgccactgatgcagcccggagcgcatcagatatagtcctgacagagccagggctgagtgtgattgttagcgctgtgttgacaagcagagccatcttccagaggatgaagaactataccatctatgcggtttcaatcacaatccgtattgtgcttggtttcatgctcatcgctcttatctggaagtttgacttctcacctttcatggttctgatcatcgccattctcaatgatggaaccatcatgaccatctctaaggacagggtgaagccatcacctatgcccgactcatggaaactcaaggaaatctttgccactggcattgtccttggcacctaccttgcccttataaccgtcctcttcttctggcttattcatgacactgacttcttttcggacaaatttggtgttagatcaatcaggcataatagagatgaggtgaccgctgctctctatcttcaagtgagtattgtgagtcaagcactcatctttgttaccaggtcgcagagctggtcctttgttgaacgccctggactcttgctggtcggtgccttcattgcggcccagctggttgccacatgcatagccgtgtatccaagctggggctttgctcggattgaaggcattgggtggggatgggcaggagccatatggctcttcagcatcatcacctacttccctcttgatatcctcaagttcatcattcgatacggattgagtgggaaggcctgggataatctgctccaaaacaagactgcattcaccacaaagaaggattatggaaggggagagagggaggcacaatgggccttggctcaacgtacactgcatggtctccagccaccagagacttcaaacttgttcaatgacaacagcagctaccgggagttgtctgagattgcagagcaagctaagagacgggcagaagtcgcaaggctcagggagctccatacactcaagggccatgttgaatcagtggtgaagctgaagggactggacattgaaaccatccaacaacactacacagtttaaaaatgatcaagtttggagtgtaggtgaggaagatagaggatcaagagcaaaaaacagaaacaaaacatacataaatggggccctgcggatgggaaaaaaattaataaaaaaac

SEQ ID NO: 2189 - DNA, 3162 bp, Arabidopsis lyrata
cttgaaagcgtcttgcatgctaagagaaggctttagagcaaggagagaagggagaagttgattcctccaccggatatatctcctttttatatctgcctttatttatttatttctaagatcatatctctcttttaaggaagaaaaatggcaactgatatttcgtgggatgaaatcaagaaagaaaatgtggatcttgagcggatccctgtggaagaagtatttgagcagctgaaatgctcaaaagaaggtttgtcaagtgatgaagggaagaaaaggcttgaaatatttggggcaaacaagctcgaagagaaatcagagaacaagtttttgaaattcttggggttcatgtggaatcctctctcatgggttatggagtctgctgcaatcatggctattgttttagctaacgggggaggaaagcctccggattggcaagattttattggtattatggtgttgcttatcatcaactccaccatcagtttcatcgaggagaacaatgctggtaatgccgccgctgctctcatggcaaatcttgcacccaagactaaggtgttgagagatggtaaatggggggagcaagaggcttcaatcttggttccgggtgatttgataagcatcaaattgggtgacattgttcctgctgatgctcgtctcctcgaaggagatcctttaaaaattgaccaatctgctcttaccggtgaatcccttccagtcaccaaacaccctggagatgaagtattctcaggctcaacctgcaagcaaggtgagattgaggctgttgtgattgctacgggtgttcacaccttctttggcaaggctgctcatcttgttgacagtaccaacaatgttggccatttccaaaaggttttgacatcaattggtaacttctgtatatgctcaattggattgggaatgttgattgaaatattgattatgtaccctatccaacaccgcacatacagagatggtattgataatctattggtacttttgatcggaggaattccaatcgccatgccaacagttttgtctgtaacaatggctattgggtcacatagactctctcaacaaggtgccatcaccaagaggatgactgcgattgaagaaatggctggaatggatgttctatgcagtgataagactggaactctaacacttaacaaactctctgtcgacaagtctttgattgaagtgttcccaaagaacatggatacagattcagttgtattgatggctgcaagagcttccaggattgaaaaccaagatgccattgatgcttccattgtcggaatgttgggtgatccaaaagaggcaagaacaggaatcacagaggtgcatttcttgccctttaaccctgtagataaacgtacagccatcacatacatcgatgaaagcggagactggcatcgaagcagcaaaggagctcctgagcagatcatcgaactatgcaatctccaaggagagactaaaagaaaagcacatgaagttattgatggttttgctgaacgtgggcttcgttctcttggtgttgctcaacagactgtgcctgagaagactaaggaaagtgatggtagtccatgggagttcgttggtctattgccactctttgacccgccaagacatgacagtgcggaaactattagacgtgcccttgagcttggtgtcaatgttaagatgattaccggtgaccaacttgccattggtattgagactggtcgtaggcttggcatgggaaccaacatgtacccatccacttcactccttggaaattcaaaagatgagtcattagttggcatccctatcgatgagctcattgagaaagctgatggatttgctggagttttccctgagcacaagtatgagatcgtaaagaagctacaagaaaggaagcacatttgtgggatgactggagatggtgtaaacgatgctccagctttgaagaaagcggatattggaattgcagtggcagatgctactgatgcggcgagaagtgcctcagacattgttctaacagaaccaggactaagcgtgatagtgagtgccgtattgacaagtcgcgctatcttccagaggatgaagaactacacaatctacgctgtttccatcactatccgtattgttttgggattcatgcttgttgctttgatctggagatttgattttgcacctttcatggtcttgattatcgcaatcctaaatgatggaaccatcatgacaatctctaaggacagggttaaaccttccccggtgccagattcttggaagctcaatgagatttttgccactggcgttgttctaggaacctacatggctcttaccactgtactctttttctggctagctcatgacacaaacttcttcagcaaaacatttggggtgaggtccatacaaggaaatgaagaagagcttatggcagctttgtatcttcaagtgagcatcataagtcaagcacttatctttgtaactagatcaaggagttggtcatttgttgagcgacctgggtttttgctcctaatagcctttgtcatagcacaattggtggctacattgatcgctgtgtatgcaaactggggatttgcaagaatcgtaggttgtggatggggatgggctggagtcatatgggtatatagtatcattacctacattcctcttgacatcctcaagttcatcattcgttacgctctcacgggcaaggcttgggataacatgatcaaccagaaaactgcgttcacaacaaagaaagattatggaaaaggagagagggaggctcaatgggcactagctcaacgtacactccatggtctaccacccccggaagcaatgttccacgacaataaaaacgagctctctgaaatagcagagcaggccaaaaggcgcgccgaagttgctaggctaagagagcttcacactctaaagggtcacgttgaatctgtagtgaagctcaaggggcttgacattgataccattcaacaacactacactgtttaaccatttctagggtgactactatgaacgagctctaatgagtaacaaaaaaagctatgtattctccttatattgtttttaaactatttgtgacaaaaagagagcaaaaacgagatataacatatttttccgttggaggatatatattaacacctagttaattacttgcaaaag

SEQ ID NO: 2190 - DNA, 3163 bp, Musa acuminata
cctataagtacacgcctgccatcgctttctaccttcgtcgcctttgaacgcctcacgaagagagccgctcgtctgcatctatgcaggcgagaaagagagggagagaaaactcgagagcatccatatctttcgtgctctcctcccccttcctcgtcttatagacgctcgaagctctcttcttcctcctcctcagcaagcagtgcagcgctgaaggaagaaaacaataacgtaagatggcgaccgacggctacggatccatctccctggaggagatcaggaacgagaccgtggatttggagagtatcccggtggaggaggtatttacgcaactaaaatgtagtcaggaggggctcaccaccgccgaaggggagcagcgactccacatctttggcctcaacaagctcgaggagaagaaggagagcaagttcctcaagttcttgggcttcatgtggaaccccctttcttgggtcatggagatcgccgccatcatggccatcgtgttggataacggagggggtgagccaccagattggcaggatttcattggcatcgtcgtcctcctgatcatcaactccaccatcagcttcatcgaggagaacaacgctggaaatgccgcggcagctctcatggccggcctcgctcccaagaccaaggtgttgagggatgggaagtggtcggagcaggaagcggcgatcctcgtccctggtgatatcatcagcatcaagctcggtgacatcatcccggctgatgcccgactcttggagggcgatccgctcaagatcgaccagtccgccctcaccggcgagtccctccctgtgaccaagatgcccggcaatgaggtcttctcgggctccacctgcaagcaaggagagatcgaggccatcgtcatcgctaccggagtgcacaccttcttcggcaaggctgcccacctcgtcgacagcaccaacaacgtgggtcacttccagaaggtgctgacggccatcgggaacttctgcatctgctcgatcgcaatggggatgatcatcgagatcatcgtcatgtacccggtccagcaccggcggtaccgggacggcatcgacaacctcctggtgctgcttatcggtggaattcccatcgccatgcccaccgtgctatcggtcaccatggccatcggatcccaccggttgtcggagcagggagcgatcaccaagaggatgaccgccattgaggagatggccggcatggatgtgctgtgcagcgacaagaccggaactctcaccctcaacaagctcagtgttgacaggaacttgatcgaggtgtttgtaaacggcttggatagggacacagtggtcctgtacgctgcgagggcttctagggtcgagaaccaggacgcgatcgatgcttccattgtcggaatgctggctgaacctaaggaggcacgcgcagggatcgaggaggtccatttcttgccgttcaatccggttgacaagcgcactgcaattacctacatcgactctgacggcaagtggcaccggtcgagcaagggtgcgcctgagcagatcattgacctctgcaacctgaaggatgatactaagaagaaggtccatgccatgatcgataagttcgccgagcgcggccttcgcgctctgggtgtggcgaggcaagaggttcctgaggcgaccaaggcgagcgccggcgatccatggcagttcatgggtctcttgcccctcttcgaccccccgaggcacgacagtgcggagaccatccgccaagccctccaccttggtgtcaatgtcaagatgatcaccggcgaccagctcgccatcgccaaggaaacagggcgacggcttggcatgggaaccaacatgtatccgtcctccacgcttcttggcgaaaagaccgacgacgtcaccggcctccccatcgatgacctaattgagaaggctgacggctttgctggagtcttccccgagcacaagtatgagatcgtgaggaggttgcaggagaggaagcacatctgtggcatgacaggagacggggtgaatgacgcaccagctctgaagaaggccgacatcggcatcgcggtggcggacgcgacggacgctgcccgtagtgcctcggacatcgtcttgacagagccagggctcagcgtcatcgtgagcgcggtgctgacgagccgtgccatcttccagcgcatgaagaactacaccatctacgccgtgtccatcaccatccgcatcgtgctcggcttcatgctcatcgccctcatctggcaattcgacttctcccccttcatgatcctcgtcatagccatcctcaacgacggcaccatcatgaccatctccaaggacagggtcaagccttcccccttgcctgattcatggaagctccgggagatcttcgccactggaatcgtcctcggtgcctacctcgccataattaccgtcgtcttcttctggctcgttcatgacaccgacttcttccctgagaaatttggagtgaagtcgatcagggacaacaacaacgagctgacggcagctctctacctccaagtgagtatcatcagtcaggcgctcatcttcgtcaccaggtcgaggagctggtccttcgtcgaacgccctggtttgctgctggtcaccgccttcctcgctgcgcagctggtggccaccgtcatcgccgtgtacgcgtcgtggggcttcgctaggatcgaaggaatcggatggggatgggcagcgatcatctggatcttcagcttggtcacctacttccctctcgacgtcctcaagttcattatccgctatgctctgagcggcagggcctgggacaaccttctccagaacaagacggcattcaccacgaagaaggattacgggagggaagagagggaggcgcagtgggctctggctcagcgcaccctccatggcctgcaggtcccggacacctcagccctcttcaacgacaataacagctacagggagttgtctgagatcgctgatcaggcgatgaggcgcgccgaggttgcccggctgagggaactaaacacgctgaaagggcacgtcgagtccgtggtgaagctaaagggactggacattgacacaattcagcagcactacactgtgtgaagcaaaagacaaggggaatatgaatatgccgccatcggggtatagaattcttgtggtgttct

SEQ ID NO: 2191 - DNA, 3378 bp, Secale cereale
tcagcacggagagaggaggcaggcagccaggcagcgcttgcccccgccctccctcccagggcctcccccctctcgggcgagcgccggcgccaccaacccaccaccacccggccggccccgtagctagcccggaataaaataaatttatctaagtacctagccagccatggcgtccctctccctcgaggacgtccgcaacgagaccgtcgacctgtcgacggtcgccgtggatgaggtgttcaagacgctcaagtgcgacaagaaggggctgagcgaggcggagggcgagaaccggctcaagctcttcggccccaacaagctggaggagaagaaggagagcaagctgctcaagttcctgggcttcatgtggaacccgctgtcctgggtcatggagatcgccgccatcatggccatcgcgctcgccaacggcggcggcaggccgccggactggcaggacttcgtcggcatcgtcaccctcctcttcatcaactccaccatcagctacatcgaggaggccaacgccggggacgccgccgccgcgctcatggccgggctcgcgcccaagaccaagctgctcagggacggcagctgggaggagcgggacgccgccatcctcgtccccggcgacatcatcagcatcaagctcggcgacatcatccccgccgacgccaggctgctcgacggcgacgcgctcaagatcgaccagtcggcgctcacgggcgagtccatgccggtcaacaagtacgccgggcaggaggtcttctccggctccacggtgaagcagggcgagctcgaggccgtcgtcattgccaccggcgtgcacaccttcttcggcaaggcggcgcacctcgtcgacagcaccaacaacgtggggcacttccagcaggtgctcacggccatcggcaacttctgcatcatctccatcgccgcgggcatgctggtggagatcatcgtcatgtacccgatccagcaccgcgcgtaccgcgacggcatcgacaacctcctcgtgctcctcatcggtggcatccccatcgccatgcccaccgtgctctccgtcaccatggccatcggctcccaccggctgtcgcagcagggcgccatcaccaagcgcatgacggccatcgaggagatggccggcatggacgtgctctgcagcgacaagaccggcacgctcacactcaacaagctcaccgtcgacaagaccctcatcgaggtgtgctccaagggcgtagacaaggagatggtgctcctctacgccgccagggcgtcccgcgtcgagaaccaggacgccattgacacatgcatcgtcaacatgctcgccgaccccaaggaggcccgcgcgggcatccaggaagtccacttcctccccttcaacccggtcgacaagcgcacggccatcacctacgtcgacggtaacggcgactggcacagggtcagcaagggcgcgcccgagcagatcatcgagctctgcaagatggcgccggacgccgagaagaaggtgcacgcgctcatcgactcgtacgccgaccgcggcctccggtccctgggcgtgtcgtaccagcaggtcccggagaagaacaaggagagcggcggcgacccgtggcagttcatcgggctgctcccgctgttcgaccctccgaggcacgacagcgcggagaccatccgccgcgcgctccacctcggcgtcaacgtgaagatgatcaccggcgaccagctggccatcgggaaggagaccgggcggaggctcggcatgggcaccaacatgtacccgtccacggcgctcctcggcgacaagaacacggccgtggacgggctccccatcgacgagctcatcgagaaggcggacgggttcgcgggggtgttcccggagcacaagtacgagatcgtgaagcggctgcaggacaagaagcacatcgtggggatgacgggcgacggcgtgaacgacgcgccggcgctgaagaaggcggacatcggtatcgccgtggacgacgcgacggacgcggcgcggtcggcgtcggacatcgtgctgacggagcccgggctgagcgtgatcgtgagcgcggtgctgacgagccgcgccatcttccagcggatgaagaactacaccatctacgcggtgtccatcacgatccggatcgtgctggggttcatgctggtggcgctgatctggaagttcgacttcgcgccattcatggtgctcatcatcgccatcctcaacgacggcaccatcatgaccatctccaaggaccgggtgaagccgtcgcccaagccggactcgtggaagctggacgagatcttcgcgacgggggtggtgctggggacgtacatggcgctggtcaccgtggtcttcttctacctggcgcacgacacggacttcttcacggagacgttcggggtgcacccgatccggggcaacgaccggcagctgatggcggcgctgtacctgcaggtgagcatcatcagccaggcgctcatcttcgtgacgcggtcgcggagctggtccttcgtggagcggccggggttcctgctgctcttcgccttcttcgcggcgcagctggtggcgacggcgatcgccgtgtacgccaactgggacttctgcgacatggaggggatcgggtgggcgtggggcggcgccatctgggtcttcaccgtcgtcacctacgtgccgctggacgtgctcaagttcatcatccgctactcgatcagcggcaaggggtgggacaacgtccagaacaagacggcgttcaccaacaagaaggactacggcaggggcgagcgggaggcgatgtgggccaaggagcagaggacgctccacggcctcagccagccggccacctccgacctgctgagcagcaaggaggagctctccgacatcgccgccgaggccgccaagcgcgccgagatcgccaggctccgggagctgcacacgctcaagggccacgtcgagtcggtggtgaagcagaagggcatcgacatcgacgccattccgcagaactacaccgtctagatcgcttgctttgctttgctctgctccggtggagagggcacgcccttgtgttgcgtctgcgtggttttgagcgggaagagtactacaactatgcctgcctgtctgtgtgtatacatctctcttccctactgctgcataggttttcttgtgctctctatctgactttatctgtaatacatgtgtgtgggaacggtgcgtctgcatgaacattttgtctctgtctctctgtctgtcaacaaacatcttgcttctctcactgttgtgatgtgaaaactgtatatatactggctaatgcgtcacctgcactacctaaatcctctttcttaccttttacaaatggaattacggaaacgcaaaagtagaacgtgcaa

SEQ ID NO: 2192 - DNA, 3584 bp, Cicer arietinum
ttagaatcaaaatgtgcttcttagtgttagttgttatcaaacgtgtatttcctctctattatagttgagttttgtggtacaacctgttgattttgaagactccgtgtatgcgtaatgttgaagacctcactgaataccgtagagtttggtaagccacagaaaacaaaagaccgaggaacacgaacgagcatacaagtggtcaacaattgtagcattccacggacaatcacatgttctctattgtgtctcagaaacttgaacattatcactatataatataatgggaacataggcttcggttgctgtctaccttttgtgtagcagatttcttttatttttttgttctgttagctttcttcgttctctccgtttctcttctacctgtctatgggtggatagaaacttggagagcgttgaaagaagacagattaattatatttaaaataaaaagtaggtatatagtttttttcttttgtcatggcttctgatatctcatttgaggatttgaagaacgagaatatagacctagaaaacattccagttgatgaagtctttcagcaactaaaatgtaccaaagagggtctctcatccgaggaaggagagaagaggctccaaatttttggccccaacaagctagaggagaaaacagagagcaaattcctcaagtttttgggttttatgtggaatccattatcatgggttatggagtcagctgctatcatggccattgtattggccaatggagggggaaagccaccggattggcaagatttcactggaattgtggtgttgcttatcattaactcaaccattagtttcattgaggaaaacaatgcaggcaatgctgcagctgctttgatggctggtcttgcccccaaaacaaaggtgttgagggatggaaaatggagtgagcaagaggcagaaattttggtaccaggagatgtgatcagcatcaagttgggagacattgtcccagctgatgcccgtctcttggaaggagatcctttaaagattgaccaatctgccctcactggtgagtctttgccagtcacaaggaaccctggttcagaggttttctctggctcaacttgcaaacaaggtgaaattgaagcagttgttattgccactggtgtccatactttctttggtaaggctgcacaccttgtagacagcaccaacaatgttggtcacttccaaaaggtgttgacatccattggtaacttctgtatctgctcaattgcaattggaatgttggttgagatcattgtgatgtacccaatccaaaatagagcttacagagatggtattgacaacttgttagtgcttcttattggaggtatcccaattgccatgccaactgtcttgtctgtgaccatggctattggatctcaccgcctttctcagcaaggagctatcacaaagaggatgacagccattgaagaaatggctggaatggatgttctctgcagtgacaagactggaacactaacacttaacaagcttactgttgacaagagcttgattgaggtgttcccctctggtatggacaaggacagtgttgtcctatatgctgcaagagcatcaagagttgaaaaccaggatgcaattgatgcttcaattgttggaatgttgagcgatcccaaggaggcaagagcaggaatcactgaggtgcatttcttgccctttaacccagttgacaagcgcacagctattacctatattgacagcaatggtgactggcacagaagcagcaaaggtgctcctgagcaaattattgagctttgtgaacttaagggagagacattgaaaagagcacacaaaaccattgatgggtatgctgagcgcggcctgcgttcgttggcagttggtttccagactgtttcagaaaagagcaaggagagtgcaggagaaccatgggtgttcttgggtctcttacccctctttgaccctccaaggcatgatagtgctgagactattcgtcgtgctcttgaccttggtgtcaatgttaagatgatcactggtgaccaacttgccattggaaaagaaactggtcgtagacttggaatgggcaccaacatgtatccttcatcctcccttcttggccaatgcaaagatccagccatagcatccatgccaattgatgagctcattgagaaggctgatggatttgctggagtcttccctgagcacaagtatgagattgtgaagaggttgcaggacaggaagcacatctgtggaatgaccggagatggtgtaaatgatgcaccagcgttgaagaaggcagacatcggtattgcagtcgctgatgcaactgatgctgcaaggagtgcctcagacattgtcttgaccgagcctggattgagtgtgattgtgagtgctgtgttgacaagtagggctatcttccaaaggatgaagaactacacaatctacgctgtttccatcacaatccgtattgttcttgggttcttgctcgttgctctaatctggaagttcgacttctctcctttcatggttctgattatcgccatcttgaacgatggaaccatcatgaccatatcaaaggatagggtgaagccatcccctgtccctgactcatggaagcttaaggaaatctttgccactggagtcgttcttggaacatacatggccatcatgaccgcagttttcttctatattgtccatgacaccgatttcttctctcaaactttcggtgtcctcccaatttcagacagtgaggaacaacttaactcagctttataccttcaagtcagtattataagtcaggcacttatctttgtgaccagatcaaggagctggtccttcctcgagcgccctggtatgatgcttcttggtgccttcgttgctgcacaattggtggcaactgccattgctgtctatgcacactgggacttcgctagaatcaacggaatcgggtggaaatgggctggagttatttggatctttagcgttgtcacctacattcctcttgacatcctcaagtttttcatccgcatgggactcactggcagtgcttgggacaacatgctccaaaataagactgcattcacgacaaagaaagactatggaaggggagagagggaggctcaatgggccgtcgctcaacgcacattgcatggtcttcaacctcatgaggcacacaagaacacccaccatgagcattctgaaattgctgaacaagccaagagacgtgctgaggcagctaggctgcgagagctacacacactcaagggacatgttgaatcagttgtcaagttgaagggtcttgacattgaaaccatccaacaacattacacagtctaaaaacatttaaggatggaagaaaaaagccaattcatatttgtaaaaaactggtgaccttaggttgctcatgaagatgtggtcatatacatagctttaaaaagaagatgattaagtataccttacctcgggtttgaattaacttgtactaattttttcctacacattcttttgttcttcatcccaaattggagtggaaatatgaaaaatagttttttctatatgcaatttgtgtttcgtagaccttttatactcccatttttacg

SEQ ID NO: 2193 - DNA, 2889 bp, Musa acuminata
atggccaccgatttcggtggaggcggcaggtccgtctccctggaggacatcaggaacgaggccgtcgatcttgagaaaattccggtggaagaggtcttccagcagctgaaatgtagcaccgaggggctcaccactgccgagggtgagcagcggctccagatctttggtcccaacaagctcgaggagaagaaggaaagcaagttactcaagttcttaggattcatgtggaatccgctttcgtgggtcatggagatcgctgcgatcatggccattgccttggctaacggagggggtaagccaccagactggcaggacttcatcggaatcgtctctctccttatcatcaactctaccatcagcttcatcgaggagaacaacgccggaaatgccgccgctgccctcatggctggcctcgcccccaagacgaaggtgctgagggatggcaagtggtcagagcaggatgcttcaatccttgttcctggtgacattatcagcatcaagcttggtgatatcatccctgccgatgcccgcctccttgagggcgacccgctcaagatcgaccaagccgccctcaccggcgagtccctccctgtgaccaggcacccgggcgacgaggtcttctcagggtccacgtgcaagcaaggagagatcgaggccgtcgtcatcgccaccggcgtccacaccttcttcggaaaggctgcacaccttgtcgacagcaccaacaacgtgggtcacttccagaaagtgctcaccgccatcggaaacttctgcatctgctccattgtcgtcggcatgctaatcgagatcatcgtcatgtacccgatccagcaccgaagatacagagatggcattgataacctcctggtgctgctcattggcggaattccgatcgccatgcccactgtgctgtcggtcacaatggccattggatcccaccgcttgtcggaacaaggagcgattaccaagaggatgactgccatcgaggagatggccggcatggacgtgctttgcagtgacaagactggcaccctcacccttaacaagctcaccgtcgacaagaccttgatcgaggtgtttgtgagggatttggataaggatgccatagtcttgtatgcagcaagggcttccagggtcgagaaccaggacgcgattgatgcctgcattgtcggaatgctggccgaccccagggaggcacgagctgggatccaggaaatccacttcctgccctttaatccagtggaaaaacgcactgcaatcacatacatcgaatcagacggcaaatggcaccgctcaagcaagggtgctcctgagcagatcattgagctctgcaacatgcgaggggatgctcggacgaaggtccatggcatgattaccaagtttgccgaccgcggcctccgtgctcttggtgtggcgaggcaggaggtgcctgaagcaagcaaggagagtgctggtggcccatggcagtttctgggtctcttgcccctcttcgatcctcctaggcatgacagtgccgagaccatccgccgtgcccttaatcttggtgttaacgtcaagatgatcaccggcgaccagcttgccattgccaaagagactgggcgcaggcttgggatgggcactaacatgtatccgtcctccaccctcctcggcgagaggagcgatgacaccaccggcctccccattgacgagcttatcgagaaggccgatggctttgctggagtcttccctgagcacaagtatgagatagtgaggaggttgcaggagaaggagcacatctgtgggatgacaggagatggtgtcaatgatgcaccagctctgaagaaggcagacattggtattgccgtggcagatgcaaccgatgccgcccgtggcgcttcagacatcgtgctcacagagcctggtctgagcgtgatcgtgagtgcggtgctcacaagccgcgccatcttccagcgcatgaagaactacacgatctacgccgtctccatcaccatccgtatcgtgctcggcttcatgctcgtcgccctcatttggcgcttcgacttctccccgttcatggtcctcatcattgccatcctcaatgatggtaccatcatgaccatctccaaggaccgggttaagccctcccctgtgccagactcatggaagctccaggagatcttctcgaccggggtcgttctcggtgcttaccttgcaatcatgactgtggtcttcttcttccttgttcacgacactgatttcttccctaaagcgttcggcgtgaggtcaatcaatggcaacaacgatgagctaaccgcagcactgtacctccaagtgagcatcgtcagtcaggcactcatctttgtcacccggtccaggagctggtccttcatcgagcgccctggtctcctgctggtctctgccttcgtcgccgcccagctggtggccactctcatcgctgtgtacgccacatggggctttgcgaggatgaatggcatcggatgggggtgggctggggtcatttggctctacagcctcatcacctacttccctctcgacattctcaagttcatcattcgctatggtctgagcggcagggcctgggacaaccttctccagaacaagacggccttcacctcgaagaaggattacgggaagggcgagagggaagcacaatgggcgctggcccaacgcaccctgcatggtctgcatcccccagagaccaccggtctgttcgacgaaaagagctacagggagttgtcggagatcgctgaacaggccaagaggcgcgccgaggtcgccaggcttagggagctgcacacgctcaagggtcatgtcgagtccgtcgtgaagctcaagggattgaacatcgagaacatgcagcagcactacactctctaaagggagaaataagcg

SEQ ID NO: 2194 - DNA, 2889 bp, Musa acuminata
atggccaccgatttcggtggaggcggcaggtccgtctccctggaggacatcaggaacgaggccgtcgatcttgagaaaattccggtggaagaggtcttccagcagctgaaatgtagcaccgaggggctcaccactgccgagggtgagcagcggctccagatctttggtcccaacaagctcgaggagaagaaggaaagcaagttactcaagttcttaggattcatgtggaatccgctttcgtgggtcatggagatcgctgcgatcatggccattgccttggctaacggagggggtaagccaccagactggcaggacttcatcggaatcgtctctctccttatcatcaactctaccatcagcttcatcgaggagaacaacgccggaaatgccgccgctgccctcatggctggcctcgcccccaagacgaaggtgctgagggatggcaagtggtcagagcaggatgcttcaatccttgttcctggtgacattatcagcatcaagcttggtgatatcatccctgccgatgcccgcctccttgagggcgacccgctcaagatcgaccaagccgccctcaccggcgagtccctccctgtgaccaggcacccgggcgacgaggtcttctcagggtccacgtgcaagcaaggagagatcgaggccgtcgtcatcgccaccggcgtccacaccttcttcggaaaggctgcacaccttgtcgacagcaccaacaacgtgggtcacttccagaaagtgctcaccgccatcggaaacttctgcatctgctccattgtcgtcggcatgctaatcgagatcatcgtcatgtacccgatccagcaccggagatacagagatggcattgataacctcctggtgctgctcattggcggaattccgatcgccatgcccactgtgctgtcggtcacaatggccattggatcccaccgcttgtcggaacaaggagcgattaccaagaggatgactgccatcgaggagatggccggcatggacgtgctttgcagtgacaagactggcaccctcacccttaacaagctcaccgtcgacaagaccttgatcgaggtgtttgtgagggatttggataaggatgccatagtcttgtatgcagcaagggcttccagggtcgagaaccaggacgcgattgatgcctgcattgtcggaatgctggccgaccccagggaggcacgagctgggatccaggaaatccacttcctgccctttaatccagtggaaaaacgcactgcaatcacatacatcgaatcagacggcaaatggcaccgctcaagcaagggtgctcctgagcagatcattgagctctgcaacatgcgaggggatgctcggacgaaggtccatggcatgattaccaagtttgccgaccgcggcctccgtgctcttggtgtggcgaggcaggaggtgcctgaagcaagcaaggagagtgctggtggcccatggcagtttctgggtctcttgcccctcttcgatcctcctaggcatgacagtgccgagaccatccgccgtgcccttaatcttggtgttaacgtcaagatgatcaccggcgaccagcttgccattgccaaagagactgggcgcaggcttgggatgggcactaacatgtatccgtcctccaccctcctcggcgagaggagcgatgacaccaccggcctccccattgacgagcttatcgagaaggccgatggctttgctggagtcttccctgagcacaagtatgagatagtgaggaggttgcaggagaaggagcacatctgtgggatgacaggagatggtgtcaatgatgcaccagctctgaagaaggcagacattggtattgccgtggcagatgcaaccgatgccgcccgtggcgcttcagacatcgtgctcacagagcctggtctgagcgtgatcgtgagtgcggtgctcacaagccgcgccatcttccagcgcatgaagaactacacgatctacgccgtctccatcaccatccgtatcgtgctcggcttcatgctcgtcgccctcatttggcgcttcgacttctccccgttcatggtcctcatcattgccatcctcaatgatggtaccatcatgaccatctccaaggaccgggttaagccctcccctgtgccagactcatggaagctccaggagatcttctcgaccggggtcgttctcggtgcttaccttgcaatcatgactgtggtcttcttcttccttgttcacgacactgatttcttccctaaagcgttcggcgtgaggtcaatcaatggcaacaacgatgagctaaccgcagcactgtacctccaagtgagcatcgtcagtcaggcactcatctttgtcacccggtccaggagctggtccttcatcgagcgccctggtctcctgctggtctctgccttcgtcgccgcccagctggtggccactctcatcgctgtgtacgccacatggggctttgcgaggatgaatggcatcggatgggggtgggctggggtcatttggctctacagcctcatcacctacttccctctcgacattctcaagttcatcattcgctatggtctgagcggcagggcctgggacaaccttctccagaacaagacggccttcacctcgaagaaggattacgggaagggcgagagggaagcacaatgggcgctggcccaacgcaccctgcatggtctgcatcccccagagaccaccggtctgttcgacgaaaagagctacagggagttgtcggagatcgctgaacaggccaagaggcgcgccgaggtcgccaggcttagggagctgcacacgctcaagggtcatgtcgagtccgtcgtgaagctcaagggattgaacatcgagaacatgcagcagcactacactctctaaagggagaaataagcg

SEQ ID NO: 2195 - DNA, 3043 bp, Arabidopsis thaliana
atcggatatatcttctttttatatctgtctctcttttaaggaagaaaaatggcgactgaattctcgtgggatgaaatcaagaaagaaaatgtggaccttgagcggatccctgtggaagaagtgtttgagcagctgaaatgctcaaaagaaggtttgtccagcgatgaaggtgctaaaaggcttgaaatatttggggcaaacaagcttgaagagaaatcagagaacaagtttttgaaattcttggggttcatgtggaatcctctctcatgggttatggagtctgctgcaatcatggctattgttttagctaatggaggaggaaaggcgccggattggcaagattttatcggtattatggtgttgcttatcatcaactccaccataagtttcatcgaggagaacaatgctggcaatgccgctgctgctctcatggcaaatcttgcaccaaagactaaggtgttgagagatggtaaatggggggagcaagaggcttcaatcttggttccgggtgatttgataagcatcaaattgggtgacattgttcctgctgatgctcgtctcctcgaaggagatcctttaaaaattgaccaatctgctcttactggtgaatcccttccaaccaccaaacacccaggagatgaagtattctctggctcaacctgcaagcaaggtgagattgaggctgttgtcattgccacgggtgtccacaccttttttggcaaggctgctcatcttgttgacagtaccaacaatgttggccatttccaaaaggttttgacatcaattggtaacttctgtatatgctcaattggattggggatgttgattgagatattgattatgtaccctatccaacaccgcacatacagagatggtattgataatctattggtgcttttgatcggaggaatcccaatcgccatgccaacagttttgtctgtaacaatggctattggatcacatagactctctcaacaaggtgccatcaccaagaggatgactgcaattgaagaaatggctggaatggatgttctctgcagtgataagactggaactctaacccttaacaagctctctgtcgacaagtccttaattgaagtgttcccaaagaacatggatagtgactcagttgtattgatggctgcaagagcttccaggattgaaaaccaagatgccattgatgcttccatcgtcggaatgttgggtgatcctaaagaggcaagagcaggaatcacagaggtgcatttcttgccctttaaccctgtagataaacgtacagcgatcacatacatcgatgaaagcggagactggcatcggagcagtaaaggagctcctgagcagatcattgaactctgcaatctccaaggagagactaaaagaaaagcacacgaagttatcgatggttttgctgaacgtgggcttcgttctcttggtgttgctcaacagactgtgcctgagaagactaaggaaagtgatggtagtccatgggagttcgttggtctgttgccactctttgaccccccaagacatgacagtgcggaaactattagacgagcccttgagcttggtgtcaatgttaagatgattaccggtgaccaacttgccatcggtattgagactggtcgtaggcttggcatgggaaccaacatgtacccatccacttcactccttggcaattcaaaggatgaatcattagttggcatccctatcgatgagctcattgagaaagctgatggatttgctggagtcttccctgagcacaagtatgagatcgtaaagaagctacaagagaggaagcacatttgtgggatgactggagatggtgtaaacgatgctccagctttgaagaaagcggatattggaattgcagtggcagatgctactgatgcggcaagaagcgcctcagacattgttctaacagaaccaggactaagcgtgataataagtgccgtattgacaagtcgcgctatcttccagaggatgaagaactacacaatctacgctgtttccatcactatccgtattgttttgggattcatgcttgttgctttaatctggagatttgatttcgcacctttcatggtcttgattatcgcaatcctaaatgatggaaccatcatgactatctctaaggacagggttaaaccttccccggtgccagattcttggaagctcaatgagattttcgccactggcgttgttctaggaacctacatggctcttaccactgtactctttttctggctagctcatgacacagacttcttcagcaaaacatttggagttaggtccatacaagggaacgaagaagaacttatggcagctttgtatcttcaagtgagcatcataagtcaagcacttatctttgtaaccagatcaaggagctggtcatttgttgaacgacctgggtttttgctcctaatagcctttgttatagcacaattggtggctacattgatcgctgtgtatgcaaactggggattcgcaagaatcgtcggttgtggatggggatgggctggaggtatatgggtatacagtatcattacctacattcctcttgatattctcaagttcatcatccgttacgctctcactggcaaggcttgggataacatgatcaaccagaaaactgcgttcacaactaagaaagattatggaaaaggagagagggaggctcagtgggcactagctcaacgtacactccatggtctaccacctccagaagcaatgttcaacgacaataagaacgagctctctgaaatagcagagcaggccaaaaggcgtgccgaagttgcgaggctgagagagcttcacactctaaagggtcacgttgaatctgtagtgaagctcaaggggcttgacattgataccattcaacaacactacactgtttaaccatttatggggttactatgatgaaagagccctaatgagtaacgaaataagctatgtattctccttatattggttttaaactatttgtaacaaaaagagagcaaaaacaagatgtaaaatatatcttttccgttggatgaaatataat

SEQ ID NO: 2196 - DNA, 3269 bp, Brassica rapa
tgtattcttgtcttgtgtttctttttgtcctaggttttctcttatacaagcttcttcttcctctgcctccctctaatggcctcctcttgaactgtcttccatgaccgtctaagagaaaggctttagagaaaggagagaaggaagaacttgattcttccaacggatatatatctttttatatctttctttcttcattatttacttttgttagatcatatctcttttaaggagcaaaaatggcatctgaaatctcttgggacgaaatcaagaatgagaacgtggatcttgagcggatccctgtggaagaagtgtttcagcaactaaaatgcacaaaagaaggtttgtcaagtgatgaaggtaagaagaggcttgagatatttggggcaaacaagcttgaggagaaatcagaaaacaagtttttaaaattcttggggtttatgtggaatcctctctcatgggttatggagtctgctgcaattatggccattgttttagccaatggtggtggaaagccgccggactggcaagatttcatcggtattatggtgttacttgttatcaattccaccattagtttcattgaagagaataatgccggcaatgctgctgcagctctcatggctaatcttgcacccaaaaccaaggtgttgagagatggaaaatggggagagcaagacgcttcaattctagttccaggtgatctaataagcgtcaaactgggtgacattgtccctgctgatgctcgtctcctccaaggagatcctctgaaaattgaccaatctgctctcaccggtgaatctcttccagtcaccaaacaccctggagatgaagtattctcgggttcaacttgcaaacaaggtgagattgaggccgttgtcatagccactggtgtccacactttcttcggtaaggctgcccatcttgtcgacagtaccaacaacgttggccacttccaaaaggttttgacagctattggtaacttctgtatttgctcaattggaattgggatgttgattgagatcgtagtaatgtaccctattcaacaccgcacatatagagacggtattgataatcttttggtgcttttgattggaggaatcccaatcgccatgccaacagttttgtcggtaacaatggctattggatcacatagactctctcaacaaggtgccatcaccaagaggatgactgcgattgaagaaatggctggaatggatgttctctgcagtgataagacagggactctcactcttaacaagctctccgtagacaagtcattgattgaagtatttccaagtaacttggataccgatgcagttgtattgatggctgcaagagcgtctagaatcgaaaaccaagacgccattgatgcatccattgttggcatgttgggtgatccaaaagaggcgagagaaggaatcaaagaggtgcatttcttgccttttaaccctgtcgataaacgtacagccattacatacattgatgaaaatggagaatggtatcggagcagcaaaggagctcctgagcaaatcattgaactctgcaatctccaaggagaggctagaagaaaagctcatgaagtgattgatggttttgctgaacgtgggcttcgttctcttggagttgctcaacaaactgtacctgaaaagagcaaggaaagcgatggtagtccatgggagtttattggtctattgccactgtttgatcccccaagacatgatagtgcagaaacgatcagacgagcccttgagcttggtgtcaacgttaaaatgattactggtgaccaacttgccattggaatagagaccgggcgtaggcttggtatgggaacaaatatgtacccatccacttcactccttggaaattcaaaggatgaatcattagttgggatccctgtcgatgagctcattgagaaagctgatggatttgctggagttttccctgagcacaagtatgagattgtaaagaagcttcaagagaggaagcacatttgtgggatgactggagatggtgtaaacgacgctccagctttgaagaaagcagatattggaatcgctgtggctgatgcaactgatgcggctagaagcgcctctgacattgtgctaacggaacctggactaagcgtgatagtgagtgccgttcttacaagtcgtgcaatcttccagaggatgaagaactacacgatctatgctgtctccatcaccattcgtattgttttgggattcatgcttgtggctttgatatggcgatttgattttgcacctttcatggttttgattatcgcaatccttaatgatggaactatcatgactatctcgaaggacagagttaaaccttctcctgtccctgattcatggaagctcaatgagatttttgctacgggtgttgtgctaggaacctacatggctcttaccacagttctctttttctggctagctcatgatactaatttcttcagcaaaacatttggtgtgaggtccattcaagagaatgaggaagagcttatggcagctctgtaccttcaagtgagcatcataagccaagcacttatttttgtcaccagatcaaggagttggtcatttgtcgaacgtcctgggtttttgctccttatagcctttgttatagcacagctggttgctacattgatcgctgtgtatgcaaactggggatttgcaaggatcctaggttgtggatggggatgggctggagtcatatggttatacagtatcattacctacattcctcttgacattctcaagttcaccatccgttactctctcactggcaaggcttgggataatatgatccaacaaaaaaccgcctttacaacaaagaaagattacggcaaaggagagagggaggctcaatgggcattagctcagcgcacactccatggcctaccaccacctgaagcaatgttccatgacaagaaccatgagctctctgaaatagcagagcaggcgaagaggcgtgccgaagtggctaggctgagagagcttcacactctaaagggccacgttgaatctgtagtgaagctgaaggggcttgacattgataccattcaacaacactacactgtctagccatttcttgcattctactttccatgagttcaaatcaacaaagtgagctatgtactccacttgtattgtttttaaactatatgtaacaaaaagagagaaaaaagagagataaaatatgtttttccgtttgttgaaatataataaaacctagttacttaaaaaaaaaatattatttgtttagaggtt

SEQ ID NO: 2197 - DNA, 3321 bp, Brassica napus
gtcttgtatttctttttgtcctaggttttctcttatacaagcttcttcttcctctgcctccctctaatggcctcctcttgaactgtcttccatgaccgtctaagagaaaggctttagagaaaggagagaaggaagaacttgattcttccaacggatatatatctttttatatctttctttcatcattatttacttttgttagatcatctcttttaaggagcaaaaatggcatctgaaatctcttgggacgaaatcaagaatgagaacgtggatcttgagcggatccctgtggaagaagtgtttaagcaactaaaatgcacaaaggaaggtttgtcaagtgatgaaggtaagaagaggcttgagatatttggggcaaacaagcttgaggagaaatcagaaaacaagtttttaaaattcttggggtttatgtggaatcctctctcatgggttatggagtctgctgcaattatggccattgttttagccaatggtggaggaaagccgccggactggcaagatttcatcggtattatggtgttacttgttatcaattccaccattagtttcattgaagagaataatgccggcaatgctgctgcagctctcatggctaatcttgcacccaaaaccaaggtgttgagagatggaaaatggggagagcaagacgcttcaattctagttccaggtgatctaataagcgtcaaactgggtgacattgtccctgctgatgctcgtctcctccaaggagatcctctgaaaattgaccaatctgctctcaccggtgaatctcttccagtcaccaaacaccctggagatgaagtattctcgggttcaacttgcaaacaaggtgagattgaggccgttgtcatagccactggtgtccacactttcttcggtaaggctgcccatcttgtcgacagtaccaacaacgttggccacttccaaaaggttttgacagctattggtaacttctgtatttgctcaattggaattgggatgttgattgagatcgtagtaatgtaccctattcaacaccgcacatatagagacggtattgataatcttttggtgcttttgattggaggaatcccaatcgccatgccaacagttttgtcggtaacaatggctattggatcacatagactctctcaacaaggtgccatcaccaagaggatgactgcgattgaagaaatggctggaatggatgttctctgcagtgataagacagggactctcactcttaacaagctctccgtagacaagtcattgattgaagtatttccaagtaacttggataccgatgcagttgtattgatggctgcaagagcgtctagaatcgaaaaccaagacgccattgatgcatccattgtcggcatgttgggtgatccaaaagaggcgagagaaggaatcaaagaggtgcatttcttgccttttaaccctgtcgataaacgtacagccattacatacattgatgaaaatggagaatggcatcggagcagcaaaggagctcctgagcaaatcattgaactctgcaatctccaaggagaggctagaagaaaagctcatgaagtgattgatggttttgctgaacgtgggcttcgttctcttggagttgctcaacaaactgtacctgaaaagagcaaggaaagcgatggtagtccatgggagtttattggtctattgccactgtttgatcccccaagacatgatagtgcagaaacgatcagacgagcccttgagcttggtgtcaacgttaaaatgattactggtgaccaacttgccattggaatagagaccgggcgtaggcttggtatgggaacaaatatgtacccatccacttcactccttggaaattcaaaggatgaatcattagttgggatccctgtcgatgagctcattgagaaagctgatggatttgctggagttttccctgagcacaagtatgagattgtaaagaagcttcaagagaggaagcacatttgtgggatgactggagatggcgtaaacgacgctccagctttgaagaaagcagatattggaatcgctgtggctgatgcaactgatgcggcaagaagcgcctctgacattgtgctaacggaacctggactaagcgtgatagtgagtgccgttcttacaagtcgtgcaatcttccagaggatgaagaactacacgatttatgctgtctccatcaccattcgtattgttttgggattcatgcttgtggctttgatatggcgatttgattttgcacctttcatggttttgattatcgcaatccttaatgatggaactatcatgactatctcgaaggacagagttaaaccttctcctgtccctgattcatggaagctcaatgagatttttgctacgggtgttgtgctaggaacctacatggctcttaccacagttctctttttctggctagctcatgatactaatttcttcagcaaaacatttggtgtgaggtccattcaagagaatgaggaagagcttatggcagctctgtaccttcaagtgagcatcataagccaagcacttatctttgtcaccagatcaaggagttggtcatttgtcgaacgtcctgggtttttgctccttatagcctttgttatagcacagctggttgctacattgatcgctgtgtatgcaaactggggatttgcaaggatcctaggttgtggatggggatgggctggagtcatatggttatacagtatcattacctacattcctcttgacattctcaagttcaccatccgttactctctcactggcaaggcttgggataatatgatccaacaaaaaaccgcctttacaacaaagaaagattacggcaaaggagagagggaggctcaatgggcattagctcagcgcacactccatggcctaccaccacctgaagcaatgttccatgacaagaaccatgagctctctgaaatagcagagcaggcgaagaggcgtgccgaagtggctaggctgagagagcttcacactctaaagggccacgttgaatctgtagtgaagctgaaggggcttgacattgataccattcaacaacactacactgtctagccatttcttgcattctactttccatgagttcaaatcaacaaagtgagctatgtactccacttgtattgtttttaaactatatgtaacaaaaagagagaaaaaagagagataaaatatgtttttccgtttgttgaaatataataaaacctagttacttaaaaaaaaaaaaaaaaaaactcgagactagttctctctctcttttatttctttcactttcctttggttttctcggcggcttcattcgaatcg

SEQ ID NO: 2198 - DNA, 3386 bp, Mimulus guttatus
gccattttagagtagctaatgcgaacgagaatttgctaaatatagaggtgggaatgcgcctttaaaaagctccaccacccacagttgtctgaattgtctgtgttttgtttcttgcatggcgggcctgtaaagaagagagaggaaataaaaaataaataaattaaataaataaataaaattagcgagaggggatacagagatttgttcttcttcttcctgtaaagaaaagaaaaaatggcgtcagacatttcgttagaggcgattaagaatgaaacgattgaccttgagcatatgcccattgaagaagtgttcgccgagttaaaatgtacgagggagggtttgacatcggaagaaggggcgaaaaggctcgatattttcggcccgaacaagctagaggagaagcaagagagcaaattcttgaagtttttgggctttatgtggaatcctctttcttgggtcatggaatctgctgccattatggccattgttttagccaatggagggggcaagccgccggactggcaagatttcgtcggtattctcgtgctgctgattatcaactccaccataagtttcatcgaagaaaacaacgctggaaatgcggctgctgcccttatggctggtcttgctcccaaaactaaggttttgagagatggcaaatggagtgagcaggatgcatcgatcctggttccgggagatttgatcagtgtcaaactaggggatattatccctgccgatgctcgtctattggaaggggaccctttaaagatcgaccaatcggcgctcaccggagaatctcttccggtgaccaaacaccccggagcggaggtcttctccggctccacctgcaagcaaggtgagatcgaggctgttgttattgccaccggagtccacaccttcttcggcaaggccgcccatctcgttgacagcaccaacaacgtcggccactttcaaaaggtgttgactgcaattggaaacttctgcatctgctcaattgcattgggaatgattatcgagattgtagtgatgtacccgattcagaggaggaaatacagagaaggaatcgacaacctgctggtgctcctcatcggtggtattccgatcgctatgccgacagtcctgtctgtcaccatggccatcgggtcccaccgtctgtcacagcagggcgctatcaccaagagaatgacagccattgaggaaatggctggcatggatgtcctctgcagtgacaaaaccggaacactcaccttaaacaaactcacagtcgacaaaaccttgatcgaggtattcccagataatgctgacaaggacactgtcatcttgctcgccgcacgtgcttcgagggtagagaatcaagatgctatcgatgcttccatcgttaacatgttgagtgatccaaaggaggcaagagctggcattacagaggttcatttcttgcctttcaacccggtggaaaaacgaactgcaataacgtattacgacgctcaaggaaactggcatagaagtagcaagggtgctcctgagcaaattatcgagctttgccaactcaaaggggctgttctaaagaaggctcatgatatcatcgataattttgcaaaccgcggtcttcgttctcttggtattgcaagacagactgttccggagaaaacgaaagagggttccggtgggccgtgggagtttgttggcttgttgccattgttcgatcctccaaggcacgatagtgcagagacaattaggaaggcactcgagttaggtgtgaatgtgaaaatgatcaccggtgatcaattagctatcggcaaagagacgggcagacgacttggtatgggcacaaatatgtatccgtcttcttctcttcttggccagtgcaaagacgagtcgattgcttcgatgccgatcgacgaactcatcgagaaagccgatggcttcgccggggttttcccagagcataaatacgagattgtgaagagactacaagagagaaagcacatatgcggaatgacgggtgatggtgtgaacgacgcaccggctctaaaaaaggccgacatcggaattgcggtggcggacgcaaccgatgccgccaggggcgcgtcggacattgtgttgactgagcccgggctcagtgtgattgtcagtgcagttctgacgagcagagccattttccagaggatgaagaactacacgatttacgcagtctcgattacgatccgtatcgtgatgggcttcatgctgattgcccttttgtggaaatttgatttttcgccttttatggttttgattattgcgattctgaacgacgggactatcatgaccatttcgaaggatagggtgaagccttctcccttgccggactcgtggaagttgaaagagattttcgctactggagttgtgcttgggagttatatggctcttatgactgtcgtcttcttttacttggccgccgacaccgacttcttctctgaaaaatttaaagttaggtccctaagaaacagtccagacgagctgactgctgctctataccttcaagtgagtattatcagtcaagccctcattttcgtgacgaggtcaagaagctggtctttcgtcgaacgccccggtttcttgctcatgagtgctttcttgatagcccagttggtggctacaattattgctgtgtatgcaaactggggatttgcaagaattcaaggcattggatgggggtgggccggaattatctggatctacagcattgtcacttacttcccactcgacgttttgaagttcattatccgatatgcgttaaccggcaaagcttgggattcaatgatccagaacagggttgctttcacaacgaagaaggattacggtagaggcgagagagaagcacaatgggcagtggcgcagcgaaccctacacggcctatcggccggagaaactccggcccttcttcacgacaagaactacggagaattgtcggaaatcgcagagcaagctaaacgacgagctgaagttgcaaggctgagggagcttcacacgcttaaagggcacgtcgagtcggtggtgaagctgaaggggttggatatcgagacgatccagcaacattacactgtctaaaaagtaattggaagaaattggaggacgttgaacaagagacgacgaagacgcgtgaaatcgaaagattcacaagtggcaattcattttttttttatggtagagtttgtaggggtgttgaaaataaggttttggggggaagatggaataaatcaataatcactgctgtgtaactcctttttttttttgggctgatttctgataaaatttgtatttttaataatacttgttatttttattctgcgaatgttattaataaaacaaatattggatatgtcaaaaaaaaaaatgaattactt

SEQ ID NO: 2199 - DNA, 2945 bp, Cajanus cajan
acacgttctttcaacatggcctccgacatatcatttgacgacctcaaaaacgagaatgttgatctggaacacattcctgttgaggaagttttcaagcagctaaaatgtacaagagagggtctaacatctgcagagggagagaagaggctccaagtctttggtcccaacaagttagaggagaaaaaggagagcaagtttcttaagttcttgggttttatgtggaatccactttcatgggtcatggaagctgctgctatcatggccattgcattggccaatggagggggaaagccaccggattggcaagatttcgttggtattgttgtgttgctcatcatcaattcaaccattagtttcattgaggagaacaacgctggcaatgccgcagcagctttaatggctggtcttgcacccaaaaccaaggtgttgagggatggaagatggagtgaggaggatgcagcacttctggtgccaggagatttgatcagcatcaagttgggtgatattgtcccagctgatgctcgtttattggagggtgatcccctgaagattgatcaatctgcactcactggtgagtccttgccagtcaccaagaaccctggtgatgaggtcttctctggctccacctgcaagcaaggtgagattgaagctgttgtcattgccactggtgtacataccttctttggcaaggctgcacatcttgtggatagcaccaacaatgttggtcacttccagaaggtgttgacagccattggaaatttctgtatctgctcaattgctgtgggaatggtgattgagattattgtgatgtaccctattcagcaaagggcttacagagatggtattgacaatttgttggttctcctcatcggtggtatcccaattgcaatgcctacagtgttgtctgtcaccatggctattggctctcaccgcttgtctgagcaaggagccatcaccaagaggatgacagccattgaagaaatggctggcatggatgttctctgcagtgacaagaccggaactctcacccttaacaagctcacagtggacaagaccttgattgaggtgttccccactggcatggacaaggaaaccctgctgttgtatgctgccagggcttctaggactgaaaatcaggatgccatcgatgcttcaatcgttgggatgttgagtgaccccaaggaggcaagagcaggaatcaaagaggtgcatttcttgcccttcaatccagtggacaagcgcacagctattacctacattgatgatcaaggcgattggcacagaagcagcaagggtgctccagagcaaattattgaactctgtggactcaagggagagcctttgaaaaaggctcatgatgtcattgattcctatgctaaccgtggtctgcgttcattgggagtttcacgccagactgtttcagaaaagagcaaggagagtgcaggagactcatgggagttcttgggactcttgcccctctttgaccctccaagacatgacagtgctgagactattcgtcgtgcacttgaccttggagtcaacgttaagatgatcactggtgaccaacttgccattggaaaagaaaccggtcgcagacttggaatgggaaccaacatgtacccttcatcatcccttcttggtgatagcaaggaccctgccattgcatcaatcccagttgacgatctcattgagaaggctgatggatttgccggagtcttccctgagcacaagtatgagattgtgaagaggctgcaagatagaaagcatatttgtggaatgactggtgatggtgtgaatgatgcaccagcactgaagaaggcagacattggtattgcggtggctgatgcaactgacgcagccagaagtgcctcagacattgtcctgaccgagcctggactcagtgtgatcgtgagtgctgtgttgaccagcagagccatcttccagaggatgaagaactacacaatctatgctgtttccatcaccatccgtatcgtgtttggattcatgctcgttgctctaatctggaagtttgacttctctcctttcatggtcctcatcattgctatcttgaacgatggaaccatcatgaccatctccaaggatagggtggtgccttcacctcttcctgactcatggaagctcagggaaatctttgctaccggagtcgttcttggagcttacatggccatcatcactgttgtgttcttctttttggttcatgacaccgatttcttccctagaacctttggtgtcaaaccaattgcagacagcgaggagcatcttaactcagctctctaccttcaagtgagtattattagtcaagcactcatcttcgtgaccaggtcaaggagctggtcttatgttgagcgcccaggccttttgcttatccttgccttctttgctgcacaattggtggcaactgtcattgctgtgtatgcacattgggactttgcaaggatcaatggagttggttggggttgggcaggagtaatctgggtctttagcatcattacctacattcctcttgatatcctcaagttcctcatccgatttgggttatctggcagggcgtgggacaacatgcttgagaagaagactgctttcacaacaaagaaagactatggaaaaggagaaagggaagctcaatgggccgtggctcagcgcacattgcatggtctccaaactggagaaccaaagagcaaccaacatgagcagtctgaacttgcagagcaggctaagagacgtgctgaggctgccaggttgagggaactccacacactcaagggacatgtagaatctgtggtgaagttgaagggtattgacattgataccatccagcaacactacacgctctaaaagattatcttcagactatcaacgggatcagagattggagcctctgattacacgatgtattttgtgctatattaccactcttcctctaa

SEQ ID NO: 2200 - DNA, 3103 bp, Ricinus communis
gaaaacagaaaaacaaaacagaaaaaagaagaagatagccatggctgctaaaagctttagtttagaggaaataaaaaacgagactgtcgatcttgagaggataccagtggaggaagtgtttcaacaactgaattgcaccagagaaggtttatcatccgatgaaggtcagaagaggttgcagatttttggccctaataaactcgaagagaaaaaggaaagcaagtttttgaaattcttggggtttatgtggaaccctctctcatgggttatggaaatagctgcgatcatggctattgctttggccaatggagggggcaaaccaccagactggcaagattttgtgggtattgttgtattgcttttcatcaactctactattagtttcattgaagagaacaatgcaggcaatgctgctgctgctctcatggctggtcttgctcctaaaaccaaggtcttacgagatggaaggtggactgaacaagaggctgctatcttagttccaggtgatgtgatcagcattaagttgggagatattatcccagcagatgctcgcttgcttgaaggagaccctttaaagattgatcagtctgctctcactggcgagtcattgcctgttacaaagcacccaggtgatgaagtcttttctgggtctacttgcaagcaaggtgagattgaagcaattgtaattgctactggtgtgcacactttctttggcaaagctgctcatctagtcgatagcacaaatcaagagggccacttccagaaggtgctgacagctattgggaacttctgcatatgctccattgcgttaggaatgattatagagatagttgtcatgtaccccattcagcaccgggagtatcgtagtggtattgataatcttttggtgcttctcattggagggattccaattgctatgccgacagttttgtctgtgacaatggccatcggctcccataggctttcacagcaaggtgctattaccaagaggatgacagctattgaggaaatggctggaatggatgtcttgtgtagtgacaagactggtactctcactctcaataaacttacagttgataagtccttgattgagatatttgcgaaggatgtggacaaagacactgtgattctgtatggtgctatggcctccagggttgagaatcaggatgccattgatgcgtgtattgttgggatgttgggtgacccaaaggaggccagagcaggcatcactgaggtgcattttttgccatttaacccagtggggaagcgcacggctattacatacatcgactcagatggcaactggcatagaattagcaaaggcgcaccagagcagatcattgaactgtgcaacctgagggatgatgcaaaaaagaaggctcatgccataattgataagtttgctgatcgtggacttcgctctctagctgtttctaaacaagctgtacctgagaaaaccaaggaaagccctggagggccatggcaatttgtcggtctcttgccactttttgatcctccgaggcatgacagtgctgagaccattaaccgtgcccttaatctaggtgtcaatgtcaagatgatcactggtgaccagcttgcaattggcaaggaaactggtcgcaggctaggcatgggaaccaacatgtatccttcttctgctctccttgggcagaacaaggatgagtctattgctggcctccccgttgatgagcttattgaaaaggccgatggcttcgctggagtattccctgagcacaaatacgagattgtgaagaggctgcaagaaaggaagcacatttgcgggatgactggagacggtgtgaatgatgctccagcattgaagaaggcagacattggaattgcagtggctgatgctaccgatgcagctcggggtgcatctgacatagtcctgacagagccaggattgagcgttatcgttagtgctgtcttgacaagcagagccattttccagagaatgaagaactacaccatttatgcagtttctataaccattcgtattgtgatgggatttatgcttcttgctctcatatggaaattcgatttctctcctttcatggttctgatcattgccatactcaatgatggaaccatcatgactatttccaaagacagagtgaagccatctcctctacctgattcatggaaactcaaggagatttttgctactggggttgtccttggtacctacctagctatcatgactgttgtgttcttctgggcagctaacagttctgacttcttctctgatcattttggtgttagatccattagagaaaaccataatgagcttacagctgcaatctacctccaagtgagcatagtcagtcaggcactcatctttgtcactaggtcccgtagctggtcttatgttgaacgccctggtctcctgcttgtcgctgcctttattattgcccagctgattgctacacttcttgctgtgtacgccaattgggcctttgcaaaaatccacggtatcgggtggggatgggctggcgttatttggctctacagcatcgtcttctacatccctcttgatgttctgaagttcgccatccgatatgctttgagtggcaaagcttgggacaaccttgtccaaaataagactgctttcacaaccaagaaggattacgggaggggagagagggaagcccaatgggccgctgctcagcgtaccctccatggactgcagcctcctgaaactgcagaaatattccaagataagaattacagggaattgtctgagattgctgagcaagccaagaggcgtgcggaagtcgcaaggttaagggagcttcataccctcaaggggcatgttgaatcagtggtgaaactcaagggacttgacattgagaccattcaacagcactacactgtttgattcagaaattgcaactaatatgttggcaaagaattttgggcgataaacgagaaatctggactatgagaattagggttcattcaatttcgttttcaaatcctttcttatttcattttgaggattttgtaggatgcaatgcaactacgcaagggttgggaataagacatgtaagattgtgttggacaatcatgggttggaaaaaaa

SEQ ID NO: 2201 - DNA, 3310 bp, Brassica oleracea
aaaaagttggatctctggttacagctttaaatggaacacaacaacgatttgtgtcaagtgtattcttgtcttgtatttctttttgtcctaggttttctcttatacaagcttcttcttcctctgcctccctctaatggcctcctcttgaactgtcttccatgaccgtctaagagaaaggctttagagaaaggagagaaggaagaacttgattcttccaacggatatatatctttttatatctttctttcatcattatttacttttgttagatcatatctcttttaaggagcaaaaatggcatctgaaatctcttgggacgaaatcaagaatgagaacgtggatcttgagcggatccctgtggaagaagtgtttaagcaactaaaatgcacaaaggaaggtttgtcaagtgatgaaggtaagaagaggcttgagatatttggggcaaacaagcttgaggagaaatcagaaaacaagtttttaaaattcttggggtttatgtggaatcctctctcatgggttatggagtctgctgcaattatggccattgttttagccaatggtggaggaaagccgccggactggcaagatttcatcggtattatggtgttacttgttatcaattccaccattagtttcattgaagagaataatgccggcaatgctgctgcagctctcatggctaatcttgcacccaaaaccaaggtgttgagagatggaaaatggggagagcaagacgcttcaattctagttccaggtgatctaataagcgtcaaactgggtgacattgtccctgctgatgctcgtctcctccaaggagatcctctgaaaattgaccaatctgctctcaccggtgaatctcttccagtcaccaaacaccctggagatgaagtattctcgggttcaacttgcaaacaaggtgagattgaggccgttgtcatagccactggtgtccacactttcttcggtaaggctgcccatcttgtcgacagtaccaacaacgttggccacttccaaaaggttttgacagctattggtaacttctgtatttgctcaattggaattgggatgttgattgagatcgtagtaatgtaccctattcaacaccgcacatatagagacggtattgataatcttttggtgcttttgattggaggaatcccaatcgccatgccaacagttttgtcggtaacaatggctattggatcacatagactctctcaacaaggtgccatcaccaagaggatgactgcgattgaagaaatggctggaatggatgttctctgcagtgataagacagggactctcactcttaacaagctctccgtagacaagtcattgattgaagtatttccaagtaacttggataccgatgcagttgtattgatggctgcaagagcgtctagaatcgaaaaccaagacgccattgatgcatccattgtcggcatgttgggtgatccaaaagaggcgagagaaggaatcaaagaggtgcatttcttgccttttaaccctgtcgataaacgtacagccattacatacattgatgaaaatggagaatggtatcggagcagcaaaggagctcctgagcaaatcattgaactctgcaatctccaaggagaggctagaagaaaagctcatgaagtgattgatggttttgctgaacgtgggcttcgttctcttggagttgctcaacaaactgtacctgaaaagagcaaggaaagcgatggtagtccatgggagtttattggtctattgccactgtttgatcccccaagacatgatagtgcagaaacgatcagacgagcccttgagcttggtgtcaacgttaaaatgattactggtgaccaacttgccattggaatagagaccgggcgtaggcttggtatgggaacaaatatgtacccatccacttcactccttggaaattcaaaggatgaatcattagttgggatccctgtcgatgagctcattgagaaagctgatggatttgctggagttttccctgagcacaagtatgagattgtaaagaagcttcaagagaggaagcacatttgtgggatgactggagatggtgtaaacgacgctccagctttgaagaaagcagatattggaatcgctgtggctgatgcaactgatgcggctagaagcgcctctgacattgtgctaacggaacctggactaagcgtgatagtgagtgccgttcttacaagtcgtgcaatcttccagaggatgaagaactacacgatctatgctgtctccatcaccattcgtattgttttgggattcatgcttgtggctttgatatggcgatttgattttgcacctttcatggttttgattatcgcaatccttaatgatggaactatcatgactatctcgaaggacagagttaaaccttctcctgtccctgattcatggaagctcaatgagatttttgctacgggtgttgtgctaggaacctacatggctcttaccacagttctctttttctggctagctcatgatactaatttcttcagcaaaacatttggtgtgaggtccattcaagagaatgaggaagagcttatggcagctctgtaccttcaagtgagcatcataagccaagcacttatctttgtcaccagatcaaggagttggtcatttgtcgaacgtcctgggtttttgctccttatagcctttgttatagcacagctggttgctacattgatcgctgtgtatgcaaactggggatttgcaaggatcctaggttgtggatggggatgggctggagtcatatggttatacagtatcattacctacattcctcttgacattctcaagttcaccatccgttactctctcactggcaaggcttgggataatatgatccaacaaaaaaccgcctttacaacaaagaaagattacggcaaaggagagagggaggctcaatgggcattagctcagcgcacactccatggcctaccaccacctgaagcaatgttccatgacaagaaccatgagctctctgaaatagcagagcaggcgaagaggcgtgccgaagtggctaggctgagagagcttcacactctaaagggccacgttgaatctgtagtgaagctgaaggggcttgacattgataccattcaacaacactacactgtctagccatttcttgcattctactttccatgagttcaaatcaacaaagtgagctatgtactccacttgtattgtttttaaactatatgtaacaaaaagagagaaaaaagagagataaaatatgtttttccgtttgttgaaatataataaaacctagttacttgaaaaaaaaaaa

SEQ ID NO: 2202 - DNA, 3410 bp, Glycine max
tgaggcgcgcgtagcacaggtcaatgcataaaaagtgttgctctgtggtaccccaccacccacataatcgcataaaccacaccacacacccttctctctttcacctacaacttgttacaacttacaaggccattcccacaatattgcatatatatagcaccccataaggcactgcacccactaccatcttaatttctccttcaattgctacttcaattctgattgcaaccacgacactactccaccttccaacatgggcggtatcagccttgaggaaatcaaaaacgaaaacgtcgatctggaaaaaattccagtagaggaagtgtttgagtcgctgaaatgttcaagagcaggtttaacatcagacgaaggagccagccggcttcaagtttttggaccaaacaaattggaagagaaaaaggagagcaaacttttgaagtttctgggtttcatgtggaaccccttatcatgggtcatggaagctgctgctataatggccattgctttggctaatggtggaggaaggcctccggattggcaagattttgttggtatcattgctctattgttcattaactccacaatcagtttcatagaagaaaacaatgctggtaatgctgctgctgcactcatggctggtttggctcccaagaccaaggttcttagagatgggagatggactgagcaagatgctgcaattttggtcccgggagacataatcagcatcaaactgggagatatcatccctgctgatgcccgtcttctggagggtgatgctctgagtgttgatcagtctgctctgactggtgaatctcttccagtgacaaagaatccctctgaagaagtgttttctggatcaaccgttaagaagggtgagatagaagcagtggtgattgccactggagtgcacaccttttttggcaaagctgctcatctggttgatagcaccaaccaagttggtcacttccagaaagtgcttacagcaattggtaacttctgcatttgctccatcgcggttggaataatcattgagctcatagtcatgtacccaatacagcaccgcaagtacagagatgggattgacaatctgttggttctcttgattggaggaattccaattgccatgccaactgttctgtctgtcactatggctattggttcgcacaggctttcgcagcaaggcgctattacgaaacgtatgacagctattgaggaaatggcaggaatggatgtcctctgcagtgacaaaactggaactctgaccctgaataagctcagtgttgataaaaacctgattgaggtttttgccaagggtgttgagaaggactatgttatccttcttgcagcaagggcttctaggactgagaatcaggatgctatagatgctgcaatagttgggatgcttgctgatccaaaggaggcacgagctggtatcagggaggtccactttcttccattcaatcctgtggacaagaggactgctctaacttacattgattctgatggaaattggcatcgatctagcaaaggagctcccgagcagatattgaacctctgcaactgcaaagaggatgtaaggaaaagggttcatggaacgattgacaagtttgctgagcgtggactccgttctttaggtgttgctagacaggaagtacctgagaaaaacaaggatagtcctggtgcaccatggcaatttgttggtctgctaccactttttgatcctccaaggcatgacagtgcggaaaccatcacaagagctctaaaccttggtgtgaatgttaagatgatcaccggtgatcagcttgccattgccaaagaaactggccgaaggcttgggatgggaacaaacatgtacccatcttcttcattgcttggtcaaagcaaggatgctgctgtttcagcagttccagttgatgaattgattgagaaggctgatggatttgctggagtatttcctgaacacaaatatgaaattgtgaagaggctgcaagagaggaagcatatttgtggaatgacaggtgatggtgtcaacgatgctcctgcattaaagaaagcagacattggaattgctgttgctgacgctacagatgctgctagaagtgcttcggacattgtcctcactgaacctggtctgagtgtcattattagtgcagtgctcaccagcagggcaattttccaaaggatgaagaattatactatctatgctgtgtcaatcaccattcgtatagtgtttggtttcatgtttattgcattgatttggaaatttgattttgcacccttcatggtgttgattattgccatactaaacgatggtaccatcatgacaatatccaaggatcgagtgaaaccatctccaatgccagacagctggaagctgagggagatatttgccactggtgttgtgctaggagcttacatggcactaatgacagtagtatttttctggctcatgaaggataccgacttcttctcggacaagttcggtgtgaggtctataaggaacagccccggagaaatgatggcagccctgtacctacaagtcagtattataagtcaagcactaatttttgtgacaaggtcccgcagctggtcctatgttgaaagacctggtcttctcctactgagtgcttttatgattgcacaactggtggcaacttttctggcagtgtatgctaactggggcttcgcaagaattcagggaatgggatggggttgggctggtgtaatctggctctacagtttagtcacatatatccctcttgatatactcaaatttgcaatccgctacgtcctgagtgggaaggcttgggataatcttttggagaacaagactgccttcactacaaagaaagactatggcaaagaagagagagaagcacagtgggcaactgctcagaggactcttcatggtcttcagccacctgaaacaaccaaccttttcaatgacaagaacagttacagggagctttcagagattgctgagcaagctaagagacgtgccgaggttgcaaggctcagggagcttcatacattgaaaggacatgttgaatcagtgaagctgaagacattgatacaatccaacagcattataaagtttaaggagtttggacaaccttcaagcagaacacactttggtgcttgtccaagaactagaacaacaaatataatgaaggcccaagttaatccgcctttagattaagatgaaagtccttttgtgggtcaaaatctgaatgatttactcttattttgagaatgataatgatatcaaggtcactttaaggctctatatttttttttcctgatgaagaaaatatattttctatcttgattttctatcaggataaaggaagatggattctgatactggcctttaaatagattccccaattatacctcaccagccctagtgc

SEQ ID NO: 2203 - DNA, 2856 bp, Eucalyptus grandis
atggcctccggcgacatctccttagaacaaatcaagaacgaaagcatcgaccttgagcgaattcctgtggaggaagtgttcgaacagctaaaatgtacacgagagggtttgtcgactacagaaggtggaaggcggcttcaaattttcggcctgaataagcttgaagagaaaaaggagagcaagtttctcaagtttctgggttttatgtggaaccctctgtcatgggtcatggaggctgctgcagtcatggccattgctttggctaatggagggggaaagccaccagattggcaagacttcgtcggcattgtgacgttgttgatcatcaattcaactattagctttatcgaggagaacaacgcaggaaatgccgcagctgctttgatggctggtctagcccctaaaaccaaggtattgagagatggcaagtggaatgagcaagaggccgcgatcctagtacccggagatgtcgttagcatcaagttaggagacattgtcccggccgacgctcgtctcttggaaggagatcccctcaagattgatcagtctgcgctcaccggtgagtcgttgcctgtgacaaagaacccgggtgacgaagttttttcaggttccacgtgcaagcaaggtgagatcgaggctattgttattgccactggcgtccataccttctttggcaaggcagcccaccttgtcgacagtacaaaccaagttggtcacttccaaaaggtgttgacggctatcgggaacttctgcatttgctcgattgcgttggggatgctagttgaaattgtggtgatgtacccgatccaacataggagctacagagctggtatcgacaacttgttggtccttctcattggagggatcccgatcgcaatgcccaccgttttgtctgtcacgatggccattgggtctcaccgactctcacaacaaggcgccatcaccaagaggatgactgccatagaggagatggccgggatggatgtactctgcagcgacaagaccggcactctcaccctgaacaagctctctgttgacaagagcttgatcgaggtatttccaaaggatgcagacaaggacactgttatgttgcttgctgccagggcatccagggttgagaaccaggatgcaattgatgcttcaatcgtcggaacattggccgaccccaaagaggcaagggctggaattacagaggtgcatttcctgcctttcaacccagtcgacaagcgcactgcgatcacctacctcgatggtaacggcaattggcatagatgcagcaagggtgctccagaacagatcatggacctttgcaatctcagaggggaggcaaagaaaaaagcccattcgttcatcgacaattttgccgcacgtggcctccgttcgcttgctgttgctcgacagatggttcctgagaagaccaaggagagcgcaggagggccatgggagttcgtcggtctcctgtctttgtttgatcctccgaggcatgatagcgcagagactatccgccgtgccctcaaccttggtgtcaacgtgaagatgatcaccggcgatcaactcgctattggcaaagagactggccgcaggcttggcatgggtagcaatatgtatccgtcatcttctcttcttggtgagagtaaggatgagtcaattgcatcgattcccgtcgaagagctcattgaaaaagctgacggatttgccggtgtcttccctgagcacaaatatgaaattgttaagaagctccaggagaggaagcacatttgtggaatgactggagatggtgtcaacgacgcgcccgcacttaaaaaggcagatatcggcattgcggtggcggatgcaactgatgcagctcgaagtgcatcagatattgtcttgacagagccagggctgagtgtaatcgtaagtgccgtgttgacaagcagggccatattccaaaggatgaaaaactacaccatctatgccgtctccatcacaatccgtatcgtgctgggtttcctgctcgtggctctcatttggaagttcgatttttcgcctttcatggttctcattattgccatcctaaacgacgggaccatcatgaccatctctaaggacagagtgaagccttctccggttcccgactcgtggaagctcaaggagatctttgccaccggcatagttctgggaacctatcttgccctaatgacagtgctcttcttctggcttgcgcatgatactgacttcttccccaatacattcggcgtgaggccgatcaaaggaagcgaagatgagctaactgcggcgctctatctccaagtcagcatcattagtcaagcactcatctttgtaacccgatcacgaagctggtcctttgttgagcgtcctggactcttgcttgtcggtgccttcctcgctgcacaattggtggcaacgctcattgccgtgtacgcaacctggggctttgctagggttcaaggcatcggatggggatgggctggattgatctggatcttcagcatcatcacgtacttcccactcgatgtcctcaagttcttgatccgctacgcgttaaccggcaaggcttgggacaatatgtttcagagcaagactgcattcacaaccaagacggattatggcaagggcgagagggaggcgcaatgggctttggctgagaggacgctccatggtcttcagaccccaccatcactgttcaatgacaagagcagctaccgggagttgtccgagatcgccgagcaggccaggagacgtgctgaagtcgcgaggctaacggagctccacacgcttaagggacatgttgactcagtggtgaagttgaaggggttggacattgaaaccattcaacaacactatacagtttga

SEQ ID NO: 2204 - DNA, 3174 bp, Mimulus guttatus
acctccccattgtctcaatcttctaaatattttcaagggtgtaataactcatatggaagggagatagagagatttttcccctctcaatctcttttccttccaaaccctaataaaaaaaattaaactttaaaaaaaaaaaaaagagataaaccaccaaccatggcttcagacttggaagatataagaaatgaaacagttgatctcgaaaccatcccgattgaggaagtgttcacacagttgaagtgttcaaaggaaggattgacttcagatgaaggagcgaagaggctcgagattttcgggccgaataaactcgaggagaaaaaagagagcaagttcctcaagtttttagggttcatgtggaatcctctctcttgggttatggaatctgctgcaatcatggctattgttttggccaatggaggggggaagccaccggattggcaagatttcgtcggtatcatgacgttgctcgttatcaactcgacgattagtttcatcgaagaaaacaatgccggaaatgccgctgcagctcttatggctggccttgctcccaagactaaggttttgagagatggaaagtggtctgagcaggatgcatcaatcctagtaccgggtgacctcatcagcgtgaagttgggtgacatcatccccgccgatgctcgtctcttggaaggcgatcccttaaagatcgatcaatccgccctgaccggagagtcccttccggtaacaaagcaccccggagacgaggttttctccggctccacttgcaagcaaggcgagctcgaggcggtggttattgccaccggggtccacaccttcttcggcaaagccgctcatctcgtcgatagcaccaacaatgtcggccacttccaaaaggttttgacttcgatcgggaacttctgcatctgctcgatcgcggtgggaatgctgatcgaggtggttgtgatgtacccgatccagcaccgaaagtacagagaagggatcgacaatctgctagtgctcctcatcggcggtatcccgatcgctatgccgacagtgctgtcggtgacaatggcgatcgggtcccaccgcctgtcgcagcaaggcgccatcaccaagaggatgacagccatcgaggaaatggcgggaatggacgtgctttgcagcgacaaaaccggtaccctcacactcaacaagctcacagtcgacaagtccctcgtcgaggttttcccccagaacgcagaccaggacaccgttttgcttctcgccgcacgcgcttcgagggtcgagaatcaagatgccatcgatgcttccatcgtcaacatgctcgatgaccccaaggaggcaagagcaggaattacggaagtgcatttcttgccgtttaatccggtggataagcgtaccgcaattacatattacgacaccgatggaaactggcataggtgcagcaagggtgctcctgagcaaatcattgaactatgtgagctcaaaggggaagtcttgaagagggctcacgagataatcgacaactttgcaaaccgcggtcttcgttctcttggcgtcgctcgacagacggtttcggagaaaacgaaagagagcgccggagactcgtgggagtttgtgggtttattgcctttgttcgaccctccgaggcacgacagtgcggagaccataaggaaagccctagacctaggtgtgaacgtgaagatgatcaccggtgatcaattagccatcggcaaagaaaccggacgaaggctcggtatgggaaccaacatgtacccgtcgtcgtcactcctcggccagagcaaggacgagtccatctcttcaatccccatcgacgaactcatcgaaaaagccgatggtttcgccggagtcttcccggagcacaaatacgagattgtgaggaagcttcaagagctaaagcacatctgcggtatgaccggagatggtgtgaacgacgcaccggctttgaaaaaggccgacataggcatagcagtggccgatgcaaccgatgccgctaggggcgcgtcggacatagtgttgaccgagccggggctaagtgtgatcataagcgcggtccttacgagccgagccatcttccagaggatgaagaactacaccatctacgcggtctcgatcaccatccgtatagtcatgggattcatgctcatcgcgcttatctggaagttcgacttctcgccgttcatggttttgattatcgccattctcaacgatggcacaatcatgacgatatcaaaggatagggttaagccgtcaccggtccccgattcttggaagctcaatgagatttttgctaccgggattgtgctcggaacatacatggctctcatgactgtcattttcttctatcttgcctctgataccgacttcttctccgatacattcaatgtgaaatcaatgaggggaaaccctaatgagctaacggctgcactctacctacaagtgagcattatcagtcaagcattgatcttcgtgacgagatcgagaagctggtcgttcgtcgaacgaccaggtttcttgctcttgggagctttcttgattgcccaattgttggcaacggtgatagcggtgtatgcaaagtgggaattcgcaagaatcagcggcatcgggtggggatgggccggagttatctggatcttcagcatcgttacgtacttcccgctcgacgttctcaagttcataattcgcttcgctttgagtggcaaagcttgggattcaatgattcagaacaagactgctttcactacgaagaaggattacggtaagggcgagagagaagcgcagtgggccgtagctcaacgaaccctacacggattatcgactacagaaaatgcggccctttacaacgacaagaactaccgggaattatccgagatcgctgaacaagcaaaaagaagagctgaagttgcaaggctgagggagctccacacacttaagggacacgtggagtcggtggtgaagctgaaaggattggatattgatacaatccagcaacattacactgtgtaacattcattacaagtgaagattgacagacaattgttttttatttggtttgtaatacttctatgttgatgaataattaatcctgggagaagggatatgtatttttgcatagaagtttaatataaagaaattattaatacatgtcccattttatattttctttttgaa

SEQ ID NO: 2205 - DNA, 3224 bp, Phaseolus vulgaris
aaccttggacaacataactgtccttccctaggcaaaaaatttctcctcttctttccacccttggcatggtcttccaggcctaagggagtgagctcaaggagttcatagaagagaggagataataaaataaaataaaataattaactagggaggaacacgttcatcatttttacaacatggcctccgacatatcgtttgaagacctcaaaaacgagaatgtggatcttgaacacattcctgttgaggaggttttcaagcaactgaaatgtaccaaagagggtctcacatctgctgaaggagagaagaggctccaaatctttggccccaacaagctagaggagaaaacagatagcaagtttcttaagttcttgggttttatgtggaatccactttcatgggtcatggaggctgctgccgtcatggccattgcattggccaacggagggggcaagccaccggattggcaagatttcgttggtattgtcgtgttgcttatcatcaattcaaccattagtttcattgaggagaacaacgcaggcaatgccgcagcagctttaatggctggtcttgcacccaaaaccaaggtgttgagggatggaaaatggagtgaggaggaggcagcaattctggtgccgggagatttgatcagtatcaagttgggagatattgttccagctgatgctcgtcttttggagggagatccccttaagattgatcagtctgccctcactggtgagtcccttcccgtcaccaagaaccctggtagtgaggttttctctggttccacctgtaaacaaggtgagatagaagctgttgtcattgccaccggtgttcacaccttctttggaaaggcagcacatcttgtggatagcaccaacaatgttggtcacttccaaaaggtgttgacttccattggaaacttctgtatctgctcaattgctgtgggaatgctgattgagattattgtgatgtatcccatccagcaaagggcttacagagagggtattgataatttgttggttcttctcattggaggtatcccaattgccatgcctacagtcttgtctgttaccatggctattgggtctcaccgtttgtctgagcaaggagcaatcaccaagaggatgacagccattgaagaaatggcgggcatggatgttctctgcagtgacaagaccggaactcttactcttaacaagctcactgtggacaagaccttgattgaggtgttccccactggcatggacaaggatgcccttgtcttgtatgctgccagggcttctaggattgaaaaccaggatgccatcgatgcttcaatcgttggaatgttggctgatcccaaggaggcaagagcaggaatcaatgaggtgcatttcttgcccttcaaccctgtggacaagcgcacagctatcacttacattgatggccaaaacaattggcacagaagcagcaagggtgctcctgagcaaattattgagctctgtggactcaagggagaggctttgaaaaaggcccacaaagtcattgatgagtatgctaaccgtggtctgcgttcattgggtgtttcacgacagactgtttcggaaaagagcaaggagagtgtaggagactcctgggagttcctgggtctcttgcccctctttgaccctccaaggcacgacagtgctgagactattcgacgtgctcttgaccttggagtcaatgttaagatgatcaccggtgatcaacttgccattggaaaagaaaccggtcgcaggcttggaatgggcaccaacatgtacccttcatcctcccttctgggtgacagcaaggacccagccattgcatcaatcccagttgatgaactcattgagaaggctgatggatttgccggagtcttccctgagcacaagtatgagattgtgaagagattgcaagatagaaagcatatttgtggaatgactggagatggtgtgaatgatgccccagcactgaagaaggcagacattggtatcgccgtggctgatgccactgatgcagccagaagtgcctcagacattgtcctgactgagcccggactcagtgtgatcgtgagtgctgttttgaccagccgagccatcttccagaggatgaagaattacacaatctatgctgtttccatcaccatccgtattgtgtttggattcatgcttgttgctctaatctggaaatttgacttctcccctttcatggtcctcatcatcgccatcctcaacgatggaaccatcatgaccatctccaaggatagggtgaagccttctcctcttcctgactcatggaagctgaaagaaatcttcgccactggagttgttcttggagcttacatggcaatcatcactgttgtcttcttctttttggttcacgacaccgatttcttcactagaacctttggcgtgaagccaattgtagacagtgaggagcagcttaactcagccctgtaccttcaagtgagtattatcagtcaagcactcatcttcgtcaccaggtcaaggagctggtcttatgttgaacgccctggcattttgcttattacagccttctttgctgctcaaatggtggccactgtgattgctgtgtatgcacactgggactttgccaggatcaatggagttggttggggatgggcaggagcaatctgggtcttcagcattgttacctacattcctcttgacatcctcaagttcctcatccggttgggactgtcaggcagggcttgggacaacatgcttgagaacaagactgccttcactaccaagaaggactacggaaagggagaaagagaagctcaatgggccgtggctcagcgcacacttcacggcctccaagttggagaaaccaacaaggctaaccacgagcagtctgaaattgcagagcaagctaaaagacgtgctgaagctgccaggttgaaggagctccacaccctgaagggacatgttgaatctgtggtgaagttgaagggtattgatattgataccatccagcaacactacactctctaaaagaatcttaaggaaccataaatggaggaaaacggatcagagcttcttagagcatataaccatgaatcttttgttcatgttctcaccatgtatcttttgtttatatgctctcgggtacaatcgagaccacacaattatgtacgtggcatatgttgaatcatttttttccaataaaataataaaacaattattattacaagttttgca

SEQ ID NO: 2206 - DNA, 3253 bp, Glycine max
tcctaaacaaaaaattttctttctctttttcgctctccatgatcgtccccgcctaagggagggagctcgtggagcttgttgaaaagagaggacgtgaagaataaaaaaatcttaagaaaaataaataaactaaactaggaagggacacgttcatctttaacaacatggcctctgacatatcgtttgaggacctaaaaaacgagaatgtggatcttgaacacattcccgttgaggaagttttcaagcagctaaaatgtactagagagggtctcacttcagctgaaggagagaagagactccaaatctttggtcccaacaagctagaggagaaaaaagatagcaagttacttaagttcttgggttttatgtggaatccactttcatgggtcatggaagttgctgctatcatggccattgtaatggccaacggagggggcaagccaccagattggcaagattttgttggtattgtcgtgttgctcatcatcaattcaaccattagtttcattgaggagaacaatgcaggcaatgccgcagcagctttaatggctggtcttgcacccaaaaccaaggtgttgagggatggaaaatggagtgaggaggaggcagcattgttggtgccaggagatttgatcagcatcaagttgggagatattgtcccagctgatgctcgtctattggagggagatcccttgaagattgatcaatctgctctcactggtgagtccttgccagtcaccaagaaccctggtagtgaggtcttctctggctccacctgcaaacaaggtgagatagaagccattgtcattgccactggtgttcacaccttctttggcaaggctgcacatctcgtggatagcaccaacaatgttggtcacttccaaaaggtcttgacatccattggaaacttttgtatttgctcaattgctgttggaatgttgattgagattattgtgatgttccccatccagcaaagggcttatagagatggtattgacaatttgttggttcttctcatcggtggtatcccaattgccatgccaacagtcttgtctgtgaccatggctattggatctcatcgcctatctgagcaaggagccatcaccaagaggatgacagccatcgaagaaatggctggcatggatgttctctgcagtgacaagaccggaactctcacccttaacaagctcaccgtggacaagagcttaattgaggtgttccccactggcatggacagggatacccttgtcttgtatgctgctagggcttctaggattgaaaaccaagatgccattgatgcttcaattgttggaatgttgggtgaccccaaggaggcaagagcaggaatcactgaggtgcatttcttgcccttcaaccccgtggacaagcgcacagctatcacctacattgatggtcaaggcaactggcacagaagcagcaagggtgcccctgagcaaattattgagctttgtgaactcaagggagaggttttgaaaaaggcccacaaggtcattgatgagtatgctaatcgtggtttacgttcattgggtgtttcacgccagactgtttcagaaaagaacaaggagagtgcaggggaatcatgggaattcttgggactcttgcccctctttgatcctccaaggcacgacagtgctgagactattcgtcgtgctcttgaccttggtgtcaacgttaagatgatcactggtgaccaacttgccatcggaaaagaaaccgggcgtagacttggaatgggcaccaacatgtacccttcatcctctcttcttggtgatagcaaggaccctgccattgcatcaatcccagttgatgaactcattgagaaggctgatggatttgccggagtcttccctgagcacaaatatgagatcgtgaagaggctgcaagaaatgaagcatatttgtggaatgactggagatggtgtgaatgatgccccagcactgaagaaggcagacattggtattgccgtggctgatgcaactgacgcagcaaggagtgcctcagacattgttctgaccgagcccggactcagtgtgatcgtgagtgctgtcttgaccagccgtgccatcttccagaggatgaagaactacacaatctatgctgtctccattaccatccgtatcgtgttaggattcatgctcgttgcactcatctggaggttcgacttctctcctttcatggtcctcatcatcgccatcttgaacgacggaaccatcatgaccatctccaaggatagggtgaagccttcacctcttcctgactcatggaagctcaaggaaatcttcgccaccggagttgttcttggagcttacatggccatcatcactgttgtgttcttctttttggttcatgacactgatttcttcaccagagtctttggtgttgagccaattgtagacagtgaggaacaacttaactcagctttgtaccttcaagtgagtatcattagtcaagcactcatcttcgtgaccaggtcaaggagttggtcttatgttgagctccctggcattttgcttatcacagccttctttgctgcacaattggtggccactgtgattgctgtgtatgctcactgggactttgccaagatcaatggagttggttggggatgggcaggagcaatctgggtcttcagcattgttacctatattcctcttgacatcctcaagttcctcatccgcatggggttatcaggcaaggcatgggacaacatgcttgacaacaagactgctttcacaacaaagaaggactatggaaggggtgaaagggaagctgaatgggctgtggctcagcgcacacttcacggtctccaagttggagaatccaacaaggccaagcaacatgagcagtctgaaatcgcggagcaggctaagagacgtgctgaggctgccaggttgagggaactccacacactcaagggacatgttgaatctgttgtcaagttgaagggtattgacattgataccatccagcaacactacaccctttaatagcctatccattcaaattccggatgtatcttgtcattatattcctactcttccgccccaagaacatcaaacattttaggacggaggaaactcttattattaaagccagggacttcttcagagattttttcttatcttttgcattttgctaaaaatattcattgaaatcacataaattattgatatttattaaaaaatgtgtattgattatttcctaattatattaaaaacacataacaatcagt

SEQ ID NO: 2207 - DNA, 3255 bp, Eutrema parvulum
tgtgctcttgttttgtatttctttttctcctaggtttcttgtaatataagcttcttcttctttctctcctccctcttattgcctcctcttgaagtgtctttcatgaccgtctaagagagggctttagagaaaggagagaagaaagaagttgattcgtccatcggatatatattttcttacatctatctttattatttacttttttagatcatatcagtttttttttctaaagaagaaaaatggcgtctgatatttcttgggatgaaatcaagaaagagaatgtggatcttgagcgtatccctgtagaagaagtgtttgagcagctaaaatgctcaaaagaaggtttatcaagcgatgaaggtaagaagaggcttgagatattcggaccaaacaagcttgaagagaaatcagaaaacaagtatttgaaattcttggggtttatgtggaatcctctttcatgggttatggagtctgctgcaattatggctattgtcttagccaatggaggaggaaagcctccagactggcaagatttcatcggtattatggtgttacttgttatcaactccaccattagtttcattgaagagaacaatgctggcaatgcagctgcagctcttatggcaaatcttgcacccaagactaaggtgttgagagatggaaaatggggtgagcaagaggcttcaatcctagttccgggtgatctaataagtgtcaaattaggtgacattgtccctgctgatgctcgtctccttgagggagatcctctcaagattgaccaatctgctctcactggtgaatctcttccagtgaccaaacaccctggtgatgaagtattctcaggttcaacttgcaaacaaggtgagattgaagctgttgttattgcaactggtgtccacactttctttggaaaggctgctcatcttgtcgatagtaccaacaatgttggccactttcaaaaggttttgacggctattggtaacttctgtatatgctcaattggaatagggatgttgattgagatcttaatcatgtaccctattcaacaccgcaaatatagagatggtattgataatcttttggtgcttttgattggaggaatcccaatcgccatgccaaccgttttatcggtaacaatggctattggatcacatagactctctcaacaaggtgccatcacaaagaggatgactgcgattgaagaaatggctggaatggatgttctctgcagtgataagactgggactttaactcttaacaagctctctgtcgataagtcattgattgaagtattcccaaggaacttggatactgatgcagttgtattattggctgcaagagcctctagaatcgaaaaccaagacgccattgatgtttccattgttgggatgttgagtgacccaaaagaggcaagagaaggtatcaaagaggtgcatttcttgccctttaaccctgtagataaacgtacagccatcacatacattgatgaaaatggggactggcatcggagcagcaaaggagctcctgagcaaatcattgaactgtgcaatctccaaggagagactagaaggaaagctcatgaagtaatcgatggttttgctgaacgtgggcttcgttctcttggggttgctcaacagactgtgcctgagaagaacaaggagagcgatggtagtccatgggagtttgttggactattacctctctttgatccaccgagacatgacagtgcagaaacgattcgacgagctcttgagcttggtgtcaatgttaagatgattactggtgaccaacttgccattggtattgaaactggtcgtaggcttggcatgggaacaaacatgtatccatcgacttcactccttggtaactcgaaggatgaatcattagttggcattcctgtcgatgagctcattgagaaagctgatggattcgctggagtttttcctgagcacaagtatgagattgtaaagaagctacaagagaggaagcacatttgtggaatgacaggagatggtgtaaatgatgctcccgctttgaagaaagcagatattggaatcgcagtggctgatgcaactgatgccgcaagaagtgcctctgacattgttctaacggaaccaggactaagtgtgatagtgagtgccgtgttgacaagtcgtgcaatcttccagaggatgaagaactatacaatatatgctgtctccatcactatccgtattgttttgggattcatgcttgtggctttgatatggagatttgattttgcacctttcatggttttgattattgcaatcctaaatgatggaaccatcatgacaatctctaaggacagggtgaaaccttctccagtgcctgattcatggaagctcaatgagattttcgccactggtgttgttctaggaacctacatggctcttaccacagtgctctttttctggctagctcatgatactgacttcttcagcaaaacatttggcgtgaggtccatccaaggaaatgaggaagagcttatggcagctttgtaccttcaagtgagcattataagtcaagcacttatctttgtcacaagatcaagaagttggtcattcgttgaacggccagggtttttgctctgtatagcctttattatagcacaattggccgctacattgatcgctgtgtatgcaaactgggaatttgcaaggatcctaggatgtggatggggatgggctggagtcatatggttatatagtatcattacctatattcctcttgacattctcaaattcatcattcgttactctctcactggcaaggcttgggataatatgatccaacagaaaaccgctttcacaacgaagaaagattatggaaaaggagagagggaggctcaatgggctttagctcaacgcacactccatggcttaccaccacctgaagcaatgttccatgacaagaaccatgagctctctgatatagcagagcaggccaagaggcgtgccgaggttgctaggctaagagagcttcacactctaaagggccatgttgaatctgtagtgaagctgaaggggctcgacattgataccattcagcaacactacactgtttaaccattccttgggttatttcttctcatgagtctaaatcaacaagatgagctatgtactctacttatattgtttctaaactatatgtaacaaaaagagaggaaaacgagagatataatatgtttttccgatggatgaaatataataatacctagtattcaaaagaattatt

SEQ ID NO: 2208 - DNA, 3460 bp, Populus trichocarpa
ctccctgccacgtaagccccccacctctgtataaattctagctcaagctactcccctacccctcgccttcttcttcttcttcagaacactctcaacttttctccctctaaattctccaatcccccccccccccagctaatattactatgattctgtagttttctcttgaattttgtttatatttcgagggttttctctagcaaggctaaaccatgtccagcaagggcggcatcagtcttgaagagatcaaaaatgagtctgtcgatctggagaggattcccatggaggaagtgtttgagcagctgaaatgcacaagagaaggtctgtcggcagacgaaggagccagcaggcttcaagtgtttggaccaaacaaactagaagagaaaaaggagagcaagattctcaagtttctggggtttatgtggaatccattgtcatgggtcatggaagctgctgcattgatggccatagccttggctaatggtgatggaagacctccagattggcaggattttgttgggattgttgtgttgttggtgattaactccactattagtttcatagaggaaaacaatgctggtaatgcagcagcagccctcatggctggtcttgctcctaagactaaggttctgagagatggccgatggagcgagcaagatgcttcaatcttggttcctggagacattatcagcattaaattgggagacatcgttccagctgatgctcgtcttctcgagggtgatcctttaaagattgatcaatctgcccttactggggagtcacttcctgtcaccaagaacccttctgatgaagtgttttctggctcaacatgtaaacaaggcgaaattgaagcagttgtgattgccactggtgtgcacacctttttcggcaaggctgcccatcttgtggacagcaccaatcaagttggacatttccagaaagttcttactgccattggtaatttctgtatttgctcaattgctgttggaataatcgccgagcttatagtgatgtaccctatacaacatcgcaagtacagagatggaattgacaacatgctggttctcttgattggaggaattcctattgctatgcctactgttttatctgtcaccatggctattggttcccacagactttctcaacagggtgctattaccaagagaatgactgccatcgaggaaatggcaggaatggatgttctttgcagtgacaaaactgggactctaactctgaacaagcttactgttgataggagcttgattgaagtgtttgcaaagggtgtggagaaggagcatgttatgcttcttgcagcaagagcttcaaggactgaaaatcaggatgctattgatgctgcgattgtagggatgcttgcagacccgaaggaggcacgagctgggatcagagaggttcatttccttccattcaaccctgtggacaagaggactgctctgacctacattgattctgatggaaactggcaccgggctagcaagggtgcccccgagcagatattagctctgtgcaattgcaaggaagatgttaagaagaaggttcattctgtgattgacaagtttgctgaacgtggacttagatctttaggtgttgcaaaacaggaagtacctgagaaatcaaaagatgctgcaggtgccccatggcagctagttggtttgttgcctttgtttgatcctcccaggcatgacagtgctgaaaccatcagaagagctctccaccttggtgttaatgttaagatgattactggggatcagcttgcaattggcaaggaaactggcaggaggcttggaatgggaacaaacatgtatccctcttctgcattgctcggccaagacaaagatgcttctattgcggctctccctgtggatgagttgattgaaaaggccgatggatttgctggagtttttccagaacacaaatatgaaattgtgaagaggctacaggagaggaagcacatctgtggaatgacaggagatggtgttaatgatgcccctgctctgaagaaggcagatattggaattgctgttgctgatgcaactgatgctgccagaagtgcttctgacattgtcctcactgaaccaggacttagtgttattataagtgcagtgctgaccagcagggctatattccaaaggatgaagaattacactatatatgcagtttcaattaccattcgtattgtctttggcttcatgtttattgccctgatatggaagtttgacttcgctccattcatggttttgattattgctattctaaatgatggaacgatcatgacaatatcaaaggatcgagtgaagccatccccacagcccgatagttggaaacttaaagagatatttagtactggcattgtgcttggaggttacatggcactgatgacagtattattcttctggattatgaaagacaccgacttcttttcagataagtttggtgtcaggtcactgagaaataacaatgaggaaatgatggcagccttgtatttacaagtgagtatcgtgagccaggcacttatttttgtcacaagatctcgcagctggtcttttgttgaacgtcctggattccttctccttggtgcatttgtagctgctcagctggtcgcaacattgatagcggtctatgcaaattggggttttgcacgtattgaggggtgtggctggggatgggctggagtaatctggctatttagcgtggtgacatatgtgccgcttgatatcctcaaattcgcaatccgctacattttgagtgggaaggcttgggataatctcttggagaacaagactgcctttactacaaagaaagactacggcaaagaagagagagaagctcagtgggccacagctcagaggaccctccacggccttcaacctcctgagacctcccacaatatgttttctgaaaagaatagttacagggagctttctgagatcgccgagcaagccaagcggagggctgagatggcaaggctgagggagctaaacaccctcaaggggcatgttgaatcagtggtgaagctgaagggactggacattgatacaattcaacaacactacacagtttaaagagttacaagtcttgatgagaacaaactcttcggagaaaagctgagctgaaagctaggtatatgatgacgaagatgacgaagaggctggaagcgaaaatcatttaaattagactagaatgacactcctcttgctataacttaagggtacctttttgttgtttgttatttaccttcaaacccagagggattatttctccttcaggagctaaatataatcagccacacattttctccgctgtaccatttttctatcgtctttaattttacattgtctgcatcaatcttatgttgctgatagagtgatgcaattatatgctttaaaattgtatcaaatgccccctactgtttccatagaaacatgagagaagccttctgtca

SEQ ID NO: 2209 - DNA, 3091 bp, Gossypium raimondii
aacatggcggataagagcatcagcttggaagaaatcaagaatgagactgttgatcttgagcgaattcccgttgaagaagtgtttcaacagttgaaatgcaccaggaacggcctgacaagtgaagaaggccaaaaaaggcttcaaatctttggtcccaacaaacttgaagagaaaaaggaaaacaagcttttgaagttcttgggatttatgtggaatcctctttcatgggtcatggagtttgctgctattatggccattgctttggctaatggaggaggcaaacccccagattggcaagattttattggaattgtctcattgctcttcatcaactcaactattagcttcatcgaagaaaataatgcaggcaatgctgctgctgcacttatggctggtcttgctcccaaaaccaaggtcctaagagatggaaaatggaatgagcaagaagcagcgattttggtaccgggagacatcatcagtattaaattgggagatattgtccctgcagatgcacgtctccttgaaggtgatgcactcaagattgatcagtctgcccttaccggtgagtctttgcctgtaaataagcactcaggtgatgaggtattctctggttcgactgtaaagcaaggtgagattgaggctgtcgttattgccaccggcgtccacaccttctttggaaaagctgctcaccttgttgatagcaccaataacatagggcacttccagcaggtgctgacagcaattgggaacttctgcatatgctcaattggagtagggatgcttatcgagattgttgtgatgtatccaatccagcgccgtaagtacagagatggaatcgataatctattggtgcttctcattggagggattccaattgccatgccaacagttttatctgtgaccatggctatcggatctcaccggctttcacaacaaggagccatcactaagagaatgacagcaattgaagaaatggctggaatggacgtactttgcagtgataagacagggacactcactctcaacaagcttacagtggacaagagcatgattgaggtgttcatggacaatattgacaaggaaatggttcttctactagcggcaagggcctcccgggttgagaatcaagatgccattgatgcctgcattgttggaatgctaggtgatcccaaggaggccagagcaggggttacagaggttcatttctttcccttcaaccctgttgataagcgtacagccatgacatatatcgaggctgatggtagttggcaccgagccagcaaaggtgctccagaacagattattgaactatgtaacctccgaaatgatgcgaagaggagagctcatgatatcattactaagtttgctgatcgtgggcttcgctctcttgcagtggcaaaacaaaaagtgcctgagaaaaccaaggatggccaaggagatccatggcaatttgtgggtttattgcctctatttgatcccccaaggcatgatagtgcagagacaattcgccgtgctctaagtcttggtgtcaatgtcaagatgatcacaggtgatcaactagccattggaaaggaaactggtcgccggctcggcatgggaaccaacatgtatccatcatcagttctccttggtgaaaataagggtgatgcattagatacaattggtgttgatgagcttatcgagaaggctgatggttttgcaggcgtttttcctgagcacaagtatgaaattgtgaagaggctacaacaaagaaagcacatatgtggcatgaccggagacggtgtgaatgatgcaccagctcttaagaaggcagatattgggattgcagtcgatgatgcaaccgatgcagctcgtagtgcgtcagacatagtattaacagaaccaggactaagtgtgattgtgagtgctgttctgacaagtagagcaattttccagagaatgaaaaactataccatctatgctgtctccattactatccggatagtgttgggatttatgctccttgcacttatttggaagttcgatttttcacctttcatggttttgatcatagccatactcaatgatggaacaattatgaccatttccaaggacagggttaagccatctcccatgcctgactcatggaagctcaaggagatttttggcactggcattgtcctcggcacctatctagcttgcatgactgttgttttcttctgggctgcgaatgactcgaacttcttttcggataaatttggtgtaagatccattagacacaatcaagacgagcttacagcagctgtttacctccaagtgagcatagtgagtcaagcactcatcttcgtcactcgttctcgaagctggtctttcatcgaacgtcccgggttcttgctcgtgattgccttcattttggcacaactcgtggctactgtaattgcagtttatgcaaactgggggtttgcaagaatcaaaggcataggatggggttgggcgggtgtaatctggatctacagtgttgtcttttacttcccacttgatgtattcaagttcttgatccgctatgccatgagtggaaaagcttggaataatttgcttcaaaacaagaccgccttcacaacaaagaaggattacggaaaaggagagagggaagcacaatgggcattggctcaacgcacccttcatggcttgacacctcctgaaattaccgagaagagcaactatatagaactgtcggagattgctgagcaagccaggaagcgtgccgaagttgcaaggttgagggagcttcacacactcaaaggacacgttgaatccgtagtgaagctcaaaggactcgacattgataccattcaacaacactacactgtttgagaaacaaagaatatgtggaacaggggttgttgtaagctaattattattaatgccatgaaggccggaagagattggggtagaaattaggctgaacttttttcttaaatcagcatctatcctatgtatttcatttttctttttggtagtaggccaacgcatggtattggaataatgttttgaataatccaagtatccctaagattttggtacatgataattgtgttttcttcaaaactcc

SEQ ID NO: 2210 - DNA, 2977 bp, Cyclamen graecum
caagaaactctattcgggagggatctgaaagagggggtgcgacaagagaaaagaagcgtgagaaaggataagagattgaaggagaaagcactctctttcgatctctcattcttggatcatcatggcctctcagtccgagctctccctagaacaaatcaagaacgagcttgtcgatctcgaaaatatacccatagaggaggtgtttgagcagctaaaatgctcaagggaaggtttaaccacagctgaaggagaacacaggctcgaacttttcggacccaacaagctcgaggagaaaaaggaaagcaagtttctaaagttcttgggattcatgtggaatcctttatcatgggtgatggagtgtgcggctatcatggccatagccttggcgaacggaggggggaaggctccggattggcaagattttgtcggaataattgttttgttgattataaactcgaccataagtttcatcgaagagaacaatgcaggcaatgctgcagctgctcttatggccggtcttgctcccaaaaccaaggttttgagggacggaaaatggagcgagcaggaggcagccatcctggttcccggagaccttatcagcgtcaagctcggtgacatcatcccagccgatgcgcgccttcttgaaggggatcccttaaagatcgaccagtctgcactgacgggcgagtccctacccgtgaccaagtacccagggaacgaggttttctccgggtccacttgcaagcaaggggagatcgaggccgtcgttattgccaccggggtccataccttcttcggcaaggccgcccacctcgttgacagcaccaaccaagtcggacacttccagaaggtgttgaccgccattggtaacttctgcatctgctccatcggcattggaatggtgatcgagataatagtgatgtacccgatccagcacaggcagtacagacaggggatcgacaacctgttggtgctcctcatcggaggtatccccattgctatgcccacggtgttgtccgtgaccatggccatcgggtcccacaggctgtcccaacagggggccattaccaagaggatgactgcgatcgaggaaatggctggaatggatgtcctttgcagtgataagaccggaaccctcacccttaacaagctcaccgtcgacaagaccttgatcgaggtgttccccaaagacttggataaggactcggttgtcttgctcgctgctagagcatccagaatcgaaaaccaggacgctattgatgcttcaatcgtcggaatgttgggtgaccccaaggaggcaagagcagggctcacagaggtgcattttctgcccttcaatccggtagataagcgcactgccattacctacatcgacgacgaaggcaactggcacagatgcagcaagggcgctcctgagcaaatcattgaactctgcgatctcaaaggagatgtgaagaagaagtccctcgatatcatcgacaactacgccaaccgtgggctccgctctcttggtgtcgccagacaaactgtttcagagaaatctaaggagagcgccggagaggcatgggaattcgttggacttttgcccctctttgaccccccgagacacgacagtgcagaaaccatccgcagggctcttgatctcggtgtcaatgtcaagatgatcactggtgatcaacttgccattgggaaagaaaccggccgtaggctaggaatgggcacaaacatgtacccgtcatcatcccttcttggccagtgcaaggacgagtctattgcagccatccccgtcgatgagctcatcgagaaggctgatggatttgctggagtcttccctgagcacaagtatgagattgtgaagaagctgcaagaaagaaaacacatttgtggaatgaccggagatggtgtgaacgacgccccagctttgaagagagccgacattggtatcgccgtggctgatgctaccgacgctgccaggggagcatccgacattgttctgaccgagccaggcctcagcgtgatcgtgagcgcagtcctaaccagcagagccatcttccagaggatgaagaactacacaatctatgccgtatctatcaccatccgtatcgtgatgggtttcatgctcatcgccctcatctggaagttcgacttctcgcctttcatggtcctgattattgccatcttgaacgacggaaccatcatgaccatttccaaggatagagttaagccatctccgttgccagactcgtggaagctcaaggagatcttcgccaccggtattgtccttggaacctacctggctctcatgaccgtgctcttcttctggctcgccaatgacactgacttcttttcggacacgttcggtgttagatcactcaggggcaacgtagatgagctcaccgctgctctctaccttcaagtgagtattgtgagccaagctctcatcttcgtaaccaggtcacgcgggttttcatttgtcgaacgccccggtatcttgcttatcactgccttcttcctagctcaattgttggccacacttattgccgtatatgcacactgggatttcgctcgcattcacggatgcggatggggatgggccggagtcatttggcttttcagccttgttacctatttccctctcgatgtcctcaagttcatcattcgatattcgttgagtgggaacgcttggaataccatgatccaaaacaagactgcattcacaaccaagaaggattacggtaaaggtgagagagaagcacaatgggccgtagcccagcgtacccttcacggtctccaatctgcccagggttacaacgacgaacaccataccgagtccgatctagctgagcaggccaaaaagcgtgccgaagttgccaggttgagggagctccatacattgaagggacatgttgaatcagtggtgaagctgaagggtttggatatcgataccattcaacagcactacactgtctaaagccaa

SEQ ID NO: 2211 - DNA, 3311 bp, Glycine max
ggaacctaagcctaccataactgttacttcctttaacaaaaatttctccttctcttttcacccttccatggacgttcaggcctaagggagggagctcgaggagctcattgaaagagaggagattaaaaaaaaatctaaagaaaaagaaataaacaaaactaggaagggacacgttcatctttgacaacatggcctctgatatctcgtttgaggacctcaaaaacgagaatgtggatcttgaacacattcccattgaggaagttttcaagcagctaaaatgtaccagagagggtctcacttcagcggaaggagagaagaggctccaagtctttggtcccaacaagctagaggagaaaacagatagcaagttacttaagttcttgggttttatgtggaatccactttcatgggtcatggaagttgctgctatcatggccattgtattggccaacggagggggcaagccaccggattggcaggattttgttggtattgtcgtgttgctcatcatcaattcaaccattagttttattgaggagaacaatgcaggcaatgccgcagcagctttaatggctggtcttgcacccaaaaccaaggtgttgagggatggaaaatggagtgaggaggaggcagcattgttggtgccaggagatttgatcagcatcaagttgggagatattgtcccagctgatgctcgtttattggagggagatcccctgaagattgatcaatctgccctcacaggtgagtccttgccagtcaccaaaaaccctggtagtgaggtcttctctggctccacctgcaaacaaggtgagatagaagctgttgtcattgccaccggtgttcacaccttctttggcaaggctgcacatcttgtggacagcaccaacaatgttggtcacttccaaaaggtgttgacatccattggaaacttctgcatctgctcaattgctattggaatgttgattgagattattgtgatgtaccccatccagcaaagggcctacagagatggtattgacaatttattggttcttctcatcggaggtatcccaattgccatgccaacagtcttgtctgtgaccatggctattggatctcaccgcctgtctgagcaaggagccatcaccaagaggatgacagccattgaagaaatggctggcatggatgtcctctgcagtgacaagaccggaactctcacccttaacaagctcactgtggacaagagcttaattgaggtgttccccactggcatggacaaggatacccttgtcttatatgctgccagggcttccaggactgaaaaccaggatgccattgatgcttcaattgttggaatgttgagtgaccccaaggaggcaagagcaggaatcactgaggtgcatttcttgcccttcaaccccgtggacaagcgcacagctattacctatattgatggtcaaggcaactggcacagaagtagcaagggtgcccctgagcaaattattgagctctgtgaactcaagggagaggttttgaaaaaggcccataaagtcattgatgagtatgctaaccgtggtctgcgttcattgggtgtttcacgccagactgtttcagaaaagaacaaggagagtgcaggagaatcatgggaattcttgggactcttgcccctctttgaccctccaaggcatgacagtgccgagactattcgtcgtgctcttgaccttggtgtcaacgttaagatgatcactggtgaccaacttgccattggaaaagaaaccggtcgcagacttggaatgggcaccaacatgtacccttcatcctctcttcttggtaatagcaaggaccctgctattgcatcaatcccagttgatgaactcattgagaaggctgatggatttgccggagtcttccctgagcacaaatatgagatcgtgaagaggctgcaagaaatgaagcatatctgtggaatgactggagatggtgtgaatgatgcccctgcattgaagaaggcagacattggtattgcggtggctgatgcaactgacgcagccagaagtgcctcagacattgttctgaccgagcctggacttagtgtgatcgtgagtgccgtgttgaccagccgtgccatcttccagaggatgaagaactacacaatctatgctgtctccatcaccatccgtatcgtgtttgggttcatgctcgttgctcttatctggaagtttgacttctctcctttcatggtcctcatcattgccatcttaaacgacggaaccatcatgaccatctccaaggatagggtgaagccttctcctcttcctgactcatggaagctcaaggaaatctttgccactggagtcgttcttggagcttacatggccatcatcactgttgtgttcttctttttggttcatgacacggatttcttcactagagtctttggtgtcgagccaattgtagacaatgaagagcagcttaactcagctctctaccttcaagtgagtatcattagtcaagcactcatcttcgtgaccaggtcaagaagctggtcttatgttgagcgccctggtattttgcttatcacagccttctttgctgcacaattggtggccactgtgattgctgtgtatgctcactgggactttgctagggtcaatggagttggctggggatgggcaggagcaatttgggtcttcagcattgttacctatattcctcttgacatccttaagttcctcatccgcttggggttatcaggcagggcatgggacaacatgcttgagaacaagactgcattcacaacaaagaaggactatggaaggggtgaaagggaagctgaatgggccgtggctcagcgcacacttcacggtctccaagttggagaatccaacaaggccaaccaacatgaccagtctgaaatcgcggaacaggctaagagacgtgctgaggctgccaggttgagggagctccacacactcaagggacatgttgaatctgttgtcaagttgaagggtattgacattgataccatccagcaacactacaccctctaaatcaatctttaaggaacaataaatacttaatacgggacattagagcttcatggagcagatcataaaaaaaccatgtatcttgtggttatattcctactcttccccttagccttggggccacacaattttatatacgaggcacatgttgcaatttccatttggcatttctcatgggctaggaatacaaaaacacttaaatgtttcatatcctaaatcttatataaccgatcaatttactttgatgaaaaacaacaagaataaagtacagtaaaaatggag

SEQ ID NO: 2212 - DNA, 3236 bp, Eutrema halophilum
tgtgttcttattttgtattttgtattttcctaggtttcttgtaatacaagcttcttcttctctcttcctccctcttatggcctcctcttgaaagtgtctttcatgaccgtctaagagagagctttagagaaagggtagaaggaagaagttgattcttccatcggatatatatcttcttttatctatctttaatattcactttttagatcttatctagcttttaaggaagaaaaatgacgtctgatatctcttgggaagaaatcaagaaagagaatgtggatctcgaacgaatccctgtggaagaagtgtttgagcagctaaaatgctcaaaagatggtttgtcaagcgatgaagggaagaagaggcttgagatatttgggccaaacaagcttgaagagaaatctgaaaacaagtttttgaaattcttggggtttatgtggaatcctctctcatgggttatggagtctgcagcaattatggcgattgttttagccaacggaggaggaaagccaccagattggcaggatttcatcggtattatggtgttacttgtcatcaactccactattagtttcattgaggagaataatgcaggcaatgccgctgcagctctcatggcaaatcttgcccccaaaactaaggtgttgagagatggaaaatggggggagcaagaggcttcaatcctagttccaggtgatctaataagcatcaaattgggtgacattgtccctgctgatgctcgtctcctcgagggagatcctcttaaaattgaccaatctgctctcactggtgaatcgcttccggtcaccaaacaccctggtgatgaagtattctcaggttcaacctgcaaacaaggtgagattgaggctgttgttatcgccaccggtgtccacaccttctttggtaaggctgcacatcttgtagacagtaccaataatgttggccatttccaaaaggttttgacagcaattggtaacttctgtatatgctcaattggactagggatgttaattgaaatcttaattatgtatcctatccaacaccgcacatatagggacggtattgataatctattggtgcttttgatcggaggaatcccaattgccatgccaacagttttatcagtaacaatggctattggatcacatagactctctcaacaaggggccatcactaaaaggatgactgcaattgaagaaatggctggaatggatgttctctgcagtgataagactgggactctaacacttaacaagctttctgttgacaaatccttgattgaagtattcccaagaaacttggatactgacgcagttgtattgatggctgcaagagcctctagaattgaaaaccaagacgccattgatgcttccattgtaggcatgttaggtgacccaaaagaggcaagagaaggaatcacagaggtgcatttcttgccttttaaccctgtagataagcgtacagccatcacatacattgatgaaaatggagactggcatcgaagcagcaaaggagctcctgagcaaatcattgaactctgcaatctccaaggagacacaaaaagaaaagcacatgaagttattgacggttttgctgaacgtgggcttcgttctcttggggttgctcaacaaactgtgccagacaaaactaaggaaagtgatggtagtccttgggaattcgttggtctattgccactctttgatccaccaagacatgacagtgcggaaacgatcagacgagcccttgagcttggtgtcaatgttaagatgattaccggtgaccaacttgctattggtattgagactggtcgtaggcttggcatgggaacaaacatgtatccatcaacttcactacttggcaacacaaaggatgattcattagttggcatccctgtcgatgagctcatcgaaaaagctgatggatttgctggagttttcccagagcacaagtatgagattgtaaagaaactacaagagagaaagcacatttgtgggatgactggagatggagtaaacgatgctcccgctttgaagaaagcggatattggaattgcagtggctgatgcaactgatgcagcgagaagcgcttctgacattgtactaacggaaccaggactgagtgtgatagtgagtgccgtgctgacaagtcgtgcaattttccaaaggatgaagaattacacaatttacgctgtctccatcactattcgtatcgttttgggattcacgcttgttgctttgatatggagatttgattttgcacctttcatggttttgattatcgcaatcttgaatgatggaaccatcatgacaatttctaaggacagggtgaaaccttctccggtgcctgattcatggaagctcaatgagatttttgccacgggtgttgttcttgggacctatatggcgcttaccacagtgctctttttctggctagctcatgatacgaacttcttcagtaaaacatttggggtaaggtccattcaaggaaatgaggaagagcttatggcagctttgtaccttcaagtgagcattataagtcaagcactcatctttgtcacccgatcaaggagttggtcattcgttgaacggcccggaattttgcttgttatagcctttattatagcacaattggccgcaaccttgattgccgtgtatgccaactgggaattcgcacggatcctaggttgtggatggggctgggctggagttatatggttatacagtattattacctacatgcctcttgacatcctcaagttcataatccgttactcactcactggcaaggcttgggataatatgatccaacagaaaactgctttcacgacaaaaaaagattatggaaaaggggagagggaagctcaatgggcattagctcaacgcacactccatggcctaccaccacctgaagcaatgttccatgacaagaatcatgagctctcagaaatagcagagcaggccaagaggcgtgctgaggtggctaggctgagagagcttcacactctaaagggtcacgttgaatctgtagtgaagcttaaggggctcgacattgatactattcaacaacactacactgtttaaccatttctatccttcagccctaatcaaaaatatgagctacgtattctacttaaattgttttgaaatatatgtaacaaaaagagagctataacgagagatataatattatttttcaatttgatgaaatataataattcctagttgctttaaagatat

SEQ ID NO: 2213 - DNA, 3506 bp, Solanum lycopersicum
ataaaaagagggcaatcccccaaaatcttatacctcacaatttctctcttcacaaagaggccttaaaaacctctcttcattcccttccgccgttctcaattttgcgatcgatgagtctcattattcgttatactcactgaaatcaatccgttttctgcttaattttgtattgacttgtttgctgctggtttaccgacatggcgaaagctataagcctcgaagagatcaaaaatgagactgttgatctggagaaaatccccattgaagaagtgtttgaacaactgaaatgttcgcgagagggtctgacttcggacgaaggagccaacaggcttcaaatctttggaccgaacaaattggaagagaaaaaagaaagcaaaatactgaagtttcttgggtttatgtggaatcctctgtcatgggttatggagatggcggctatcatggccattgcactggctaatggagatgggaagcccccagattggcaagattttgttggtattgtttgcttgctggtgatcaattcaactatcagttttattgaagaaaacaatgctggcaatgctgccgcagctcttatggctggtcttgctcccaaaaccaaggttcttagagatgggcgctggagtgaacaggaagctgctattctagtgcctggtgatattataagtgtcaagttgggagacattgttcctgctgatgctcgtcttcttgaaggtgatcctttaaagattgatcaatctgcccttacaggagaatctcttcctgtgacaaagaatcctggagatgaagttttctctggatcaacctgcaaacaaggtgagcttgaagctgtagtcattgccactggagttcacactttctttggcaaggcagcacaccttgttgacagtacaaacaatgttggtcatttccagaaagtgttaacagccataggaaacttctgtatctgttccattgctattggtatgctggttgagattattgtcatgtatccaatccagcacaggaagtacagggatggaattgacaatctcttggtgctccttattggtggtattcccattgctatgcctactgtgttgtcagtcactatggctattggatcccataggctctcccagcagggtgccatcaccaagagaatgactgctattgaagaaatggctggaatggatgtgttgtgcagtgacaagacaggtaccttgactcttaacaagttgagtgtcgacagaagcttggttgaagtgtttactaagggagtagataaagaatatgtgctcctccttgccgcaagggcctctagagttgaaaatcaggatgcaattgatgcttgcatggttggcatgcttgccgatccaaaagaggcacgagctggtatcagggaggtgcatttcttgcccttcaatccagtggacaagagaactgctttaacatatattgacagcaatggcaactggcaccgtgccagcaagggagctcctgagcagattttggacctatgtaactgtaaggaagatgtcaggagaaaggttcattcaatgatcgataaatacgctgagcgtgggttgaggtcactggctgtagctagacaggaagtgccagagaaatcaaaagagagcgctggaggtccatggcaatttgttggattgctacccctctttgatcctcccaggcatgatagtgctgagaccatccgtagagctctcaaccttggtgtaaatgttaagatgatcactggggatcaattggctattgccaaggagactggccgtaggcttggaatgggaacaaacatgtacccatcagcatctttacttggtcaagacaaggattcatctattgcttcacttcctgtagaagagttgattgagaaggcagatggatttgctggagtatttcctgagcacaaatatgagattgtgaagaagttgcaggagagaaagcacattgtgggaatgactggtgatggtgtgaacgatgctcctgctttgaagaaggcagatatcggtatcgctgttgcagatgctactgatgcagcacgaggtgcttctgatattgtgctcactgagccaggtctaagcgttatcatcagtgctgtgttgaccagtagagctattttccagaggatgaagaattacacaatatatgcagtttccatcacaatccgtattgtgtttggtttcatgcttattgctctaatctggaagtacgacttctctgcatttatggttttgatcattgccatcctaaatgacggaaccattatgacaatctcaaaggatagagtgaaaccatctccaatgcctgatagctggaagttgaatgaaatctttgcaactggtgttgttcttggagggtaccaagcattgatgactgttgttttcttctgggcgatgcatgacactagtttcttcacggacaaatttggtgtgaaggatattagggaaagtgatgaagaaatgatgtctgctttgtaccttcaagtgagtattatcagccaggctttgattttcgtgacccgttcacgaagctggtccttcgttgaacgcccaggagctttgttaatgattgctttcttgattgcccaattggttgccactttaattgctgtctatgccgactggacttttgcaagagtcaaaggatgtggatggggatgggctggtgtcatctggattttcagcattgttacctacttcccacttgacataatgaaattcgccatccgttacatcttaagtggaaaggcttggaataacttgcttgacaacaagactgctttcaccacaaagaaagactatggaaaagaagaaagggaagctcaatgggcacttgctcagagaactttacatggacttcaaccaccagaagcatcaaacctgttcaacgaaaagaacagctaccgggaactgtctgaaattgctgaacaagcaaagagaagagcagagatggcaaggcttcgtgagctgcacacactcaagggtcatgttgaatcagtggtgaagctgaaaggtctggatatcgaaacgatccagcagcattatacagtttaagaaagataatcatgatacacacaagaaaagggaatggcaggctctgatatatctcatgttaattattaattagagaagaagagagagacaagcttttggccttaaccacataaacaaaaaaacattgtcttttaatataaagggggaaaacattgtcttgtgttatctttcccccctctcatctattttctttaacttcgttatgttatattttgaagcaccacccattgaaagggattgtgtccatgttttttccaaaattttaatggtgaagtgacatttccttgtaacaacagtttttcttacaatttcttcacctctttttttctttcttcatttgatgttgacgataacgtctctctctctctgcttttttgcacattcactgttgtatgtgacccttgatgaaaataatattactcaaacactgaatttctttttctcttctaa

SEQ ID NO: 2214 - DNA, 3605 bp, Phaseolus vulgaris
aagggagcactgtgagaggttcacggcttccactttcacatcaccaaacaaactcatctcttcacaaactcctcttctccttcaatctctttccttctgcttcctttttcccctctctgcatttattttcttttggacttttccactcatgcaccctccaaacccctctatttaaccctctctttctcctacacccttcatctccctcataattccacacactcattatacatactaatacccttcttcttcttcatcttcttcctcatcttcttcctcatatccaacatccaacatgggtggcatcagcctcgaagagataaaaaacgagaacgtcgatctggaacgcattcccatagaggaagtgtttgagcagctgaaatgttcaagagcaggtctaacatcagacgaaggggccaacaggctccaagtctttggaccaaacaaattggaagagaaaaaggagagcaagtttttgaagttcttgggctttatgtggaaccctttgtcttgggtcatggaagctgctgctatcatggccattgctttggcaaatggaggaggaagaccaccagattggcaagattttgtgggaatcattgctctgctagtgataaactccacaatcagttttattgaggaaaacaatgctggaaatgctgctgctgctcttatggctggtttagctcccaagactaaggtactaagggatgggcgatggagtgaacaagatgctgcaattttagtaccaggagacataatcagcatcaagttaggagatatcattccggctgatgctcgtcttcttgagggtgatcctctgagtgttgatcagtctgctttgacaggagaatctcttccagtgacaaagagttcctcagatgaagtgttttcgggatcaacggttaagaagggagagatagaagctgttgtgattgccactggagtgcacaccttttttggcaaagcagcacatctagtggacagcaccaaccaagttggacactttcagaaagtactcacagcaattggtaacttctgcatttgctcaattgctattggaatcgccatcgagctcatagtcatgtacccaattcaacaccgaaagtacagggatggaattgacaatctgttagtgctcttgattggaggaatccccattgccatgccaacagtgttgtctgtcactatggctattggttctcacaggctttctcagcagggtgccatcacaaaaagaatgacggctattgaggaaatggcagggatggatgtcctatgcagtgacaaaactgggactctcactttgaataagttgagtgttgatagaaacttgattgaggtgtttgccaagggtgttgagaaagagtatgttatccttctggcagccagagcttccaggactgaaaatcaggatgccattgatgctgcaattgttggcatgcttgctgacccaaaggaggcacgtagtggtattagagaggtacatttccttccattcaatcctgtagacaagaggactgcacttacctacattgattctgatggaaattggcatagatctagcaaaggggctcctgagcagataatcactctttgcaactgcaaagaggatgtcagaaaaaaggttcatgcagtaattgataagtttgctgagcgtggacttcgatctttaggtgttgcaagacaggaagtacctgaaaaatcaaaagatggtgctggtggaccatggcaatttgttggtctgctaccattgtttgatcctcccagacatgatagtgctgaaaccattagaagagctctaaatcttggtgtgaatgttaagatgattactggggatcagcttgccattggaaaggaaacgggtcgaaggctcggaatgggaacaaacatgtatccttcatctgcattgcttggccaagacaaggatgcttctatttcagctcttccagttgatgagttgattgagaaggctgatggatttgcaggagtatttcctgagcacaaatatgaaattgttaagcggctgcaagagaggaagcatatatgtggaatgacaggtgatggtgtaaacgatgcccctgcattaaagaaagcagatattggaattgctgttgctgatgccacagatgctgctagaagtgcttctgatattgtccttactgaacctggtctaagtgtcattattagtgcagtgctgactagcagggcaattttccagaggatgaagaactatactatctatgctgtgtcaatcaccatccgtattgtgtttggtttcttgtttattgcgttgatctggaagtttgattttgcacccttcatggttttgattattgccatactaaatgatggtaccattatgaccatatcaaaggatagagtgaaaccatctccacttcctgatagctggaaattgagggagatattcgctactggcgttgtgctaggcagctacatggctctaatgacagtgatatttttttgggcaatgaaagataccaacttcttctcgaacaagtttggtgtgaggtcactgagacttagtcctgaggaaatgatggcagccttatacctacaagtcagtataataagtcaggctctaatctttgtcacaaggtcccgcagttggtcttttgctgaaaggccgggtcttctcctactaggagcttttctgattgctcagttggtagcaacttttatagcagtatatgctaactggggctttgcaagaataaagggaatgggatggggttgggctggtgtaatctggctttacagtgtggtaacctatatccctcttgatattctcaaatttgcaatccgctatatactaagtgggaaggcttgggacaatcttttggagaacaagactgctttcaccacaaagaaagactacggcaaagaagagagggaagctcaatgggcggctgcacagaggacacttcatggtcttcagccaccggaaacttccaaccttttcaatgacaagaatagctacagggagctttcagagattgcagaacaagccaaaagacgagctgaagttgcaaggcttagggagcttcatactctaaagggacacgttgagtcagtggtgaagttgaaggggcttgacattgacacaattcagcagcactatacagtttaaggagcttggacaagcttcaagaagaatcgattcagtgctttttttgagaacaaaatcacatataatgacgaagaaaggctcaaagaccatgctcaatccatcttttaagttacataagaaaatgagtcctgtgcaaatttgaatggtctctctcactgtctccatcttttctaggagatactatgttctttacgtatcaaataacataattggtagggtttactatcatctttttacctagtggtatgctagtgttattgtttactaagatcatactaaaagctctatacattggtattgatacctttgctcaataagtcaatatcaaactcaatccaaatatgtgttttcctctggctaacatagtttgagtatgagatagttacccctttttactatgttatgttatttccaggtagtcttcgtcttctaaaagtgatttaaattggaattg

SEQ ID NO: 2215 - DNA, 3350 bp, Arabidopsis thaliana
gttatttttaccttttactcttcttgttctttaagacaattcaaaagagaataaggagagttttaattttctgtctaaagaagccgagcttcgtgaaaattgttgtttctcatcattgtgattcatcatggctgctgatatctcatgggatgaaataaagaaggagaatgttgatcttgagaaaattccggtggacgaagtgttccaacagctgaaatgttcccgggaaggtttgtcttcagaggaaggaagaaacagactacaaatatttggggcaaacaaactagaagagaaggtagagaacaaatttctaaagttcttagggtttatgtggaaccctctttcatgggtgatggaagctgccgcaatcatggccattgtgttggcaaatggcggtgggaggccaccggattggcaagactttgttggaatcacatgtttgctcatcattaactcgacaatcagtttcatcgaggagaacaatgccggtaatgcagctgcagctctcatggccaatcttgcaccaaaaacaaaggtattaagggatgggagatggggagagcaagaagctgcgattctagttccaggtgacttaatcagcatcaagttaggtgacattgttcccgcggatgctcgtctcctagaaggtgatcctctgaagatcgaccaatctgctcttaccggtgaatctctcccagctactaaacaccagggagacgaggttttttctggctccacttgtaaacaaggtgagatcgaggctgttgtcattgcaaccggagtgcataccttctttggcaaggcagctcatcttgttgatagtactaacaatgttggccatttccaaaaggtcttaaccgccattggtaacttctgtatctgttcaatcggaataggaatgttgattgagataattataatgtatccgatccaacatcgaaagtatagagatggaatcgacaatcttcttgtccttctcattggaggaatcccaatcgctatgcccactgtgttgtctgtcacaatggctattggatcacataggttgtctcaacaaggtgccatcacaaaacgaatgaccgccatcgaagaaatggctggtatggatgttctttgcagcgataaaactggaactctaactctcaacaaacttacagttgacaagaacttgattgaggtattctccaaagacgtagacaaggactatgtgatactactttcagctagggcttcaagagtagagaaccaagatgcgattgatacttccattgttaacatgttgggtgacccaaaagaggcaagagctggaataactgaagtgcatttcttgccattcaatccagtagaaaagcgaaccgcgatcacttacatcgataccaatggagagtggcatagatgtagcaaaggtgctcctgagcagataattgaactctgtgatctcaaaggagaaacaaagagaagagcacatgagataattgacaagtttgctgagcgtggtctacgttcactcggggttgcacgtcagagagttcctgagaaggacaaagaaagcgccggaacaccgtgggagtttgttggtcttttgccactctttgaccctccaagacatgacagtgcagagaccattagaagagctcttgatcttggtgtgaatgttaaaatgatcactggagatcaattggctattggtaaagagacaggtcgtaggcttggaatgggaacaaacatgtatccttcctcttctttacttgaaaacaaagatgacaccaccggaggagttcctgtcgatgagctcattgagaaggccgatggattcgctggagtctttcctgagcacaagtatgagattgtaaggaaactccaagaaaggaaacatattgttggtatgaccggagatggtgtcaacgatgccccagcgctgaaaaaggcagatattggtatagcagtcgatgatgcaactgatgcagcaagaagtgcctcagatatagtcttgacagagccaggtcttagtgtcattgtcagcgctgtgctcaccagtcgagctatctttcaaagaatgaagaactacacaatctacgcagtctccatcacaatccgtatagtcctcggcttcatgcttgtggctcttatttgggaatttgacttttctcccttcatggtcctcattattgcaatcctaaacgacggaaccatcatgaccatttccaaagatagagtcaagccttccccaattcctgattcatggaagcttaaagagattttcgctactggagttgttcttggaacctacatggctctcgtcactgttgtcttcttctggctagcccatgacacaaccttcttctcggataaatttggagtaaggtcgttacaaggcaaagacgaggaattaatagcagtattgtatttgcaagtcagtataattagtcaggctctcatctttgtcactcgatcaaggagctggtcctttgtcgaacgcccgggacttcttcttcttattgctttctttgttgcccaattgattgcaaccttaatagctacttatgcgcattgggaatttgcgagaatcaaaggttgtggatggggatggtgtggagtcatctggatctacagtatcgtcacatacattcctcttgatatcctcaagtttatcactcgctatacccttagtggcaaagcttggaacaacatgattgaaaataggactgcattcacgaccaagaaagactacggtaggggagaaagggaggctcaatgggctctagctcaacgtacgctccatggacttaaaccgccggagtcaatgttcgaagacacggcaacctacaccgagctctctgagatcgctgaacaggctaagaaacgtgcagaagttgctaggctaagagaagtgcacactctcaaaggccacgttgagtcggtagtgaagctcaagggtcttgacattgataatcttaaccaacactacaccgtctaagccaaactactatgacatttcaattattcgaatgggacacatgacaacgttctaagcaataaaagttggagaaaatggaatcataaagataaaaagaagaaaaagaaagttccggtttggattctccttcggttttgatttcgtttttcttggtaaaaacatgatataatcagcggaatgctgcaaaaaaaaagcaaaaaagaataagaagaagatggtaggatgaatgaatgagatggaataaaggacaagaagagacatgtcgtcatgtgatacactcgtattcattacttactattagtaatcccatattttttggttataagctttttctctatgttctttcttttttatgagaaattgaatttgataa

SEQ ID NO: 2216 - DNA, 3204 bp, Aquilegia formosa
aataaattgcttattatcattgtcaatggaggcctgaagggggtaggcaaataaaaaaataaattgagtaacttttagaataaaaagagagatttgctctctcttccaatttgccattggtttgtgaagtctgagctttcacaatggcaaccaaggaaattaacttggaagagatcaagaatgagaatgtcgatctcgagaggattccaatcgaggaggtattcgagcaactcaaatgtacaaaagagggtttgacatcagctgaaggggagcaaaggctcgaaatcttcggccccaacaagctagaagagaaaaaggagagcaaacttctcaagttcttaggttttatgtggaatcctttatcatgggtcatggaagctgcagctattatggctatagctttagcaaatggagggggcaaacctccagattggcaagatttcattggtatctctgttttgcttgtcatcaactccacaatcagtttcattgaagaaaacaatgctggtaatgcagcagctgctttgatggcaggtcttgctcccaagactaaggttattagagatggaaaatggagtgagcaagaagcagccatattggttccaggagatgtgataagcattaagttgggagatatcgtccccgctgatgctaggttgcttgaaggagatcctcttaagattgatcaatcagctcttactggtgaatctttacctgttaccaagcacccaggtgatgaagtcttctctggatcaacttgcaaacaaggagaaattgaggctgtggttattgccactggtgttcacactttctttggaaaggctgctcatcttgttgacagcaccaaccaagttggtcatttccaaaaggtgttgacagccattggtaacttctgcatttgttcaattggagtgggaatgttgattgaagttgttgtgatgtacggcatccagcaccgtaggtacagagaaggaattgataatctcttggtacttctcattggaggaattccaattgccatgccaacagttttgtctgtgactatggctattgggtctcaccgcctatcggaacaaggtgccatcactaagagaatgactgctattgaagaaatggctggtatggatgtcctttgcagtgacaagactggaaccttgacactcaacaagctcacagttgacaaaaacatgattgaagtttttgtcaaggacatggataaggacacagtggtcttgaccgctgccagggcatctagagttgagaatcaagatgccatagatgcctcgattgttaacatgttggctgatcctaaggaggcaagagcaggaatcactgaggtgcatttcctaccctttaaccccgttgacaagcgtacagccatcacctactatgacactgaaggaaattggcacagagccagcaagggtgcacctgaacagatcattgagctttgcaatctcaccggtgacgcgatgaacagagttcatgctattattgacaagtatgcagatcgtggccttcgttccctaggtgttgccagacagacagtacctgaaaagaccaaggaaagtgcaggagcaccatgggagtttgttgctttgttgcctctctttgaccctccaagacatgatagtgcagaaactattcgccgagctctcaaccttggcgttaacgtcaagatgattactggtgaccaacttgccattggcaaagaaaccggccgtcgtcttggcatgggaaccaacatgtacccctcatcctccctcttgggccaaagcaaggatgaatctatcgcttcaatccctgttgatgagcttattgaaaaggctgatggctttgctggagtctttccagagcacaagtatgaaattgtgaagaaactgcaagagaggaaacacatctgcggtatgactggagatggagtaaacgacgcaccggcattaaagagagctgacattggtatagcagtcgcagatgcaactgacgcagctcgaggtgcatcagatatagtgttgacagagccaggattgagtgttatcataagcgcagttctgacaagtagagccatcttccagaggatgaagaattataccatctatgcagtttcaatcaccatccgaattgtcttaggcttcatgctcattgcccttatctggaaattcgacttctccccattcatggtcttgattgttgctatcctcaatgatggaactatcatgaccatctccaaggatagagtgaagccatctccaatgcccgactcatggaaactaaatgaaatcttcgccacaggagttgttcttggtacctatctagctatcatgacagtcgttttcttctggattattcatgatacagatttcttctcgacccacttcggagtacactcaatcagaaataactatgatgagctcactgctgctctgtaccttcaagtgagcattgtaagtcaggcacttatctttgtgactcgatcacgaagttggtcctttgttgaacgccccggtatcttgcttgttgctgccttccttgctgctcaactggtggccacagtcatcgctgtgtatgcaagctggggctttgcaaggattcaaggtatcggatggggatgggcaggagttatttggctatacagcattgtcttctacttccctctggatctcctgaaattcggtatccgatacagtttgagtggaaaggcatgggacactttgcttcaaaacaagaccgctttcacgaccaagaaggatttcggtagggaagaaagagaagcacaatgggcaatggctcagcgtactttgcatggtctccagcatccagaggcatcatcaacacttttcagtggtgacaacaagaatgaatctgagattgctgatcaggctaaaagacgtgcggaggttgcaaggctgagggaagtcctcacattgaaggctcatgtcgagtcagtggtgaagaagaagggactggacattgacaccatccaacaacattacactgtgtaagattatactcaagaaagctaatgcaaggagtatgaagatacaaggggaacaaccaagaaagatggagcagaagaaaatgctgattgttctctgatggaatttctactttttactttgtattttcatttgtttgaaaatgagttgtagatggtcatggataccaaaaattcgggatggactagcttagagagggttatttaaa

SEQ ID NO: 2217 - DNA, 3098 bp, Capsicum annuum
tcaaaacctctgttcatcccttccgccgttgccccgtcctaacccccaaatctcattttcggatctctctttctcgagaattctactgttcaatgaatctcatccttcatactcactgaatcaatcttttcttttcctgttgctgtttgttttggtttgatttttccgtggagcagcgatggcaaaatctatcagcctcgaagagataaaaaatgagactgttgatctggagaaaatccccattgaagaagtattcgaacaactgaaatgtacgcgggagggtctgagttcggacgaaggagcgaacaggcttcaaatctttggaccgaacaagttggaagagaaaaaggaaagcaaaatactaaagttcctgggctttatgtggaatcctctgtcatgggttatggaagctgcggctatcatggcaattgcactagctaatggagatggaaagcccccagattggcaagactttgttggtattgtttgcttgctggtgatcaattcaactatcagttttattgaagaaaacaatgctggaaatgctgctgcagctcttatggctggacttgctcccaaaaccaaggtacttagagatggtcgctggagtgaacaggaagccgctattctggtgccaggggatattataagtgtcaaactgggagacatcgttcctgctgatgctcgtcttcttgaaggtgatcctttaaagattgatcaatctgcccttacaggagaatctcttcctgtgacaaagaatcctggggatgaagttttctctggatcaacctgcaaacaaggtgaacttgaagctgtagttattgccactggagttcataccttctttggcaaggcagcacaccttgttgacagcaccaacaatgtcggccatttccagaaagtgctaactgccataggaaacttctgtatctgttcaattgctgttggtatggtggttgagattattgtcatgtacccaatccagcacaggaagtacagggatggaattgacaatctcttggtgctccttattggaggtattcccattgctatgccgactgtgttgtctgtcactatggctattggatcccataggctctcccagcagggtgccatcaccaagagaatgactgctattgaggaaatggctggaatggatgtgctgtgcagtgacaagacaggtaccttgactcttaacaagttgagcgttgacagaaccttggtcgaggtgtttgcaaagggggtcgataaagagtacgtgctcctccttgctgcaagggcctctagagtggaaaatcaggatgcaattgatgcttgcatggttagcatgcttgccgatccaaaagaggcacgagctggtatcagggaggtgcatttcttgcccttcaatccagtggacaagagaactgctttaacatatattgagaacaatggcaactggcatcgtgccagcaagggggctcctgagcaaattttggacctatgtaactgcaaggaagatgtcaagagaaaggttcatgcaataattgataaatacgccgagcgtgggttgaggtcattggctgtggctagacaggaagtgccagagaaatcgaaagagagtcctggagggccatggcaatttgttggattgctgcccctctttgatcctcccaggcatgatagcgctgagaccatccgtagagctctcaaccttggtgtaaatgttaagatgatcactggagatcaattggctattgctaaggagactgggcgtaggcttggaatgggaacaaatatgtacccatcggcatctttgcttggtcaagacaaggattcatccattgcttcacttcctgtagaagagttgatcgagaaggctgatggatttgctggggtgtttcctgagcacaaatatgaaattgtgaagaagttgcaggagagaaagcacattgtgggaatgaccggtgatggtgtgaacgatgctcctgctttgaagaaggcagatattggaattgctgttgcagatgctactgatgccgcacgaggtgcttctgacattgttctcactgaaccaggtctaagtgttatcatcagtgctgtcttgaccagtagagctattttccagaggatgaagaattacacaatatatgcggtttccatcacaatccgtattgtgtttggtttcatgcttattgccctgatatggaagtacgacttctctgcatttatggttttgatcattgccatcctgaacgacggaaccatcatgacaatctcaaaggatagagtgaaaccatctccaatgcctgatagctggaagttgaatgaaatcttttcaaccggtgttgttcttggaggttaccaagcactgatgaccgtagttttcttttgggccatgcatgacactgatttcttctcggacaaatttggtgtgaagaatattagggaaagcgatgatgaaatgatgtctgctctgtacctgcaagtgagtattatcagccaggctttgatttttgtgacccgttcacgcagctggtcgtttgttgaacgcccaggagctctgttaatgattgctttcctgatcgcccagctggttgccactttaattgctgtatatgccgactggggttttgcaagagtcaaaggatgtgggtggggatgggctggtgtcatctggctttacagcattgttacttacttcccacttgacttaatgaaatttgccatccgctacatcttaagtggaaaggcttggaataacttgcttgataacaagactgctttcaccaccaagaaagactacggaaaagaagagagggaagctcaatgggcacttgctcagagaactttacatggacttcaaccacccgaagcctcaaatctcttcaacgaaaagaacagttaccgggaactgactgaaattgctgaacaagcaaagaggagagcagagatggccaggcttcgcgagctgcacacgctcaagggtcatgttgaatcagtggtgaagctgaaagggctggatatcgaaacgatccagcagcattatacagtttgagaaacttgatcaaatttacaccatgttaattagagaacaaagacaagcttttggccttaac

SEQ ID NO: 2218 - DNA, 2887 bp, Cucumis sativus
ttggttgttcttttgggtcagccatgggtgacatttcattggaagatgtcaagaatgagaacattgatctagaacgaattccggttgaggaagtttttgagcaactaaaatgcacaaaagaaggattgagtacagcagaaggagaaaaaagactccaaatttttggcccaaacaagcttgaagagaaaaaagagagcaaacttttgaagtttttggggtttatgtggaaccctctctcatgggtcatggaatgtgccgcaatcatggccatcgttctggccaatggagggggtaaaccaccagattggcaagattttgttggtatcattgtcttgttgatcatcaattctaccattagtttcattgaagaaaacaatgctggaaatgcagctgctgctctcatggctggtcttgcacccaaaaccaaggttctaagagatggaaagtggaaagaagaagaggcagcaattctggttccaggagatgtgattagtgtcaaactgggagatattatcccagctgatgcacgtctcctagaaggtgatcctcttaagattgatcaatctgcccttacaggtgaatctttgcctgtcaccaaacatcctggtgatgaagtgttttctggttctacctgcaagcaaggtgagattgaggccgttgttattgcaactggtgtgcatactttctttggaaaggcagcccaccttgtggacagcaccaaccaagttggccatttccaaaaggtgttgacagccatcggaaacttctgtatatgctccattgctgtgggaatggtcattgagatcttggtgatgtatccaattcagcatagggcatatagagagggaattgacaacttgttggtgcttctcattggaggtattcccattgcgatgccaaccgtactgtcagtaaccatggccatcggatcgcatcgcctatcacagcaaggtgccattaccaagaggatgacagccattgaagagatggctgggatggatgttctttgcagtgacaagactggaactctcaccctcaataagctcacagtagacaaatccttgattgaggtttttgtgccaaacatggacaaagacactgttatgttgtttgctgcaagagcttccagagttgaaaatcaagatgctattgatgcttgcattgttggaatgttgggtgaccctaaagaggcaagagcaggaataactgaggtacattttttgcctttcaatcccgtcgaaaaacgtactgccattacctacattgatggagatggtaactggcatagaagcagcaagggtgctcctgaacagataattgatctttgtgagcttaaaggagaaataagaaggaaggctcatgaaattattgataactatgctaaccgtggtcttcgatccttggcagtcggtcgacagactgttaaagataaagacaaagagagtgctggagaaccatgggagtttgttggtctcttgccgctatttgatcctccaaggcatgacagtgcagaaaccattcgtcgagctcttgaactcggtgttaatgttaagatgattactggtgaccaacttgctataggaaaagaaactggtcgaaggcttggaatgggcaccaacatgtatccatcatcgtctttgcttggccaaagcaaagatgagtcaattgcttccattcctgttgatgaactcattgagaaggctgatgggtttgcaggagtatttccggaacacaagtatgagattgtcaagaaacttcaagagaggaatcatatttgtggcatgacaggagacggtgtcaatgatgctcctgctctcaagaaggccgatatcggaattgctgtggccgatgcaaccgatgcagcaagaagtgcatcagatattgttttgacagagccagggctaagcgtgattgtgagtgctgtattgactagtagggccattttccagagaatgaagaactacactatatatgcagtttccattacaatccgtattgttttgggattcatgcttgtggctctcatttggaagttcgatttctcgccttttatggtcttgatcattgccatcctaaacgatggaaccatcatgaccatttcaaaggatagggtcaagccatcacctgtgccagactcgtggaaactcaaagaaattttcgctactggtgttgtcctaggaacatacatggcccttatgaccgtagttttcttttggctcgccaatgaaaccaacttcttcacgaatacatttggtgtaaaaccactcaaagatcttgctgagatcaattctgctctctatcttcaagttagcatcatcagtcaagctctcatctttgtcaccaggtcaagaagttggtcttttgttgaatgccctggtttcttgctagttattgctttcattgctgctcagttggttgccactttaattgctgtatattctgagtggaactttgcaaggatcaaaggtattggatggggatgggcaggagctatctgggtattcagtatcgttacttacttcccacttgatgttctcaaattcgccattcgttacggtctaagtggaaaggcttgggacaacatgcttgagaataagacggcgtttacgactaaaaaagactacggaaaaggcgaaagagaggcacaatgggcgatagcgcaacgtacaatgcacggtctacaaccaccagaaaccatattccatgaaaagagtaactacgaagacctttcagagattgcagaacaagccaaaaaaagggctgaagttgctaggttgagggagcttcacactctaaagggccatgtggagtcagtagtgaagttgaagggattggacattgaaaccatccaacaacactacactgtttaacttgcaatggagaggac

SEQ ID NO: 2219 - DNA, 2837 bp, Flaveria ramosissima
tcatcatcacattcatgttcatctcccttcagtaaccttcatcactccaatcgaatcaaacgccattgatcttcctctttagtcgttgccgttgaagatgggaggagataccgctctcagcctcgaaggaatcaaaaatgaaaccgtcgatctggaaaaagtaccaattgaagaagtgtttgagcagctgaaatgtaaccgtgaaggtctgagctccgatgaaggagcccaacggcttgaaatattcggacccaacaaactggaggagaaaaaggaaagcaaaatcctcaagtttcttgggttcatgtggaaccccctatcatgggtcatggaggctgcagccataatggcgattgcacttgctaatggtggcggaaagccaccagattggcaagactttgttggtattgtttgcctgcttgttatcaactccaccatcagtttcattgaggaaaacaatgctggaaatgctgctgctgcacttatggcaggtcttgcacctaaaaccaaggttctgagggatggtcgttggagtgaacaagaagctgctatattggttcctggagatattattagcatcaaacttggtgatattgtacctgcagatgcccggcttcttgaaggtgatcctttaaagattgaccaatctgctcttactggtgaatctctccctgtcaccaagaacccatacgatgaagtgttctccggttcgacttgcaagcaaggtgaaattgaagcagttgttattgctactggagtccataccttttttgggaaggctgcacatcttgtggatagcactaaccaagttggacatttccagaaggttctaacggctatcggaaacttctgtatttgctccattgctgttggaatggttgttgagattatagttatgtacccgatccaacacagagcgtacagaagtggaattgacaatcttttagtgttgcttattggtggtattccaattgctatgcctactgttctttcagttacaatggctattggatcacacaggctttctcagcaaggtgctatcaccaaaagaatgactgccattgaagaaatggcgggaatggatgttctttgtagtgacaagacaggaactttgactctaaacaaactaacggttgacaaaaatttgatcgaggtgtttggcaaaggtttggataaggaacaagtgttgctttatgctgctagagcttctagaatggaaaaccaagatgctattgatgcagccattgttggaacccttgctgaccccaaagaggcacgggctggcatccgagaggtccatttcttcccattcaatcctgtggataagaggactgctttgacttacattgataataatggcaactggtttagagctagcaaaggtgcaccagaacagattttgaccctttgcggatgcaaggaagatctcaagaagaaagttcacgcaatgatcgataaattcgcagaacgtgggctaagatctttgggtgttgcaagacaggaagtgcctcaaaaatcgaaagatagcccaggtggtccatgggaatttgttggattgttgtctctctttgatccaccaagacatgacagtgctgaaaccattagaagagctctccatcttggtgtaaatgtcaagatgattactggtgatcaacttgctatcgctaaggaaactggtagacgacttggtatgggaacaaacatgtacccttcttcttctttacttggtggacacaaggacgaatcaattgctgcacttcctattgatgagttgatcgagaaagctgatggatttgctggagttttccctgagcacaagtatgagattgtgaagaaattgcaagagagaaagcacatttgtgggatgactggagatggtgtgaatgatgcacctgctttaaagaaggccgatattggaatcgcggttgctgatgctacagatgctgcaagaagtgcttctgacattgtgcttactgagcctgggctcagtgtcatcattagtgccgtgcttaccagtagagctatattccaaagaatgaaaaactacacgatctatgcagtgtctatcaccattcgtattgtgtttggattcatgttcattgctttgatttggaaatttgacttctcccccttcatggttcttattattgcaatccttaatgatggtaccatcatgacaatctcaaaggatagggtgaaaccatctccattaccagacagctggaagctaaaagagatcttcgccacgggaattgttcttggaggttacttagctctaatgacagttatcttcttctggatcatgaaggataccgactttttcacagaaaaatttagtgtgaaatctctgaggacaagtgacaccgagatgatggctgctttatatttgcaagtcagcattgtgagccaagctcttatctttgttactcgatctcgtagctggtcgtttgttgaacgaccagggttcttattaatgggcgctttcctagcagcacaactggtggcaactttaatagcagtatacgccgagtgggaattcgcaagaatcaaaggaatcggttggaaatgggctggtgtcatctggctttacagtatagtgttctatttccctcttgatatcatgaagtttgccatccgatacatcctaagcggaaaggcttggctcagcatgatcgacaacaggactgctttcacaacaaagaaggattatggtagaggagagagagaggcccaatgggctcatgctcagaggactttacatgggcttcaagcacctgatacctcaaatctcttcaatgagaagagcagctacagagaattgtctgaaatcgccgaac

SEQ ID NO: 2220 - DNA, 3170 bp, Populus trichocarpa
agctagaacaccaagaaattataacaaagcttaaggttcttggtttgatctttcaccatggaagatataaagaatgagagtattgatcttgagaaaattcctattgaagaagtgtttgaaaagctaaaatgtacgaaagaggggttgaggacaacagaaggtgaagagaggcttaggatctttggccccaacaagcttgaggagaaaaaggagagcaaaatcctcaagttcttgggctttatgtggaatcctttgtcgtgggtcatggaggcagctgccattatggccattgttttggctaatggaggaggcaagccaccggattggcaagactttgttggtatcattgtgttgcttatcatcaattccaccatcagcttcattgaagaaaacaatgcgggtaacgccgccgcctctttgatggctggtcttgctcctaaaaccaaggttttgagggatggaaaatggagtgagcaagatgcagcaattttggtaccaggagatataattagcatcaagttgggagatattatcccagctgatgctcgtctcatggtaggtgatccgctcaagatcgatcagtctgccttaactggtgagtcccttccagtcacaaagtatcccggcagcggggtttactcaggatcaacctgtaagcaaggtgagattgaggctgttgttattgcgacgggtgttcataccttcttcggcaaggcagctcaccttgtagacagcaccaataacgtcggtcatttccaaaaggtgttgactgctattggtaacttctgtatctgctcaattgcaattggtatgctgattgagatcatagtgatgtacccaatccaacacaggaggtacagagatggcattgacaacctcttggtgcttctcattggaggtatccctattgccatgcccacagtcttgtcagtgacaatggctattggatctcaccgcctatcacagcaaggtgccatcaccaagaggatgactgccattgaagaaatggctggaatggatgtcttgtgcagtgacaagactggaactctcacccttaacaagcttactgttgacaagactctcattgaggtgtttgtgaaggacatggacaaggacactcttatattacacgctgccagggcttctagaaccgagaaccaggatgccattgatgcttcaatagttgggatgttgggagatcccagtgaggcaagatcaggaatcatagaggtgcatttcttgcccttcaaccctgtcgaaaagcgcactgcaatcacctactttgatggaaatggtgattggtatagaagcagcaagggagctcccgagcagattattgagctctgtgaactcaaggggaatattaggaaaaaggctcatgaaatcatcaacaactttgctgaccgtggccttcgttccctgggagttgctcgtcatagaataccagagaagaacaaggaaagtgcaggagcaccatgggagtttgtgggtctcttgcctctttttgaccctccaaggcatgatagtgctgagactatccgccgagcacttgaccttggtgtcaatgttaagatgatcactggtgaccaacttgcaattggcaaagagactggccgcaggcttggcatgggtaccaacatgtatccttcatcatccctccttggtgataacaaagatgaatcaattgcgtccgttccagttgatgagctcattgagaaagctgatgggtttgctggcgtcttcccggagcacaaatatgagattgttaagaagctccaagagaggaagcacatttgtggaatgacaggtgatggtgttaatgatgcgccggcattgaagaaggcggacattggtattgccgtggcagatgcaactgatgctgccaggagtgcctcagacattgttttgacagaaccaggattgagtgtgattatcagtgctgtgctgacaagcagagccatcttccaacggatgaagaactacacaatctatgctgtttccatcacaattcgtattgtgttgggattcttgcttgttgcacttatctggaagtttgacttctctccattcatggtcctcatcattgccatcctcaatgatggaaccattatgaccatctccaaggatagagtcaagccatctcctgtccctgactcctggaagcttaaggaaatttttgccatgggcgttgtccttggaacctacttggcaattataaccgtgctgttcttctggcttgctcatggcactgacttcttctccgataagttcggcgtgaggtcaatcagaggtaaaccagatgagcttacagcagctctctaccttcaagtgagcatcatcagtcaagcactcatatttgtgaccaggtcaaggagctggtccttcactgaacgccctggtctcttgcttgtcggtgccttccttgcagcgcaattggtggcaactgtcattgctgtgtatgcaaactggggatttgcaagaatccaaggcatcggttggggatgggcaggaataatctggattttcagcattatcacctacatccctcttgacatcctcaagttcatcacccgctatgcattgaccgggaaggcttgggataatctgctagaaaacaagactgctttcactaccaagaaggattatggaaagggtgaaagggaggctcaatgggctacagctcagcgcacgcttcatggtctccagtccccagaaaccatgaaaaatgacaaggccagctatagggagttgagtgagctcgctgagcaggcaaagaggcgtgccgaagtagcaaggctaagagagattcacacattgaagggccatgttgagtcagtggttaaaatgaaggggcttgatattgagaccatccaacaacactacacagtctaaagaaattaaagagtttctattaagaatcatatgcaagtaagatagagacatagttgaaagaaaacaaagcagctaacttgaagctgctttttctgttccctgatcatctgttcatttattaatattgttattatttttagcttaaatcataggaggaatattcaaaagggtgagattctatagttgccttttgaaaattacagaatactagtggagaactggtatatagaatgaaggactgcaggggctaatatgctatgtatgtccttgattaggat

SEQ ID NO: 2221 - DNA, 3668 bp, Glycine max
agcacccagagaggttcacggcttcactttcacatcaccaaacacctctctcaaggctagctagcttcaatctctttccttctgcttctttttcctctcctcactgcatttattttcttttggacttttccactcatgcaccctcttatcccctctatttaaccctctctatcttcttctcctcacataattcacacacactcattattactatacacaccctctttctcctcctcctccttcttcttcttctccttctttctctttttcattctttctttcaacatgggtggcatcagcctcgaagaaataaaaaacgagaacgtcgatctggaacggattccaatagaggaagtgtttgagcagctgaaatgttcaagagcaggtctaacatcagaggaaggggccaatcggctccaagtctttggaccaaacaaattggaagagaaaaaagagagcaagtttttgaagttcttgggctttatgtggaaccccttgtcttgggtcatggaagctgctgccataatggccattgctttggcaaacggaggaggaaggccaccggattggcaggactttgtcggaattattgcactgctagtgatcaactccacaatcagttttattgaggaaaacaatgctggcaatgctgctgctgctcttatggctggtttagctccaaagactaaggtacttagggataaccgatggagtgaacaagatgctgcaattttagtaccaggagacataatcagcatcaagttaggagatatcattccggctgacgctcgtcttcttgagggtgatcctttgagtgttgatcagtctgctttgactggagaatctcttcccgtaacaaagagcccctcggatgaagtgttttcgggatcaacagttaagaagggtgagatagaagcagttgtgattgctactggggtgcacaccttttttggcaaagcagctcatctggtggacagcaccaaccaagttggacacttccagaaagtgcttacagcaattggtaacttctgcatttgctcaattgcggttggaatcgccattgagctcatagtcatgtacccgattcagcaccgcaggtacagggaaggaattgacaacctgttagtgctcttgattggaggaattcccattgccatgccaactgtgttgtctgtcactatggctattggttcccacaggctttctcagcagggtgccatcacaaaaagaatgacagctattgaggaaatggcagggatggatgtcctatgcagtgacaaaactgggactctcaccttaaataagttgagtgttgacaggaacttgattgaggtgtttgctaagggtgttgagaaagagtatgttatccttcttgcagcaagagcttctaggactgaaaatcaagatgccatagatgctgcaattgttggcatgcttgctgacccaaaggaggcacgtagtggtgttagggaggtacatttccttccattcaatcctgtagacaagaggactgcactgacctacattgattctgatggaaattggcatagagctagcaaaggggctcctgagcagataatcaccctttgcaactgcaaagaggatgtcagaagaaaggtccatgctgtaattgataagtttgctgagcgtggacttcggtctttaggtgtcgcaagacaggaagtacctgaaaaatcaaaagatagtcccggtggaccatggcaatttgttggtctgctaccattgtttgatcctcccaggcatgatagtgctgaaaccattcgaagagctcttaaccttggtgtcaatgttaagatgattactggggatcagcttgccattggaaaggaaacaggccgaaggcttggaatgggaacaaacatgtacccttcatcggcattgcttggccaagacaaggatgcttctatttcagctcttccagttgatgagttgattgagaaggctgatggatttgcaggagtatttcctgaacacaaatatgaaattgttaagaggctgcaagagaggaagcatatatgtggaatgacgggagatggtgtaaacgatgcccctgcattaaagaaagcagatattggaattgctgttgccgatgctacagatgctgctagaagcgcttctgatattgtcctcactgaacctggtctgagtgtcattattagtgcagtgctcaccagcagggcaattttccagaggatgaagaactatactatctatgctgtgtcaatcaccattcgtattgtgtttggtttcttgtttattgcgttgatctggaagtttgattttgcacccttcatggttttgattattgccatactcaatgatggtaccattatgactatatccaaggatagagtgaaaccatcaccacttcctgatagctggaaactgagggagatatttgctactggcgttgtgctaggaagttacatggcactaatgacagtagtatttttctgggcaatgaaagataccaacttcttctcgaacaagtttggtgtgaggccattgagagatagccccgatgaaatgatggcagccttataccttcaagtcagcataattagccaggctctaatcttcgtcacaaggtcccgcagctggtcttttgttgaaagacctggtcttctcctactaggtgcattttttattgctcagttggtggcaacttttatagcagtgtatgctaactggggctttgcaagaataaagggaatgggatggggttgggctggtgtaatctggctgtacagtgtggtaacctatatccctcttgatttactcaaatttgctatccgctatattctaagtgggaaggcttgggataatcttttggagaacaagactgccttcactacaaagaaagactatggtaaagaagagagggaagctcaatgggcggctgcacagaggacacttcacggtcttcagcctccggaaacttccaaccttttcaatgacaaaaatagctacagggagctttcagagattgcagaacaagccaagagacgtgctgaagttgcaaggcttagggagcttcatactctaaagggacatgtcgagtcagtggtgaagctgaaggggcttgacattgacacgattcagcagcactatacagtttaaggagcttggacaagtttcaagaagaaccgtgcttttttgagaaaaaatcacatataaagacgaagaaagaccatgttcaatttgtctttaagttacataaaaaaatgagtcctgtgaaaatttgaatggcctctctcactgtctccatcttttctaggagatactatgctctttacgcaccaaataacataattggtagggtttactatcatctttttatctggtagtatgctagtgttattgcttactaagataatattaaaagctcaatacattggtattgacaccgttgctcaatattgaactcaatcttactctattttcctccaaccaaaataagttgagtctgagatgactagcccaatttttcaaggttcttttttttaaagtccatattatctataagtgttttaaattgaaactttcacggtctaatacataaaatttggtacataatcatctcagtttgatatggttgtagcaataacagataaaaatgaaataaatgcttaactgtttgaattgaa

SEQ ID NO: 2222 - DNA, 3453 bp, Theobroma cacao
cgtctctctctttgctctatcttcatttttcttcatagactttttatagtggcgcttcttagtattggtgttagcctttttctttgctttgaattatgagtctttaagtatcgacctttcctttctatatttgcttgcaaatactctaacagctcgttccttctctggctggcgctgctactccaactaaccttggaagatgggcggcgataagggcatcagcctcgacgagatcaaaaacgagtccgtcgatctggaacggattcctattgaggaagtcttcgagcagctgaaatgtacaagagcaggcttgactaccgaggaaggcgccaatcgccttcaagtttttggaccaaacaaactagaagagaaaaaggagagcaaatttctcaagttcttgggttttatgtggaaccctttgtcatgggtcatggaagctgctgctataatggctattgccttggcaaatggtgacgggaggcctccagactggcaggacttcgttggtatcattgtcttgttgtttatcaactccaccatcagttttattgaagaaaataatgctggtaacgctgcagctgccctcatggctaatcttgctccaaaaaccaaggttcttagagatggtcgatggagtgaacaagaagcagcaattctggtgccaggggacattataactattaaattgggagacatagttcctgctgatgctcgtcttcttgagggtgatcctttgaagattgatcaatctgcacttacaggggagtctcttcccgtcacaaagaatccatcagatgaagtgttttctggctcaacgtgtaaacagggtgaaatagaagcagtggttattgcaactggtgtgcacaccttctttgggaaagctgcccacctagtggacagcaccaatcaagttgggcatttccagaaagtacttactgccatcggaaatttctgcatttgctcaattgctgttggaatagtcgttgagataatagtcatgtacccaatacagcaccgcaagtacaggcagggaattgacaatttactagttctcttgattggaggaatccctattgctatgccaactgtgttatctgtcaccatggctattggttctcataggctttcccaacaaggggctatcacaaaaagaatgacagccattgaggaaatggcaggcatggatgttctctgcagtgataagactgggaccctgaccctgaacaaacttactgttgatagaaacctaattgaagtgtttgcaaagggagtcgaaaaagagcaagttatcctttatgcagcaagggcttcaaggactgaaaatcaggatgctattgatactgcaattgtaggaatgcttgcagatccgaaggaggcacgagctggtatcagagagattcacttcctaccattcaaccctgtagacaagagaactgctctgacctacattgattctgatggaaactggcatcgtgctagcaaaggtgcaccagagcagatcataactctttgcaattgcaaagaagatgtcaagaaaaaggttcatgcagttattgataaatttgctgaacgtggacttcgatctttaggcgttgcaagacaggaagtacctgagaaaacaaaagaggcccctggggcaccgtggcagtttattggtttgttgccactgtttgatcctccaagacacgatagtgctgaaaccatcaggagagctctaaaccttggagtgaatgttaagatgattactggggatcagcttgctattgccaaagaaactggcaggaggcttggaatgggaacaaacatgtacccttcttcttccttgctgggccaagacaaggacgcttccattgctgccctccctattgatgaattgattgagaaggccgatggatttgcaggagtatttccagagcacaaatatgaaattgttaagaggctacaggagaggaaacatatttgtggcatgacaggagatggtgtcaacgatgcccctgctttaaagaaggcagacattggaattgctgtggctgatgctacagatgccgctcgaagtgcctcagacattgtacttactgaacctgggctaagtgtcattataagtgcagtgctgaccagcagggctattttccaaaggatgaagaactacacgatctatgcagtttcgatcaccattcgtattgtgtttggcttcatgtttattgccttgatatggaagtttgacttcgcacccttcatggttctaattattgccatcctcaatgatggtacaatcatgacaatttccaaggacagagtaaagccatctccccagccagacagctggaaactcaaggagattttctgtactggcattgtgcttggaggttacttggcactaatgaccgtgttattcttctgggcaatgcatgacactgatttcttcacagacaagtttagtgttagatcactgaggggtagtgataaagagatgatggcagctttataccttcaagttagtattgtgagccaggccctcatttttgtcacacggtcccgcagctggtcctacgttgaacgtcccggacttctactagtcagtgcttttgtaattgctcagctggtggccactttgatagctgtctatgcaaattggggtttcgcaaggattaaaggtatgggatggggatgggctggtgtaatctggctttacagtgtggtgacttttgtcccacttgatcttatcaaatttgcaacccgatacgttcttagcggaaaggcttgggataaccttttggagaacaagactgccttcaccacaaagaaagattatggaaaagaagaaagagaagcacaatgggcagctgcacagagaactctgcacggtcttcaaccacctgaaacttcaaacattttcagtgaaaggagcagttacagggaactttcagagattgcagagcaggccaagcgcagggctgaggttgcaaggctgagggagctgaatacactgaaggggcatgtggaatcagttgttaagctgaagggacttgatatcgatacgattcagcagcattacacggtttaaaagagggatttggaacaaaagaagcatagaaccaggatgatctttcccttcagaaaagcaaaaacaaaaatattataatgacgaacaaggcctaaagtgaagaagaaacctacgacgaccaatgttaaggagatacttactagttatagaaataggcgcattttccttttactaaatgttgcgattttagtgtcattgtcactcttctcttttttcgaatgaacaaggtaaggaactgttgtcctttttttaacagcaaaaaaaagaaaaaaaaaataacaccgcctttcatggctgctgcttacccactttcttttctttttctggtcttcccgttactacatcggaagtacttggttctttccatgcggatgaaccttttgagtttc

SEQ ID NO: 2223 - DNA, 3396 bp, Arabidopsis lyrata
ttttactcttcttgttctttaagacacttcaaaagagaataaggagagttttatttttctatctaaagaagtcgagcttcgtgaaaattattgtttctcatcattgtgattcatcatggctgctgatatctcatgggatgaaataaagaaggagaatgttgatcttgagaaaattccggtggacgaagtgttccaacagctgaaatgttcccgggaaggtttgtcttcagaggaaggaagaaacagactacaaatatttggggcaaacaaactagaagagaaggtagagaacaaatttctaaagtttttagggtttatgtggaaccctctttcatgggtgatggaagcggccgcaatcatggcaattgtgttggcaaacggtggtgggaggccaccggattggcaagactttgttggtatcacatgtttgctcatcattaactcgaccatcagtttcatcgaggagaacaatgctggtaatgcagctgcagctctaatggccaatcttgcacctaaaacaaaggtattgagagatgggagatggggagagcaagaagccgcgattttggtaccaggtgacttaatcagcatcaagttaggtgacattgttcccgcggatgctcgtctcctcgaaggtgatcctcttaagatcgaccaatctgctcttactggtgaatctctcccagctactaaacacccgggagacgaggtcttctctggctccacttgtaaacaaggtgagatcgaggctgttgtcattgccaccggagtgcataccttctttggcaaggcggctcaccttgttgacagtactaacaatgttggccatttccaaaaggtcctaaccgccattggtaatttctgtatttgttcaatcggaataggaatgttgattgagatcattataatgtatccgatccagcatcggaagtatagagatggaatcgataatcttcttgtccttctcattggaggaatcccaattgcgatgcctactgtgttgtccgtgacaatggctattggatcacataggttatctcagcaaggtgctatcacaaaaagaatgactgccatcgaagaaatggctggtatggatgttctttgcagcgacaaaaccggaactctaactctcaacaaacttacagttgacaagaacttgattgaggtgttccccaaagacgtagacaaggacactgtgatactactttcagctagggcttcaagaatagagaatcaagatgcaattgatacttccattgttaacatgttgggtgacccaaaagaggcaagagctggaataactgaagtgcatttcttgccgttcaatccagtagaaaagcgaactgcgatcacttacatcgatagcaatggagagtggcatagatgcagcaaaggtgctcctgagcagataattgaactatgtgatctcaaaggagagacaaagagacgagcacatgagatcattgacaagtttgctgagcgtggacttcgttcactaggtgttgcacgccagagggttcctgagaaggacaaagaaagcgcgggaacgccgtgggagtttgttggtcttttgccactctttgaccctccaagacatgacagtgcagagaccattagacgagctcttgatctcggtgtgaatgttaaaatgatcactggagaccaattggccattggtaaagagacaggtcgtaggcttggaatgggaacaaacatgtatccttcctcttctttactagaaaacaaagatgacaccaccggaggagttcctgtagatgagctcattgagaaggctgatggattcgctggagtctttcctgaacacaagtatgagattgtaaggaaactccaagaaaggaaacatattgttggtatgaccggagatggtgtcaacgatgctccagcgctgaaaaaggcagatatcggtatagcagtggatgatgcaactgatgcggcaagaagcgcctcagatatagtcttgacagagccaggtcttagtgtcatagtcagcgctgtgcttaccagtagagctatctttcaacgaatgaagaactacacaatctatgcagtctccatcacaatccgtatagtcctaggcttcatgcttgttgctcttatttgggagtttgacttttctcctttcatggtcctcattattgcaatcctaaacgacggtaccatcatgaccatttccaaagacagagtcaagccttctccaattcctgattcatggaagcttaaagagatttttgctactggagttgttcttggaacctacatggctctcgtcactgttgtcttcttctggctagctcatgacacaaccttcttttcggataaatttggagtaaggtcattacaaggcaaagacgaggagttaatagcagttttgtatttgcaagtcagtataattagtcaggctctcatctttgtcactcgatcaaggagctggtcctttgtcgaacgccctggacttcttcttcttattgctttctttgttgcccaattgatcgcaaccttaatagctacttatgcgcactgggaattcgcaagaatcaaaggttgtggatggggatggtgtggagtcatctggatttacagtatcgtcacatacattcctcttgatatcctcaagtttatcacccgctatacccttagtggcaaagcttggaacaacatgattgaaaataggactgcattcacaaccaagaaagactacggaaggggagaaagagaggcccaatgggctctagctcaacgtacgctccatggacttaaaccaccggagtcaatgttcgaagacacggcaacctacaccgaactctctgaaatcgctgaacaggccaagaaacgtgcagaagttgctaggctaagagaagtgcacactcttaaaggccacgttgagtcggtagtgaagcttaagggccttgacattgacaatcttaaccaacactacaccgtttaagctaaactacaaagacatttcaattattcgactgcggacacatgacgacgatctaagcaataaaattggagaaaatggaatcataaagataaaaagaagaaaaagaaagttccgatttggattctccgttggtttcgatttcgtttttcttggtaaagacatgatattatccgtcgaatgcttcataacttgcgaaaaaacgcaaaaacaagaataagaagaagatagtaggatggatgaatgagatggaataaaggaaagagaagagacatatcgtcatgtgatacactcgtactcattacttattattagtaatcccatatgttttggttataagctttttctttatgttccttttttttatataagaaactgaaattgataatgataggaataaaaaaaatttcaagaaaaaaataattttattaggc

SEQ ID NO: 2224 - DNA, 3311 bp, Valeriana officinalis
tttccttcaattctcttcgccaacctttagagagagaaactctgcttttccttccccctatatatacatacacatacacacactcctgtagagagagaatgtgcgtgctatcatctctatgagcttgggtttccgctgcatgtgatctaggcttgctgcttcagacatctgcgttgcttgcttccagaatgggttcctttagtctcgaggaaattaaaaatgaggccgtcgatctggaacgaattcccgtagaagaagtctttgagcagttgaaatgtaacacagaaggtctatcatccgaagaaggagccaataggcttgttattttcggaccaaataaacttgaggaaaagaaggaaagcaaagttctgaagtttttgggtttcatgtggaatcccttatcatgggttatggaagctgctgcaataatggctattgctctagcaaacggtgatggaaggcctccagactggcaggattttgttggaattgtcgtcttattggttattaactcaactatcagctttattgaagaaaacaacgctggtaatgcagcagcagctctaatggctgggttagctccaaaaaccaaggttcttcgagacggtagatggagtgaacaagatgcgagtatcttagttccaggagatataattagcataaaattaggagatatcattcctgctgatgcacgtctgcttgagggtgatccactgaaggttgatcagtctgctttaaccggagaatctcttgccgtcactaaaaacccctctgatgaagtattttcaggctcaacttgtaagcagggtgaaattgaagcagttgtgattgcaaccggggtccacactttctttggtaaggcggcacatttagtggacagcactaaccaagtagggcacttccagaaggttcttacagcaattggtaacttctgcatatgctcaattgctgttggaatagtggtggagttggttgtaatgtaccccatacagcaccgtgaatacagggatggaattgataatttgcttgttctcttgattggaggaattcctattgccatgccgactgttttgtcggttactatggctattgggtcccacagactctcagagcagggtgccatcacgaaaagaatgacggctatcgaagagatggctggaatggacgttctttgcagtgacaaaacagggacacttacactaaataagctcacagttgacaagaatttgattgaggtgtttcccaagggtgtagaaaaggagcaggtgatgctacttgctgcaagagcatcaagaaccgaaaatcaggatgccattgatgcagccattgttggaatgcttgctgacccaaaggaggcaagagctggtattagagaggttcattttcttccattcaaccccgtggataagaggactgctttgacctatatcgattcaaatggaaattggcacagagcaagcaaaggtgctcccgagcagatattgaccctatgtaactgcaaagaggatgtcaaaaggaaagtccattctgtgattgacaagtttgctgaacgtggtcttcgatctttgggcgtggccagacaggaagtgccggagaaaacaaaggaaagtcctggtggagcatggcagctagttggtctattaccattatttgaccctcccagacatgacagtgccgaaactatcagaagagctctacatttgggagtaaatgtgaagatgataacaggtgatcaactagcgattgcaaaggaaacaggacgcaggcttggaatgggtacaaacatgtacccttcttcttcattgcttggtcaagacaaggattcatccattgcttcactccccattgatgagctaatcgagaaagctgatggctttgctggagtctttccagagcataagtatgaaattgtgaagaggttgcaagagaggaagcacatatgtggaatgaccggagatggtgtgaatgatgctccggctttaaagaaggcagatattggaattgctgttgcagatgccactgatgccgctagaggtgcttcggatattgttctcactgaacctggacttagtgtcattattagtgcagttcttactagcagggctatcttccaaaggatgaaaaactacacgatctatgcagtttcgattaccatccgtattgtgtttggtttcttgtttattgccttgatatggaggtttgatttcgctccgtttatggttctgattattgccatcctaaatgacggaacaatcatgactatctcaaaggaccgagtgaaaccatcaccaatgcccgacagttggaaactaaaagagatttttgctacgggaattgtgctgggaggttatatggcactaatgacagtagtatttttctggctaatggaagacaccaactttttttcgaatgcctttggtgtaagatcattaagagccagcacacctgagaagatggcagctctatacctacaagtaagtatagtgagccaagcactcatctttgttacaaggtcacgcagttggtcctttgttgaacgccccggatctctcttgatgctggcattcttagctgctcagctggtggcgacgctgatagctgtatatgcaaactggggttttgcaaggatacaaggatgtggttggggatgggccggtgttatatggctttacagtgtggtaacatatattcctctggacattctcaagtttacaatccgatatgctttaagtggcaaggcttggaataatcttttggagaacaagactgcgtttactacaaagtccaactatggaaaagaagagagagaggcgcagtgggctgctgcacagaggactctacatggtcttcaaccacctgagagttctaaccttttctccgagaagaacagttacagagaactgtcagagattgcggagcaagccaagagaagggccgaagttgccaggctaagggagttgcttaccctgaaggggcacgtggagtcggttgtgaagctgaaaggtctggacatagatacaatccaacagcattatacagtctaatccaagatgatgatgaagatgaagaagaagaagaagaaaagaaagagagagtactgtttgtagtttgtgtttgttttaatagatcgaatttagatgaagaagatcataatcaacataaagtagctgtactgtactatcaccgctaagctagaacttgtacagtcccatctttcatgaccaagtgggacttaaataatttgcagatcttgcaaactatgtacaccatttttctctgtgtttttttttttgaatatttagcttataaat

SEQ ID NO: 2225 - DNA, 3353 bp, Chrysanthemum coronarium
acacacatacacactctctcttatctttcttccttctttccggtgaccccagcggttgcctttgcccccagctgccattcacaatgggaggtgataatactcttagccttgaaggaataaaaaatgagactgtcgatctggaaaaagtaccaattgaggaggtgtttgagcagttgaaatgtaaccgtgaaggtctgagcaccagtgagggagaccaaaggcttgaaatctttggacccaacaagctggaggaaaagaaggaaagcaaattgctcaagtttctcgggttcatgtggaatcccctatcatgggtcatggaggctgctgccattatggctattgcgttggccaacggaggtgggaagccaccagattggcaagatttcgttggtatcataactcttttggttatcaactccactatcagtttcattgaagaaaacaacgctggaaacgctgctgctgcccttatggcaggtcttgcacctaaaactaaggttctaagagatggtcgatggagtgaacaagaagctgccatcttggttcctggtgatattatcagtatcaagcttggtgatatcgtacctgctgatgcccgtcttcttgaaggtgatcctttaaagattgaccaatctgcacttaccggtgaatcacttccagtcaccaggaacccatatgatgaagtgttctctggttcaacttgcaagcaaggagaaatcgaagcagttgttattgctaccggagtccacaccttcttcggaaaggctgcacatcttgtcgacaacaccaacaatgtcggtcatttccagaaagttctaaccgccattggaaacttctgtatttgctccattgccgttggtatggttgttgagatcatcgtcatgtacccaatccaacacagaccatacagaaatggtatcgacaatcttttggtcttgcttattggaggaattccaattgctatgcctaccgttctttcggtcaccatggctattggatcacataggctctcacagcagggtgctattaccaagagaatgactgccattgaagaaatggctggaatggatgttctctgcagtgacaaaaccggaactttgacacttaacaagctttcagtggataaaaatattatcgaagtgtttggcaaaggtatggataaggaccaggtgttgctttacgctgcaagagcttctaggacagaaaaccaagatgctattgatggagccattgttggaactcttgctgaccctaaagaggcaagagctggaatcagggaagtccattttctcccattcaaccctgtggacaagaggactgctttgacttacattgacggaaatggtaactggtttagagctagcaaaggtgcacctgaacagattttgaccctctgcaactgccgagaagatttaaagaagaaggttcacgccatgattgataaatttgccgaacgtggtcttaggtctttgggagttgcaagacaggaagtgccacaaaagtcaaaggacagccccggtagtgcatgggagtttgttggactattgtccctttttgatccaccaagacacgacagtgctgagactatccgaagagctctaaatcttggtgttaacgtcaagatgattactggtgatcaacttgctattgctaaggaaactggtagacgtcttggtatgggaacaaacatgtacccatcttcatctttactcggtggaagcaaggatgaatcaattgcatcacttcctattgaagagttgattgagaaagctgatggatttgccggagttttccctgagcacaagtatgaaattgtgaagaaattgcaagagaggaagcacatctgtggtatgactggagatggtgtgaatgatgcccctgctttgaagaaggctgatatcggtattgctgttgctgatgccactgatgctgcaagaggtgcttctgacattgtgctcactgagcccgggcttagtgttatcatcagtgccgtgcttaccagcagagctattttccaaagaatgaagaactacacaatctatgcagtttctatcaccatccgtatcgtgtttggtttcatgtttattgcattgatatggaagtttgacttctctcccttcatggttcttatcattgccattcttaatgacggtacaatcatgacaatctcaaaggacagagtgaaaccatctccactacccgacagctggaaactaaaggaaatcttcgccactggtgttgttctcggaggatacctagctttgatgaccgttatcttcttctggatcatgaaggacaccgacttcttcacggagaaatttgatgtgaaatcaatcaggaacagtgagcccgagatgatggctgctttatatttacaagtcagtattgtgagtcaagctttgatctttgtcactcgatcccgaagctggtcgtttgttgaacgtcccggatttttgctaatgggtgctttcctagcagcacaattggtggcaactgttattgccgtatatgctgactgggaattcgccagaatcaagggaattggatggaaatgggctggtgttatctggctttacagtatcgtgttttatttccctcttgatatcatgaagtttgccatccgttacatcctcagtggaaaggcttggaactcaatgattgacaacagggttgctttcacaacaaagaaggattacggaagaggagagagagaggctcaatgggctcatgcacagagaactctacatggacttcaagcacctgatacatcaaacctcttcaacgagaagagcagctacagagaactttctgaaatcgctgaacaggctaaaagacgtgctgaagttgcaaggcttcgtgaggtacttactcttaagggtcacgttgagtcggtggtgaaattgaaggggcttgacattgacaccattcaacaacattatacagtataagggaaaagggttggttttttttctacctttaacttattacagaatcgaggccgactagaagaccatgatacaaccatgggacgacatgtctcgagcgtctaaagtttgtgttatttttgtgcatttcttgagtatacccataaagggtttgtgtttggtcgcttcttacctgttagcactgaagcaaagttgaacattttcctataacgtagtttctttcccccgtttactatgtttgtttgaatgaatcaatgtaatgaacaaaaccaatggtgtaattggtgcttgtaatctacaagttttacgacagagacatttcttgttgtggcatttgaagtacccgatgttatgtatgaaacagttttggttaataatgtactatcaagggcctcttttgatcaaaaa

SEQ ID NO: 2226 - DNA, 3075 bp, Lotus japonicus
cttctttcttgaatcatggcttctgacatctcattcgaggatctcaagaatgagaatgttgatcttgaaaacattccagttgatgaggtgtttcagcaactaaaatgtaccaaagagggtctgtcatccgatgaaggagagaagaggctccagatttttggccccaacaagcttgaggaggtgacagaaagcaagcttctcaagtttttgggttttatgtggaatcccctatcatgggttatggagtcagcagccatcatggccattgttttggccaatggagggggcaagccaccggattggcaagatttcactggtatcatggtgttgcttatcatcaactcaaccatcagtttcattgaggaaaacaatgcaggtaatgctgcagctgctttgatggccggtcttgcacccaaaaccaaggttttgagggatggaaaatggagtgaggaagacgcagcaatattggtacctggagatgtgatcagcatcaaattgggagacattgttcctgctgatgcgcgtctcttggagggagatcctttaaagattgaccagtcttcactgaccggtgagtccttgcctgttacaagaaaccctggtgatgaagtcttctccggttcaacttgcaaacaaggtgagattgaagctgttgtcattgccactggtgtccacactttctttggtaaagctgcacaccttgttgacagcaccaacaatgttggtcacttccaaaaggtgttgacatccattggaaacttctgtatctgctcaattgccattggcatgttgattgagatcattgtgatgtatcccatccagaacagggcttacagagatggcattgacaatttgttggtgcttctcattggaggtattccaattgccatgcctactgtgttgtcagtgaccatggctattggatctcaccgcctgtctcagcaaggagccatcaccaagaggatgacagccattgaagaaatggcaggcatggatgttctttgcagtgacaagaccggaactctcacccttaataagcttactgtggacaagagcttgattgaggtgttcccttctggtttcgacaaggactcccttatcttatttgctgccagggcttccaggaccgaaaaccaggatgccattgatgcttcaattgtgaatatgttgagcgaccccaaggaggccagagcaggaatcactgaggtgcatttcttgcccttcaatccagtggataagcgcacagctattacctacattgacagcaatggtgactggcacagaagcagcaaaggtgctcctgagcaaattattgagctttgcgacctcaagggagagacattgaaaaaggcccacaaggtcattgatgagtatgctaaccgtggtctgcgttcattgggtgttgctcgccagactgtttctgaaaagaccaaggagagccaaggagatgaatgggagttcttgggtctcctacccctctttgaccctccaaggcatgacagtgctgagactattcgccgcgctcttgaccttggtgtcaatgttaagatgatcactggtgaccaacttgccattgggaaagaaactggtcgcagacttggaatgggaaccaacatgtatccttcatcctctcttcttggtcaaagcaaggatgccgctattgcatctatcccaattgatgaactcattgagaaggctgatggatttgcaggagtcttccctgaacacaagtatgagattgtgaagaggttgcaggatagaaagcacatttgtggaatgaccggagatggtgtgaacgacgcacccgcattgaagaaggcagacattggtattgcagtggctgatgcaactgatgctgcaaggagtgcctcagacattgtgttgactgagcctgggctcagtgtgatcatcagtgctgtgctgacaagtagggccatcttccagaggatgaagaactacacaatctatgctgtttccatcacaatccgtatcgttctcgggttcatgcttgttgctctgatctggaagttcgacttctctcctttcatggttttgatcattgccatcttgaacgatggaaccatcatgaccatctccaaggatagagtgaagccatcccctgtgcctgactcatggaagctcaaggaaatcttcgccaccggagttgttctcggaacatacatggccatcatgaccgcagttttcttctatgctgttcatgacactgatttgttcactagactatttggtgtccactcaattgctgaaagtgaggatcagcttaactctgctctctaccttcaagtgagtatcatcagtcaagctctcatctttgtgacaaggtcaaggagctggtcatttgttgagcgccctggtttgatgcttgttggagccttcattgctgcacaattggtggccactgtcattgctgtgtatgcacactgggactttgcaagaatcaatggaattgggtggagatgggctggagtcatctggatctacagcgtcattacttacatccctcttgacatcctcaagttcttcatccgcatgggactctcaggcagtgcctgggacaacatgctccaaaacaagactgcattcacaacaaagaaggactatggtaggggagagagggaggctcaatgggctgtggcacaacgcacattgcacggtcttcaagttcctgaagctcacaagaacaaccaccatgaacactctgaaatcgctgaacaggcaaagagacgtgctgaagcagctaggttgaaggagctacacacacttaagggacacgttgaatcggttgttaagttgaagggtcttgatattgaaaccattcagcaacactacacagtatgagaacattaagatggatggaaaaagagccgattcatattagctataacttatacaggctgttcatgatagtgtgatcagatggagagtttaaaacaggagatgaatgaagagatggatttcatttctcctcctttacctcttccatatatttttgttgttgtttcaaaatattgaagagatggattttaatgcaataaaatacagattatttcccag

SEQ ID NO: 2227 - DNA, 3362 bp, Silene vulgaris
tcaaagttcattgaatggcctaaccctttaattccaccgtttttatctataaaacctttgtttttctgtccactttattgccttcaatcaaaccaatctctctctcattactcttaaaacatgtcgaaggccatcaatcttgaagatataaaaaatgaagctgttgatttggagaacattcccattgaggaagtctttgagcaactgaaatgttcccgggctggtttaacaaccgaagaaggagcccacaggctcgagttatttggacccaacaaattagaagaaaagaaggaaaacaaattcctgaagttcttgggttttatgtggaacccattgtcatgggttatggaagctgctgctataatggcaattgctcttgcaaatggaggcaacaagcccccagattggcaagatttcgttggtattatgtgcttgttggttattaactcaacaatcagttttattgaagaaaacaacgctggaaatgctgctgctgccctcatggctaatcttgctcctaagtgtaagttgcttagggataatcaatggaatgagtcagaagctgcattattggtgccaggagacattattagcattaaattgggagacattgtcccagccgatgcacgtcttcttgaaggtgatgctttaaagattgatcaatctgcccttacaggagaatctctccctgtgaccaagggtcccggggatgaagttttctctggttcaacttgtaaacaaggtgagattgaagcagtcgttattgctactggggtccacaccttctttgggaaggcagctcaccttgtcgacagcacaaacaatgttggccacttccagaaggttcttacagccattggtaacttttgtattgtctccattgcggtcggtatggtggttgagatccttgtcatgtacccaattcagcaccgtccatacaggagtggaatcaacaatctgttggttctcttgatcggtggtatccctatcgctatgcctacagtgttgtctgtgactatggccattgggtcccacaggttgtctcaacaaggggctatcacaaagaggatgactgccattgaggaaatggctggtatggatgtgctgtgcagtgataagacaggaaccttgactctcaacaagttgagtgttgacaagaacttgatcgaggtgttctgcaagggtgtggataaggagcatgtccttctccttgccgctagggcctcacgagttgaaaatcaagatgctatagatacttgcatggttggaatgcttgctgaccccaaggaggcaagagctggaatcagggaagttcactttctcccatttaatcctgtagacaagaggactgccctaacttacattgatggaaacggtaactggcacagagttagtaagggtgcacctgagcagatccttgacctttgccactgcaaggaagacttgaggaagaaggttcattcagtgattgaaaagtatgccgaacgtggtcttcgatcattggctgttgcaagacaggaagtgccagagaagagcaaagagtctccaggtggcccatggcagtttgttggtttgttgcctctttttgatcctcccaggcacgacagtgctgaaactatccgcaaggcccttaaccttggtgttaatgtcaagatgattactggtgatcaacttgccattggtaaagaaactggtagaagacttggtatgggaacaaacatgtacccatcttctgctttgcttggtcaagacaaagattcatcgcttgcttctttacctattgatgaattgattgagaaagccgatggctttgccggagttttcccagaacacaagtatgaaattgtcaagaggctgcaggacaagaagcacattgttggaatgacaggagatggtgtgaatgatgctcctgcccttaagaaggcagatattggaattgcagttgatgatgccactgatgctgcaagaagcgcttctgacattgtcttgactgaacctggtctcagtgtcatcattagtgcagtgcttactagcagggccattttccaaagaatgaagaactacactatctacgcagtatccatcacaatccgtatcgtgcttggatttctgcttattgccttaatctggaagtacgacttctccccattcatggttctgatcattgccattctaaatgatggtaccatcatgacaatctcaaaggatagagtgaagccatctccggttcctgacagctggaagctgaaggaaatctttgctactggtgtagttcttggaacctacctagccttgatgacagttattttcttctgggctatgaaagaaaccgactttttccccagaaagtttggagtacgaaacatttctggcagtgacccagaaatgatggctgccttatatctacaagtgagtattgtaagtcaggctctcattttcgtgacaaggtctcgaagctggtcatttgtcgagcgtcctggtatgctattggtggttgctttcttgattgcacaactggttgcgactgtgattgctgtttacgctaactgggcctttgccgacatcaaaggatgtggatggggatgggctggtgttgtttggatctacaacattgtcttctacttcccattggacatacttaagttcataatccgatacgtcttgagtggaaaggcatggctcaacttgttcgaaagcaagactgccttcaccaccaagaaggattacggaaaagaggagagagaagctcaatgggcccacgctcaaaggacgcttcacggacttcaagctcccgagccttcgtccaccctcttccatgacaagaacaattacagagaactctctgagattgccgagcaagcaaagagacgtgctgaagttgcaaggcttcgtgagttgcacacactcaaaggtcacgttgagtcagtggtgaagctaaagggtctcgacattgataccatcaaccagaactacaccgtctaagcaacgagagtttagttaaggaagacccgtcgagagggtcctcaagattacgacgaacgaggttgccttgatggggtaattgaaggataatgaggggttaggcaaagtggaggcacttcataatttgtaatgaaatgaagttcttgtttatttgacaaattcacaaatattaagtagctcagaggaagtcccctccctcccatttgatctgtaacattttttttctcttctttttttcactgtagatgtgtggtcaggcagtgaccgacctttgttgcataaatgtcaaagaaatcaaacgccattttgtttggctattttgcttgttacataaatttcaatgatataaaaaggcttcaaagtcatgttgtttgtttttg

SEQ ID NO: 2228 - DNA, 3406 bp, Glycine max
ttaataatttctccttgctacttcaattctgattgcaataacaacaacacccccccttccaacatgggcggtatcagccttgaggaaatcaaaaacgaaaacgtcgatctggaaaaaattccagtagaggaagtgttcgagtcgctgaaatgttcaacagcaggtctaacatcagacgaaggagccaacaggcttcaagtttttggaccaaacaaattggaagagaaaaaggagagcaaacttttgaagtttttgggtttcatgtggaaccccttatcatgggtcatggaagctgctgctataatggccattgctttggccaatggtggaggaaggcctccggattggcaagattttgttggtatcattgctctcttgttcattaactccacaatcagtttcattgaagaaaataatgctggtaatgctgctgctgcacttatggctggtttagctcccaagactaaggttcttagagatgggagatggactgaacaagatgctgcaattttggtcccgggagacataatcagcatcaaactgggagatatcattcctgctgatgcacgtcttctggagggtgatgctttgagtgttgatcagtctgctttgactggagagtctcttccagtaacaaagaatccctctgaggaagtgttttctggatcaaccgttaagaagggtgagatagaagcagtggtgattgccactggagtgcacaccttttttggcaaagctgctcatctggttgacagcacaaaccaagttggtcacttccagaaagtgcttacagcaattggtaacttctgcatttgctccatcgcggtgggaataatcattgagctcatagtcatgtacccaatacaacaccgcaagtacagagatgggattgacaatctgttggttcttttgattggaggaattccaattgccatgccaactgttctgtctgtcactatggctattggttctcacaggctttcgcagcaaggtgccattacaaaacgtatgacggctatcgaggaaatggcaggaatggatgtcctctgcagtgacaaaactggaactctcaccttaaataagctcagtgttgacaaaaacctgattgaggtttttgccaagggtgttgagaaggactatgttatccttcttgctgcaagggcttctaggactgagaatcaggatgctatagatgctgcaattgttggtatgcttgctgatccaaaggaggcacgagctggtatcagggaggtccactttcttccattcaatcctgtggacaagaggactgctctaacttacattgattctgatggaaattggcatcgatctagcaaaggtgctcctgagcagatattgaacctctgcaactgcaaagaggatgtaaggaaaagggttcatggaacgattgacaagtttgctgagcgtggactccgttctttaggtgttgctagacaggaagtacctgagaaaaacaaggatagtcctggtgcaccatggcaatttgttggtctgctaccactttttgatcctccaaggcatgacagtgcggaaaccatcacaagagctctgaaccttggtgtgaatgttaagatgatcactggtgatcagcttgccattgccaaagaaactggccgaaggcttgggatgggaacaaacatgtacccatcttcttcattgcttggccaaagcaaggatgctgctgtttcagctgttccagttgatgaattgattgagaaggctgatggatttgctggagtattccctgaacacaaatatgaaatcgtgaagaggctgcaagagaggaagcatatttgtggaatgacaggtgatggtgtcaacgatgctcctgcattaaagaaagcagacattggaattgctgttgctgatgctacagatgctgcaagaagtgcttctgacattgtcctcactgaacctggtctgagtgtcattattagtgcagtgctaaccagcagggcaattttccaaaggatgaagaattatactatctatgcagtgtcaatcaccattcgtatagtatttggtttcatgtttattgcattgatttggaaatttgattttgcacccttcatggtgttgattattgccatactaaacgatggtaccatcatgacaatatccaaggatcgagtgaaaccatctccaatgccagacagctggaagctgagggagatatttgccactggtattgtgctaggaagttacatggcactaatgacagtagtatttttctggatcatgaaggataccgacttcttctcggacaagttcggtgtgaggtctataaggaacagccccggagaaatgatggcagccctgtacctacaagtcagtatcataagtcaagcactaatttttgtcacaaggtcccgcagctggtcctatgttgaaagacctggtcttcttctactgagtgcttttatgattgcacaactggtggcaacttttctggcagtatatgctaactggggcttcgcaagaattcagggaatgggatggggttgggctggtgtaatctggctctacagtttagtgacatatatccctcttgatatactcaaattcgcaatccgctatgttctgagtgggaaggcttgggataatcttttggagaacaagactgccttcactacaaagaaagactatggcaaagaagagagagaagcacagtgggcaactgcacagaggactcttcatggtcttcagccacctgaaacaaccaaccttttcaatgacaagaacagttacagggagctgtcagagattgctgagcaagctaagagacgtgccgaggttgcaaggctcagggagcttcatactctgaaaggacatgttgagtcagtggtgaagctgaagggacttgacattgatacaatccaacaacattatacagtttaaggagtttagataattcatgcagaacccgctttggtgcttgtccaagaacaagaacaacaaatataatgaagaccgaagttaatccgtctataaattaggatgaaggtccttttgtcaaaatctgaatggtttactcttctattccatctatgccagtagctggaggagatgctatgctctttaggtaccaaataacgtggttgataggatttacttgcatcttattttgggaatgttaatgataccaaggtcactaaagctctatatatttttttgtctgatgaacaaaactcaatatattttcaatcttgattaatgttgctcaataatgagttcagtctccatgtttcttttttaccttcgttcatgtccagcctaaaaaaatgtgagtggtagaagcacgatgtatacactccaccattgaaattaaatagaaaaaatatttgatcattaatgagaggaaaataaaaggagtgatacagttaaa

SEQ ID NO: 2229 - DNA, 3103 bp, Citrullus lanatus
tggagattttcttcttcgttttggttgtttagttttttatgtcagctatgggggacatttcattagaagatgtcaagaatgagaacattgatctagaaagaattcctgttgaggaagtttttgagcaactaaaatgtacaaaagaaggattgagtacagcagaaggagaaaaaaggctccaaatttttggccctaataagcttgaagagaagaaagagagcaaagttttgaagtttttggggtttatgtggaaccctctttcatgggtcatggaatctgcggcaatcatggccattgtcttggccaatggaggggggaaaccaccagattggcaagattttgttggtatcattgtcttgttgatcatcaactctaccatcagtttcattgaagagaacaatgctggaaatgcagctgctgctctcatggctggtcttgcccccaaaaccaaggtcctaagagatggaaaatggaaagaagaggaggcagcaattctagttccaggagatgtgattagtgtcaaattgggagatattatcccggctgatgcacgtctcttagaaggcgatcctcttaagattgatcaatctgctcttacaggtgaatctttgccagtcaccaagcatcctggtgatgaagtgttctctggctccacttgcaagcaaggtgagattgaggccgtagttattgccactggtgtgcatactttctttggaaaggcagctcaccttgtggatagcaccaaccaaattggtcatttccaaaaggtgttgacggccattggaaacttctgtatatgctcgatcgcgatagggatgatcattgagatcttggtaatgtatccaatccagcatagggcatacagagagggaattgacaacttgttggtgctcctcattggaggtattcccattgcaatgccaacagttctgtcagtaacaatggccatcggatcgcatcgcctttcacaacaaggtgccattactaagaggatgactgcaattgaagagatggctgggatggatgttctctgcagtgacaagactggaactctcaccctcaacaagctcactgtcgacaagtccttgattgaggtgtttgtgccaaacatggacaaagacactgttatgttgtttgctgcaagagcttctagagttgaaaatcaagatgccattgatgcatgtattgttggaatgttgggtgaccctaaagaggcaagagcaggaataactgaagtacatttcttgcctttcaatcctgttgataaacgtaccgccattacctacattgacagagatggtaactggcacagaagcagcaagggtgctcctgaacagataattgacctttgtgagcttaaaggagaaataagaaagaaagctcatgacattattgataactatgctaaccgcggtcttcgttccttggcagttggtcgacagactgttaaagataaggacaaggaaagtgctggagaaccatgggaatttgttggtctcttgcccctatttgatcctccaaggcatgatagtgcagaaaccattcgccgagctcttgaactcggtgttaatgttaagatgatcacaggtgaccaacttgcaataggaaaagaaactggtcgaaggctcggcatgggcactaacatgtatccatcatcgtctttgctcggccaatgcaaggatgagtcaattgcttccattcctgttgatgaactcattgagaaggctgatgggtttgcaggagtcttccctgaacacaagtatgagatcgtcaagaaacttcaggagaggaatcatatttgtggcatgacaggagatggtgtcaatgatgctcctgctctcaagaaggccgacatcggtattgctgtggctgatgcaaccgatgcagcaagaagtgcttcagacattgtcttgacagagccagggctaagtgtgattgtgagtgctgtattgaccagtagggccatctttcagagaatgaagaactatactatctatgcagtttccattacaattcgtattgtgttgggattcatgcttgttgctctcatctggaagttcgatttctcaccttttatggtcttgatcattgccatcctaaacgatggaaccatcatgaccatttcaaaggatagggtcaagccatcaccagtgccagactcatggaaactcaaagaaatttttgctactggtgttgtccttggaacatacatggccctcatgaccgtctttttcttttggcttgccaacgaaaccaacttcttcacgaacacatttggtgtaaagccactcaaagatcttgctgagatcaattctgctctttatcttcaagtgagcatcatcagtcaagctctcatctttgtcaccaggtcaagaagttggtcttttgttgaatgccctggtctcttgttagttattgccttcattgctgcacagttggttgccactttaattgctgtattttctgaatgggactttgcaaggatcagaggtattggatggggatgggcaggagctatctgggtattcagtattgttacttacttcccactagatgttctcaaattcggaattcgatacgctcttagcggcaaggcttgggacaacatgctcgagaataagacggcgtttacgactaagaaggattatggaaaaggcgaaagagaggcacaatgggcaatagcacaacgtacaatgcacggactacaaccaccagaaaccatatttcatgaaaagagcaactatgaagagctttcagagattgcagagcaagccaagaaaagggctgaagttgctaggttgagggaacttcacactctaaagggtcatgtggagtcagtagtgaagttgaagggattggacattgagactatccaacaacactacactgtttaatctgcagtggagaagacaacatttggctgactttcaacaaaaacgaagaaggaataatttaagggaaaaaaaaaaagaaaagaaaaatagaggaacaaaatttatgggtggtgaaatgggttgttctaattcttttttcttctttcttttgtacttgcaattctttttctataggcattgtgggggaaaatgtaatctagattcaagtt

SEQ ID NO: 2230 - DNA, 3536 bp, Glycine max
gaaactgaaagagaaaaaagtgaagtgaacgggagcacccagagaagttcacggcttcactttcacatcaccaaacacctctctcaaggcctagctagcttagcttcaatctctttccttctgcctccttttcctccctctctgcatttattttcttttggactattccactcatgcaccctccaatcccctctatttaaccctccctatcttcttctcctcacataattcacacacactcattattactatatacacaccttctttcttctcttctccttcttcagttctcttcctctttttccttctttctttcaacatgggtggcatcagcctcgaagagatcaaaaacgagaacgtcgatctggaacggattccaatagaggaagtgtttgagcagctgaaatgttcaagagcaggtctaacatcagaggaagggggcaatcggcttcaagtctttggaccaaacaaattggaagagaaaaaagagagcaagtttttgaagttcttgggttttatgtggaaccccttgtcttgggttatggaagctgctgctataatggccattgctttggcaaatggaggaggaaggccaccagattggcaggactttgtcggaattatcgcgctgctagtgatcaactccacaattagttttattgaggaaaacaatgctggcaatgctgctgctgctcttatggctggtttggctcccaagactaaggtactaagggataaccgatggagtgaacaagatgctgcaattttagtaccaggagacataatcagcatcaagttaggagatatcattccggccgacgctcgtcttcttgagggtgatcctttgagtgttgatcagtctgctctgactggagaatcactccctgtaacaaagagtccctcggatgaagtgttttcgggatcaacggtcaagaagggtgagatagaagcagttgtgattgctactggggtgcacaccttttttggcaaagcagctcatctggtggacagcaccaaccaagttggacacttccagaaagtgcttacagcaattggtaacttctgcatttgctcaattgcggttggaatcgtcatcgagctcatagtcatgtacccgattcagcaccgcaggtacagggatggaattgacaacctgttagtgctcttgatcggaggaattcccattgccatgccaactgtgttgtctgtcactatggctattggttcccacaggctttctcagcagggtgccatcacaaaaagaatgacagctattgaggaaatggcaggcatggatgtcctatgcagtgacaaaaccgggactctcaccttgaataagttgagtgttgacagaaacttgattgaggtgtttgctaagggtgttgagaaagagtatgttattcttctcgcggcaagagcttctaggactgaaaatcaagatgccatagatgctgcaattgttggaatgcttgctgacccaaaggaggcacgtagtggtattagggaggtacatttccttccattcaatcctgtagacaagaggactgcactgacctacattgattctgatggaaattggcatagagctagcaaaggggctcctgagcagataatcaccctctgcaactgcaaagaggatgtcagaagaaaggttcatgcagtaattgataagtttgccgagcgtggacttcggtctctaggtgttgcaagacaggaagtacctgaaaaatcaaaagatagtcctggtggaccatggcaatttgttggtctgctaccattgtttgatcctcccaggcatgatagtgccgaaaccattagaagggctctgaaccttggtgtgaatgttaagatgattactggggatcagcttgccattggaaaggaaacgggccgaaggcttggaatgggaacaaacatgtacccttcatctgcattgcttggccaagacaaggatgcttctatttcagctcttccagttgatgagttgattgagaaggctgatggatttgcaggagtatttcctgaacacaaatatgaaattgttaagaggctgcaagagaggaaacatatatgtggaatgacgggagatggtgtaaacgatgcccctgcattaaagaaagcagatattggaattgctgttgctgatgctacagatgctgctagaagtgcttctgatattgtcctcactgaacctggtctgagtgtcattattagtgcagtgctcaccagcagggcaattttccagaggatgaagaactatactatctatgctgtctcaatcaccattcgtattgtgtttggtttcttgtttattgcgttgatctggaagtttgattttgcacccttcatggttttgattattgccatactcaatgatggtaccattatgactatatccaaggatagagtgaaaccatctccacttcctgatagctggaaactgagggagatatttgctactggagttgtgctaggaagttacatggcactaatgacagtagtatttttctgggcaatgaaagataccaacttcttctcgaacaagtttggtgtgaggccgttgagcgatagccctgacaaaatgatggcagccttatacctacaagtcagtataattagccaggctctaatcttcgtcacaaggtcccgcagctggtcttttgttgaaagacctggtcttctcctactaggtgcattttttattgctcagttggtggcaacttttatagcagtatatgctaactggagctttgcacgaataaagggaatgggatggggttgggctggtgtaatctggctctacagtgtggtaacctatatccctcttgatttactcaaattcgcaatccgctatattctaagtgggaaggcttgggataatcttttggagaacaagactgctttcactacaaagaaagactatggtaaagaagagagggaagctcaatgggcggctgcacagaggacacttcacggtcttcagcctccggaaacttccaaccttttcaatgacaaaaatagctacagggagctttcagagattgctgaacaagccaagagacgtgccgaagttgcaaggcttagggagcttcatactctaaagggacatgttgagtcagtggtgaagctgaaggggctggacattgacacgattcagcagcactatacagtttaaggagcttggacaagcttcgggaagaaccggctcagtgcttttttgagaaattttttttacatataatgacgaagaaagaccatgttcaatctgtctttaagttacataaaaaaatgagtcctgtgaaaatttgaatggtctctctcactgtctccatcttttcttggagatactatgctctttttacgtaccaaataacataattggtagggtttactatcatctttttatctggtagtatgctagtgttattgcttactaagatagtattaaaagctcaatacattggtattaacaccgttgtttaatattgaactcaacttcctgtgtttttctccaatcaaaataagttgagtctccg

SEQ ID NO: 2231 - DNA, 2889 bp, Gossypium raimondii
atcatctcattgccaatggcttccaatggtgatatctctttggagcagatcaagaacgagactgttgatcttgagagaatccctgtggaggaggtttttcagcagctgaaatgtacaagagagggtttgacatcagaagaaggagagaaaaggctccaaatctttggccctaacaagcttgaagagaaagaagagagcaaatttcttaagttcttgggctttatgtggaatcctctgtcttgggtgatggaggctgctgctattatggccattgttttggccaatggaggtggcaagcctccagactggcctgactttatcggtatcgtttccttgcttttcatcaattcaaccatcagtttcatcgaggaaaataatgccggcaatgccgcagctgctttgatggctggtcttgcacccaaaaccaaggtgttgagagatggcaaatggggtgagcaagaagctgcaactctggtaccaggagatgtaattaatgttaagttgggagacatcatcccggcggatgctcgtcttttggaaggcgatgcactcaagatcgatcaatcggccctaactggtgagtccctgcctgttaccaagaatccaggtgatgaggtcttctcgggatccacctgcaaacaaggtgagatcgaggctgttgtcattgccactggtgtccataccttctttggcaaggctgctcaccttgttgacaacaccgacaatgttggtcacttccaaaaggtattggcagccattggtaacttctgcatctgctcgattgctgtgggaatgctcattgagatcctggtgatgtacccaatccagcacaggagatacagagacggtattgacaaccttttggtgcttctcatcggaggaattccaatagccatgcccacagtcttgtctgtgacaatggctattgggtctcacagcttgtcacaacaaggagccatcaccaagaggatgactgccattgaagaaatggcagggatggatgttttgtgcagcgataagaccgggactctcaccctcaacaagctaacagtagacaagagtctcattgaggtgtttgtaagtgacatggatgcagacgcccttgtactgattgctgcaagggcttccagggttgaaaaccaggatgccattgatgcttcgattgtagggatgttgggagaccccaaagaggcaagggccggaatcaccgaggtacacttcttaccattcaatcccgtggataagcgcacagctatcacctacattgacagaaatggtgagtggcatcgttgtagcaagggtgctcctgagcagataattgagctatgtgagctcaccggtggcttgaggcaaaaggcgcatcatgtcattgacagttttgctggccgtggccttcggtccttgggagttgctagacagacaattccagagaaaaaaaaggagtgtgctggaggaccatgggagttcgtgggccttttgcctctttttgatcccccaaggcacgatagtgccgagactattcgacaggctcttgaccttggtgtcaatgttaagatgatcacaggtgaccagcttgccatcggaaaagagacgagtcgcagacttggaatggggacgaacatgtatccttcttcctccctccttggccagtgtaaggatgaggctattgctaccattcccgtcgatgagctcattgagacagctgatggatttgccggagtcttccctgagcacaagtacgagattgttaaaaggctccaagaattgaagcacatatgtggcatgacaggagatggtgtcaacgatgccccagcacttaagaaggcggatatcggtattgcagtggctgatgcaactgatgctgcgaggagtgcctcggacatagtcttgaccgagccaggattgagtgtgatcgtgagcgcggttttgactagtagagccatcttccagaggatgaagaactacacaatctatgccgtttccattacaatccgtatcgtaatgggattcatgctgattgctctcatctgggagtttgacttctcaccattcatggtgttgatcattgccatcctcaatgatggaaccatcatgactatctccaaggacagggtcaaaccatctcctacacccgactcgtggaagttgaaggaaatcttcatcactggggtcgtcctcggggcttacatggcgattgtgagcgtgatatttttctggctggtccacgacacgctgttcttcactgagaagtttggagtgaaaccgataaacgaaaacgcaaatgagttaacttcagctctctaccttcaagtgagtatcatcagtcaagcactcatattcgtgacaaggtcaaggagctggtcctttgttgaactccctggtctcttgcttcttggagccttcctcgcagcgcagttggtggctacttgtattgcggtgtatgcaaactgggggtttgccaggatcgaaggcattggatgggaatgggcaggtgttatttggttatttagcgttattacatacatccctcttgatatcctcaagttcatcatccgctactctttgaccggcaaagcctgggacaatctgcttcagaaaaaggccgcattcacaacaaagaagaattatggaaaggaagcgagggaggcacaatgggcagcagatcaacgtacccttcacggcctttcacccccagaaaccagctggaccaatgagaaggaccaccacgagttgtcagaaatagctgagcaggctaagaagcgtgctgagattgcaaggctgagggagctccacacactcaagggtcatgttgaatcagtggtgaagttgaaggggatagatattgatacaatccaacaacactacactgtataatggaaggcttaaaca

SEQ ID NO: 2232 - DNA, 3001 bp, Ricinus communis
ctccctccctccctccctcccttatgagtctctagaactagtttcactgaaggttttccggaggaatttagccagccatggccaccaaaggcggtatcagtctcgaggagataaaaaacgagtctgttgatctggaacggattcctatagaggaagtgtttgagcagctgaaatgttccagggaaggtctttcctcagaggaaggaaccaacaggcttcaagttttcggaccaaacaaattggaagagaaaaaggagagcaaaattctcaagtttttgggctttatgtggaatccattgtcatgggtcatggaagctgctgctataatggctattgctttggcaaatggtgatggaagacctccagattggcaggacttcgtgggtattgttgccttgttgctgatcaactccacaattagttttatcgaagaaaacaatgctggaaatgcagcagcagccctcatggctggtcttgctccaaagactaaggttctcagagatggtagatggactgagcaagaagctgcaattttggttccaggagacattatcagcattaagttgggagatattatccctgctgatgcgcgtcttcttgaaggcgatcccttgaaggttgatcaatctgctcttactggggagtcactacccgttacaaagaacccttcagatgaagtgttttctggctcaacatgtaaacagggtgaaattgaagcagtagtaattgccaccggtgtgcacacattttttggtaaagctgcccatctagtggacagcaccaaccaagttggtcatttccaaaaagttctaactgccattggtaacttctgtatttgctcaatcgctgttggaataattattgaacttatagtcatgtacccaatacagcatcgcaagtacagagatggaattgacaacttattggttcttttgattggaggaattcccatagctatgccaactgttttgtctgtcaccatggccattggttcgcacaggctctctcagcagggggcaattaccaagagaatgactgccattgaggaaatggcaggcatggatgttctttgcagtgacaagactggaactctaaccctgaacaagctgactgttgacaggaccctcattgaagtgtttgtgaagggtgtggataaagagtatgtaatccttcttgcagctagagcttcaagaactgaaaatcaagatgctattgatgctgcaattgtaggaatgctggcagacccaaaggaggcacgagctggtattagagagcttcatttccttccattcaaccctgtggacaagaggactgccttgacctatatagattctgatggaaactggcaccgagctagcaagggtgctcctgagcagattctaacactgtgcaatagcaaggaggatgtcaagaagaaagttcatgctgtgattgataagtttgctgaacgtggacttcgatctttagctgttgcaagacaggaagtacctgagagatcaaaagaaagtcctggtggcccatggcaacttgttggtttgttgcctttgtttgatcctcccaggcatgacagtgctgagactatcagaagagctcttaaccttggcgtgaatgttaaaatgattactggggatcagcttgccattgctaaagaaactggtcggaggcttggaatgggaacaaacatgtatccatcttcttcattgcttggccaagacaaagatgcttccatcgcaaccctccctgtagatgagttgattgaaaaggctgatggatttgctggagtttttccagaacacaagtacgaaattgttaagaggctgcaggagaggaagcacatttgtggtatgacaggagatggcgttaacgatgcccctgctttgaagaaggcagatattggaattgctgttgctgatgctactgatgctgccagaggtgcttcagacattgtccttactgaacctgggcttagtgtaattataagtgcagtgctgaccagcagggccatattccaaagaatgaagaactacacgatatatgcagtctcaattaccatccgtatagtgtttggcttcctgtttatcgccttgatatggaagtttgacttttctccattcatggttttaatcattgccatcctaaacgacggaacaatcatgacaatttcaaaggatcgagtgaaaccatctccgcagccagacagctggaaacttaaagagatttttagtactggtgttgttcttggaggttatctggcactaatgactgtgatatttttctgggcaatggaagagactgacttcttttccgacaagtttggtgtaagatcattgcataatagtgaaggtgaaatgatggcagctctatacctacaagtcagtattgtgagccaggcccttatttttgtcacaaggtctcgcagctggtcctttgttgaacgtcctggacttcttctaatcggtgcattcatagctgctcaactgatagcaacagtgatagcagtttatgcaaactgggggtttgctcgtatagagggatgtggttggggatgggctggtgtaatctggctttacagtgtggttacttatgtgccacttgatctgctgaaattcgccatacgctacattctgagcggcaaggcttgggataatcttttggagaacaagactgcctttactacaaagaaagactatggaaaagaagagagagaagcacagtgggctacagcacagaggactcttcatggcctccaaccacctgaaactactaacttctttgctgacaagaatagttacagggagctttcagagatcgcagagcaagccaagcggcgggctgaggtggcaaggctgagggagcttcataccctcaagggacacgtggagtcggtggtgaagctgaaaggacttgacatcgacacgattcaacaacattacacagtttgaagagttggaattctcgagagaaccaatcttctccgagagagcgcccctccccccaaccc

SEQ ID NO: 2233 - DNA, 3484 bp, Gossypium raimondii
acgtcaatataaccaaacccaaaacaaggtgtaaaccatacaataaaataaaataactaaagaagaagggcaacgtctccgtttattgttataccgtcattatcgtcgtagagtttttcattagtattgcttcttagcattggtattagccattattggcttgtgtatgtggctctaaatagctgctactactactagttctttatctagctaatacagatggctggcaacaagggcataagcctcgacgagatcaagaatgagtccgtcgatctggaacggattccaattgaggaagtgttcgagcaactgaaatgtacaagagcaggcttgagtacccaggaaggtaacaatcgccttcaagtttttggaccaaacaaactagaagagaaaaaggagagcaaatttctcaagttcttgggttttatgtggaaccctttgtcatgggtcatggaagctgctgccatcatggctattgccttggcaaatggtggtggaaggcctccggactggcaggacttcgttggtatcattgtcttgttggtcatcaactccaccatcagttttattgaagaaaacaatgctggtaatgcagctgctgctctcatggctaatcttgctcccaaaactaaggttcttagagatggtcgatggagtgagcaagaagcagcaatcctggttcctggggacattatcactattaaactgggagacatagttccggctgatgctcgccttctcgagggtgatcctttgaagatcgatcaatctgctctcactggagagtctcttcctgtcaccaagaatccttcggatgaagtgttttcgggatcaacctgtaaacagggtgaaatagaagcagttgttattgcaactggtgttcacactttctttggtaaagctgctcacctggtcgacagcaccaatcaagtgggacacttccagcaagtgcttactgccattggtaacttttgtatttgttcaattgccgttggaatagtcattgagttaatagtcatgtacccgatacagcgccgcaagtatagggatggaattgacaatttactggtactcttgatcggtggaatcccgatcgctatgccaactgtgttgtctgtcactatggctattggttcccataggctttctcagcaaggggctatcacaaagagaatgaccgccattgaggaaatggcaggcatggatgttctctgcagtgataagactgggaccctaactctaaacaaacttacagttgatagaaacttaattgaagtgttcgcaaagggagtcgaaaaagagcaagtgctgctttatgcagcaagggcttcaaggactgaaaaccaggatgctattgatgctgcaattgtaggaatgcttgctgatccaaaggaggcacgagccggtatccgagaggtccatttcctaccattcaaccctgttgacaaaagaactgctctaacctacatcgattccgatggaaagtggcatcgtgctagcaaaggtgcaccagagcagatcataactctttgcaactgcaaagcagatgtgaggaacaaagttcatgcagttattgataaatttgccgaacgcgggcttcggtctttagctgttgcaagacaggaagtacctgagaaaacaaaagagagtcctggagcaccatggcagcttgttggtttgttgccactgtttgatcctcctaggcatgatagtgctgaaactatcacaagagccctaaaccttggagtgaatgttaaaatgattactggggatcagcttgccattgccaaagaaactggcaggaggcttggaatgggaaccaacatgtacccttcatcttccttgcttggtcaagacaaggattcttccgtttctgccctccctgttgatgaattgattgagaaggctgatggatttgctggagttttccctgaacacaagtatgaaattgttaaaaggctacaagagaggaaacatatttgtggtatgacaggagatggtgtcaacgatgctcctgctttaaagaaggcagacattggtatcgctgtcgctgatgccaccgatgccgctcgaagtgcttcagatatcgtacttactgaacctgggcttagtgtcattatcagtgcagtgctgaccagtagggctattttccaaaggatgaagaactacacgatctatgctgtttcaatcaccatccgtattgtgtttgggttcttgttcatagccttaatatggaagtttgatttcgcaccgttcatggttttaatcattgccattctaaatgatggtacaatcatgacaatttccaaggacagagtaaagccatctccacaaccagatagctggaaactcaaagagattttctctactggcattgtgcttggaggttacttagcactaatgaccgtgttattcttctgggcaatgaaagacactgatttcttctctgacaagtttcatgttaggtcactgagggatcgtcctgaacaaatgatggcagctttataccttcaagttagtatagtaagtcaggccctcatttttgtcacacggtctcgcagctggtcctttgtcgaacgtcctggacttctattagtcactgcatttattgctgctcagctggtggccactttgatagctgtctacgctaattggcgttttgcaaagatacaaggcatgggttggggatgggctgctgtaatctggctttacagtttggtcacttatattccacttgatcttataaaatttgcaatccgctatgtccttagtggaaaggcttgggacaaccttttggagaacaagactgccttcactacaaagaaagattatggaaaagaggaaagagaagcacaatgggcagctgctcagagaactctgcatggccttcaaccacctgaaacctcaaacgtcttcaatgaaaggagcagttacagggaactttcagagattgcagagcaggccaagcgcagggctgaggttgcaaggctgagggagctgaatacactgaagggtcatgttgaatcagttgtgaagctgaagggacttgatatcgatactattcagcagcattacacagtttaaagctaaagccaccgcagatgatgacgatatgcattttaatttgagacaaacaaaggatcattcatgatcttccctcccttgctacaaagaaaatgttgatgatgaacaaggcctatggagtatggccgatgttatgagaaaaaaaataatgaaacaggaatttgtattatggtaagtattctaagatggtataggttatgtatgttatgttctcttttggaacacgggataagctagtatagggaagggaaagaagtgttttaccttttttataactgcaaaataacaacaggctttcaattcatagcctggccttgtttgcagaaccttgcttcttaatcttcttcatttcccccaatccttttttttctttctttccctttttgatggttctacatct

SEQ ID NO: 2234 - DNA, 2957 bp, Ananas comosus
aggcgaggatgggggagaaggaggcgagcctcgatgccgtgctcaaggaggcggtggatttggagaacataccattggaggaggtgtttgagaacctacgatgcagccccgaggggctcaccggcgaacaagcctcgcagaggctcgacatttttggccccaacaagctcgaggagaagaaggagagcaagttcctcaagttcttgggcttcatgtggaacccgctgtcgtgggtgatggagatggcggcggtcatggccatcgccctcgccaacggcgggggcaggcccccgattggcaggacttcgtcggcatcatcgtcctcctcgtcatcaactccaccatctccttcatcgaggagaacaacgcgggcaatgctgccgccgctctcatggccgggctcgcgcctaaaactaaagtgttgagggacgggaggtggtcggagcaggaggcggcgatcctcgtccccggcgacatcatcagcatcaagctcggcgacatcatcccggccgatgccaggttgctcgagggcgaccccctcaagattgaccaatcggccctcaccggcgagtcgctccccgtgacgaagagccccggggacgagatcttctccgggtcgacgtgcaagcagggcgagatcgaggccgtcgtcatcgccaccggcgtccacaccttcttcggcaaggccgcccacctcgtcgacagcaccaacaatgttggccactttcagaaggtgttgacggccatagggaacttctgcatatgctctatcgcggtgggtatgctgatcgagatcgtggtaatgtacccgatccagcaccggcggtacagggaggggatcgacaacctgctggtgctgctgatcggcgggatcccgatcgcgatgccgacggtcctgtcggtgacgatggcgatcgggtcgcaccggctctcggagcaaggggcgatcacgaagcggatgaccgccatcgaggagatggccgggatggacgtgctctgcagcgacaagaccggaacgctcaccctcaacaagctcaccgtcgacaagaccatgatcgaggcgttcgtgaaggacattgacagagatacggtggtgctctacgcggcgagagcttcaagagtggagaatcaggacgctatcgatgcttccattgtcggcatgctcgcagatcccaaggaggcacgcgccgggattcaggaggtccacttcctgcccttcaacccggtcgagaagcgcactgccatcacctacatcgactccgccggcaagtggcaccgcatcagcaaaggcgcccccgaacagatcattgacctctgcaacttgagagaagatgcgcggaagcgggtccacgggatcatcgacaagttcgccgaccgcggcctccgcgcgctggccgtggcgcggcaggaggtccccgaggccgccaaggagagcgcgggtgggccgtggcagttcgtcgcggtgctgccgctcttcgacccgccgcgccacgacagcgcggagaccatccgccgcgcgctcaacctcggcgtcaacgtcaagatgatcaccggcgaccagctcgccatcgccaaggagaccgggcggcgcctcggcatggggaccaacatgtacccgtcgtcgaccctcctcgccgacaagaaggacgacctcgccggcgggctgccggtcgacgagctaatcgagaaggccgacggcttcgccggagtcttcccggagcacaagtacgagatcgtgaggcggctgcaggagcggcggcacatctgcgggatgacgggggacggggtgaacgacgcgccggcgctgaagaaggcggacatcgggatcgccgtggcggacgcgacggacgcggcgcggggggcgtcggacatcgtgctgacggagcccgggctgagcgtgatcgtgagcgcggtgctgacgagccgcgccatcttccagcgcatgaagaactacaccatctacgccgtatcgatcacgatccgcatcgtgctcggcttcctcctcctcgccctcatctggcgcttcgacttctcgcccttcatggtgctcatcatcgccatactcaacgacggcaccatcatgaccatctccaaggaccgcgtcaagccctcgccggtccccgactcatggaagctgcaggagatcttcgccaccggggtcgtgctcggcacctacctcgcgctcgtgaccgtcctcttcttctgggccaccttccgaaccgacttcttctcagacgcattcaaggtgagaccgatcagggacagcgcggacgagctgatggcggccgtgtacctgcaggtgagcatcgtcagccaggcgctgatcttcgtcacccggtcgcggagttggtgcttcgtcgagcgccccggcctcctcctcgtcgccgccttcatcgcggcacagctggtggctaccatcatcgcggtgtacgcgaactggggctttgcgaggatccgcggcatcggatggggatgggcaggagtcatatggctcttcagcatcataaccttcttccctctcgacatcctcaagtttattattcgctacgccctcagtggcaaggcctgggacaacgttttccagaacaagacggcatttgccaatacgttggactacgggaagggcgagagggaggcccagtgggctatagcccagcggacaatccacggcctgcacccaccggagtcttccggcctcttcaacgacaagaccaactacagagagttgtctgagatcgcggagcaggcgaaaaggcgcgcggaggtcgcaaggcttagggagctgcacacactgaaggggcatgtggagtcagtggtgaagctcaaggggctcgacatcgagacaatccaacaacactacacagtttagagaactttcggatcgacgccgaagacagaaaaaagttttggaaaggaaatattggtttttgattagtttttctttcaatgttagggag

SEQ ID NO: 2235 - DNA, 3274 bp, Gossypium raimondii
cttaaccccaattattcttttgggaaacagaaagaaaaagagtcgtaattgttataaataagacgtcaaaagtgtagcatccttttgatgtaaacaaccctacggggatttactgtgaacaaagaagagccactggagattaagaagaatacaagaggatacaaaggctaatataactgtgttgggtttttttttcttcgaggaggaaaagaaaagagaaaagatggtggacatagacgacaccttgcaggagatcaagaacgagaacgtcgatcttgagcgtatacccgttgaagaagtatttctgcagttgaaatgcaccaaggaagggttgacaaccgaggaggggctgaagagactgcaaatctttggcccaaacaaactcgaagagaagagtgaaagcaaggttttgaagttcttgggatttatgtggaatcctttatcatgggtgatggagattgcagcaattatggccattgctttggccaatggaggaggcaagcccccagattggcaagatttcgttggtatcacggttttgcttattatcaactccactatcagtttcattgaagaaaacaatgcaggcaatgcagcagcggcacttatggccggtcttgctcccaaaaccaaggtcctaagagatggaaaatggtgcgagcaagaagctgcgattttggtaccaggagatatcatcagcatcaagttgggagatatcatcccagcagatgcacgtctcctagagggcgatgcgctcaaggttgatcaatctgccttaactggtgagtctttgccggtaaacaagaaccccggtgatggggtttactcgggttctaccgtcaagcaaggtgagctcgaggccgttgttatcgctactggtgttcacaccttctttggtaaagcagctcacctggtcgatagcaccaacaacgtaggccacttccagaaggtgctgaccgcaattgggaacttctgcatatgctcaattgcagtaggcatgctagttgagattgtggtgatgtatccgatccagcgtcgaaagtatagagatggaattgataatctcttggtgcttctcatcggagggattcctatcgccatgccaacagttttgtcggtgacaatggctatcgggtctcaccggctttctcaacaaggagctattacaaagagaatgacagccatcgaggaaatggcaggaatggatgtactctgcagtgacaagactgggacacttactctaaacaagcttactgtagacaagagcatggttgaggtattcacaaaggatgttgacaaggaaatgcttctgttactcgcggcaagggcctcaagggttgaaaatcaagatgctattgatgcctgcattgttggaatgctaggtgaccccaaggaggcaagagagggtatcacagaggtccatttcttcccttttaacccagttgacaagcgtacagccatgacatacatcgagtccgatggcagttggcatcgagtcagcaaaggtgcaccagagcagatcatttctctctgcgaccttcgagatgatgtgaagaagaaggctcatgatattattgataaatttgctgatcgtggacttcgttctcttggtgtggctagacaaactgttcctgagaaaaccaaggacagcccggggagtccatgggaatttgtgggccttttacctctttttgatcctcctagacacgacagcgcggagacgattcgtcgcgcactccatcttggtgtgaatgtcaagatgattaccggtgatcagttggccattggtaaggaaaccggtaggaggctgggcatgggaaccaacatgtatccatcatctgctctcctgggccacaataaagatgaaaaagttgacacaatcgatgtggatgagcttattgaaaaggctgatggctttgcaggagttttcccagagcacaaatatgagattgtgaagaggctacaagaaaggaaccacatttgtggcatgactggagatggagtgaatgatgcaccagcccttaagaaggcagacattggaattgctgtggatgacgcaaccgatgcagctcgaagtgcatcggatatagtattaacagagcctggactaagtgtgattgttagtgctgttctaacaagcagagccatttttcagagaatgaaaaactataccatctatgccgtttccatcactatccgtatcgtgctgggtttcatgctccttgctcttatttggaagttcgatttctcccccttcatggttttgatcattgctatactcaatgacggaactattatgaccatctccaaggacagggttaagccatctcctatgcctgactcatggaagctcaaggagatctttgccaccggcattgttctcggaacctaccttgcttgcatgactgttgttttcttctgggctgctaacgattccgacttcttttcggataagtttggggtaaaatccatccggtacagtcaagatgagcttacagccgctgtgtatctccaagtgagtattgtgagtcaggcactcatctttgtgactcgttctcggagctggtcttttatcgaacgtcccggtctccttctagtggttgccttcattctagcacaactggtggctactgtccttgccgtttatgcaaactggggattcgctagaattaaaggcatcgggtggccttgggctggtgttatttggctctacagtatagttttctacatcccacttgatgttctcaagttcttaatccggtatgccttaagtggaaaggcctgggataatctccttcagaataagactgctttcacaacaaagaaggattatggaagggaagagagggaggcacaatgggccacggcgcaacgaacccttcatggattgcaggctcccggagctgaagaaatcttgaatgagaagagcagctaccgagagttatcggagatcgccgaacaagccaagaagcgtgctgaagttgcaaggttgagggagcttcataccctgaaagggcatgttgactcagttgtgaaactcaaaggacttgacattgagaccatcaaccaaaactacactgtatgagaaatgcagggctgaacattgcaaattagcgatatccaatttttttttctttattagttgtttctgtaataacagagtggcaatataaaacacaggcttcatttagctggttcttgttgtccgtatcaatgtaataaagaaaattttttcttccatttaatgattgaaggaatctttcattaattccgt

SEQ ID NO: 2236 - DNA, 3289 bp, Chrysanthemum coronarium
ctttcctgtgaccccagcggttgcctttgcccccagctgccattcacaatgggaggtgataatactcttagccttgaaggaataaaaaatgagactgtcgatctggaaaaagtaccaattgaggaggtgtttgagcagttgaaatgtaaccgtgaaggtctgagcaccagtgagggagaccaaaggcttgaaatctttggacccaacaagttggaggagaagaaggaaagcaaattcctcaagtttctcgggtttatgtggaatcccctatcatgggtcatggaggctgctgccattatggctattgcgttggccaacggaggtgggaagccaccagattggcaagatttcgttggtatcataactcttttggttatcaactccactatcagtttcattgaagaaaacaacgctggaaacgctgctgctgcccttatggcaggtcttgcacctaaaactaaggttctaagagatggtcgatggagtgaacaagaagctgccatcttggttcctggtgatattatcagtatcaagcttggtgatatcgtacctgctgatgcccgtcttcttgaaggtgatcctttaaagattgaccaatctgcacttaccggtgaatcgcttccagtcaccaggaacccatatgatgaagtgttctctggttcaacttgcaagcaaggagaaatcgaagcagttgttattgctaccggagtccacaccttcttcggaaaggctgcacatcttgtcgacaacactaacaatgtcggacatttccagaaagttcttaccgccattggaaacttctgtatttgctccattgccgttggtatggttgttgagatcatcgtcatgtacccaatccaacacagaccatacagaaatggtatcgacaatcttttggtcttgcttattggaggaattccaattgctatgcctaccgttctttcggtcaccatggctattggatcacataggctttcacagcaaggtgctattaccaagagaatgactgccattgaagaaatggctggaatggatgttctctgcagtgacaaaaccggaactttgacgcttaacaagctttcggtggataaaaatattatcgaagtgtttggcaaaggtatggataaggaccaggtgttgctttacgctgcaagagcttctaggacagaaaaccaagatgctattgatggagccattgttggaactcttgctgaccctaaagaggcaagagctggaatcagggaagtccattttctcccattcaaccctgtggacaagaggactgctttgacttacattgacggaaatggtaactggtttagagctagcaaaggtgcacctgaacagattttgaccctctgcaactgccgagaagatttaaagaagaaggttcacgccatgattgataaatttgccgaacgtggtcttaggtctttgggagttgcaagacaggaagtgccacaaaagtcaaaggacagccccggtagtgcatgggagtttgttggactattgtccctttttgatccaccaagacacgacagtgctgagactatccgaagagctctaaatcttggtgttaacgtcaagatgattactggtgatcaacttgctattgctaaggaaactggtagacgtcttggtatgggaacaaacatgtacccatcttcatctttactcggcggaagcaaggatgaatcaattgcatcacttcctattgaagagttgattgagaaagctgatggatttgccggagttttccctgagcacaagtatgaaatcgtgaagaaattgcaagagaggaagcacatctgtggtatgactggagatggtgtgaatgatgcccctgctttgaagaaggctgatatcggtattgctgttgctgatgccactgatgctgcaagaggtgcttctgacattgtgctcaccgagcctgggcttagtgtcatcatcagtgccgtgcttaccagcagagctattttccaaagaatgaagaactacacaatctatgcagtttctatcaccatccgtatcgtgtttggtttcatgtttattgcattgatatggaagtttgacttctctcccttcatggttcttatcattgccattcttaatgacggtacaatcatgacaatctcaaaggacagagtgaaaccatctccactacccgacagctggaaactaaaggaaatctttgccactggtgttgttcttggaggatacctagctttgatgaccgttatcttcttctggatcatgaaggacaccgacttcttcacggagaaatttgatgtgaaatcaatcaggaacagtgagcccgagatgatggctgctttatatttacaagtcagtattgtgagtcaagctttgatctttgtcactcgatcccgaagctggtcgtttgttgaacgtcccggatttttgctaatgggtgctttcctagcagcacaattggtggcaactgttattgccgtatatgctgactgggaattcgccagaatcaagggaattggatggaaatgggctggtgttatctggctttacagtatcgtgttttatttccctcttgatatcatgaagtttgccatccgttacatcctcagtggaaaggcttggaactcaatgattgacaacagggttgctttcacaacaaagaaggattacggaagaggagagagagaggctcaatgggctcatgcacagagaactctacatggacttcaagcacctgatacatcaaacctcttcaacgagaagagcagctacagagaactttctgaaatcgctgaacaggctaaaagacgtgctgaagttgcaaggcttcgtgaggtacttactctcaagggtcacgttgagtcggtggtgaaactgaagggtcttgacattgacaccattcaacaacattatacagtataagggaaaagagttgggttttttttttctacctttaacttattacagaatcgagggcgactagaagaccatgttacaaccatgggacgacgtgtctcgagtgtctaaagtttgtgttatttttgtgcatttctggagtacacccataaaggggtttgtggttggtcgcttcttacttgtcagcaccgaagcaaagttgaacatttttctataacgtagtttctttctccccgtttactatgtttgtttgtactgaacaaaaccaatggtgcaattggtgcttgtaatctacaagttttacgatcgagatacatttcttgttaagtacctgatgttgtgtatgaaacggttttggttaataatgtactatcaaggttca

SEQ ID NO: 2237 - DNA, 3327 bp, Chrysanthemum coronarium
gacacacacatacacactctctcttatctttcttccttctttccggtgaccccagcggttgcctttgcccccagctgccattcacaatgggaggtgataatactcttagccttgaaggaataaaaaatgagactgtcgatctggaaaaagtaccaattgaggaggtgtttgagcagttgaaatgtaaccgtgaaggtctgagcaccagtgagggagaccaaaggcttgaaatctttggacccaacaagttggaggagaagaaggaaagcaaattcctcaagtttctcgggtttatgtggaatcccctatcatgggtcatggaggctgctgccattatggctattgcgttggccaacggaggtgggaagccaccagattggcaagatttcgttggtatcataactcttttggttatcaactccactatcagtttcattgaagaaaacaacgctggaaacgctgctgctgcccttatggcaggtcttgcacctaaaactaaggttctaagagatggtcgatggagtgaacaagaagctgccatcttggttcctggtgatattatcagtatcaagcttggtgatatcgtacctgctgatgcccgtcttcttgaaggtgatcctttaaagattgaccaatctgcacttaccggtgaatcacttccagtcaccaggaacccatatgatgaagtgttctctggttcaacttgcaagcaaggagaaatcgaagcagttgttattgctaccggagtccacaccttcttcggaaaggctgcacatcttgtcgacaacaccaacaatgtcggtcatttccagaaagttctaaccgccattggaaacttctgtatttgctccattgccgttggtatggttgttgagatcattgtcatgtacccaatccaacacagaccatacagaaatggtatcgacaatcttttggtcttgcttatcggaggaattccaattgctatgcctaccgttctttcggtcaccatggctattggatcacataggctctcacagcagggtgctattaccaagagaatgactgccattgaagaaatggctggaatggatgttctctgcagtgacaaaaccggaactttgacgcttaacaagctttcagtggataaaaatattatcgaagtgtttggcaaaggtatggataaggaccaggtgttgctttacgctgcaagagcttctaggacagaaaaccaagatgctattgatggagccattgttggaactcttgctgaccctaaagaggcaagagctggaatcagggaagtccattttctcccattcaaccctgtggacaagaggactgctttgacttacattgacggaaatggtaactggtttagagctagcaaaggtgcacctgaacagattttgaccctctgcaactgccgagaagatttaaagaagaaggttcacgccatgattgataaatttgccgaacgtggtcttaggtctttgggagttgcaagacaggaagtgccacaaaagtcaaaggacagccccggtagtgcatgggagtttgttggactattgtccctttttgatccaccaagacacgacagtgctgagactatccgaagagctctaaatcttggtgttaatgtcaagatgattactggtgatcaacttgctattgctaaggaaactggtagacgtcttggtatgggaacaaacatgtacccatcttcatctttactcggtggaagcaaggatgaatcaattgcatcactccctattgaagagttgattgagaaagctgatggatttgccggagttttccctgagcacaagtatgaaatcgtgaagaaattgcaagagaggaagcacatctgtggtatgactggagatggtgtgaatgatgcccctgctttgaagaaggctgatatcggtattgctgttgctgatgccactgatgctgcaagaggtgcttctgacattgtgctcactgagcccgggcttagtgttatcatcagtgccgtgcttaccagcagagctattttccaaagaatgaagaactacacaatctatgcagtttctatcaccatccgtatcgtgtttggtttcatgtttattgctttgatatggaagtttgacttctctcccttcatggttcttatcattgccattcttaatgacggtacaatcatgacaatctcaaaggacagagtgaaaccatctccactacccgacagctggaaactaaaggaaatcttcgccactggtgttgttcttggaggatacctagctttgatgaccgttatcttcttctggatcatgaaggacaccgacttcttcacggagaaatttgatgtgaaatcaatcaggaacagtgagcccgagatgatggctgctttatatttacaagtcagtattgtgagtcaagctttgatctttgtcactcgatctcgaagctggtcgtttgttgaacgtcccggatttttgctaatgggtgctttcctagcagcacaattggtggcaactgttattgccgtatatgctgactgggaattcgccagaatcaagggaattggatggaaatgggctggtgttatctggctttacagtatcgtgttttatttccctcttgatatcatgaagtttgccattcgttacatcctcagtggaaaggcttggaactcgatgattgacaacagggttgctttcacaacaaagaaggattacggaagaggagagagagaggctcaatgggctcatgcacagagaactctacatggacttcaagcacctgatacatcaaacctattcaacgagaagagcagctacagagaactttctgaaatcgctgaacaggctaaaagacgtgctgaagttgcaaggcttcgtgaggtacttactctcaagggtcacgttgagtcggtggtgaaactgaagggtcttgacattgacaccattcaacaacattatacagtataagggaaaagagttgggttttttttttctacctttaacttattacagaatcgaggccgactagaagaccatgttacaaccatgggacgacgtttctcgagtgtctaaagtttgtgttatttttgtgcatttctggagtacacccataaaggggtttgtgtttcgtcgcttcttacttgatagcactgaagcaaagttgaacatttttctataacgtagtttctttcgccccgtttactatgtttgtttgaatgaatcactgtaatgaacaaaaccaatggtgtaattggtgcttgtaatctacaagttttacgatcgagaaacttaaatttgaagtaccctatgttatgtatgaaacgattttggttaataatgtact

SEQ ID NO: 2238 - DNA, 3331 bp, Chrysanthemum coronarium
acactactcgtcacacatacacactctctcttatctttcttccttctttccggtgaccccagcggttgcctttgcccccagctgccattcacaatgggaggtgataatactcttagccttgaaggaataaaaaatgagactgtcgatctggaaaaagtaccaattgaggaggtgtttgagcagttgaaatgtaaccgtgaaggtctgagcaccagtgagggagaccaaaggcttgaaatctttggacccaacaagttggaggagaagaaggaaagcaaattcctcaagtttctcgggtttatgtggaatcccctatcatgggtcatggaggctgctgccattatggctattgcgttggccaacggaggtgggaagccaccagattggcaagatttcgttggtatcataactcttttggttatcaactccactatcagtttcattgaagaaaacaacgctggaaacgctgctgctgcccttatggcaggtcttgcacctaaaactaaggttctaagagatggtcgatggagtgaacaagaagctgccatcttggttcctggtgatattatcagtatcaagcttggtgatatcgtacctgctgatgcccgtcttcttgaaggtgatcctttaaagattgaccaatctgcacttaccggtgaatcacttccagtcaccaggaacccatatgatgaagtgttctctggttcaacttgcaagcaaggagaaatcgaagcagttgttattgctaccggagtccacaccttcttcggaaaggctgcacatcttgtcgacaacaccaacaatgtcggtcatttccagaaagttctaaccgccattggaaacttctgtatttgctccattgccgttggtatggttgttgagatcattgtcatgtacccaatccaacacagaccatacagaaatggtatcgacaatcttttggtcttgcttatcggaggaattccaattgctatgcctaccgttctttcggtcaccatggctattggatcacataggctctcacagcagggtgctattaccaagagaatgactgccattgaagaaatggctggaatggatgttctctgcagtgacaaaaccggaactttgacgcttaacaagctttcagtggataaaaatattatcgaagtgtttggcaaaggtatggataaggaccaggtgttgctttacgctgcaagagcttctaggacagaaaaccaagatgctattgatggagccattgttggaactcttgctgaccctaaagaggcaagagctggaatcagggaagtccattttctcccattcaaccctgtggacaagaggactgctttgacttacattgacggaaatggtaactggtttagagctagcaaaggtgcacctgaacagattttgaccctctgcaactgccgagaagatttaaagaagaaggttcacgccatgattgataaatttgccgaacgtggtcttaggtctttgggagttgcaagacaggaagtgccacaaaagtcaaaggacagccccggtagtgcatgggagtttgttggactattgtccctttttgatccaccaagacacgacagtgctgagactatccgaagagctctaaatcttggtgttaacgtcaagatgattactggtgatcaacttgctattgctaaggaaactggtagacgtcttggtatgggaacaaacatgtacccatcttcatctttactcggtggaagcaaggatgaatcaattgcatcactccctattgaagagttgattgagaaagctgatggatttgccggagttttccctgagcacaagtatgaaatcgtgaagaaattgcaagagaggaagcacatctgtggtatgactggagatggtgtgaatgatgcccctgctttgaagaaggctgatatcggtattgctgttgctgatgccactgatgctgcaagaggtgcttctgacattgtgctcactgagcccgggcttagtgtcatcatcagtgccgtgcttaccagcagagctattttccaaagaatgaagaactacacaatctatgcagtttctatcaccatccgtatcgtgtttggtttcatgtttattgctttgatatggaagtttgacttctctcccttcatggttcttatcattgccattcttaatgacggtacaatcatgacaatctcaaaggacagagtgaaaccatctccactacccgacagctggaaactaaaggaaatcttcgccactggtgttgttcttggaggatacctagctttgatgaccgttatcttcttctggatcatgaaggacaccgacttcttcacggagaaatttgatgtgaaatcaatcaggaacagtgagcccgagatgatggctgctttatatttacaagtcagtattgtgagtcaagctttgatctttgtcactcgatctcgaagctggtcgtttgttgaacgtcccggatttttgctaatgggtgctttcctagcagcacaattggtggcaactgttattgccgtatatgctgactgggaattcgccagaatcaagggaattggatggaaatgggctggtgttatctggctttacagtatcgtgttttatttccctcttgatatcatgaagtttgccatccgttacatcctcagtggaaaggcttggaactcaatgattgacaacagggttgctttcaccacaaagaaggattacggaagaggagagagagaggctcaatgggctcatgctcaaagaactctacacggacttcaagcacctgatacatcaaacctattcaacgagaagagcagctacagagaactttctgaaatcgctgaacaggctaaaagacgtgctgaagttgcaaggcttcgtgaggtacttactctcaagggtcacgttgagtcggtggtgaaactgaagggtcttgacattgacaccattcaacaacattatacagtataagggaaaagagttgggttttttttttctacctttaacttattacagaatcgaggccgactagaagaccatgttacaaccatgggacgacgtgtctcgagtgtctaaagtttgtgttattttgtgcatttctggagtacacccataaaggggtttgtggttggtcgcttcttacttgtcagcaccgaagcaaagttgaacatttttctataacgtagtttctttctttccccctcgtttactatgtttgtttgtactgaacaaaaccaatggtgcaattggtgcttgtaatctacaagttttacgatcgagatacatttcttgttaagtacctgatgttgtgtatgaaacggttttggttaataatgtactatca

SEQ ID NO: 2239 - DNA, 2969 bp, Cyclamen graecum
ttgatctggagaaaatcccgatagaggaggttttcgagcagctgaaatgtacccgagagggattaagctccgaggaaggttccaacaggcttcagatctttggacccaacaaattggaagagaaaaaggaaagcaagtttctcaagtttctcgggttcatgtggaacccgctctcgtgggttatggaagcagctgccatcatggccatcgcgctggctaatggggatgggaagcctcctgattggcaagatttcgtgggtatcttttgcttgttggttatcaactcgactatctccttcattgaagagaacaatgcaggcaatgctgcagctgcccttatggctggtcttgctcccaaaaccaaggttttgagagatgggaaatggagcgagcaggaggccgcgatcttggtgccgggagacctcatcagcgtcaagctcggcgacatcatcccagccgacgcccgtctcctcgaaggcgatccattaaagatcgaccagtcggcactgacaggcgagtccttgccagttaccaagtatccggggaatgaggtgttctccgggtccacttgcaagcaaggggagttagaggccgtcgttattgccacgggggttcacacattcttcgggaaggctgcccatctcgtcgacagcaccaaccaagtcggacacttccagaaggtgttgactgcgattggtaacttctgcatctgttcgattggcatcgggatgctggtagagatattggtaatgtacccgatccagggcagagcgtacagacagggaattgacaacctgttggtgctcctcatcggaggtattcccattgccatgcccacggtcttgtccgtgaccatggccatcgggtcccacaggctatcccaacagggggctattaccaagaggatgaccgcgattgaggaaatggctgggatggatgtcctttgcagtgataagaccggaaccctcaccctgaacaagctcacggtcgacaagaccttgatcgaggtgttcgccaaagacttggataaggactctgttgtcttgcttgccgctagggcctccagaatcgaaaaccaggacgctattgatgcttcaatcgtcggaatgttgggtgaccccaaggaggcaagagcagggctcacagaggtgcattttctgcccttcaatccggtagataagcgcactgccattacgtacatcgacgacgaaggcaactggcacagatgcagcaagggtgctcctgagcaaatcattgaactctgcaatctcaaaggaaatgcgaagaataaatcccttgctatcatcgacaactacgccaaccgtgggctccgttctctcggtgttgcaagacagactgtttcggagaaatctaaggagagtgccggagatccatgggaattcgtcggtcttttgcccctcttcgaccccccaagacacgacagtgcagaaaccatccgcagggctcttgatctcggtgtcaatgtcaagatgattactggcgatcagcttgctattggaaaagaaaccgggcgtaggcttggaatgggcacaaacatgtacccatcgtcgtcccttcttggccagtgcaaggacgagtctatcacaggcatccccatcgatgagctcattgagaaggctgatggatttgccggggtctttcctgagcacaagtacgagatcgtgaagaagctgcaagagagaaaacatatttgcggtatgaccggagatggtgtgaacgatgccccagctctaaagaaagccgacattggtatcgccgtggctgatgctacagatgctgccaggggagcatccgacatagtcctgactgagccaggcctcagcgtgatcgtgagcgcggtcctaaccagcagagccatcttccagaggatgaagaactacacaatctatgccgtatctatcaccatccgtatcgtgatgggtttcatgctcatcgccctcatctggaagttcgacttctcgcctttcatggtcctgattattgccatcttgaacgacggaaccatcatgaccatttccaaggatagagttaagccatctccattgcccgactcgtggaagctcaaggagatcttcgccacaggtgttgtccttggaacctatctggctatcatgaccgtggtctttttctggctcgcagctgacactgacttcttctcgaacactttcggtgttagatcactcaggggaaatgtagatgagctcaccgctgctctctaccttcaagtgagtatcgtgagccaagctctcatcttcgtaaccaggtcacgtgggtggtcgtttgtcgaacgccccggtgtcttgctcgtcactgcctttttcctagctcaactggttgccactttaattgctgtatatgcacactgggattttgctcgcattcacggatgcggatggggatgggccggagtcatttggcttttcagccttgttacctatttccctctcgatgtcctcaagttcatcattcgatattcgttgagtgggaacgcttggaataccatgatccaaaacaagactgcattcacaaccaagaaggattacggtaaaggtgagagagaagcacaatgggccgtagcccagcgtacccttcacggtctccaatctgcccagggttacaacgacgaacaccataccgagtccgatctagctgagcaggccaaaaagcgtgccgaagttgccaggttgagggagctccatacattgaagggacatgttgaatcagtggtgaagctgaagggtttggatatcgataccattcaacagcactacactgtctaaagccaacgagcgggttgaaatgtaatggtttattttttcacgattcttggcttttgagaaaagtaggagaaaatacgagtaatttgtatgggggaatcacaactttttctttatttgttggaacgaaatgtagaggtgattggagatctaagacgggaactcaaacga

SEQ ID NO: 2240 - DNA, 3325 bp, Ambrosia trifida
ggcgaagagagactctcctcacacatccttatctctcttctcttctctttctctactatatttttctcctttaaggccttatatcaatcatactccattgtaagattatcatcaactttcatcaatccaattgctcctgctcattagttaattgatctcgctatcgaagatgggcggcgacactgctctcagcctcgaaggcattaaaaatgagaccgttgatctggaaaaagtaccaatcgaagaggtgtttgaacaattgaaatgtaaccgtgaaggtctgagctccgatgaaggagcccaacggcttgaaatctttggacccaacaagttggaggaaaaaaggaaagcaaaatcctcaagtttcttggttttatgtggaaccccctatcatgggtcatggaggctgcagccataatggcaatcgcccttgctaatggtggtggtaggccgccggattggcaagactttgttggtattgtttgcctgcttgttatcaactccaccatcagttttattgaagaaaacaatgctggaaatgctgctgctgcacttatggctggtcttgcacctaaaactaaggttctgagggatggtcgttggagtgaacaagaagctgcaatattggttccgggagatatcataagtatcaaacttggtgatattgtacctgctgatgcacggcttcttgaaggtgatcctttaaaaattgaccagtctgctcttaccggtgaatctctgcctgtcaccaagaatccatatgatgaagtgttctctggttcaacttgcaagcaaggtgaacttgaagccgttgttattgctaccggagtccataccttttttgggaaggctgcacatcttgtggatagcactaaccaagttggacacttccaaaaggttctaacagcgatcggaaacttctgtatttgctccattgctgttggaatggctgttgagattattgttatgtacccgatccaacacagagagtacagagcaggaattgacaatctattggtgttgcttattggtgggattccaattgctatgcctactgttctttcggttacaatggctattggatcacacaggctttcacagcaaggtgctatcacaaaagaatgactgccattgaagaaatggcgggaatggatgttctttgcagtgacaaaacaggaactttgacactaaacaaactcacagttgacaaaaatttgattgaggtgttcgccaaaggtttggataaggaacaggtgttgctttatgctgctcgcgcttctagaacagaaaaccaagatgctattgatgcagccattgttggaacccttgctgacccgaaagaggcacgagcgggcatcagagaggtccatttcttcccattcaaccctgtcgataagagaactgctttaacttacattgataataacggcaactggtttagagctagcaaaggtgcaccggaacagattttgacactttgcgggtgcaaggaagatctcaagaagaaagtccacgcaatgattgataaattcgccgaacgtgggttgagatctttgggtgttgctagacaggaagtgccgcaaaaatcaaaagatagcacgggtggtccatgggaattcgttggattgttgtctctctttgacccaccaaggcatgacagtgctgagaccattagaagagctctcaatcttggtgtaaatgtcaagatgattactggtgatcaacttgctattgctaaggaaaccggtagacgccttggtatgggaactaacatgtacccttcttcttctttacttggcggacacaaggacgaatcaattgctggacttcctgtagatgagttgatcgagaaagctgatggatttgctggagttttccctgagcacaagtatgaaattgtgaagaaattacaagagcggaagcacatttgtggaatgaccggagatggtgtgaatgacgcacctgccttaaagaaggctgatattggaattgcggtagctgatgctacagatgctgcaagaagcgcttcggatattgtgcttactgagcctggtctcagtgtgatcattagcgctgtgcttactagtagagctattttccaaagaatgaaaaattacacgatctatgccgtttctatcaccattcgtattgtgtttggatttatgttcatcgctttgatatggaagtttgacttctctcccttcatggttcttattattgcaattcttaacgacggtactatcatgacaatctcaaaggatagagtaaaaccatctccattaccagacagctggaagctaaaagagatctttgccactggagttgctcttggaggttacttagccttaatgacagttatcttcttctatatcatgaaggataccgactttttcactgataaatttagtgtgaaatctctgaggaatagtaaccccgagatgatggctgctttatatttgcaagtcagtatcgtgagtcaagctctcatctttgtcacccgatcacgtagctggtcattcattgaacggcctgggtttctactgatgggtgccttcctagcagcacaactggtagcaactataatcgctgtatacgcagagtggggattcgctagaatcaaaggaatcggatggaaatgggccggtgttatctggctttacagtatagtgttttatttccctcttgatatcatgaagtttgccatcagatacatcctcagtggcaaggcttggctcagcatgattgacaacaggactgctttcacaaccaagaaggattacggtagaggagagagagaggcgcaatgggctcatgctcaaaggactttacatgggcttcaagcacctgatacatcaaatctgtttaatgagaagagcagctacagagaactatctgaaatcgctgaacaagccaaacgacgtgctgaagttgcaaggcttcgagaggtgcttacgctcaagggtcatgttgagtcagtggtgaaactgaaggggcttgacattgatacaattcaacaacattatacagtatgaggtgcttttgataatggggcggtttttaacttattatagaatcgaggccagcttaacgtccgtgtttagaccatggagagcagtgttgtatgcagtgttgcagcctcgagtgtttaaagtttatgttatcttgtaaaatttctagagtatacccgtaaacgatttgtgttttggtcgcttcttgttatctaaaatttggtaacgtttttaatatgacttttagttttttttaacttgaaaatatactccaattccattacaaactctgcatccttgttatagaatctccccac

SEQ ID NO: 2241 - DNA, 3139 bp, Malus domestica
aaaatggcggaaggcaaagcaattagcttggaggaaatcaagaaggaaaatgtcgacctggagcgcattccagttcaggaagtgttcgaacaattgaattgcacaaaagagggtttgtcaagcgatgaagggcagaagaggcttcagatcttcgggccaaacaagctcgaagaaaagaaggataacaaagtgctcaagtttttgggttttatgtggaatcccctatcgtgggtgatggaggctgctgcaatcatggccattgccttggcaaatggagggggaagaccaccagactggcaggactttgtgggaattactgctctcttgatcatcaactctaccataagctttatcgaagaaaacaatgcaggaaatgctgcagcggcattgatggcgggtcttgcaccgaaaacaaaggttctgagagatggaagatggaatgagctagaagctgcaatcttggtaccaggagatgtggtcagtattaagttgggagatattgtccctgcagatgctcgtctcttggacggagatcctctaaagatcgatcaatctgccctcactggtgaatctctgcccgtgacaaggtaccctggcgatgaagttttctctggctcgaccgtcaagcaaggtgagattgaggcagttgtaattgccaccggtgttcataccttctttgggaaggctgctcaccttgttgatagcaccaaccaagtaggccacttccaaaaggttttgactgccattggaaacttctgcatatgctccattggcgtgggaattgttattgaggtaatagtcatgtatccaattcagcaccgggcgtacagagatggaattgacaatctcctggtgcttctcattggaggcattccaattgctatgccaacggtgttgtcagttacgatggcaattggttcccaccgcctctcgacacaaggtgccatcaccaagaggatgacagccattgaggagatggctggaatggatgtcctctgcagtgataagactggaactcttactcttaacaagcttacagttgacaagaccatggttgaggtgtttgtaaaggatgtggacaaggatggcctaattctgctcggagccagggcttccagggttgagaatcaggacgccattgacacctgcatcgttggaatgctgggagaccccaaggaggccagggaaggaataaatgaggtccatttcttgccctttaatccagtggaaaaacgtaccgccataacatacatcgaccctgaagggaattggcatcgggttagcaaaggtgcaccagagcagatcattgagctttgcaacctaaagggtgatgctgagaagaaagcacatgctatcattggcaagtttgcagatcgcggccttcgttcccttgctgttgctagacagaccgtaccagaaaaaaccaaagagagtgctggaacaccatggcagtttgtgggtctcttgcctctctttgatcctccaaggcatgatagtgcagagaccattcgccgagcccttaatctcggtgtcaatgtcaagatgattactggtgatcagcttgccattggcaaagagaccggtcgcagacttggcatgggcaccaacatgtatccttcttcttccctccttggtgacacaaaggacgagtcgatcgctagcctccctattgatgagcttatcgaaaaggctgatggctttgctggtgtcttcccagagcataagtatgaaattgtcaagaggctgcaagacaggaagcatatttgtgggatgactggagatggtgtgaatgatgccccagctctaaagagggcagacattggaattgcagtggatgatgcaactgatgcagctcgcagcgcatccgacattgtcctgacagaaccagggttgtctgtgatcatcagtgctgtgttgacgagcagagccatcttccagaggatgaagaattacaccatttatgccgtttccataacaatccgtgttgtgctaggttttatgctccttgctctcatctggaagtttgatttctcgcctttcatggttctggttatcgccatactcaatgacggaacaatcatgactatttctaaagatagggtgaagccatctcctcttccagactcatggaagctaaaggagatcttcgcgactggcgtagtccttggcacctacatggctgtcatgactgttgttttcttctgggcggctcatggctctgactttttcacggaaaaatttggggtaagatctatcaggggaaactttcctgagcttacagcagctatctacctacaagtgagtattattagtcaggcacttatctttgttactcgatcgcgaagctggtcttatgttgaacgccccggtttctttctcttgggagcctttgtcatagcacagctgattgctaccataattgctgtttatgctaactggggctttgcaagaatccatggcattggatggggatgggcaggagttatctggctctacagccttatcacctacgtaccattggacattctcaagttcatcattcgatacgtgttgagcggcaaggcctgggataatgtacttgagagaaagactgctttcacaacaaagaaggattacggaaagggagagagggaggcgcaatgggctaccgctcagcgaaccctccacggtctgcagcctcctgagacatctgagctctttaatgacaagaacaactacagagagttgtctgaaatcgctgaacaggccaagaggcgagctgaagttgctaggttgagggagcttcacacactcaaggggcacgtcgagtcggtggtgaagcttaaaggactagacattgacaccattcaacaacactacactgtttaagtgagtggcaagacgaaagacaactagcgcattagcatgggaatccagtgttcatccttaaaaagaaaaaaaccaacaaaaaccaaggaaaaaaattgctgttatttgtcattaactttgtaggaggatgacggggttgggaataatccaatgggggagttgttttagacaacctaaggttggaatcggttatattagaaggttgaatcttgtattctctatgaattaaataattagttcatttcaatgataatttgctatttttcgcttc

SEQ ID NO: 2242 - DNA, 3178 bp, Arnica chamissonis
ttctcggcgttatcgccgccgtcgccggtaatttcctccctccgccattgcaaagatgggtggcgataaggctctcagtctcgaagagattaaaaacgaaaccgttgatctggagaaagtaccgattgaggaggtgtttcaacagttgaaatgtgaccgcgaaggtctaagttcagatgaaggagccacaagacttgaaatttttggacccaacaaacttgaggagaaaaaagaaagcaagctactcaagtttcttgggttcatgtggaatcctctatcatgggtcatggaagctgcagcaattatggcaattgcaatggctaatggaggcggaaaaccgccagattggcaagactttgtaggtattgtttgccttcttgttatcaactcaaccatcagttttattgaagaaaacaatgctggaaacgcggctgctgcacttatggctggtcttgcccctaaaacgaaggttctgagggacggtcgttggagtgagcaagaagcttccatcttggttccgggagatatcatcagtatcaaacttggtgatatcgttccagctgatgctcgtcttctagaaggtgatcctttaaagattgaccaatctgcccttactggtgaatcacttcctgtgaacaagaatccttatgatgaggtgttctctggttcaacttgcaagcaaggtgaaatcgaagccgttgttattgccactggtgtgcacaccttctttgggaaggctgcacatcttgtggatagcacgaaccaagttggtcatttccagcaagttcttacagcaatcggaaacttctgtatttgctccattgctgttggaatgttggttgagatagttgtcatgtacccaattcagcacagacagtacagaagtggaattgacaatcttttggtgttgcttattggtggaattccaattgccatgcctactgttctttcggtcaccatggctatcggatcacataggctttcacagcagggtgccattactaaaagaatgactgcaattgaagagatggctggaatggatgtactctgcagtgataagacaggaacactgacacttaacaagctttcggttgataaaaacttgatagaggtgtttgcgaaaggtgtggataaggagcaggtgttgctttttgctgctagggcttctaggaccgaaaaccaggatgctattgatgctgccattgttggaacgcttgctgatcctaaagaggcacgagctggaattagggagattcattctttccatttaaccctgttgacaagaggacagctttgacttacattgacgaccgtggaaattggcatagaacaagcaaaggtgctccagaacagattttgaccctctgtggatgcaaagaagatttgaaaaagaaagttcatgcaatgattgataaatttgctgaacgcgggttgcgttctttggctgttgcaaaacaggaagtgcctgaaaaaacaaaagaaagccccggtggcgcatggcaatttgttggattgttgtccctcttcgacccgccaaggcatgacagtgccgagaccattcgtagagctctcaatcttggtgtaaatgtcaaaatgattactggagatcaacttgccattgctaaggagaccggtagacggcttggtatgggaacaaacatgtacccttcttcttctttgcttggtggccacaaggatgcatcgattgcagcactccctattgaagagttgattgagaaagcagatggatttgcaggagttttcccagaacacaagtacgagattgtgaagaagttacaagaaagaaagcacatttgtgggatgactggagatggtgtgaatgatgccccggctttgaagaaggccgacatcggaattgctgttgctgatgctacagatgctgcaaggagtgcttctgacattgtgcttaccgagcctgggcttagtgttattatcagtgcagtgcttaccagtcgagctattttccaaagaatgaagaattataccatatatgccgtctctatcaccatacgtattgtgtttggatttatgttcatcgctttgatatggaagtttgacttctctcccttcatggttttgattattgcaatccttaatgatggaactatcatgacgatctcaaaggatagagtgaaaccgtctccattacccgacagctggaagctaaaagagatctttgccactggagttgtgcttggaggatacctagcactgatgactgtcatattcttctggatcatgagagacaccgacttcttctcggacaagtttggtgttagatctctgagaaacagtgaagttgagatgatggctgctttatatctccaagtcagtatagtcagccaggctttgattttcgtgacccgttctcgcagttggtcttttatcgaacgcccgggtctcttgttattgagtgctttctttgccgcacaactggttgcaactctaatagcagtgtatgcagagtggggttttgcgagaatcaagggagtcgggtggggatgggctggtgtcatctggctctacagcatcgtgttctacttccctcttgatattatgaaattcgccatccgatacatccttagcgggaaagcgtggctcaacttctttgaaaacaagactgctttcacaaccaagaaggattatggaaaagaagagagagaagcgcaatgggctcttgctcagaggacactacatggtcttcaagccccagaaacctcaaatatcttcaatgaaaagagcggctacagagaactgtcggaaatagcagaacaggctaagagacgcgctgaagttgcaagacttcgggaggtgcttacactgaaggggcacgttgagtcagtggtgaagctgaaggggctggatatcgacacgatccaacagcattacaccgtgtgagagaggggtctgttttttctttaacttattatgagactagtagacgatgatgataacttgtgtggggaaaggcattttatgctgggaattaacccctaacaacttggtcctgtttttccgtttccgagtatggttgtttgtgtatgtgttaagaaagaatgtaaaacatttcccataacttagtttgcatgtaaaacacaacacatgatgatattgttggctttactgcttcactttctgcctcggcattaaacaccaa

SEQ ID NO: 2243 - DNA, 3074 bp, Flaveria ramosissima
atgggtggtgataaggctctcagcctcgaagagattaagaatgaaactgttgatctggaaaaagtgccgattgaggaggtgttcgaacagttgaaatgtaaccgagaaggtctaagctcagatgaaggagctgcaagacttcaaattttcggacctaacaaattggaggagaaaaaggaaagcaaaatactcaagtttcttgggttcatgtggaatcctctatcatgggtcatggaagctgcagccatcatggcaattgcactggctaatggaggcggaaaaccaccagattggcaagactttgttggtattgtttgccttctcgttatcaactcgaccatcagttttatcgaagaaaacaatgctggaaatgctgctgcagcacttatggctggtcttgcccccaagaccaaggttctgagggatggtcgttggagtgagcaagaagccgcaatcttggttccgggagatattatcagtataaaacttggtgatatcgttcctgctgatgctcgtcttctagaaggtgaccctttaaagattgatcaatctgctctgactggtgaatcacttcctgtgaacaagaatccttatgatgaggtgttttctggttcgacttgcaagcaaggtgaaatagaagctgttgtcattgcaactggtgtgcacactttctttgggaaagcagcacatttagtggatagcactaaccaagttggtcatttccaacaagttttaacagcaattggaaacttctgtatttgctcaattgctgttggtatgttggttgagattattgtcatgtatccgattcagcacaggccatatagaagtggaattgacaatcttttggtgttgcttattggtggaattcccattgctatgccaactgttctttctgtcaccatggctattggatcacataggctttcacaacagggtgctattactaaaagaatgactgcaattgaagaaatggcgggaatggatgtactttgcagtgataaaacaggaacactgacacttaacaagcttacagttgataaaaatttgattgaggtttttgctaagggtgtggataaggaacaggttttgctttatgctgctagggcttctaggactgaaaatcaggatgctattgatgctgccattgttggaacccttgctgaccctaaagaggcacgagctggaattcgagaggtccatttctttccatttaatcctgttgacaagagaacagctttgacatacatcgatgagcaagggaactggcatagaacaagcaaaggtgctcccgaacagattttgaccctctgtggatgcaaagaagatttgaaaaagaaagttcatgcaatgattgataaatttgctgaacgtgggttgcgttctttggctgttgcaaaacaggaagtgcctgaaaaaacaaagaaagccctggtggtccgtggcagtttattggattgttgtccttgtttgacccacctaggcatgacagtgccgagaccattcgtagagctctcaatctcggtgtaaatgttaagatgattactggtgatcaacttgctattgctaaggaaaccggtagacggcttggtatgggaacaaacatgtacccttcttcttctttacttggtggccacaaggatgcatctatagcagctctccctattgaagagttgattgagaaagctgatggatttgctggagttttcccagaacacaagtatgagattgtgaagaagctgcaagaaagaaagcacatttgtggaatgactggtgatggtgtgaatgatgcacctgctttaaagaaagctgacattggaattgctgttgctgatgccactgatgctgcaaggagtgcttctgacatcgtgcttaccgagcctgggctcagtgtcatcatcagtgcagtgcttactagtcgagctattttccaaagaatgaagaattacaccatctatgctgtttctatcaccattcgtattgtgtttggatttatgttcattgctttgatatggaagtttgacttctctcctttcatggttttgattattgcaatccttaatgacggcacaatcatgacaatctcaaaggacagggtgaaaccatctccattacccgatagttggaagctaaaagagatctttgccactggcattgtgcttggaggttacctagcattgatgactgtcatattcttctggatcatgaaatctacaaacttcttctcagacacatttggtgttagatctttgagaaacagtgaagttgagatgatggctgctttatatcttcaagtcagtatagtcagccaggctttaatctttgtgactcgctctcgcagttggtcgtttatagaacgtccaggtctcttgctgttgggtgctttcttggcggcacaattggtggcaaccttaatagcagtgtatgcagagtgggagtttgcaagaatcaagggagtcggatggggatgggctggtgtcatctggctctacagcatcgtgttctacttccctcttgaccttatgaaattcgccatccgatatatccttagtgggaaagcatggctcaacttgcttgaaaacaagactgccttcacaaccaagaaggattatggaagagaagagagagaggctcaatgggctcttgctcagaggacattacatgggctgcaagcaccagaaacatcaaatatatttaatgaaaagagcagctaccgggaactgtctgaaattgcagaacaggctaagagacgtgctgaagttgcaaggcttcgcgaggtgcttacattgaaggggcatgttgagtcggtagtgaagctgaaggggatagatcttgacaatatccagcaacattacacagtgtgagagagcaatgagaaacaagtcctttttttcttttaacttattacgtgactagtagaagttgataactcgtgtggggaaatggtactttatgctgcaatgtaacccccccgaaactgtttacttctgtttttctagtgcatttccgagtattacagcatatggttgttgctgctgctttgtgtatgtttagaaagaatgaaagctacataa

SEQ ID NO: 2244 - DNA, 3123 bp, Medicago truncatula
gcagatttcatttgtatcatcatctatctctacatttttttttctgttcactttcttcttcgtactctccgtttctctctaccgtctatgggtggtagagacctggagagtgttgaaagtatacagataattataaatttaaaaattatataaaaagaagattaactttatagtttttctcttttcatcatgactactgatatttcatttgaggatctgaaggacgagaatgtggaccttgaaaacattccaattgatgaagtctttcagcagctaaaatgtaccaaagagggtctctcatccgaggaaggagagaagaggctccaagtttttggacccaacaagctagaggagaaatcagagagcaaactcctcaagtttttgggttttatgtggaatccattatcatgggtcatggaggcagctgcaatcatggccattgtattggccaatggagggggaaaaccaccggattggcaagatttcactggtattatggtgttgcttatcattaactcaacgattagtttcattgaggaaaacaatgctggaaatgctgcagctgctttgatggccggtcttgccccaaaaaccaaggtgttgagggatggaaaatggagtgagcaagaggcagaaattttggtgccgggagatgtgatcagtatcaagttgggagacattgtcccagctgatgcccgtcttttggaaggagatcccttaaagattgaccagtctgcccttactggtgagtccttgccagtaacaaggaaccctggtcaagaggtcttctctggttcaacttgcaagcaaggtgaaatcgaggctattgtcattgccactggtgtccacaccttctttgggaaggctgcacaccttgttgatagcaccaacaatgttggtcacttccaaaaggtgttgacatccattggtaacttctgtatctgctcaattgctgtgggaatggtgattgaaatcattgtgatgtatcccatccaaaatagagcttacagagatggtattgacaacttgttggttcttctcattggaggtatcccaattgctatgccaactgtcttgtctgtgaccatggctattggatctcaccgcctttctcagcaaggagctatcaccaagaggatgacagccatcgaagaaatggcaggaatggatgttctatgcagtgacaagactggaactctcactcttaacaagcttactgtggacaagaacttgattgaggtcttccctactgatatgaacaaggacagtgttgttctatatgcagcaagagcttcacgagtcgaaaaccaggatgccattgatgcatcaattgtgaatatgttgagcgatcccaaggaggcaagagcaggaatcactgaggtgcatttcttgccctttaatcctgtggacaagcgcacagctattacctttattgacggaaatggcaactggcacagaagcagcaaaggtgctcctgaacaaattattgaactctgtggacttaagggagagactttgaaaagggcacacaaaaccatcgatgagtacgctgagcgcggtctgcgttccttggctgttggtttccagactgtttcagaaaagaccaaggagagtgcaggagaaccatgggtgttcttgggtctcttacccctctttgacccgcctagacatgacagtgctgagactattcgtcgcgctcttgacctcggtgtcaatgttaagatgatcactggcgatcaacttgccattggaaaagaaactggtcgcagacttggaatgggaaccaacatgtacccttcatcctcccttcttggccaatccaatgatgcagccattgcatcaattccaattgatgaacttattgagaaggctgatggatttgctggagtcttccctgagcacaagtacgagattgtgaagaggttgcaggataggaagcacatatgtggtatgaccggagatggtgtaaacgatgcaccagcattgaagaaggcagacattggtattgctgttgctgatgcaactgatgccgcaaggagtgcctcagacattgtcttgactgagccgggtttgagtgtgattgtgagtgctgtgttgacaagtagggccatcttccagaggatgaagaactacacaatctatgctgtttccatcacaatccgtattgttcttgggttcatgcttgttgctctaatttggaagtttgatttctcccctttcatggttttgatcatcgccattttgaatgatggaaccatcatgaccatctccaaggacagggtgaagccatctcctgttcccgattcatggaagctcaaagaaatcttcgcaacaggagttgttcttggaacatatatggccatcatgactgcagttttcttccattttattcacgacaccgatttcttctcagaaatcttcgatgtccactcaattgcagacagtgaggaacagcttaactcagctctctacctccaagtgagtatcattagtcaggcacttatctttgtgaccaggtcaagaagctggtcattcgtcgagcgccctggtttgatgcttcttggagccttcattgctgcacaattggtggcaactgccattgctgtgtatgcacactgggactttgctagaatcaatggaattgggtggagatgggctggagttatctggatctacagcattattacatacattcctcttgacattctcaagtttctcatccgcatgggactcacaggtagtgcatgggacaacatgctccaaaacaagactgcattcacaacaaagaaagactacggtaaaggagagagggaggctcaatgggccgtggctcaacgtacaatgcacggccttgacactcaagacgcccacaagaacaaccaccaccatgagctctcttaaattgctgaacaggctaagagacgtgctgaggcagctaggttgagagagctacacacactgaagggacacgttgaatcagttgtcaagttgaagggtcttgacattgataccatgcaacaacactacacagtctaaaaatatttaaagatggaagaaaagagtctactcatatttgtaaaaaaacagctaagtaactaacttaggctgctcacgaagatgtgg

SEQ ID NO: 2245 - DNA, 3409 bp, Cajanus cajan
acaatctttctcattctcactctctgcatatcttcaattctgattgcagcaacaacaacacttcaatccttccaacatgggcggtatcagccttgaggaaatcaaaaacgaaaacgtcgatctggaacgaattccagtagaggaagtgtttgagcagctgaaatgttcaagagcaggtctatcatcagacgaaggagccagtcggcttcaggtttttggaccaaacaaattggaagagaaaaaggaaagcaaacttttgaagtttttgggtttcatgtggaaccccttatcatgggtgatggaagctgctgctatcatggccattgctttggccaatggtggaggaaggcctccggattggcaagatttcgttggtatcattgctctcttgttcatcaactccacaatcagtttcattgaagaaaacaatgctggcaatgctgctgctgcactcatggctggtttagctcccaagaccaaggttctaagagatgggcgatggactgaacaagatgctgcaattttggtcccgggagacatagtcagcatcaaattgggagatatcattcctgcggatgctcgtcttctggagggtgatgctctgagtgttgatcagtctgctttgactggagagtctcttccagtgacaaagaatccctctgatgaagtgttttctggatcaaccgttaagaaaggtgagatagaagcagtggtgattgccactggggtgcacaccttttttggcaaagctgcacatttggtggacagcaccaaccaagttggtcacttccagaaagtcctcacggcaattggtaacttctgcatttgctccattgcggttggaattatcattgagctcatagtcatgtaccccatacaacaccgcaagtacagagatgggattgacaatctgttggttctcctgattggaggaattcctattgctatgccaactgtgttgtctgtcacaatggctattggttcgcacaggctttcacagcaaggtgccatcacaaaacgtatgacggctattgaggaaatggcaggaatggatgtcctctgcagtgacaaaactgggactctcaccttaaataaactcagtgttgacaaaaacctgattgaggtttttgccaagggtgttgagaaggatcatgttatccttcttgcagcaagggcttcgaggactgagaatcaggatgccatagatgctgcaattgttgggatgcttgctgatccaaaggaggcacgagctggtatcagggaggttcactttctccctttcaatcctgtggacaagaggacggctctaacttacattgattctgatggaaattggcatcgatctagcaaaggtgctcctgagcagatattgaacctctgcaactgcaaagaggatgtcaggaaaagggttcatggagtgattgacaaatttgctgagcgtggactccgttctttgggtgttgctagacaggagatacctgagaaaaacaaggatagtcctggtgcaccatggcaatttgttggtcttctaccactatttgatcctccaaggcatgacagtgcagaaaccatcacaagagctctgaaccttggtgtgaatgttaagatgattactggtgatcagcttgctattgcaaaggaaactggccgaaggcttggtatgggaacaaacatgtatccatcttcttcattgcttggccaaagcaaggatgcttcagtttcagctctgccagttgatgaattgattgagaaggctgatggatttgctggagtatttcctgaacacaaatatgaaatcgttaagaggctgcaagagaggaaacacatttgtggaatgacaggtgatggtgtcaatgatgcccctgcattaaagaaagcagatattggaattgctgttgctgatgctacagatgctgctagaagtgcttctgacattgtccttacggagcctggtctcagtgtcattatcagtgcagtgctcaccagcagggcaattttccaaaggatgaagaattatactatctatgctgtgtcaatcaccatccgtatagtgtttggtttcatgtttattgcattgatttggaaatttgattttgcacccttcatggtgttgatcattgccatactaaacgatggtaccatcatgacaatatccaaggatcgagtgaaaccatctccacagcctgacagctggaagctgagggagatatttgccactggtgttgtgctaggcagttacttggcactaatgacagtagtatttttctggctcatgaaggataccgacttcttctcggacaagtttggtgttcggtctataaggaatagccctgaagaaatgatggcagccctgtacctacaagtcagtattataagtcaagcactaatttttgtcaccaggtcccgaagctggtcctatgttgaaagacccggtcttctcctactgggtgctttcatgattgcacagctggtggcaacttttctagcagtatatgctagctggggcttcgcaagaattaagggaatgggatggggttgggctggtgtaatctggctctacagtttagttacatatgtccctcttgatatactcaaatttacaatccgctatgttctgagtgggaaggcttgggataatcttttggagaacaagactgccttcactacaaagaaagattatggcaaagaagagagagaagcacaatgggcaactgcacagagaactcttcatggccttcagccacctgaaacaaccaaccttttcaatgacaagaatagctacagggagctttcagaaattgctgaacaagccaagagacgtgctgaggttgcaaggctcagggagcttcatactctgaaaggacatgttgaatcagtggtgaagctgaagggacttgacattgatacaatccaacagcattatacagtttaaggaggaggtttggacaactttcaagcacgacacgctttggtgcttgtcccataacataaacagcaaatataatgaagacctaagttaatccgtctttagattaggatgaaggtccttttgtgaaaatttgatggttactcttctattccatctatgccagtagctggaggagatgccctctttaggtaccaaataacagcatggttcataggattaattgcgtcttattttggaatgttaatgatatcatagtcagttaacagctttatattttttcctcgaacaaatctcaatatattttcaatcctgattagttgctcaataatgaattcagtcttcatgtcttttttttttttcattcattcttgtccggcctaaaacaaatgagtgggtgaaagggtactttgtaacttttttaaaaaaaataaatgaatgctgtaaggttgaacagccacatattgagtttcaggaagttaa

SEQ ID NO: 2246 - DNA, 3142 bp, Tabernaemontana elegans
ccttctgccttgaggtgaggctgttgagaccaccaccaacatgggtggagataagggtatcagtcttgaagagatcaagaatgaaaccgttgatctggagaaaatccccattgaggaagtgtttgagcaactaaaatgtacaagagatggtttatcttcagaggaaggagccaacaggatccaaatctttggacccaacaaattagaagagaaaaaggaaagcaaaattctcaagttccttggttttatgtggaatccactctcatgggtcatggaagctgctgctataatggcaattgcacttgctaatggaggcggagcgccacctgattggcaagactttgttggtattgtttgcttgctggttatcaactcaactatcagtttcattgaagaaaataatgctggaaatgcggctgccgcccttatggctggtcttgctccaaaaactaaggttctcagagatggtcgctggactgagcaggaagcagccattctggttcctggagatataataagcatcaaattgggagacatcattcctgctgatgctcgtctacttgaaggagatcccctgaagattgatcaatctgcccttacaggagaatcactccctgtgaccaagaatcctggtgatgaagttttctctggttcaacctgcaaacaaggtgagattgaagctgttgttatagccactggagttcatactttctttggcaaggcagcgcatcttgttgacagcaccaaccaggttggacatttccagaaagtgctgactgccatcggaaacttctgcatttgctctattgccgttggaatgctggcagagataattgttatgtaccccattcaacatagagcatacagaaaaggaatcgacaatctccttgtgctcttaattggaggcattcccattgctatgcctactgttttgtcggtcacaatggctattggatctcacaggttatcccagcagggagccatcacaaagagaatgactgccattgaggaaatggctggcatggatgtcctctgcagtgataagacagggactttgactcttaataagctaactgttgataagagcataattgaagtatttgcaaagggagtcgataaagatcatgtcattcttttggctgcaagggcttcccgagtagaaaatcaggatgcaatcgatgcttgcattgttgggtcacttgctgatccaaaagaggcccgagctggtattagagaggtccatttcttcccatttaatcctgtggacaagaggactgctttgacatatattgattctgatggcaactggcatagatcaagcaaaggagctccagaacagatcttgactctctgcaatgcaagtgaagatatgaagagaaaagtacactcaattatagataagtttgctgaacgtggtttgcgttcattggctgttgcaagacagcaagtgcctgcgaaatcaaaagatagtcctggtggtccatggcagtttgttggattactctctctctttgatcctcctagacatgatagtgcagagaccatccgcagggctctaaatcttggtgtaaatgtcaagatgattactggtgatcagcttgccattgcaaaggagacagggcgtagacttggaatgggaacaaacatgtacccttctgcttctttgcttggtcaacacaaggatgagtccattgctggccttcctgttgaggagttgatcgagaaggctgatggttttgctggagtgttcccagaacacaaatatgaaatcgtgaagaagttgcaggagaggaagcatattgttggaatgactggagatggtgtcaatgatgcccctgctctaaagaaggcagatattggtattgcagttgctgatgccactgatgctgctagaagtgcttctgatattgtgctcactgaacctgggctaagtgttatcattagtgctgttttgactagccgagctattttccagaggatgaagaattacacgatatatgcagtctccatcactattcgtattgtgtttggtttcttgttcattgctttgatttggaaatttgacttctctccattcatggtcttgatcattgccattttgaatgatggaacaattatgacaatctcaaaggatagagtgaagccatcacctaccccagatagctggaaactgaaagaaatttttgcaactggcattgtgcttggaggttacttggcattgatgactgttattttcttttgggtgatgaaggatactgactttttcactgacaaatttggggtcagatctattaggaacagtgagcatgaaatgatggctgctctatacctgcaagtcagtattgtcagccaagctttgatttttgtcactagatcacgtagttggtcctttatggaacggcctgggctattcttactgggtgctttcctcattgctcagctggttgcaactctgattgccgtttatgccaactggagctttgcaagaattaaaggatgtggttggggatgggctggtgtcatttggctatacagtgtcgtattttatgtgccacttgacttaattaagttcttcattcgatacgtattgagtggaaaggcttggactaacttgcttgagaacaagactgccttcacaaccaagaaggattatggcaaagaggagagagaagctcaatgggctgttgcacagagaactctacatggacttcaaccacctgaaacctccaacatcttcgaggaaaagagcagctacagagagctttctgaaatcgctgaacaagctaagaggagagctgagatggctaggcttagggagctgcatacactcaagggccatgttgagtctgtggtgaagctgaaaggcctggatattgaaaccatccagcagcattatactgtttgaagaagcttaattcacaaccttgcgtgagagggacggggccgggaaatccaatatctagtggagaaggctgagaagaagaccaccctggatattggtggtggtacaatgtgaagactagtttatcccccgaatttcactttacctgataatgttatttttgtatcagtaaagcccccatattaagtccacatcagtgttttctttttctttttccaaataaatgctaatattgaaagt

SEQ ID NO: 2247 - DNA, 2745 bp, Triphysaria pusilla
aggattgtacactatagagaaacagaggctttgttttcgtgatttcaaaataatagaaattcaaattcatatatatagggagaaggatagagagaaaaataatacaatttctactctcaatctttcttcctaattttgtgttattattattatttcctctttttcttgaatatcaataatggcctccgatatcaccttagatggggtcaagaatgaaactgttgatctggaaaacatcccgattgaggaagttttcactgagctaaaatgctcgagggaaggtttgagttccgacgaaggggcgaaaaggctcgagatattcggcccgaataagcttgaggagaagaaggatagcaagtttctcaagttcttggggttcatgtggaatcctctttcatgggttatggagtctgctgctgttatggctattgtgttggccaatggcgggggcaagcctccggactggcaagatttcgtcggtattgttgtacttctcattatcaactctacaatcagtttcatcgaagaaaacaatgctggaaacgcggctgctgctcttatggctggccttgctcccaaaaccaaggttttgagagatggcaagtggtctgagcaagaagcctgtatcctagttcccggagacttgatcagcgtcaagttaggcgatattatccctgcagacgctcgtctcttggaaggcgatcctttaaagatcgaccaatcagctctcaccggcgagtcccttcccgtcaccaagaaccccggagacggagtcttctccggctccacttgcaagcaaggtgaactcgaggctgtcgtaatagccaccggggtccacactttcttcggtaaggccgcacatctcgtcgatagcaccaacaacgttggtcacttccaaaaggttttgaccgctatcggaaacttctgtatctgttcgattgccgtcggtatggctatcgaaatcatagtaatgtacccaatccagcaaagagagtacagacaaggaatcgacaatttgctcgtcttgctcatcggtggtattccgattgctatgccgacggttttatccgttaccatggctatcgggtcccaccgattgtcccagcaaggggctattactaagagaatgacagctatcgaagaaatggctggcatggatgtgctttgcagcgacaaaaccggaactcttacgctcaacaaacttaccgtcgataaatcgttaatcgaggttttcgttaaggatatggataaagatacggttgtcttgcttgccgctcgtgcctccaggaccgagaaccaagatgccatcgatgcttctattgttaacatgctaagcgaccccaaggaggcaagagcaggattaacagaggtgcatttcttgccgtttaacccggtggataaacgtactgccattacttattacgactcaaatggagattggcataggtgcagcaagggtgctcctgaacaaataatcgaactttgtgaactcaaaggagctgagttgaaaaaggctcacgatatcatcgataattacgcaaaccgtggtcttcgttctcttggaatttcacgacagacggtacccgagaaaacaaaggaaagcgccggttcaccatgggagtttgttgggttattaccattgttcgaccctccaaggcacgacagtgccgagacgatcaagaaagcactcgaactcggagtcaatgtaaaaatgatcaccggtgaccagctagccatcggaaaagaaaccggccgtcgtctcggaatgggcaccaacatgtacccatcctcatcccttctcggccaatgcaaggacgagtcaatctcctcgatcccagtcgacgagctcatcaaaaagccgacggcttcgccggagtcttcccggagcacaagtacgagatcgtcaggcgactccaagaaatgaagcatatttgcggtatgaccggagacggcgtaaatgacgcccctgccctcaagaaagccgacatcgggatagccgttgccgatgcaaccgacgcggctaggtccgcatcggatattgtcctgaccgaaccgggactcagcgttatcgtcagcgcggtgctaacgagccgagccattttccagaggatgaagaattatactatttacgcggtgtccatcacgatccgtatcgtgatggggttcatgctgatcgcccttatctggaaatttgacttctcgcctttcatggtcttgatcatcgcaatcctcaacgacgggaccattatgacgatatctaaggacagggtgaagccttccccgctccccgattcttggaagcttaaggagattttctccaccggtgtcgtcttgggaacttatatggctatcatgaccgtcgttttcttttacttggctaacgataccgaatttttctccgaaaaattcggagtgaaatcgataagaggcaaccaagacgagcttaccgcggcactttatcttcaagtgagcattatcagtcaagcgcttatcttcgtaacaaggtcgagaagctggtcattcgtcgagcgtcccggtttcttgctttgtgctgcattcttgttagctcagcttttggctacaataattgcggtatacgcaaactggggatttgcgaggatgaaagggatcggatggggatgggcggagtcatttggatcttcagtatcgtcacttatttcccactcgacgttcttaagttcatgattcgatatgggctgagtggcaaagcatggaactcgatga

SEQ ID NO: 2248 - DNA, 3402 bp, Theobroma cacao
gtaatctcctattctcattttcctctcggcaccggtccagtgttatggaggacgggaaagcctgaccaggggcagctaccacaataacctgaagaaagaaggaactcaaagatcagttcctgtgatcaagagctttcttctttcttctcttaaacaaggtcctggtttgttattctgttttccggattgtccgtagccatggcttccgatggcgacacctctttggagcagataaaaaacgagactgttgaccttgagcgcatccccgtggaggaggtttttgagcagctgaaatgtacgcgagagggtttgacaacagcagaaggagagaaaaggctcgaaatctttggccctaacaagcttgaagagaagaaagagtgcaaatttctcaagttcttgggcttcatgtggaatcctctgtcgtgggttatggaggctgctgctatcatggccattgttttggccaacggaggaggcaagcctccagactggcaagacttcgttggtatcgttgctttgctttttatcaactcaactatcagtttcattgaggaaaacaacgctggcaacgcggcagctgctttgatggctggtcttgcccccaaaactaaggtgttgagagatggcaaatggggtgagcaagatgcagcaattctggtaccaggagatgtaattagtgtcaaattgggagatatcatccctgcggatgctcgtctcttggagggtgatgcactcaagattgatcagtctgccctcactggtgagtccctacctgttaccaagaatccaggtgatgaggtcttctctggatccacctgcaaacaaggtgagattgaggctgttgtcattgccaccggtgtccataccttctttggcaaggctgctcaccttgttgacagcaccaacaatgttggtcacttccaaaaggtgttgactgccattggtaacttctgtatctgctcgattgctgtgggaatgctcattgagatcatagtgatgtacccaatccagcacaggaggtacagagatggtattgacaacctgttggtgcttctcattggaggaatcccgatcgccatgcctacagtcttgtctgtgacaatggctattgggtctcaccgcttgtcagagcaaggtgccatcaccaagaggatgactgccattgaagaaatggcaggaatggatgtcctgtgcagtgataagaccgggaccctcaccctcaacaagctaacagtagacaggagtctcattgaggtgttcgcaagtggtattgacaaggacacccttatgctgcttgctgcaagggcttccagggttgaaaaccaggatgccattgacgcttcaattgtagggatgttgggcgaccccaaagaggcaagggctggaatcactgagttgcacttctttccctttaaccctgtggataagcgcactgctatcacctacatcgacagtgatggcgagtggcatcgttgcagcaagggcgctcctgagcagatcattgacctttgtgggctaactggagagttgaggaagaaggcgcttggtgtcattgacaactttgctgaccgtggccttcgctccttggcagttgctagacagacaattccagagaaaacaaaggagagcgctggaggaccttgggagtttgtgggtcttttgcctctctttgatcctccaaggcatgacagtgctgagactattcgacgggcccttgaccttggtgttaatgttaagatgatcactggtgaccagctggccattggcaaagagactggtcgcagacttggcatgggcactaacatgtatccttcttcctccctccttggacagagtaaggatgaggctattgccgccattcctgttgatgagctcattgagaaggctgatggatttgccggagtcttccctgagcacaagtacgagattgttaaaaggctccaagatcggaagcacatctgtggcatgacaggagatggtgtgaacgatgccccagcacttaagaaggcagatattggtattgctgtggctgatgcaactgatgctgccagaagcgcctcagacatagtcttaaccgagccaggattgagtgtgattgtgagcgcagtattgacaagcagagccatctttcagaggatgaagaactacacaatttatgctgtttccatcacaattcgtattgtgatgggattcatgcttgttgctctcatctggaagtttgacttctcaccattcatggtcttgatcattgccatcctcaatgatggaaccatcatgactatctccaaggacagggtcaagccatctcctatgcccgactcatggaagctgaatgaaatcttcgccacagggattgttcttggggcctacatggctatcatctccgtgctctttttctggctcgctcatgacactgacttcttcactgagaagtttggcgtgaggccaatccatgataacatagatgagcttacttcggctctctaccttcaagtgagtatcatcagtcaagcactcatctttgtgacaaggtcaaggagctggtcctttgttgagcgccctggtctcttgcttatcggagccttcattgcagcacagctggtggctactctcatagccgtgtatgcaagctggggcttcgccaggatccaaggcattggatggggatgggcaggagttatctggctcttcagcttgattacctacatccctcttgatatcctcaagttcatcatccgctactccttgagtggcaaagcctgggataacctgcttcagaacaagaccgcattcacgacaaagaaggactacggaaagggagagagggaggcacaatgggcagcggctcaacgtacccttcacggcctttcacccccagaaaccattttgaacgacaagagctaccacgagttgtcagaaatagctgagcaggctaagaagcgtgctgaggttgcaaggctgagggagctccacactctcaagggtcacgttgagtcagtggtcaagttgaaggggctggacattgataccatccagcagcactacacagtataattcaagtggtggaacaaatttaaggatggagcacagggaaagctgagagactaggcgattttaatatttctctcttccctgctttgttcttgtcctgattttttttttctttgggagagggacaaaaaatcgggattagttgttattgattttgacaaccctattagaatggaatgaaagaaaagattaaagaaattgttacaccaagtatagttattataatttttatcttactgtatatatcatgttctttcttcccatacaagctcttctattatagttgtctatcaaacataaattcaccctcagccatcaaagtgtcatcagtaatctttgtaaaatatgccc

SEQ ID NO: 2249 - DNA, 2886 bp, Musa acuminata
tccaccaccaccacaatgtcgtccgccatctcactggaggagatcaagaacgacgccgtcgatcttgagcacattccggtcggggaagtctttgagcagctcaaatgcgacaggaatgggctcaccaacgtcgagggggagaaccgcatcaagatctttgggctcaacaagctcgaggagaagaaggagagcaaggtgctcaaattcttggggttcatgtggaatccgctctcgtgggtcatggagagcgccgccatcatggccatcgccctcgctaatggaggggggaagcctccggactggcaagacttcatcggcatcatctcccttctcatcatcaactccaccatcagcttcatcgaggagaacaacgccggcaatgccgccgccgctctcatggctggccttgcacccaagaccaaggtgttgagagacgggaggtggtcggagcaggatgcggcgatcctcgtccctggcgacattatcagcattaagctcggcgacatcatccctgcggacgcacgcctactcgacggcgacccgctcaagatcgaccagtccgccctaaccggcgagtcgcttccggtgaccagaaaccctggcgatgaggtcttctcgggctccacatgcaagcaaggcgagatcgaggccgtcgtcatcgccaccggcgtgcacaccttcttcggcaaggccgcgcacctcgtcgacagcaccaataacgtcggccacttccaaaaggtgctaactgcgatcggaaacttctgcatctgctcgatcgcggtcggcatggcgatcgagatcgtggtgatgtacccgatccagcgccggaagtacagggacgggatcgacaacctactggtgctgctcatcggcgggataccgattgcgatgcccaccgtgctgtcggtcaccatggccatcggatcgcatcggctgtcagagcagggagccatcacgaagaggatgactgcaatcgaggagatggcagggatggacgtgctctgcagcgacaagaccggaaccctcacccttaacaagcttaccgtcgacaggaatctaatcgaggtattcgagagagatgtggatagggaagccgtaatcctccatgccgcaagggccgccagggtcgagaaccaggacgccatcgatgccgccattgttggaatgcttgctgatcccaaggaggcacgtgcagggatcgatgaggtgcacttcttgcccttcaatcctgtcgacaagcggacggccatcacctacgtagactcctttggcaattggcatcgatcgagcaagggagccccggaacagatcgttgagctgtgcaacatgagggaggatgccaagaagaaggttcacgccgtcatcgacaagttcgccgaccgtggcctgcggtcgctggccgtcgcccgacaggaaattcctgagaagaggaaggaaagcgccggagggccatggcagttcatggggctgctaccgctgttcgacccaccgagacacgacagtgcggagaccattcgtcgagcactcaacctaggcgtcaacgtgaagatgatcaccggtgatcagttggctatagcgaaggagaccgggcggaggctcgggatgggtaccaacatgtacccctcgtccactcttctcggcaacaagaacgatgatttcaccggtagcatccctgtcgacgagctcatcgagaaggccgatggttttgctggtgtcttcccagagcacaagtacgagatcgtgaagcgactgcaggagaggagccacatctgtggcatgacaggcgacggcgtgaacgacgccccggccctgaagaaggcggacatcggcatcgccgtcgctgacgccaccgacgctgctcgtggcgcttcggacattgtcctgacggagccgggactcagtgtcatcgtcagcgccgtcctcaccagccgcgcaatcttccagcgcatgaagaactacaccatctacgccgtctccatcaccatccgagtcgtgctaggcttcctcctcctcgcgctcatctggcgcttcaacttttcccctttcatggtcctcataatcgccatcctcaatgacgggactatcatgaccatctccaaggaccgagtcaagccctctccgatgcccgattcgtggaagctccgcgagatcttcgccaccgggatcgtcctcggcacctaccttgcgctcatgactgtgctgttcttctggatcgccgaccaaacggacttattccccaaaacatttggagtaaggccgatcagggacaatcaagatgaactgacctccgcgatctacctccaagtgagtgtagttagccaggcgctcatattcgtgacgcggtccagaagctggtgcttcgtggagcgccccgggctgttgcttgtggctgccttcgttgttgcgcagctggtggctactttcatctctgtgtacgcgagctggggattcgcgagaatccatggcatagggtgggggtgggctggagtgatatggctcttcagcatcgtcaccttcttcccgctcgacatcctcaagttcatcatccggtacacactgagtggcaaggcttgggtcaacctctacgagagcaagacggctttcacgaccaagttggattacgggaagggggaaagggaggcgcaatgggcgctagcgcagcgtaccctgcacggcctccagccaccagactcttcaggtctcttcaacgagaagaactacagggagttgtctgagatcgccgagcaggctaagagacgcgccgaggtcgccaggcttagggagcttcacacgctaaaaggacacgttgagtcagtagtgaagctcaaagggctggacattgagacgatgcagcatcactatacgctttgaaaggagggaggagga

SEQ ID NO: 2250 - DNA, 3308 bp, Petroselinum crispum
cccccaacattttcttgggcttgagagagaactcatttaccactaacataaaacatatatctatatatgtgtgttcctctcttcatctaacctgttgataaattaaacaaggtggtggtggtgtttcaaagttgattatcaagatgggcctcagtcttgaagagatcaaaaatgagactgttgatctggagaagattccgatagaggaagtctttgagcagttaaaatgtacccgcgaaggtctaagcacagacgagggagaaaacaggcttcagatctttggccccaacaagttagaagagaaaaaagaaagcaaactactcaagtttctcgggtttatgtggaatccactctcatgggtcatggaagctgctgctataatggctattgcactggctaacggtaatgggaaacctccagattggcaagattttgtcggcattatgtgcctgctggtcatcaactcaacaatcagtttcattgaagaaaacaatgctggtaatgctgctgcagcacttatggctggtctggctcccaaaaccaaggttcttagagatggtcgatggagtgaacaagatgctgcaatcttggttcctggagacatcattagtattaaactgggagacattgttcctgcagatgcacgtcttcttgagggtgatcctttaaagattgaccaatctgccctcactggagaatcacttccggtgaccaggaatccttatgatgaagttttctccggttcaacttgtaaacaaggtgagatcgaagctgtggtcattgctactggggttcatactttctttggaaaggctgcacatcttgttgacagcacaaaccaagttggacacttccaaaaggtgctgacagctattggaaacttttgtatctgttccattgctgtcggcatgttggtcgagattgttgtcatgtacccaattcagcacaggaagtatcgggatggaattgacaatctcttggttctattgatcggaggtattcccattgctatgcccacagttctgtcagttacaatggctattggatcgcacaggctctctcaacaaggagccattactaagagaatgactgctatagaagagatggctggtatggacgtcctttgtagtgataagacaggaacactgacccttaacaagctaactgttgataagaacttgattgaggtatttgcaaagggctctgataaggaacatgtgttactttgtgctgcacgagcttcaagaactgaaaatcaggatgctattgatgctgctatagttggaacacttgctgatccgaaagaggctcgagctggtattagagaagtacactttcttcctttcaatcccgtggacaagaggactgccttgacttacatcgattctgatggaaattggcacagaaccagcaagggtgctccagaacagattcttactctctgcaattgcaaggaagatctaaagaagaaggtccatgccatgattgataaatttgcagagcgtgggttaagatcactaggtgttgcaagccaggtagtgccagagaaatcaaaagatagtgctggtggtccatggcaatttgttggattgctgtccctgtttgatccaccgaggcatgacagtgctgagactattcgcagggctctccatcttggtgtgaatgtgaagatgattactggtgatcaacttgccattgcaaaggagactgggcgaagactgggaatgggaacaaatatgtatccttctgcttctctgcttggtcaagacaaggatgcatcaatagcagcacttcctgtcgaagaattgattgaaaaggcagatggatttgctggagtttttcccgagcacaaatatgaaatcgtcaagaagttgcaggagaggaagcatatttgtggtatgaccggagatggtgtcaatgatgcccctgctttgaagaaggcagacatcggaattgcagtggccgatgctactgatgcagcacgaagtgcttctgacattgttcttactgaacccgggcttagtgttattataagcgcagtgctaaccagtagagctattttccagaggatgaaaaattacacaatatatgcagtatccatcacaatccgtattgtgtttggtttcatgtttattgctctgatatggaagttcgacttttctccattcatggttttgatcattgccatcctaaatgacggaaccattatgacaatctcaaaggatcgagtaaagccatctccattgcctgatagctggaagttgaaagagatatttgctactggtgtagtgcttggaggttacttggcattattaactgttatcttcttctggttaatgaaggatactgattggtttccgaacacatttggtgtgagatctatcagatataatcctgaggaaatgatggcagccctctacctccaagtcagtattgtaagccaggctctaatttttgtaacaaggtcacgcagctggtcctttgttgagcgccccggattcttgttgcttggagctttcctgattgcacaattgatagcaactttggtagctgtgtacgcaaactggggtttcgccaggattcacggatgtggatggggatgggctggtgtcatatggctatacagtatcgtcttctacttcccgcttgatattatgaaattcgctactcgctatgctttaagcaacaaggcctggcaaagcatgattgacaacaggactgcttttacaactaagaaagactacggaaaagaagagagagaagctcagtgggctttagctcaaaggactttacacggacttcagccaccagaggcctctaacatctttaacgagaagagcagttatagagaactttctgagattgctgaacaggccaagagacgagcagaagttgcaaggctccgagaactccacactcttaaggggcacgttgaatcggtggtgaagcttaaaggtcttgatatcgatacaattcaacagcattacacagtctaagacaagctaaagagagataagtaattcgagagcggatatgccattgctcaagaacttgtccgaatagataagagataaaagagaaggcattagtagttaacataagaagtgtaccctaagaaaatgcactgtgaacattggcctgtgtgctaaaaccccagcagtacttgagctttgtgttacattttcttacattaccatgtgttttgatatgctcctggtttggttttcttcatgctttagatgttggattaaattagaaatttgctgtaccaccaaattttcttaaataaatgttaaaatataaaaagc

SEQ ID NO: 2251 - DNA, 2895 bp, Musa acuminata
ttcatcgcttccaccaccaccacaatgtcgtccgccatctcactggaggagatcaagaacgacgccgtcgatcttgagcacattccggtcggggaagtctttgagcagctcaaatgcgacaggaatgggctcaccaacgtcgagggggagaaccgcatcaagatctttgggctcaacaagctcgaggagaagaaggagagcaaggtgctcaaattcttggggttcatgtggaatccgctctcgtgggtcatggagagcgccgccatcatggccatcgccctcgctaatggaggggggaagcctccggactggcaagacttcatcggcatcatctcccttctcatcatcaactccaccatcagcttcatcgaggagaacaacgccggcaatgccgccgccgctctcatggctggccttgcacccaagaccaaggtgttgagagacgggaggtggtcggagcaggatgcggcgatcctcgtccctggcgacattatcagcattaagctcggcgacatcatccctgcggacgcacgcctactcgacggcgacccgctcaagatcgaccagtccgccctaaccggcgagtcgcttccggtgaccagaaaccctggcgatgaggtcttctcgggctccacatgcaagcaaggcgagatcgaggccgtcgtcatcgccaccggcgtgcacaccttcttcggcaaggccgcgcacctcgtcgacagcaccaataacgtcggccacttccaaaaggtgctaactgcgatcggaaacttctgcatctgctcgatcgcggtcggcatggcgatcgagatcgtggtgatgtacccgatccagcgccggaagtacagggacgggatcgacaacctactggtgctgctcatcggcgggataccgattgcgatgcccaccgtgctgtcggtcaccatggccatcggatcgcatcggctgtcagagcagggagccatcacgaagaggatgactgcaatcgaggagatggcagggatggacgtgctctgcagcgacaagaccggaaccctcacccttaacaagcttaccgtcgacaggaatctaatcgaggtattcgagagagatgtggatagggaagccgtaatcctccatgccgcaagggccgccagggtcgagaaccaggacgccatcgatgccgccattgttggaatgcttgctgatcccaaggaggcacgtgcagggatcgatgaggtgcacttcttgcccttcaatcctgtcgacaagcggacggccatcacctacgtagactcctttggcaattggcatcgatcgagcaagggagccccggaacagatcgttgagctgtgcaacatgagggaggatgccaagaagaaggttcacgccgtcatcgacaagttcgccgaccgtggcctgcggtcgctggccgtcgcccgacaggaaattcctgagaagaggaaggaaagcgccggagggccatggcagttcatggggctgctaccgctgttcgacccaccgagacacgacagtgcggagaccattcgtcgagcactcaacctaggcgtcaacgtgaagatgatcaccggtgatcagttggctatagcgaaggagaccgggcggaggctcgggatgggtaccaacatgtacccctcgtccactcttctcggcaacaagaacgatgatttcaccggtagcatccctgtcgacgagctcatcgagaaggccgatggttttgctggtgtcttcccagagcacaagtacgagatcgtgaagcgactgcaggagaggagccacatctgtggcatgacaggcgacggcgtgaacgacgccccggccctgaagaaggcggacatcggcatcgccgtcgctgacgccaccgacgctgctcgtggcgcttcggacattgtcctgacggagccgggactcagtgtcatcgtcagcgccgtcctcaccagccgcgcaatcttccagcgcatgaagaactacaccatctacgccgtctccatcaccatccgagtcgtgctaggcttcctcctcctcgcgctcatctggcgcttcaacttttcccctttcatggtcctcataatcgccatcctcaatgacgggactatcatgaccatctccaaggaccgagtcaagccctctccgatgcccgattcgtggaagctccgcgagatcttcgccaccgggatcgtcctcggcacctaccttgcgctcatgactgtgctgttcttctggatcgccgaccaaacggacttattccccaaaacatttggagtaaggccgatcagggacaatcaagatgaactgacctccgcgatctacctccaagtgagtgtagttagccaggcgctcatattcgtgacgcggtccagaagctggtgcttcgtggagcgccccgggctgttgcttgtggctgccttcgttgttgcgcagctggtggctactttcatctctgtgtacgcgagctggggattcgcgagaatccatggcatagggtgggggtgggctggagtgatatggctcttcagcatcgtcaccttcttcccgctcgacatcctcaagttcatcatccggtacacactgagtggcaaggcttgggtcaacctctacgagagcaagacggctttcacgaccaagttggattacgggaagggggaaagggaggcgcaatgggcgctagcgcagcgtaccctgcacggcctccagccaccagactcttcaggtctcttcaacgagaagaactacagggagttgtctgagatcgccgagcaggctaagagacgcgccgaggtcgccaggcttagggagcttcacacgctaaaaggacacgttgagtcagtagtgaagctcaaagggctggacattgagacgatgcagcatcactatacgctttgaaaggagggaggagga

SEQ ID NO: 2252 - DNA, 3608 bp, Cicer arietinum
gaacaatataagaaaatgaaaagtataaaagttggacacgcagagtagttcacggcttcatttcacaatcataattcataacatcacacaactcaaaaatctcactatttttcccttcatcttcttcctctttatgttatctcaatgcatttatttatatttggaccttttcactaaccacatgactcatcaaccttctatttaatccaatcttttttctagtactatcacatattattattattattattcacaacaacaacacatttattcatttcttccaacatgggaggtatcagccttgaagagatcaaaaatgaaagtgtcgatctagaacgtattccaatagaagaggtttttgagcagctgaaatgttcaagacaaggtctcacatcagaggaaggagccaacaggcttcaagtgtttggaccaaacaaattggaagagaaaaaggagagcaagtttttgaagtttttgggatttatgtggaaccctttgtcatgggttatggaagctgctgctataatggcaattgctttggcaaatggaagtggaaggccacctgattggcaagattttgttggaatcattgctttgttagttatcaattccacaattagtttcattgaagaaaacaatgctggtaatgctgctgctgctctcatggctggtcttgctcccaaaaccaaggtactaagagatagtaggtggagtgaacaagatgctgcaattttagtaccaggagacataatcagcattaaattaggagatatcattccagctgatgcgcgtcttcttgagggagatcctttgagtgttgatcaatccgctttaacaggagaatctcttcctgtgacaaagagttcctcggacgaagtattttcaggatcgacggttaagaagggggagattgaagcagttgtgattgctactggtgtccacacttttttcggtaaagcagctcatttggttgatagtactaaccaagttggacattttcagaaagtgcttacagctattggtaacttctgcatttgttcaattgctattggaatactcattgagctaattgtgatgtatccaatacaacacagaaaatatagagatggaattgacaatcttttggtgcttttgattggtggaattccaattgcaatgccaactgttttgtctgtcactatggctattggttctcataggctttcacagcaaggtgcaattactaaaagaatgacagctattgaggaaatggctggaatggatgttctatgcagtgataaaactggaactctcactttgaataagcttagtgttgatagaaacttgattgaagtgtttgctaaaggaattgagaaggaatatgtgattcttctagcagctagagcttctaggactgaaaatcaagatgctattgatgctgctattgttggaatgcttgctgatccaaaagaggcaagagccggtattagggaggttcattttcttccattcaatcctgttgacaagaggactgctttaacctatattgattctgaaggaaaatggcatcgagctagcaaaggtgctcctgagcagataataaacctttgtaactgcaaagaagatgtaaggaaaaaggttcattcagtgattgataagtttgcagagcgtggacttcggtctttaggtgttgcaagacaggaagtacctgagaaatcaaaagaaagtcctggtggaccgtggcaatttgttggtcttctaccactgtttgatcctcctaggcatgacagtgctgaaacaattagaagagctcttaaccttggtgtcaatgttaagatgattactggggatcagcttgccattggaaaggaaacaggaagaaggcttggaatgggaacaaatatgtatccatcatctgcattgcttggtcaggacaaggatgcttctatttcggctcttccggttgacgagttgattgagaaggctgacggatttgcaggagtatttcctgagcacaaatatgaaattgtcaagaggctgcaagagaagaagcatatatgtggaatgacaggagatggtgtaaacgatgcgcctgcgttaaagaaagcagatattggaattgctgttgctgacgctacagatgcagctagaagtgcttctgatattgtcctcactgaacccggtctcagtgtcattatcagtgctgttctcactagcagggcaattttccagaggatgaaaaattatactatttatgccgtgtcaatcaccattcgtattgtgtttggtttcttgtttatcgcgttgatctggaagtttgattttgcgccgttcatggttttgattattgccatactaaatgatggtaccataatgacaatatcaaaggatagagttaaaccatctccactacctgacagttggaaactgagggagatatttgctactggtgttgttctaggaagttacatggcactaatgacagtagtatttttctgggcaatgaaagataccaacttcttctcgaacaagtttggtgtgaggtctttgagacataactctgaagaaatgatggcagccttatacctacaagtcagtataataagccaagcactaatttttgtaactaggtcccgcagttggtctttcgccgaaagacctggtcttctcctcctaggagcttttttcattgctcaactggttgcaacttttatagcagtgtatgctaattggggctttgcaagaataaaaggaatgggatggggttgggctggtgtaatttggctgtacagtttggtaacctatatccctcttgatttactcaaatttgctatccgctatgttctgagtggcaaagcttgggacaatcttttggaaaacaagactgctttcactacaaagaaagactatggcaaagaagagagagaagcacaatgggcagctgcacagagaacacttcatggtcttcagcctccagaagcctccaaccttttcaatgagaagaatagctatagggaactttcggagattgcggagcaagccaagagacgcgctgaagttgcaaggcttagggagcttcacactctgaagggacatgtggagtcagtggtgaagctgaagggacttgacattgatacaattcagcagcactatacagtttaaggagcttggacaattttcaagaaatggtttagtgctttttctgcgaacaaaatcacataacgacggagaaagattcaaagagctagtcaatctatcttttaagttattaaaaaaaatggcaggcttgtaaaaatttgaagggttaatccttttcttataatctatgctaggaggaaatactattctcaagtatcaaataacatcattgatagagtttacttttttttcttccttggataacattagtgttgtgttattaagtccgcattaagagctccatatattggtaatgatatagttgctcaaagctcaatatattgatattgataccttttctcaatactttcaatatatgttttctctcccttcttctacatccatgttttttggaatggaaaggcaggagaggttccaaaagatgacttctaaggaggtcatccgttcttgtactactctcacaaaagcac

SEQ ID NO: 2253 - DNA, 3282 bp, Lupinus angustifolius
tgaatagcccttatttaagcatctttttgtgccatcttctcctcccattatccatcatcatatacatagagtgcaacctaaggtgatagtgttctttccaacatcatcatcaaataacaaacaacaacatgggtgtcattagccttgaagagatcaaaaacgagaatgttgatttggaacgaattccaatagaggaagtgtttgagcagctaaaatgttcaagagcaggactcacatcagaagaaggagacaacaggattcaagtttttggaccaaacaaattggaagaaaaaagagagagcaagtttttgaagttcttgggttttatgtggaatcccttatcatgggtaatggaagctgctgctataatggctattgctttggcaaatggtaatggaagaccaccagattggcaagattttgttggtatcattgctctattggtgattaactccacaatcagttttattgaggaaaacaatgctggtaatgctgctgctgcactcatggctggattagctcccaagaccaaggtactacgagatgggcgatggagtgagcaagatgctgcaattttagtaccgggagacataatcagcattaagttaggagatatcattccagctgatgctcgtcttcttgagggtgatcctttgagtgttgaccaatctgctttaacaggagaatctcttccggcgacgaaacattcatcggatgaagtattttctggatcaactgttaagaagggtgagatagaggcagttgtgattgctacaggtgtgcacacatttttcggtaaagcagctcatcttgtagacagcactaaccaagttggtcactttcagaaagtacttacagcaattggtaatttctgtatttgctcaattgctgttggaatagtgattgagctcgtagtcatgtacccgatacaacaccgcaagtaccgagatggaattgacaatcttttagttctcttgattggaggaatcccgatcgctatgcctactgttctgtctgtcactatggctattggttctcaccggctgtcacagcaaggtgcaattacaaaaagaatgacggctattgaggaaatggcagggatggatgtcctatgcagtgacaaaactggaactctgacccttaataagttaagtgttgatagaaacttgatcgaggtgtttgctaagggtgttgagaaggagtatgttattcttctcgcggcaagggcttctaggactgaaaatcaagatgccatagatgctgcaattgttgggatgcttgcggacccaaaggaggcacgagctggaattcgggaggtgcatttccttccattcaatccagtagacaagaggactgctctaacttacattgattctaatggaaattggcatcgatctagcaaaggggctcctgagcagataattgaactttgtaactgcaaagaagatgtgaggaaaagagttcattcagtaattgataagtttgctgagcgtggacttcgttctttaggtgttgcaagacaggaagtacccgagaaaacaaaagagagtcctggtgcaccatggcaatttgttggtctgctaccactgtttgatcctccaaggcatgatagcgccgaaaccatcagaagagctcttaatcttggagtgaatgttaagatgattacaggtgatcagcttgccatcggaaaggaaacaggccgaagacttggaatgggaacgaacatgtatccttcatcttcgttgctcggccaagacaaagattcttctatttcggctcttccagttgatgagttgatagaaaaggctgatggatttgccggagtatttcctgaacacaaatatgaaatcgttaagaggcttcaagagaggaagcatatatgtggaatgacgggagacggtgtgaacgatgcccctgcattgaagaaagcagatattggaattgctgttgctgatgctacagatgctgctagaagtgcttctgatattgtcctcacagaacccggtttaagtgttattattagtgcagtgctcactagcagagcaatcttccagagaatgaagaactacactatttatgccgtgtcaatcaccattcgtattgtgttcggtttcatgtttattgccttgatctggaagtttgattttgcaccattcatggttttgattattgccatactaaatgatggtaccattatgacaatatccaaggatagagtgaaaccatctccattgccagatagctggaaactgagggagatatttgctaccggcgttgttctgggaacttacatggcactcatgacagtcgtatttttctgggcaatgaaagataccaacttcttcccagacatgtttggtgtgaggactataagatataaccctgatgagatgatggcagccttatacctacaagtcagtattataagccaagcactaatcttcgtgacaaggtctcgaagctggtcctttgccgaaagacctggtctcctcctactaggtgcttttttgattgctcagctggtggcaacttttatagcagtatatgctaattgggggtttgcaagaataaaaggaatgggatggggttgggctggtgtaatctggctatacagtttagtgacatatatccctctcgatttactcaaattcgcgatccgctatattctcagtggaaaagcttgggataatcttttggagaacaagactgctttcactacgaagaaagactacggcaaagaagagagagaagcgcaatgggctgctgcacagagaacacttcatggccttcagccgccggaaacctccaaccttttcaatgagaagaatagctatagggaactttcagagattgcagagcaagcaaagaggcgcgctgaggttgcaaggcttagggagcttcatactctgaaaggacatgttgagtcagtggtgaagctgaagggacttgacattgatacaattcagcaacactacacagtttaaggagcttgaaggaagagcaacaagaacatatgatgatgaagacaagctaaaagaccttagtatttaggttcttaccaagacaaaaaaaattgtagtccttctgttaaaacttgagtctatgctaggaggaatgctactattctctttagatatcaaataacatctttgataaggttaactgtcttctattttgttgttgtggagaataatagtgttattaaggccacaagaaaaacctcactgtattgttggtcttgacaataatgtcataattttaacatgttaattcatgatgaat

SEQ ID NO: 2254 - DNA, 3539 bp, Lupinus angustifolius
atatatatatatattatcatcatatagtgttaagaacatcatcaacccaaaacaaaaacaacaacaaaaacaacaacatgggtgtcattagcttagaagagatcaaaaatgagaatgttgatttggaacgaattccaatagaggaagtgtttgagcagctaaaatgttcaagagcaggtctcacatcagaagaaggagacaacaggcttcaagtttttggaccaaacaaattggaagaaaaaaaggagagtaagtttttgaagttcttgggttttatgtggaaccctttatcttgggttatggaagctgctgctataatggcaattgctttagcaaatggtgatggaatgcccccagattggcaagattttgttggtattattgctcttttggtcattaactccacaatcagttttattgaagaaaacaatgctggtaatgctgctgctgctcttatggctggtttagctcccaagaccaaggtactaagagatgggcgatggagtgaacaagacgctgcaattttagttccgggagacataatcagcattaagttaggagatatcattccagctgatgctcgtcttctcgagggtgatcctttgagtgttgatcagtctgccttaacgggagaatctcttccggtgacgaagcattcgtctgatgaagtattttcaggatcaactgttaagaagggtgagatagaggcagttgtgattgctactggtgtgcatacctttttcggtaaagcagctcatcttgtggatagcactaaccaagttggtcactttcaaaaagtacttacagcaattggtaatttctgtatttgctcaattgctgttggaatagtcattgagctcgtagtcatgtacccgatacaacgccgcaagtatcgagatggaattgacaatctgttagttctcttgattggaggaatccctatcgccatgccaacggttttgtctgttactatggctattggttctcacaggctgtctcagcagggtgcgattacaaaaagaatgacggctattgaggaaatggctggaatggacgtcctctgcagtgacaaaactgggactctgacccttaataagttaagtgttgatagaaacttgattgaggtgtttgctaagggtgttgagaaggaatatgttatccttcttgcagcaagggcttctcggactgaaaatcaggacgccatagatgctgcaattgttgggatgcttgctgatccaaaggaggcacgagctgccattagggaggtccatttccttccattcaatcctgtagacaagagaactgctctaacttacattgattcaaatggaaattggcatcgagctagcaaaggggctcctgagcagataattgaactttgcaactgcaaagaggatgtcaggaagaaggttcattccgtaattgataagtttgctgagcgtggacttcgttctttaggtgttgcaagacaggaagtacctgagaaaacaaaagacagtcctggtgcaccatggcaatttgttggtttgttaccactttttgatcctccaaggcacgatagcgctgaaaccatccgaagagctcttaaccttggagtgaatgttaagatgattacaggagatcagcttgcaatcggaaaggaaacaggccgaaggcttggaatgggaacaaacatgtacccttcatcttcgttgctcggccaagacaaggattcttctatttcagctcttccggttgatgagttgatagaaaaggctgacggatttgcgggagtatttcctgaacacaaatatgaaatcgttaagcgacttcaagagaggaagcatatatgtggaatgacaggagacggtgtgaacgatgcccctgcattaaagaaagcagatatcggaattgctgttgccgatgctacagatgctgctagaagtgcttctgatattgtccttaccgaacctggcctgagtgtcattattagtgcagtgctcaccagcagagcaatcttccagagaatgaagaactatacgatttatgctgtatcaatcaccattcgtattgtgttcggtttcatgtttattgcactgatctggaagttcgattttgcacccttcatggtcttgattatcgccatactaaatgatggtaccattatgacgatatccaaggatagagtgaaaccatctccacttccagacagctggaaattgagggagatattcgctaccggcgtcgtgctgggaagttatatggcattcatgacagtagtatttttctgggcaatgaaagataccaactttttcccgaacaagttcggtgtgaggactataagatataaccccgatgaaatgatggcagccttatatctacaagttagtatcataagccaggcactaatttttgtcactaggtcccgtagctggtcctttgccgagcgaccgggtcttctgctactaggtgcattttttattgctcagttggttgcaacatttatagcagtatatgctaattgggagtttgcaagaataaagggtatgggatggggttgggctggtgtaatctggttatacagtttagtgacatatatccctcttgatatactcaaattcgcgatccgatatattctcagtggaaaggcttgggataatctcttggagaacaagactgcatttactacaaagaaagactatggaaaagaagagagagaagcacaatgggcagctgcacaaaggacacttcacggtcttcagcctcccgaaacatccaaccttttcaatgagaagaatagctatcgggagctttcggagatcgcagagcaagcaaagagacgtgccgaggttgcaaggcttagggagcttcatactctaaagggacacgttgagtccgtggtgaagctgaagggacttgacattgatacaattcagcagcactatacagtttaaggagctcgatcaacgacaacctcgaagaagaaccggtttcctgagaacgacaagaacatataatgatgagaaaggttcaaagatcttgttaagcttaaaatttgagcctatgctaggagagctactattctctttaattaccaaataacatcattgatagggttaaatgtcatgtattttgttattccatgaaagttgagagtgagaaggctactcaatttccactagtatgtaatgaaagatttggatttttcgattttagaggatggagacttttgaccaatctgaaacacaattgatcaatctggaactcagttaaccagtctttgtcgattgttcgtaagattggtctgattcaatcgagttcaagattggtcaattgtgttataaaggtaagcagatatccaccaatgtcaccaacctctatagtcattgaatccaaatcgagcaaattacgggtatgcagattaaaatgaaatatagtccttgttattcgatcgactttgctctaatagtacttgttagatcaaacattacaagatggaatgcttactaattgatcaaaagtcataactaatgagtaattacaaggatgaaatttatttc

SEQ ID NO: 2255 - DNA, 3197 bp, Arachis hypogaea
tcttcttcttctatgactttatagtaagttgttaccctctgatcttgaaaacctaattatattaatactctctatttgtaatctttggtcgtcgttgtcttcttcttccggagttgcggtggtcgtcgtcgccattagtgctccaacatgggcggaatcagccttgaggagatcaagaacgagaacgtcgatctggaacatattccagtagacgaagtgtttgagcagctgaaatgttccagagaaggtttatcacaggacgaaggagccagcaggcttcaagtctttggaccaaacaaattggaagagaaaaaggaaagcaagtttcttaagttcttgggttttatgtggaatccattatcatgggtcatggaagctgctgccattatggccattgctcttgcaaatggtggtggaaggccaccggattggcaggattttgttggtatcattgctctcttgttcattaactctacaatcagtttcattgaggaaaacaatgctgggaatgcagctgctgcactcatggctggtttagcccccaaaaccaaggttctgagagatggcagatggactgaacaagatgccgctattttggtcccaggagacataatcagcatcaaattgggagatatcatcccggccgatgcgcgtcttctggagggtgatgctctgagtgttgatcagtctgctttaaccggagaatctcttccggtgacaaagaatcctcatgatgaagtgttttccgggtcaactgttaagaagggtgagattgaagcagttgtgattgccactggtgtccacaccttctttggtaaagcagctcatcttgttgacagcaccaatcaagttggtcactttcagaaagttcttacagccattggtaacttctgcatttgctcaattgctgttgggatagccattgagctcatagtcatgtatccaattcagcacagaaagtacagggatgggattgacaacctgttggttctcttgattggagggatccctattgccatgccaactgtgttgtctgtcactatggctattggttctcacaggctttcccagcaaggtgcaatcacaaagagaatgacagctatcgaggaaatggcgggtatggatgttctctgcagtgacaaaactgggactctcacactgaacaagctgactgttgataaaaaccttattgaggtttttgcaaagggtgttgagaaggatcatgttatccttcttgctgcaagggcttctaggactgagaatcaagatgctattgatgccgcaattgttggtatgcttgctgatccaaaggaggcaagagctggaatcagggaggtccattttttccctttcaatcctgtagacaagaggactgctctaacttacattgattctgatggaaattggcatagatccagcaaaggtgctcctgagcagatattgaacctctgcaactgcaaagaggatgtgaggagaaaggctcatgcaattattgataagtttgccgagcgtgggctccgatctttgggagttgctagacaggaagtacctgagaaatcaaaagatgctcctggtgcaccatggcaatttgttgcgctgctaccactgtttgatcctcccaggcatgatagcgctgaaaccatcacaagagccctgaaccttggtgttaatgtaaaaatgattactggtgatcagcttgctattgccaaggaaactggaagaaggcttggcatgggaacaaacatgtacccttcatcctcattgcttggtcaaagcaaggatgctgcagtttcagctcttccagttgatgagttgattgagaaagctgatggatttgctggagtgtttcccgaacacaaatatgaaattgttaagaggctgcaagacaggaagcatatatgtggaatgacaggtgatggtgtcaacgacgcccctgcattaaagagagcagatattggaattgctgttgctgatgctacagatgctgctagaagtgcttctgatattgtcctcactgaacctggtcttagtgtcattattagtgcagtcctcaccagcagggcaattttccaaaggatgaagaactataccatatatgcagtgtcaatcaccattcgtattgtgtttggtttcatgtttattgcattgatttggaagtttgattttgcaccctttatggtattgatcattgccatacttaatgatggtaccattatgactatatccaaggatagagtgaaaccatccccacaacctgatagctggaaactgaaggagatatttgctactggtattgtgcttggaagttacctggcactaatgacagtagtatttttctggcttatgaaggacactgacttcttctcggacaagtttggtgtaaggtctctgagacacagccctgcagaaatgatggcagccctttacctacaagtcagtattattagccaggcactgattttcgtcactaggtcacgcagttggtcctatgttgaaagacctggtcttcttctattgggtgctttcatgattgctcagctggtggcaactgctcttgcagtatatgctaactggagctttgcaagaatcaagggaatgggatggggttgggctggtgtaatctggctctacagtttagtgacttatgtgcctcttgatttgcttaaattcgcaatccgctatgctcttagtggcaaggcctgggataatcttttggagaacaagactgcattcaccacaaagaaagactatggcaaagaagagagagaggcacaatgggctgctgcacagagaactcttcatggtcttcagccaccagaaacaaccaatcttttcaatgacaagaatagctacagggaactttcagagattgctgagcaagcaaaaagacgtgctgaggttgcaaggctgagggagcttcacactctaaagggtcatgttgagtcagttgtgaagctgaagggacttgacattgacacaatccagcagcattacactgtttgaggaagaaaccttgtcagttcttttgtccaaggagacaacataatatgatgatgaaagacctaagttaatccatctttagatttcatttcggtcctttattttgtgaaaaaaaaaaaattgaatggttacactcccctatctcaccaccccatgtttatgatagcagcaggaggagatgctattctctttaggta

SEQ ID NO: 2256 - DNA, 3215 bp, Papaver somniferum
ttgatctggaacgaatccccatggatgaagttttcgaacaattgaaatgttcgaaggagggtctgagtacggaagaaggagccaacaggcttgagatctttggacctaataagcttgaagagaaaaaggagagcaaacttctcaagtttttgggattcatgtggaatccattgtcatgggtcatggagattgctgcaataatggctattgccctggctaatggtggtggtaggcccccagattggcaagatttcgttggtatcatggttttgcttgttatcaattccacaatcagtttcattgaagaaaataatgccggtaacgccgcacaagctctcatggctggtcttgctcccaaaactaaggtacttagagacggtcgttggagtgagcaagatgccgcaattcttgttccaggagatatcatcagcatcaaattgggtgacatcgtcccagctgatgctcgtcttctagagggtgatcctttaaagattgatcaatctgctcttactggagaatctctcccagttactaagaacccatctgacgaggtgttctctggttcaacctgtaaacaaggagagcttgaagccgttgttattgcaactggagtgcacactttctttggcaaggctgcacatttagtcgacagtaccaaccaagttggtcacttccagaaggttcttactgctattggtaacttctgtatctgttcgatcgcaatcggtatgttaattgagatcatagtaatgtacccaattcagaaacgaaagtacagagatggaattgataacctattggttctcttgattggtggtatcccaattgccatgcccactgtgttatctgtcaccatggccattggatcccacaggctctctcaacaaggtgctatcactaagagaatgactgccattgaagagatggctggtatggatgttctctgttccgataagacaggaacccttaccctaaacaagcttagtgttgacaagaacttggttgaagtgttcgctaagggtgtcgagaaagatcacgttctccttgttgctgcaagggcatccagggtggaaaatcaggatgcaattgatgcttgcatggttggtatgcttgcggatcccaaagaggctagagctggtataagagaggttcactttttaccgttcaaccctgtggataagaggactgctcttacctatattgataatgacggcaaatggcacagggccagtaaaggggcacctgaacagattattgatctttgcaactgcaaagaggatgtaagaaacaaggttcattccgtcattgacaagtatgcagaacgtggtctgcgatcattggccgtcgcaagacaggaagttcctgagaaaaacaaagacagtccaggtgcaccatggcagtttgttggtcttctgcctctgttcgatcctcccaggcatgacagtgcagaaaccatcagaagagctctcaatcttggagtgaacgtaaagatgattacaggagaccagcttgccattgctaaggaaactggaagaaggctaggaatgggaactaacatgtacccctcttctgcacttcttggcaacaacaaggatgcatcaattgcttctctccctgtagatgagctgatcgagaaggccgatgggtttgcaggagttttccctgagcataagtatgaaattgtaaagaagctgcaagagaaaaaacacatatgtggtatgaccggagatggtgtgaatgatgctcctgcactcaagaaagctgatattggtattgctgttgctgatgcaactgatgctgccagaggtgcctccgatattgtgctcacagaacctggattgagtgttattatcagtgcagtacttactagcagagccattttccaaaggatgaagaattacacaatttatgctgtttcaatcactatccgtattgtgttcggcttcatgtttattgctttgatctggaagtttgactttgctcctttcatggttttgatcattgccatcctaaatgatggaaccatcatgaccatctctaaagatcgtgtcaagccatctccaactcccgacagttggaaactaaaagaaatttttgcaactggagttgtgcttggaagttacttggcattgatgacagtcatattcttctgggctgcatggaaaactgatttcttctctgacaaattcggtgttagacctattagggatgataagcgtgaaatgatggctgccttgtacttgcaagtcagtattgtgagccaggccctcattttcgttacaaggtctcgcagctggtcgttcgttgaaagacctggatttcttcttgtttttgcgttctttgctgctcagctggtggcaactttgattgccgtatacgccaattgggaatttgctaacatgagaggtattggttggggatgggctggggttgtttggcttttcagccttgttacctatttcccacttgacattctcaaattcatcatccgatatgttcttagtgaaaggcttgggacaacctccttgaaaacaagactgccttcactaccaagaaggattacggaaaagaggagagagaagctcaatgggctcttgctcaaagaactctacatggactacaaccaccagaagcaaataacctcttcgctgacaagaatagctacagagagctttcagaaattgctgagcaagctaagaggcgagctgaagttgccagactaagggaacttcacacactcaagggacatgttgaatctgtcgtgaagctaaaaggactagatatcgatactatccaacagcactacactgtttaataaactcggataaacataattatattgagaaagtgtggtttgttggcgctccttgaaagaacatcaccataactaagaagaggatgccgacggcgtaacagctattagaactcttttttttccttctaaatagtgaatcagatatttgccggtgctataaacttatttatcagtttgctttttcttctttccgctgctgtttctaggtgccctcaaggaaaagttgtgtttcacatctccttatgtatgaagagttataataacatcgcatcacacagtttttttttcccttcacttttcttgtgcactttgtaatctcagtctcaaggggcatcgtaacattttcaatgatgacccaattgagtatttgagtgataaagcaaaattgttcaatcaacct

SEQ ID NO: 2257 - DNA, 3202 bp, Helianthus annuus
ctctcttgtttctctctcttcatttacatacactgttccttcgatgctcttcttctccaattaatttccccaaaattcactctactttccgccattaacttcgcttctcaatcgctgcaaacatgggcggcgataaggctctcagcctcgaagagattaaaaatgaaactgttgatctggagaaagtacccattgaagaggtgtttgaacagttgaaatgtaaccgagaaggtctaagttccgatgaaggggccgcaagacttcaaatttttggtcctaacaaattggaggagaaaaaggaaagcaaactactcaagtttcttgggttcatgtggaatcctctatcatgggtcatggaagctgcagccattatggcaattgcactggctaatggaggcgggaaaccacccgactggcaagactttgtcggtattgtttgccttcttgttatcaactcaaccatcagttttatcgaagaaaacaatgctggaaatgctgctgctgcacttatggctggtctcgcccctaaaaccaaggttctgagggatggtaattggagtgaacaagaagctgcaatcttggttccaggagatattatcagtatcaaacttggtgatatcgttcctgctgacgcacgtctcctagaaggtgaccccttaaagattgaccaatctgcccttactggtgaatcgcttcctgtgaacaagaacccttacgacgaggtgttttccggttcaacttgcaagcaaggtgaaatagaagccgtcgttatcgcaactggtgtgcacactttcttcgggaaagccgcacacttagtggatagcactaaccaagtcggtcacttccaacaagttctaacagctatcggaaacttctgtatctgctcaatcgctgtcggaatgttggttgagattgtcgtcatgtatccgattcagcacagggagtacagaaatggaatcgacaatcttctggtcttgcttatcggtggaatcccaatcgctatgccgacggttctttctgtcaccatggctattggatcgcataggctttcacaacaaggagctattactaaaagaatgactgccattgaagaaatggcgggaatggacgtactttgcagtgataaaaccggaacactgactcttaacaagcttagtgttgataaaaatttgattgaggtttttgctaaaggtgtcgataaggatcaggttctgctttatgctgctcgggcttctaggaccgaaaaccaggacgctattgatgcggccattgttggaacccttgctgacccgaaagaggcacgagctggaattagggaggtccatttctttccgtttaatcctgttgacaagcggacagctttgacatacatcgatgagcgcggtaactggcatagaacaagcaaaggtgctcccgaacagattttgaccctctgtggatgcaaagaagatatgaaaaagaaagttcatgcaatgattgacaaatttgctgaacgtgggttgcgttctttggctgttgcgaaacaggaagtacctgaaaaaaacaaagaaagccctggtggtccatggacgtttatcggattgttgtcgttgtttgacccaccaaggcatgacagtgctgagaccattcgcagagctctcaatctcggtgtcaatgttaagatgattactggtgatcaacttgctattgctaaagagactggtagacgactcggtatgggaacaaacatgtacccgtcttcttctttactcggtaaccacaaggatgcatcgatagccgctatccctattgaagagttgatcgagaaagccgatggatttgccggagttttcccagaacacaagtatgagattgtgaagaagttacaagaaagaaagcacatttgtggaatgaccggtgatggtgtgaatgatgcgcctgctttgaagaaggccgatattggtatcgctgttgccgatgctacagatgccgcaaggggtgcttctgacatcgtgcttactgagcccgggcttagtgtcattatcagtgcagtgcttaccagtcgcgctattttccaaagaatgaagaactacaccatctacgctgtttctatcaccattcgtattgtgtttggatttctgttcattgctttgatatggaagttcgacttctctcccttcatggttttgatcatcgcaatccttaacgacggcacaatcatgacaatctcaaaggatagggtgaaaccatcgccattacccgacagctggaagctaaaagagatcttcgccaccggcattgtgctcggaggttaccttgcattgatgactgtcatattcttctggatcatgaaagacacaaacttcttctcggacacgtttggtgttagatctttgagacacagtgaagttgagatgatggctgctttatatcttcaagtcagtatagtcagccaggctttgattttcgtgacgcgttctcgcagttggtcgtttatcgaacgtcccggtctcttacttttgggtgccttcttagcagcacaactggtggcaacgttaatcgcagtgtatgcaaattgggaatttgcaagaatcaagggagtcggctggggatgggctggtgtcatctggctctacagcatcgtgttctacttcccgctcgatcttatgaaattcgccatccgatatatccttagcgggaaagcatggaacaacttgcttgaaaacaagactgctttcacaagcaagaaggattatggaagagaagagagagaggcccaatgggctcttgctcaaaggacattgcatgggctccaacaacccgaaacctccaacatctttaatgaaaagagcagctacagggagctgtctgagatagcggaacaggctaagaggcgcgctgaagttgcaaggcttcgggaggtgcttacactgaaggggcatgttgagtcggtggtgaagctgaaggggctagatatcgacacgatccaacagcattacacagtgtgagagagcagtgggaaacaagtcttttgttcttttaacttattatattaatagactagtagaagttgataactcgtgtggggaaaaggtattttgtgcttttggaatgtaaccccccgaaactgtttacttgttctgtttttctagtgcaattccaagtattacagcatatggttgctgctgttttgtgtatgttttacaaagaatgaaagccaagt

SEQ ID NO: 2258 - DNA, 2989 bp, Ananas comosus
ctctcgtttcctcttccttttttagagagggagagaaggagagctctcttcgtaaatggaggagtcgacgacgatgatggtgtcttcgtctccgtcctcgttctcttcttcttcttcgtctcattagggtttcggttcctcggttttcctagggtttctgcgcggatctaccagggtttcgcttcgtccgcgatcgtgtctctgaggcggtgaggcgatcgagatggcgagcaacaagagcaccggcctcgaggacatcaaaaacgagaccgttgatctggagcgtatcccaatcgacgaagtgtttgagcagctgaaatgtacgagggaaggtctcagctcggaggagggagccaatcggctccaactcttcggtcccaacaagctcgaagagaaaaaggagagcaaggtcctcaagttcctgggcttcatgtggaacccgctctcgtgggtcatggagatggccgccatcatggccatcgccttggccaacggcgacggcaagccccccgactggcaagactttgtcggcatcgtcgttctcctcctcatcaactccaccatctccttcatcgaggagaacaacgccggcaatgccgccgccgccctcatggccggcctcgctcccaaaacgagagtgctgagagatggccgctggaccgagcaggatgctgcgatcctcgtcccgggagacatcataagcataaagctcggggacatcgtcccggccgatgctcggcttcttgaaggagacccattaaaaatcgaccaatctgctctgaccggagagtcgctccccgttacgaagaatcccggcgatgaggtcttctccggttccacttgtaaacagggtgagatcgaggccgtcgtcatcgcgaccggcgtccataccttctttggcaaggcggcccaccttgtcgacagcaccaaccaggtgggccacttccagaaggtcctcaccgccatcggaaacttctgcatctgctccatcgcggtgggcatcgttgtcgagatcatcgtcatgtacccgatccagcacaggaagtaccgcgatgggattgacaatctcttggtactcttgatcggagggattccgatcgccatgccgactgtcctgtcggtgactatggcgatcgggtcccacaggctggcccagcagggcgcaattaccaagaggatgacagctatagaggagatggccgggatggacgttctttgcagcgataagaccgggacattgacgcttaacaagctgagtgtggataagaacttgatcgaggttttcgcaaaaggcgtggataaggagtatgtgatcttgctggccgctagagcgtcgagaacggagaatcaggatgccatcgatgctgcaatagttggaatgctcgcagacccaaaagaggcaagagctggaattagagaggtacattttctgccattcaaccctgttgacaaaagaacagctcttacctacattgacgccgatggcacctggcatcgtgtgagcaaaggcgcacctgagcagattctgaacctctgtaactgcaaagaagatgtcaggaataaggttcactctgtgattgataagttcgccgaacgtggacttcgttcgttagctgttgctagacaggtagttccagagaagaacaaggatagtcctggagggccgtggcaatttgttggcctgttgcctctgttcgatcccccaaggcatgacagtgcagaaacaatccgaagggcgctcaatcttggcgtcaatgttaagatgattactggtgatcagttggctattgccaaggagactggccgaaggcttgggatgggaaccaacatgtacccatcatcctccttgcttggtcagcacaaggatgcttctattgccgtccttcctgtggatgaattaattgagaaggctgatgggtttgcaggagtattcccagaacacaagtttgaaattgtgaagaggttgcaggagaggaagcacatctgcggaatgacgggagacggagtgaacgatgcacctgctctgaagaaggctgatattggaattgctgttgcagatgccacagatgcggcgagaagtgcttctgatattgtccttactgaaccagggcttagtgttatcataagtgctgttcttaccagcagagccattttccagaggatgaagaactacacgatttatgctgtctccatcaccatccgtattgttcttggtttcatgcttattgcgctgatatggaagtttgatttctcgcccttcatggttttgatcattgccattttaaatgatggtactatcatgacaatctcaaaggatcgggtgaagccatcgccgatgcccgacagctggaaactgaaggagatttttgttaccggcgttgtatttggtagttacttggcacttatgaccgtagtcttcttctgggccatgatagacactgacttcttcttggataagtttaatgttcgatcgctgaggcatagtgaggacgaaatgatggctgctttgtaccttcaagttagtatcattagccaggctcttatattcgtcactcgatcccgcagctggtgctttgttgaacgcccaggacttttgctgatcagtgcatttatcattgctcagcttgtcgcaactgtcatagccgtgtatgcggactggggcttcgctcggatcaaaggtatcgggtggggatgggccggggtcatctggctatatagcatagcctccttcatgcctctcgactggttcaaattcgccatccgctacgccctcagtggaaaggcctgggataatctcttggagaataagacggccttcactacaaagaaagattacggcagggaagaaagggaagcccagtgggccatggcccagaggactcttcacggtctccaaccgcctgaaactgcaaatatcttccccgacaagggcggctacagagagctctcggagatcgcagagcaagccaaaaggcgcgcggaggtcgca

SEQ ID NO: 2259 - DNA, 3483 bp, Allium cepa
gaattctgttcttcaaccatctattcattttcactctatttcattcgtaaacttctgattttttcgattctatatcagaaccggaaccgaaggtcgacggttcgatttgattcgagatgggtgcgattagtttggaggagataaaaaatgagaacgtggatctggaacggattccgattgaggaggtgtttgagcaattgaaatgcacaagggaaggactttcatctgatgagggagccagcaggcttacaattttcggccctaacaagctagaagagaaaaaggaaagcaaactcctaaagtttttggggttcatgtggaatccactttcctgggtcatggagatggctgccattatggccattgctttggccaatggtggtgggaagcctcctgattggcaagatttcgttggaattgtcgtgcttcttgtgattaactccaccatcagtttcatcgaagaaaacaatgctggtaatgctgcagctgctttgatggctggacttgctcccaaaacgaaggtactcagagatggtaggtggagcgaacaagatgcagcaatccttgtacctggtgacatcatcagcatcaagcttggtgacattgttccagctgatgcccgtcttcttgaaggcgatcctttaaagatcgatcaatctgcccttaccggtgagtctcttccagtcacaagacacccaggtgatgaagtattctcaggttccacctgcaagcaaggagaaatcgaagcagtagttattgccacaggggtccacaccttctttggaaaagctgctcacttagtcgacagcaccaaccaagtaggccatttccaaaaggttcttacagccatcggtaacttctgcatctgctccatcgctataggaatggtagtcgagatagtagtaatgtacccgattcagaaaaggcactacagaagtggaatcgataaccttttggttctattgatcggtggcattccaattgccatgcctactgttttatctgtcactatggcaattgggtcccataggctatccgagcaaggtgctattactaagaggatgactgctatcgaagagatggctggtatggacgtgctctgcagtgataaaactggaactttgactttgaataagttgagtgttgacaagaacttgattgaggttttcgtaaagggcgtggataaggattatgttatgctcttggctgcaagagcttctaggactgaaaaccaggatgctattgatacttgcatggttggcatgctcgctgacccgaaagaggctagagcaggtattagagaaattcactttctacccttcaatcccgttgacaagaggactgctctgacctacatcgactctgatggaaactggcatcgtgctagtaagggtgctcctgagcagattgtcgacctttgcaagtgcaaggaagatgttaaaaacaaggttcactccataatggagaagtatgctgaacgtgggcttagatcattggctgtggctagacaggaggttcctgaaaagagcaaagaaagttcaggggggccatggcaatttgttgggttgttaccattgtttgatccacctagacacgatagtgctgaaacaatccgtagagctttaaatcttggtgttaatgtcaagatgatcactggcgatcagcttgctattgctaaagaaactggaagaagacttggaatgggaacaaacatgtatccttcctcttctttgcttggtcagcataaagatgaatcaatagcttctcttcctattgatgaattgatcgaaaaggctgacgggtttgctggagttttccctgaacacaaatatgaaatcgtgaagaagttgcaagaaaggaagcacatttgtggtatgactggagatggtgtgaacgatgctccagcgctgaagaaagctgatattggaattgcggttgatgacgccactgatgctgcaaggagtgcatctgatattgttctcactgaacctgggctcagtgttatcatcagtgctgttcttactagcagagccattttccaaaggatgaagaattataccatctatgccgtctccatcactatccgtattgttcttgggtttcttcttattgcattgatttggaagtttgatttctctcccttcatggttttgatcatcgccatcctcaatgatggtaccattatgacaatttcaaaagatagagtgaaaccatccccattacccgatagctggaagctgaaagaaatttttgctaccggtgttgtttatggaacctacttggcaattatgagtgtcatcttcttctgggtgatgaaagatactgatttcttctctaaaaaatttggagtaagatcaattagacacagtgaagatgaaatgatgtctgctttatacctacaagtcagtatcgtaagtcaggctctcattttcgtcacccgttctcgtggctggttctttgttgaacgccctggacttctcttggtctctgctttcttcattgctcaacttgttgcaactcttattgctgtctatgctgattggggttttgcacgtatcaagggtattggctggggatgggctggtgttatctggctatacagtgtcattttctttttccctctcgactggtttaaatttgctattcgttacattcttagcggaaaggcttgggataaccttcttcaaaacaagactgccttcaccacaaagaaagattacgggaaagaggaaagagaagcacaatgggcaacggcacaaagaacacttcacgggcttcaaacctcagagaacacaaacttattttctgataagaacaactatagggaactatccgagatcgccgagcaagcaaagaagagagctgaagttgcaaggcttcgtgagctacacacactgaaaggtcacgtagaatcagtaatcaagctaaagggtctggacatcgacggcatgcagcagcactacactgtgtagaactgtaattacaaacagataatttgaatccctcctatacatgaacatttatgtatttatggaggtgaagatggctgctacatcatttgacctggataaagacttctttgttttttgttccttccaccccccatagattattaagcattccatgcagtaatttctcttttctcgtacctttgttatttttgcccatgatagctgtggtaaaacagcgttttcagtttgatgcctggctttgcaggatgcagatgaaataacatgaacctgctactagcttttgttgtcttttccttttatttagtgcttgctgtataatgttactatttagcaaaaacagattatatggtattgtattatgtatgtgtgtacattttactttgtttacctaattgcagttcagttttgagcagacctaagtttacttttcacgttttatagttcagtgtatttgtttatgtgctgatgtacatgtacataactgttatagccgttttcgaaaaacacacac

SEQ ID NO: 2260 - DNA, 3325 bp, Nicotiana tabacum
ggcaccaggagattccaagaaaagtgaaaaagtaaaataaacaaaaaagaataaggggagagacagagcaattctgcaaataagtctctctccatttattttttattaacaagaaagatttttagtctttcttgttttttctcatgtggtgaaaaaaatactaattttccttctcttggttcctcttattaaattatcatcatggcgtctaatttatcattagaagatattaaaaatgagcaagttgaccttgaaaacattccggtggaggaagtgtttcagcagctaaaatgtagcaaagaaggattatcatctgaagagggcaaaacaaggctccaaatatttggccccaacaaacttgaagagaaaaaggagaacaagtttctcaaattcttggggtttatgtggaatcctctctcatgggttatggaatcagctgctattatggccattgctttggccaatggaggaggcaaggcaccggattggccagatttcgttggtatcactgtattgctcgtaatcaactctactatcagttttattgaggaaaataatgcaggaaatgctgcagctgcccttatggctaatcttgctcccaaaactaagattttgagagatggaaaatggtcagaggaggatgcctcaatcttggtaccaggtgatcttattagtatcaagttgggagatatcgtcccagccgatgctcgtcttcttgagggtgatcccctcaagattgatcaggctgcactcactggtgagtccttaccagtgacaaagttccctggtgctgaggttttctctggttccactgtcaagcaaggagaaatcgaggcagtagtcatcgctactggtgttcacaccttctttggaaaggctgctcatcttgtagatagcacaaaccaagttggtcatttccaaaaggtgttgactgccattggtaacttctgtatctgctccattgctgtgggaatggtgattgagattgtggttatgtacccgattcagaggcgtaaatatagagatggaattgacaacttgcttgtgttgcttatcggaggtatcccaattgccatgccaacagtcttgtctgtgacaatggctattggatctcataggcttgcacaacaaggtgccattacaaagaggatgactgctattgaggaaatggctggtatggatgttctttgcagtgacaagaccggtaccctcaccctcaacaagctcaccgttgacaaaaatttgattgaggttttccctaaagatgcggacaaggataccgtcatgttacttgctgctagggcttctagggttgaaaaccaggatgctatcgatgcttgcatcgttaacatgttgggcgatcccaaggaggcaagagcaggcatccaagaagttcatttcttacctttcaatccggttgaaaagcgcacagcaattacatatattgatgacaaaggaaactggcacagggctagcaaaggagctcctgagcaaattattgaactttgtgagctcaaaggagatatcaggaagaagtccttagatatcatcgacagctatgccaaccgtggtcttcgttccttggctgtggctagacagactgtaccagagaagagcaaggaaagcgatggttcaccttgggaattcgttggccttctgcccctttttgatcctccaaggcatgacagtgctgaaacaatccgcaaagctcttgatcttggtgttaatgttaagatgatcactggtgaccagctcgccatcggtaaggaaactgcccgtaggcttggcatgggaaccaacatgtatccttcttcagctcttcttggagagcacaaagatgcagccattgcttcaattcctgtcgatgagctcattgaaaaggcagatggttttgccggagtcttcccagagcataaatatgagattgtgaagaagctccaagaaagaaaccatatctgcggtatgacaggagatggagtgaacgacgcaccagcactaaagaaggcagacattggtatagctgtggatgatgcaacagacgctgccaggagcgcatctgatatcgtcttgactgaaccaggtcttagtgttatcgtgagtgctgtgttgacgagcagagccatcttccagaggatgaagaactacaccatctatgcagtttccatcacaatccgtgttgttatgggattcatgctcattgcccttatctggaagttcgacttctcgccattcatggtccttatcattgccatactcaatgatggaactatcatgaccatctctaaggacagggtgaaaccatctccattgcccgattcgtggaaactcaaagaaatctttgccactggtgttgtcctcggaacctaccaagcgatcatgactgttgtgttcttctaccttgcagctgacactgatttcttctctgaaaacttccatgttagatcaatcagaaactctccaactgagcttacagctgcactataccttcaagtgagcattattagtcaagctctcatctttgtgaccagatcaagaagttggtcattcgttgaacgccctggccttatgcttgtcggtgctttctttgccgctcaattggttgctaccgtgctcgctgtatatgcaaactgggaatttgccaggatcaagggagttggttggggatgggcagcagttatctggatctacacaattattacctatatccctcttgatattcttaaattcatcatccgtttcgctttaagtggaagggcatgggattcaatgatccagaacaagactgccttcacaaccaagaaagactatggaaggggtgaaagggaagcacaatgggctttagctcaacgtacacttcacggtctgcagacacctgaaaacactggcctattcaatgacaagaactacagggaactatccgagattgctgagcaggctaaacgtcgtgctgaagttgcaaggttgagagagctacacactctaaagggacatgttgaatcagtggtcaagctaaagggactagatattgaaaccatccaacaacactatactgtctaaagaagctgcaaatcaaatcaactttcattttttcccatataaggaaggacatttttcagctggcactatgttggatgaggatattgtttggttgaagaacaagggctagctgtgtatttaaaaaaaatcttgagtattgatagttatctatagaagaaaataaaaaataaaaaattgtaagtagtagttactttttatctttattgttatttatcctatctatacaatgtatgttatctatacaatgtatgttattttatttgcttag

SEQ ID NO: 2261 - DNA, 3352 bp, Cocos nucifera
cggcggtccgtgacttctttcctttgcttgtctcctccctataactcccagagtggaggtggggagagggatcgtgcgacgcagtccccctatttcccttggctcccgcggtttcttactcctagcagggcgtggtgcgcagccactgagagaatgggtggagggacggcgatcagtctagaggagatcaagaacgagactgttgatctggaaaatattccaatcgaggaggtcttccagcagctgaaatgcaccagggaaggtctcacatcggacgaaggagcccaacggctccagatcttcgggcccaacaagctagaagagaaaaaggagagcaaggttctcaagtttctgggtttcatgtggaatcccctgtcctgggtgatggaatcggctgccatcatggccattgccttggctaacggcggaggtaagcccccggactggcaagacttcgtcggtatcgtcgtcctgcttgtcatcaactccaccatcagtttcatcgaggaaaacaacgccggcaacgccgcagcagccttgatggccggtctcgctccaaagactaaggtgctcagaaatggctgctggtgcgaggaggaggcagcgattctcgtgcctggagatataatcagcatcaaactcggagacattgtgcctgctgatgcaagactcctcgagggagatccgttgaagatcgatcagtccgccttgaccggagaatcccttcctgtcactaagaacccaggggatgaggtgttctccggctcaacctgcaagcagggtgagatcgaggctgtagtcatagccaccggcgtccataccttctttgggaaggcggcccacctcgtggacagcacgaaccaagttggccatttccagaaggtcctcacggccatcggtaacttctgtatctgctccattgctctggggatgattgtcgagatacttgtcatgtacccgatccaacatcggaaatacagaaatggaatcgacaatctgttggtactcttgatcggtggtataccaattgctatgccaaccgtcctgtcggtgaccatggctatcggatcccaccgactgtccgagcaaggagcaatcactaagagaatgactgcaatagaggagatggccggcatggatgttctctgcagtgacaaaactgggacactgacccttaacaagctgagcgttgacaaaaaccttattgaggtttttgcgaaaggtgtggacaaggatcatgtggtcttattggcagcgagggcatcgaggacggaaaaccaggatgccatcgatgccgccatggttgggatgcttgcagacccgaaagaggcaagagctggtatcacggaagtacacttcctcccgttcaatcctgttgataagagaactgctcttacttacgttgatgctcatggcaagtggcatcgtgcgagtaaaggtgctcccgagcagattttgagcctctgcaactgcaaggaagatgtcagaaaaaaggttcacggtgtgattgataagtttgccgagcgtgggcttcgatcactaggtgttgcgagacaggaagttcctgagaagaacaaggagagcccaggggccccatggcagttcgttggtttgttgtctctgtttgatcccccaaggcatgacagtgcagaaaccatccgtagggctctgaatcttggtgtgaacgtaaagatgattactggggatcagctagctattgccaaggagactggccgaaggcttggaatgggtacaaacatgtacccttcttcttcattgcttggccagaacaaagatgaatcaattgctggacttcctgtagatgagttgattgagaaggctgatggatttgcaggagtatttccggagcacaaatatgaaattgttaaaaagctgcaagagagaaagcacatctgtggaatgactggagatggagtgaacgatgcccctgctttaaagaaggctgatattggaattgctgtggctgatgccacagatgccgctagaagtgcttccgacatcgtgcttactgaacctgggcttagtgtcatcatcagtgctgttctaactagcagagccattttccagaggatgaagaactacacgatctatgctgtttctattaccatccgtattgttctcgggtttatgcttattgcattgatatggaagttcgacttttcacccttcatggttttgattattgccatcctaaatgatggtacaattatgacaatctcaaaagatcgagtcaagccatctccacagcctgacagttggaagctgagggagatttttgcaactggcgttgtgcttggcacctacttggcattgatgactgttatcttcttctgggcaatgaaggagacggatttcttctcagataaatttcacgttagatcactgaggaacagtgaggatgaaatgatggctgctttatacctgcaagttagcattgttagtcaggctcttatattcgttactcgatcacgcagctggtgctttgttgaacgccccgggcttctcttagtcactgcttttgttgttgcgcagcttgttgctactcttatagctgtctatgctaactggggtttcgcacgaattaaaggcataggctggggatgggctggagttatctggctttatagtattgttttcttcttccctcttgaccttttcaaatttgccatccgctacattctaagtggtaaagcttgggataacgtgcttgagaagaagactgccttcaccagcaagaaggattatggtatagaagaaagggaggcccagtgggctacggcacagaggactctgcatggacttcagccccctgaaacaaccaacctgttcaatgacaaaaatagctacagggaactttcagagattgcggagcaggctaaaaggcgagcggaggtcgcaaggctccgtgagctgcacactctgaagggtcacgtagaatcagttgttaagctcaaaggccttgatattgataccatccagcagcattacactgtataatcaccagagaggatggtgaaccttcaaggggaagcccgagaaggaagctttcaattttttaacctaagaatattgtattcctgcattatgccttgatcctgcagtcagtttccgtttttctttctcttaagagctgtggtgacaacctatctgtttacaagttgcgcatgtagatgaccatgatgcagacttgctgttctctgcttctaaagtttattctttcccaataactgctgctaaacaatgagtaaattgaatctttttgatgctatctcatgcagccacttcagaatccgatcggcggctttgggttttactttgcattatctacagt

SEQ ID NO: 2262 - DNA, 3273 bp, Cocos nucifera
ctcatttcctgtgttctgcacctccatcgtggggggagagcgagggttgtggcctgtcggcggccgctaaaacaatgggtggagggtcggcgatcagtctggaggagatcaagaacgagactgttgatctggaaaggattccgatcgaggaggtctttgagcagctgaaatgcacgcaagaaggtctcacatcggaggagggagccaaccggctccagatcttcgggcccaacaagctagaagagaaaaaggagagcaaggttctcaagtttctgggtttcatgtggaatcccctgtcctgggtgatggaatcggctgccatcatggccattgccttggctaacggcggaggtaagcccccggactggcaagacttcgtcggtatcatcgctctgcttgtcatcaactccaccatcagtttcatcgaagaaaataacgccggtaacgccgcagcagccttgatggccggtcttgctcccaagactaaggtgctgagagatggccgctggagcgagcaggatgcagcaatccttgtgcctggagacataattagcattaaactcggagatatcgtgcctgccgatgcacgacttctcgagggagatccgttgaagattgatcagtctgccttgaccggagaatccctccctgtcaccaagaacccaggagatgaggtgttctctggctcgacctgcaagcagggtgagatcgaggctgtagtgatagccactggcgtccataccttcttcgggaaggcggcccatctcgtggacagcacgaaccaggttgggcacttccagcaggttcttacagccatcggtaacttctgcatctgctccatcgccgtggggattctcgttgagataatcgtcatgtacccgatccagcatcggaagtacagagacggaatcgacaacctgctggtccttttgatcggaggcataccaattgcgatgcctaccgtcctgtcggtgaccatggctattggatcccaccggctctccgagcaaggagcaatcaccaagagaatgactgcaattgaggagatggccggcatggatgttctctgcagtgataaaaccgggactctcacccttaacaagctgagcgttgacaaaaaccttatcgaggtttttgtgaaaggtgtcgataaggatcatgtgctcttattggcagcgagggcatcgaggacggaaaatcaggatgctattgatgctgccatggttgggatgcttgcagaccccaaggaggcaagagctggtattagggaagtacactttctccccttcaaccctgtggacaagagaactgctctgacgtatattgatgctgatggcaaatggcatcgtgtgagtaaaggtgctcctgagcagattttgaacctctgcaactgcaaggaagatgtcagaaaaagggttcattctgtgattgacaagtttgccgaacgcgggcttcgatcactagctgttgcaagacaggaagttccagagaagaccaaggagagtcctgggagcccatggcagtttgttggattattgcctctatttgatcccccgaggcacgacagtgcagagaccatccgtagggctctgaatcttggtgtgaacgtaaagatgattactggggatcagctcgctattgctaaggagactggccgaaggcttggaatgggcacaaacatgtatccttcctcttcattgcttggccaacataaagatgaatcaattgctgggcttcctgtagatgagttgattgagaaggctgatggatttgcaggagtatttccagagcacaaatatgaaattgtcaagaagttgcaagagaggaggcacatatgtggaatgactggagatggagtgaatgatgcccctgctttaaagaaggctgatattggaattgctgttgctgatgccacggatgctgctagaagtgcttctgacattgtcctcactgagcctgggcttagtgtcatcatcagtgctgttctaacaagccgggccattttccagaggatgaagaactacactatctatgctgtttccattacaatccgtattgttctcggctttatgctcattgcactgatatggaagtttgacttttcacccttcatggttttgattattgccatcctaaacgatggcacaattatgacgatatcgaaagatcgagtgaagccatctccacagcctgacagttggaagctgaaggagatttttgcaactggcattgtgcttggcacctacttggcattgatgactgtcattttcttttgggccatgcataaaacagatttcttctcggatgaatttaaagtcagatcattgagggaaaaggaagaacaacagatgtctgctttatacctgcaagttagtattgtcagtcaggctcttatattcgtcactcggtcacgcagctggtgctttgttgaacgccctgggcttctcttagtcactgcctttgttattgctcagcttgtcgctactcttatagctgtctatgctaactggggtttcgcacgaattaaaggcataggctggggatgggctggagttatctggctttatagtattgttttcttcttccctcttgaccttttcaaatttgccatccgctacattctaagtggtaaagcttgggataacgtgcttgagaagaagactgccttcaccagcaagaaggattatggtatagaagaaagggaggcccagtgggctacggcacagaggactctgcatggacttcagccccctgaaacaaccaacctgttcaatgacaaaaatagctacagggaactttcagagattgcggagcaggctaaaaggcgagcggaggtcgcaaggctccgtgagctgcacactctgaagggtcacgtagaatcagttgttaagctcaaaggccttgatattgataccatccagcagcattacactgtataatcaccagagaggatggtgaaccttcaaggggaagcccgagaaggaagctttcaattttttaacctaagaatattgtattcctgcattatgccttgatcctgcagtcagtttccgtttttctttctcttaagagctgtggtgacaacctatctgtttacaagttgcgcatgtagatgaccatgatgcagacttgctgttctctgcttctaaagtttattctttcccaataactgctgctaaacaatgagtaaattgaatctttttgatgctatctcatgcagccacttcagaatccgatcggcggctttgggttttactttgcattatctacagt

SEQ ID NO: 2263 - DNA, 3316 bp, Allium cepa
tcttcttatttttggtccaaagtttgaaccggagacgacgttcggcgtttccgtttgatcgagatgggggcaattagtctggaggagatcaaaaatgagaacgtggatctggagcgaattccaatcgaggaggtattcgagcagctgaagtgtacaagggagggtctttcatctgatgagggagccagcaggcttacaatttttgggcccaacaagctagaagagaaaaaggaaagcaaaatccttaaatttttggggttcatgtggaatccgctctcctgggtcatggagatggctgccatcatggccattgctttggccaatggcggtgggaagcctcctgattggcaagattttgttggtattgtcgtccttcttgtgattaactccaccatcagtttcattgaagaaaacaatgctggtaatgctgcagctgcactgatggctggtcttgctcccaaaactaaggtgctaagagacggtcgctggagtgaagaagatgcagcaatcctagtgcctggtgacatcataagcatcaagcttggggatatagtccctgccgatgcccgtcttctagaaggcgatcctttaaaaatagatcaatctgctcttacaggtgaatctcttccagtaaccaggaacccaggagatgaagttttctcaggctccacctgcaagcaaggtgaaatagaagcagtcgtcatagccactggagtccacaccttctttggaaaagccgctcacttagtcgacagcactaaccaagtggggcatttccagaaggtcttgacagccattggtaacttctgcatctgctccattgctattggaatggtcattgagataatagtcatgtacccgatccagaaaaggcagtacaggagtggaatcgataaccttttggtcctcttgattggtggtattcctattgccatgcctactgtcttgtctgtcaccatggccatcggatctcacaggctatcagagcagggtgccattactaagaggatgactgccattgaagagatggctggaatggatgtgctctgcagtgataagactggaactttaactttaaataagttgagtgttgacaagaacttgatcgaggtgtttgcaaagggtgtcgacaaggattatgttatgttgttggctgctagggcttctaggactgagaaccaggatgctatcgatacatgtatggttggtatgcttgctgaccctaaagaggctagagcaggtattagggaagttcacttccttccattcaaccctgtcgataaaaggactgctttaacctacattgattccgaaggaaactggcatcgtgttagtaaaggtgctcctgagcagattgtagagctctgcaagtgcaaggaagatgttaaaaacaaggttcattcaataatggagaagtatgctgaacgtggtctgcgatcattggctgtggctagacaagaggtccctgaaaagagcaaggatagtccagggggaccatggcaatttgttgggctgttgccactttttgatccaccaaggcatgatagtgccgaaacaatccgtagagctttgaatcttggtgtcaatgttaagatgatcactggtgatcagcttgctattgctaaggaaactggccgaagacttggaatgggaactaacatgtatccttcctcttctttgcttggacaaaataaagatgcatcaattgcttctcttcctgttgatgaattgatcgaaaaagctgatgggtttgctggagttttcccagagcacaaatatgaaatcgttaagaagttgcaggagcggaagcacatctgtggtatgactggagatggtgtgaatgatgctccagctttaaagaaagctgatattggaattgcagtcgacgatgctactgatgctgctaggagtgcctctgatatcgtgctcacggaacctggtctcagtgttatcattagtgctgttcttactagcagagccatttttcagaggatgaagaattacactatctatgctgtctcaatcactatccgtattgttcttggatttctccttattgcgctcatttggaagttcgacttctcacccttcatggtcttgattatcgccatcctcaatgatggaaccattatgacaatttcaaaagacagggtaaaaccatctccattgcctgacagctggaagctaaaagaaatttttgctactggtgttgtgtttggaacctacttggcagtgatgagtgttatctttttctgggcaatgaaggatactgatttcttttctgataaattcggagtgagatcgatcaggcatagtgaagatgaaatgatgtctgctttatacctccaagtgagtattgtaagtcaagcactcatttttgtcacacgatctcgtggctggttctttgtcgaacgtcctggtcttctcttggtttctgctttcttcattgctcaacttgttgcaactgttattgctgtgtatgccgattggggatttgcacggataaagggaattggctggggatgggccggtgttatctggttatacagtgtagtattcttcttccctcttgattggttcaaatttgccattcgatatgttcttagcggaaaagcatgggataatcttctagaaaacaggactgccttcacctccaagaaagattatggtaaagaggaaagagaagctcaatgggctatggcacaaagaacacttcacggacttcaaccacccgaaaccaccaacctatttgccgacaaaaacagttacagggaactatctgagattgctgagcaagccaagaagagagccgaagttgcaaggcttcgtgagctgcacacattgaagggtcatgttgaatcggtggtgaaactgaagggtctggatatcgacaccattcagcagcactacactgtctaggttattattatatgtatagaaagacatcgaatcctcttatctatatacatatacgtatgaacctacagacatttacaaggatgaagaggactgactggcctacattgcatgatagagtaaaggcttttttattatttcataatatagattattagtatgtacgtcagcattttaaaatgcctattgtctccattgtgatatttttctttagtgttgttcttcgtcatgagagagctttggtaaagctgatttttcagtataatgccaggccgaaagatggatattgatcaaataacgcagacttgctctagtttttctctttacgctatctcctttcaattgatgtttcatgtattgcagcatgtttggtgtctgtattttcgagttctctttagat

SEQ ID NO: 2264 - DNA, 3288 bp, Arnica chamissonis
tctgcagatttttctcgttgatttgcgagaaaaatcaaactccattgattagaacttgaaactctacctcattatcatcgcagtcacgttggcgtgacggtgatgcaatagttcccgtaagtttcatcaatccaattgttgttgattatcctctttagcttctcggcgtttttgccgtcgatctcgccgtcgttgccgctgcagttctctcgctaatgaagatgggcggcgataacgctctcagcctcgaaggaatcaaaaaatgagaccgtcgatctggaaaaagtaccaattgaagaggtgtttgaacagttgaaatgtaaccatgaaggtctgagcaccgatgaaggagcccaacggcttgaaattttcggacccaacaaattggaggagaaaaaggaaagcaaattcctcaagtttcttgggtttatgtggaatcccctatcatgggtcatggaggctgcagccattatggcaattgcacttgctaatggtggtgggaagccgccagattggcaagactttgttggtattgtttgcctgcttgttatcaactccaccatcagtttcattgaagaaaacaatgctggaaatgctgctgctgcccttatggcaggtcttgcacctaaaaccaaggttctgagggatggtcgttggagtgaacaagaagcttctatattggttcctggggatattataagtatcaaacttggtgatatcgtacctgctgatgcacggcttcttgaaggtgaccctttaaagattgaccaatctgcccttaccggtgaatcactccctgtcaccaagaacccatatgatgaagtgttctctggttcaacttgcaagcagggtgaaattgaagcagttgttattgctactggagtccataccttttttgggaaggctgcacatcttgtggacagcacaaaccaagttggacattttcagaaggttctaacagcaattggtaacttctgtatttgctcgattgccgttggaatggttgttgagattattgtcatgtacccgattcaacaccgagagtacagaaagggaattgacaacctgttggtgttgcttattggtggaattccaattgctatgcctactgttctttcagttacaatggctattggatcacataggctttcacagcagggtgctatcaccaaaagaatgactgccattgaagaaatggccggaatggatgttctttgcagtgacaaaacaggaactctgacactaaacaaactctcggtcgacaaaaatttgatcgaagtgtttgccaaaggtttggataaggaacaggtgttgctttatgctgccagggcttctagaactgaaaaccaagatgctattgatgcagccattgttggaacccttgctgacccgaaagaggcacgcgctggcatcagagaggtccattttttcccattcaaccctgtggataagaggactgctttgacttacattgatggtagtgggaactggtttagagctagcaaaggtgcacctgaacagattttgaccctttgcgggtgcaaggaagatctcaagaagaaagttcatgcaatgatcgataaattcgccgaacgtgggctgagatctttgggtgttgcaagacaggaagtgcctcaaaaatcaaaagatagcgcgggtggtccatgggaatttgttggattgttgtctctctttgatccaccaaggcatgacagtgcggagactattagaagagctcttaatcttggtgtaaatgtcaagatgattactggtgatcaacttgcaatcgctaaggaaactggtagacggcttggaatgggaacaaacatgtacccttcttcttctttacttggtggacacaaggacgaatcaattgcttcacttcctatagatgagttgatcgagaaagctgatggatttgctggagttttccccgagcacaagtatgagattgtgaagaaattacaagagaggaagcacatttgtgggatgaccggagatggtgtgaatgatgcacctgctttaaagaaggctgatattggaatcgcggttgctgatgctacagatgctgcaagaagtgcttctgacattgtgcttactgagcccgggctcagtgtgatcatcagtgctgtgcttaccagtagagctattttccaaagaatagaaaaattacacaatctatgccgtttctatcaccatccgtattgtgtttggatttatgttcatcgctttgatttggaagttcgacttctctcccttcatggttcttattattgcaattcttaatgatggtactatcatgacaatctcaaaggatagggtgaaaccatctccattaccagatagctggaagctaaaagagatctttgccactggagttgttcttggaggctacttagctttaatgacagttatcttcttctggatcatgaaggataccgactttttcactgatagatttaacgtgaagtctctgaggacaagtgaaactgagatgatggctgctttatatttgcaagtcagcattgtgagccaagccctcatctttgtcactcgctctcgtagctggtcgtttgttgaacgaccaggatttttactaatgggcgctttcctagcagcacaactggtagcaactttagtagcagtatatgccgagtgggaattcgcacgaatcaaaggaatcggttggaaatgggctggtgttatctggctttacagtttagtgttctatttccctcttgatatcatgaagttcgccatccggtacatccttagtggaaaggcttggctcagcatgattgacaacaggactgctttcacaacaaagaaggattatggtagaggagagagagaagcccaatgggctcatgctcagaggactttacatgggcttcaagcacctgatacatcaactctcttcaatgagaagagcagctacagagaattgtctgaaatcgccgaacaggccaaacgacgcgctgaagttgcaaggcttcgggaggtacttacgctcaagggtcacgttgagtcagtggtgaaactgaaggggctcgatattgatacaattcaacagcattatacagtatgaggagcttttgatcaccgggcagttttaacttattacagagtcgaggccaacttcaaaatatgtagttaaaaaccgacgggggagaagtgttgtatgctgcgatgcagcctcgagttctttaaagttgtgttatcttagtaaattcgagagtatatgacgtaaacggttgtgtttggtcccttgttgttaagtaaaagttg

SEQ ID NO: 2265 - DNA, 3454 bp, Gossypium hirsutum
tacttccccctacctcttacctacctaacctaattcttcttttcttttgtccttttggtattcttggtaaattccctaattctaattgttctttcctatttctttttgtaccttcttttctcttaaaattgtttttagtctttctgtttttattttttgttgttgttgttaagctgttactgctggtgattgctgtcagaaacaaaacatgggtgctatcagtcttgaagagatcaagaacgagactgttgatctggaaaaaatcccaatagaggaagtgtttgagcagctgaaatgtagcagagaaggattgagttcggaggagggagccaacaggcttcagatttttggaccaaacaagttagaggagaagaaggaaagtaagattctaaaatttttggggtttatgtggaatccactgtcatgggtgatggaagctgctgcaatcatggccattgctttggctaatggtgatggaaagcccccagattggcaagactttgttggtattgtttgtttgttggtaattaactctaccatcagtttcattgaagaaaacaatgctggcaatgctgccgccgctcttatggctggtcttgcccccaaaaccaaggtgcttagggatggcaaatggagtgaacaagaagcagcgattctggttcctggagacatcattagtattaaattgggagatattatccctgccgatgctcgtcttcttgaaggtgatcccttgaagattgatcaatctgctcttactggtgaatcactccctgtgaccaagaaccccggggatgaagtcttctctggttcgacttgcaaacaaggtgaaatcgaggctgttgttattgctaccggtgttcataccttctttggtaaggctgcacatcttgtggatagcaccaacaacgtaggacatttccaaaaggtgctcactgctattggaaacttctgtatttgttccattgctattggtatgttggttgagatcatagtcatgtaccccatccaacaccgcaaataccgggatggaatcgacaatctcttggttcttttgattggtggtattccaattgctatgcctactgttttgtctgtgaccatggcaattggatctcacaggctgtctcagcaaggtgctattaccaagcgtatgactgccattgaagaaatggctggcatggatgtcctttgtagtgataagacaggaacattgacacttaacaagctgagtgttgatagaaacttgattgaggtgtttgtaaaggatgttgataaggaacatgttgtactgcttgccgcaagggcctctagaactgaaaatcaagatgctattgatgctgccattgttggaatgctcgctgatcctaaggaggcaagagctggtattagagaggtgcacttcttacccttcaatcctgtggacaagagaactgcattgacttacatcgattcaaacggtaactggcaccgagcaagcaaaggtgctcccgaacagatcttgactctttgcaatgcaaaagaagatgttaagaagaaggttcacgctatcatcgacaagttcgcggatcgtggtctgcggtcattaggtgttgcaagacagcaagtaccagaaaaatcaaaagatggtgctggtactccatggcaatttgttggtttattgcctctgtttgatcctccaaggcatgacagtgccgaaaccattcgcagagctcttaaccttggtgttaatgtcaagatgataacaggtgatcaacttgccattgcaaaggaaactggtcgccgactaggaatgggaacaaacatgtatccatctgcttctttgttaggtcaagacaaggatgcaagcatagctgcccttcctgttgaagagttgattgagaaggcagatgggtttgccggcgtctttccagaacacaaatacgaaattgtgaggaaattgcaggagaggaaacatatatgtggaatgactggagatggtgttaatgacgctcctgctttaaagaaagctgatataggtattgctgttgctgatgctacagacgccgcacgaagcgcttcagacattgttcttacagaacctggattgagtgttattatcagtgcagtgttaactagtagagctattttccagaggatgaagaactatactatttatgcagtttccatcacaatccgtatagtgtttggatttatgcttatcgctctcatttggaagttcgacttttcaccgttcatggttttgatcattgccattctaaatgatggaactattatgaccatctcaaaggacagagtaaagccatctcccttgcctgatagctggaaactgaaagaaatttttgccactggtattgtgcttggtggctacttggcattgatgaccgttgttttcttctggattatgcatgatacagacttcttttcggaaaaatttggtgtaaggtctctaaggaagaaggatgaccaaatgatgggtgctttatatttacaagtgagcattgtgagccaggctttaattttcgtcactagatcacgcagctggtcatatttcgagcgtcctggactgctattggtcactgccttcattattgcacagctggctgctactgtgattgctgtatatgctaactggggatttgcaaggattcaaggaataggatggggatgggccggtgtcatatggctttacagtgttgttttctacatcccacttgatctaatgaagttcgccattcgttacatcttaagtggaaaagcttggctcaacttgctagaaaacaagactgcattcaccaccaagaaagactatggaaaagaagagagggaagctcaatgggcacttgctcagaggacattacatggacttcaaccaccagaagcttctaacctcttcaatgacaagagtagctacagagagttgtctgagattgccgagcaggccaagaggcgagctgaggtggcaaggcttcgagagcttcacactctgaaagggcatgtggagtcagtggtgaagctgaagggactggacattgatacaatccaacaacattatacagtttagaaagttgctgctgaatgagaaatgcaggtccaagctagagcaagaagaagtaatgttcaagttttaaaattttctacattagtcacaacatgtgtgttataattttcctgcccttcccatttagttttttactttgcctgtcttatgtaattcaaggccgaaaaaggtgttttagtcgcgtcttgctccaataaggagttaggccatgtaatcttccacttcaatctttattcttagctgcaaatctactttttttcctatgctttcttgaaggtatattatgagaaatagctgcctgccattcagccactatgtcaacgacttgtaattttaagtacaccataaccatatcaagttctggtaatgaagcagtaatctgtgatattaaat

SEQ ID NO: 2266 - DNA, 3495 bp, Gossypium raimondii
aaaacataagagcaaaaaaaaaaaaaaaagaaagaaaaaaacactcttttttgcctattcccattccccccactcttaccaccaaacccaatctctttttcttttgccctttttgggattctggaaatcccaatcaatgttcttccatttcatttgaccttctttcataaaattgttttagcttctgttttttttttttgttgttgttgttaagctgttactgctggtggttgctgtcagaaacaaaacatgggtgctatcagtcttgaagagatcaagaacgagactgttgatctggaaaaaatcccaatagaggaagtgtttgagcagctgaaatgtagcagagaaggattgagttcagaggagggagccaacaggcttcagatttttggaccaaacaagttagaggagaagaaggaaagtaagattctaaaatttttggggtttatgtggaatccactgtcatgggtgatggaagctgctgcaatcatggccattgctttggctaatggtgatggaaagcccccagattggcaagactttgttggtattgtttgtttgttggtaattaactctaccatcagtttcattgaagaaaacaatgctggcaatgctgccgccgctcttatggctggtcttgcccccaaaaccaaggtgcttagggatggcaaatggagtgaacaagaagcagcgattctggttcctggagacatcattagtattaaattgggagatattatccctgccgatgctcgtcttcttgaaggtgatcccttgaagattgatcaatctgctcttactggtgaatcactcccggtgaccaagaaccccggggatgaagtcttctctggttcaacttgcaaacaaggtgaaatcgaggctgttgttattgctaccggtgttcataccttctttggtaaggctgcacatcttgtggatagcaccaacaacgtaggacatttccaaaaggtgctcactgctattggaaacttctgtatttgttccattgctattggtatgttggttgagatcatagtcatgtaccccattcaacaccgcaagtaccgggatggaatcgacaatctcttggttcttttgatcggtggtattccaattgctatgcctactgttttgtctgtgaccatggcaattggatctcacaggctgtctcagcaaggtgctattaccaagcgtatgactgccattgaagaaatggctggcatggatgtcctttgtagtgataagacaggaacattgacacttaacaagctcagtgttgacagaaacttgattgaggtgtttgtaaaggatgttgataaggaacatgttgtactgcttgctgcaagggcctctagaactgaaaatcaagatgctattgatgctgccattgttggaatgcttgctgatcctaaggaggcaagagctggtattagagaggtgcacttcttacccttcaatcctgtggacaagagaactgcattgacttacatcgattcaaacggtaactggcaccgagcaagcaaaggtgctcccgaacagatcttgactctttgcaatgcaaaagaagatgttaagaagaaggttcatgctatcatcgacaagttcgcggatcgtggtctgcggtcattaggtgttgcaagacagctagtaccagaaaaatcaaaagatggtgccggtactccatggcaatttgttggtttattgcctctgtttgatcctcccaggcatgacagtgcagaaaccattcgcagagctcttaaccttggtgttaatgtcaagatgataacaggtgatcaacttgccattgcaaaggaaactggtcgccgactaggaatgggaacaaacatgtatccatctgcttctttgttaggtcaagacaaggatgcaagcatagctgcccttcctgttgaagagttgattgagaaggcagacgggtttgccggcgtctttccagaacacaaatacgaaattgtgaggaaattgcaggagaggaaacatatatgtggaatgactggagatggtgttaatgacgctcctgctttaaagaaagctgatataggtattgctgttgctgatgctacagacgccgcacgaagcgcttcagacattgttcttacagaacctggattgagtgttattatcagtgcagtgttaactagtagagctattttccagaggatgaagaactatactatttatgcagtttccatcacaatccgtatagtgtttggatttatgcttatcgctctcatttggaagttcgacttttcaccgttcatggttttgatcattgccattctaaatgatggaactattatgaccatctcaaaggacagagtaaagccatctcccttgcctgatagctggaaactgaaagaaatttttgccactggtattgtgcttggtggctacttggcattgatgaccgttgttttcttctggattatgcatgatacagacttcttttcggaaaaatttggtgtaaggtctctaaggaagagggatgaccaaatgatgggtgctttatatttacaagtgagcattgtgagccaggctttaattttcgtcactagatcacgtagctggtcatattttgagcgtcctggactgctattggtcactgccttcatcattgcacagctggttgctactgtgattgctgtatatgctaactggggatttgcaaggattcaaggaataggatggggatgggccggtgtcatatggctttacagtgttgttttctacatcccacttgatctaatgaagttcgccattcgttacatcttaagtggaaaagcttggctcaacttgctagaaaacaagactgcattcaccaccaagaaagactacggaaaagaagagagggaagctcaatgggcacttgctcagaggacattacatggacttcaaccaccagaagcttctaacctcttcaatgacaagagtagctacagagagttgtctgagattgccgagcaggccaagaggcgagctgaggtggcaaggcttcgagagcttcacactctgaaagggcatgtggagtcagtggtgaagctgaagggactggacattgatacaatccaacaacattatacagtttagaaagttgctgctgaatgagaaatgcaggtccaagctagagcaagaagaagtaatgttcaagttttaaaattttctacattagtcacaacatgtgtgttataattttcctgcccttcccatttagttttttactttgcctgtcttatgtaattcaaggccgaaaaaggtgttttagtcgcgtcttgctccaataaggagttaggccatgtaatcttccacttcaatctttattcttagctgcaaatctacgttttttcctacgctttctttaaggtatattatgagaaacagctgcctgccattcagccactatgtcaacgacttgtaattttaagtacaccataaccatatcaagttctggtaatgaagcagtaatctgtgatattaaat

SEQ ID NO: 2267 - DNA, 3246 bp, Lupinus angustifolius
aaggcattcagtgtcttcttcttcctatagctaaatctacatcttgtttttgtgtcattcttttttctcctaatctttctttcttcctcttccaaggccttcttctaaggcctatagggagaggtcatcaaaagaaagaacaaaagaaaactttttaacaaaagaaataaaataacgatgacatctgacatttcatttgaagaactcaaaaacgagaatgtggatcttgagaacattcccattgaggaagttttcaagcagctaaaatgtagcagggagggtctaaccacagctgaaggggaaaatagacttcaagtgtttggtcccaacaagcttgaagagaaaacagagagcaaattccttaaatttttgggttttatgtggaatcctttatcatgggttatggaagctgctgctataatggccattgctttggccaatggagggggcaagccaccggattggcaagatttcgttggtattgtggtattgcttatcatcaactcaaccattagtttcattgaggaaaacaatgcaggcaatgccgcagcggcattgatggctggtcttgcaccaaaaaccaaggttttgagggatggaaaatggagtgaggaagaagcagcattgttggtgccaggagatttgatcagcatcaagctaggagatatagtcccagctgatgctcgtctcttggagggtgatcctttaaagattgatcagtctgcccttaccggcgagtctttgccagtcaccaggcaccctggtgatgaggttttctctggttccacttgcaaacaaggtgagatagaggctattgttatcgctactggtgtccacaccttctttggcaaggctgcacatcttgttgatagcaccaacaatgttggtcacttccaaaaggtgttgacatcgattggaaacttttgtatttgctctattgctgtgggaatgttgattgagattgttgtgatgtaccccatccaacaaagagcatatagagatggtattgacaatttattggttcttctaattggaggcatcccaattgcaatgccaacagtcttgtctgtgactatggctattggatctcaccgactctccgagcaaggagccatcaccaagaggatgactgccattgaagaaatggctggcatggatgttctttgcagtgacaagactggaacactcacccttaacaagcttactgtggacaagaacatgattgaggtcttcccaactggcatggacaaagatacccttgtcttgcatgctgccagggcttctaggattgaaaaccaggatgcaattgatgcttcaattgttgggatgttgggcgaccctaaggaggcaagagcaggaatcactgaggtgcatttcttgccctttaatcctgtggaaaagcgcacagctattaccttcattgatggtcaaggcaaatggcacagaagcagcaagggtgctcctgagcagatcattgaactttgtgatctcaagggagaggttttgaaaagggctcatggcatcattgatcagttcgctgagcgcgggcttcgttcattaggtgtcgcacaccagactgtttcagaaaagaccaaggaaagtgcaggagactcgtgggagttcttgggcctcttgcccctatttgaccctccaagacatgatagtgcagagactattcgtcgtgctcttgaccttggagtcaatgttaaaatgatcaccggtgatcaacttgccattggaaaagaaaccggtcgtaggcttggaatgggaaccaacatgtatccttcatccacccttcttggtgacaacaaggatccatcccttgcaacaatcccaattgatgagctcattgagaaggctgatggatttgctggagtcttccctgaacacaagtatgaaattgtcaagagattgcaagataggaagcacattgttggaatgactggagatggtgtgaatgatgcaccagcacttaagaaagcagacattggcattgcagtggatgatgcaactgatgcagcaagaagtgcctcagacattgttttgacagaaccaggacttagtgtgattgtgagtgccgtcttgaccagcagggccatcttccagaggatgaagaactacacaatctatgctgtttctatcactattcgtatcgtgtttgggttcatgcttgtggctttgatatggaagtttgacttctcaccattcatggtcttgatcattgccatcttgaacgatggaaccattatgacgatctccaaagatagggtgaagccttctcctctacccgactcatggaagcttaaggaaatctttgctactggagttgttcttggatcttacatggctatcatcacagtggtcttcttctatttagttcatgacactgacttcttcaccagagtttttggtgtcaagccaattgcagacagtgaagagatgcttaactctgctctctaccttcaagttagtattattagtcaggcacttatctttgtgaccagatcaaggagttggtcttatgttgaacgtcctggcttcttgctaatggcagccttccttgctgcacaattggttgccactgtcattgctgtgtatgcacactgggacttcgccagaatccacggattcggttggagatgggcaggagtaatttggatcttcagcattgtgacatacattcctcttgacattctcaagttcctcattcgcttgggattgtctggcaaggcctgggacaacatgctacaaaacaagactgcattcacaacaaagaaggactacggaaagggacagagggaggctcaatgggcggtcgctcaacgcacactccacggtctccacgttcctgaatcccataagaacatcaattatgaacaatctgacattgccgagcaggctaagaggcgtgccgaggctgctaggctaagagaactccacacactcaagggacatgttgaatctgtggtgaagttgaagggtcttgatattgataccatccaacaacactatacactttaaacaactttaaggaatggaactattcatacttacgtgtattcatgaaaatgggatccagacttaatgagacacaaaatgatatatcttgtgctttctttctcaattttccccaagcatagtggtgtaccaattatgtaatacgattgaatatttgttgtagctggttttttaaataccagtaataaagaacatataaataaaatattttttttagaattatatttt

SEQ ID NO: 2268 - DNA, 3253 bp, Lupinus angustifolius
gtctcatctttgtgttgagatagagatatcaaaacatttgttttcttgggtttcttccttctcttcttttgttctacctacctatattgggaggtagaaacatagagagcctaaaaataaaaggaatataggaagaaccaaatacttcacctctgaaagcttctttattatatcatggcttctgacatctcgtttgaggatctcaaaaacgagaatgttgatcttgaaaacattccaattgaggaggtatttcagcatctaaaatgtagtaaagagggtctatcatctgaagaaggagaaaagaggcttctggtttttggccccaacaagctagaggagataacagagagtaagtttctcaagttcttgggtttcatgtggaatccactttcatgggttatggaagcagctgctatcatggcaattgtgttggccaatggagggggaaagccaccagattggcaagattttactggtattgtggtcttgcttatcatcaattcaaccattagtttcattgaggaaaataatgcaggcaatgctgcagctgctttgatggctggtcttgctcctaaaaccaaggttttgagagatggaaaatggggtgaagaagatgctgcaattttggtaccaggagatttgatcagcatcaagttgggagatattgtcccggccgatgctcgtctcttggagggagatcctttaaagattgaccaatctgccctaactggtgagtccttgccagtcacaaggaatcctggtgatcaggttttctctggatccacctgcaaacaaggtgaaattgaggctattgtcattgccacgggtgtccacaccttcttcggtaaggccgcacaccttgtagacagcaccaacaatgttggtcacttccaaaaggtgttgacatccattggtaacttttgtatatgctcaattgctattggaatgttggttgagattattgtcatgtaccctatccagcaaagatcatatagagatgggattgacaatttgttggtgcttctcattggaggtatcccaattgccatgccaactgtgttatctgtgacaatggctattggatctcaccgcctgtctcaacaaggagccatcaccaagaggatgacagccattgaagaaatggcagggatggatgttctctgcagtgacaagaccggaactcttacccttaacaaacttactgtggacaagagcttgattgaggtgttcacaagtggtgtggacaaggacagccttgtcttatatgctgcaagggcttctaggactgaaaaccaagatgccattgatgcatcaattgtgggaatgttgggagaccccaaggaggcaagagcaggaatcactgaggtgcacttcttgcccttcaatcctgtggataaacgaactgctattactttcattgatagcaatggcaactggcatagaagcagcaaaggtgctcctgagcaaattattgaactttgtggcctcaagggagaggttttgaaaaaggcacacaaaaccattgattcctatgctgaacgcggtcttcgttccttgggtgtttctcgccagactgtttcagagaagaccaaggagagtgcaggagattcatgggagttcttgggtctattgcccctctttgaccctccaaggcatgacagtgctgagactattcgtcgtgctcttgaccttggtgttaatgttaagatgatcaccggtgaccaacttgctattggcaaagaaactggtcgtagacttggaatgggcactaatatgtacccttcatcatccctccttggtaatagcaaggatcctgccattgcatcaatcccagttgatgaactcattgagaaggctgatggatttgcaggagtcttccctgagcacaagtatgaaattgtcaagagattgcaagataagaagcacattgttgggatgaccggagacggtgtgaacgatgcaccagcactcaagaaagcagatattggtattgcagtggacgatgcaactgatgcagccagaagtgcctcagacattgttttgacagaaccaggactgagtgtgattgtgagtgctgtgttgacaagcagggccatcttccagaggatgaagaactacacaatctatgccgtttccatcacaatccgtattgtgcttggattcttgctcgttgctctaatatggaagtttgacttctcaccgttcatggttctgatcattgccatcttgaatgacggaaccatcatgaccatctccaaagatagggtgaagccatctcctcttcctgactcatggaagcttaacgaaatatttgccactggagttgttcttgggacatacatggccatcatgaccgcggtcttcttctatgctgttcacgacactgatttcttctctagaattttcggtgtcaagtcaattgcagatagtgaggagaatcttaactcagctctctaccttcaagtgagtatcattagtcaagcactcatctttgtgactcggtccaggagctggtcatattttgaacgccctggtgcgatgctttgtatagccttccttgctgcacaactggtggccactgtgattgctgtgtatgcacattgggactttgccagaatcaatggagttgggtggagatgggctggagtaatctggatctatagcattgttacatatatccctcttgacatcctcaagttttttattcgcatgggactctcaggtagtgcttggaacagcatgctccaaaacaagactgcattcacaacaaagaaggactatggtaggggagatagggaagctcaatgggcagtggctcaacgcacattgcacggtcttcaagtttctgatgcccacttaaacaaccagcatgagcactctgaaatagctgagcaggctaagaagcgcgctgaagctgctaggttgagggagcttcacacactcaagggacatgttgagtctgtggtgaagttgaagggtcttgacattgaaaccatgcaacaacactacacggtctaaaattattttgttatttcatacatgatgtaaaagaagctaaaatagatcattcaagaagttgtaatcagaggccgagcataaatggaagatgaataatctttacttatatcataatcctctcatctttttttaccatacagtttatgtgaaattgaattaaagtagcctgccataagggtatggtgaatagatttttgagaaaaaatatatgcactgatagtgtaagagttttata

SEQ ID NO: 2269 - DNA, 3261 bp, Medicago truncatula
ctcaaaccttaatctttttttcccaacttcttcctctttctatattatctctacctagctagctgcatttattttcactaaccccatgactcaacacttttctatttaacccaactcacttttctcattcatttctctcatattattcattcatctttcacgtttccttcatccaacatgggaggtatcagcctcgaagagattaaaaatgaaagcgtcgatcttgaacggattccaatagacgaggtgtttgagcagctaaaatgttcaagacaaggtctgacatcagaagaaggagccaacaggcttcaagtctttggaccaaacaaattggaagagaaaaaagagagcaagtttttgaagtttttgggttttatgtggaatcctttatcatgggttatggaagctgctgctatcatggccattgctttggctaatggaagtggaaggccccctgattggcaagactttgtcggaatcattgctttgttagtcatcaattccacaatcagtttcattgaagaaaacaatgccggcaatgccgccgctgctctcatggctggtttagctcccaaaaccaaggtactaagagatagtagatggagtgaacaagatgctgcaattttagtaccaggagacataatcagcatcaagttaggagatattgttccagctgatgcgcgtcttcttgagggagatcctttgagcatagatcagtctgctttaacaggagaatcacttcctgtaacaaagagttcatcggacgaagtgttttcaggttcgacggttaagaagggtgagattgaagcagttgttattgctactggtgtgcatacttttttcggtaaagcggctcatttggttgatagtactaatcaagttggacactttcagaaagtgcttacagcaattggaaacttctgcatttgttcaatcgctattggaatattggttgagcttatagtgatgtatccgatacaacaccgcaagtatagagatggaatcgacaatcttttggtgcttttgattggtggaattccaattgcaatgccaactgttttgtctgtcactatggctattggttctcataggctttcacagcaaggtgcaattacaaaaagaatgacagctattgaggaaatggctggaatggatgttctttgcagtgataaaactggaactctcactctgaataagcttagtgttgatagaaacttgattgaagtgtttgccaagggaattgagaaggaatatgtgatgcttttagcagcaagagcttctaggactgaaaatcaagatgctatagatgctgcaatagttggaatgcttgctgatcctaaagaggcaagagctggtataagggaggtgcattttctaccattcaatcctgtagacaagaggactgctcttacatatatcgattccgatggaaaatggcatcgagcgagcaaaggagctcctgagcagataataaacctgtgcaattgcaaagaagatgtcaggaaaaaagttcatgcagtgattgataagtttgcggagcgtggacttcgatctttaggtgttgcaagacaagaggtacctgagagaacaaaagatagtcctggtggaccatggcaatttgtcggtctgctaccgttgtttgatcctccaaggcatgatagtgctgaaacaattagaagagcacttaaccttggtgtgaatgttaagatgattactggggatcagcttgccattggaaaggaaactggtagaaggcttggaatgggaacaaacatgtatccatcgtctgctttgcttggtcaagacaaagattcttctatttcggctcttccagttgacgagttgatcgagaaggctgatggatttgcaggagtatttccagagcacaaatacgaaatcgtcaagaggctgcaagagaagaagcatatatgtggaatgacaggagatggtgtaaacgatgctcctgcgttaaagaaagccgatatcggaattgcagttgctgatgctacagatgctgctagaagtgcttctgatattgtcctcactgaacccggtcttagtgtcattattagcgctgtgctcaccagccgagcgatttttcaaaggatgaagaattatactatttatgctgtgtcaatcaccatccgtattgtgttcggttttatgtttattgcgttgatctggaagtttgattttgcacccttcatggttttgattattgccattctaaatgatggtaccattatgacaatatcaaaggatagagtgaaaccatctccactacctgatagttggaaactgagggagatatttgctactggtgttgtcctaggaagttacatggcactaatgacagtagtatttttctgggcgatgaaagataccaacttcttttcgaacaagtttggtgtgaggcctataagacataatcctgatgagatgatggcggctttatatctacaagttagtataataagccaagcactaatttttgtaactagatcacgcagttggtctttcgccgaaagacctggtcttctcctacttggtgcttttctcattgctcaactgattgcaacatttatagcagtgtatgctaattggggatttgcaagaataaagggaatgggatggggttgggctggtgtgatttggttgtatagcttggtaacttatatccctcttgatttactcaaattcgcaatccgctattttctaagcgggaaggcttgggataatcttttggaaaataagactgccttcactacaaagaaagactatggaaaagaagagagggaagcacaatgggcggctgcgcagagaacacttcacggtcttcagcctccggaagcctccaacgttttcaatgaaaagaatagctatagagaactttcggagattgcggagcaagccaagagacgtgctgaagttgcaaggcttagggaggttcatactctcaagggacatgtagaatcagtggtgaagctgaagggactagatattgatacaattcagcagcactacacagtttaagaagcttcaacaattttcaagaaagactcgaagatcttagtcaatctatctttaaaaaaaaggtgtcttgtaaaaatttggatggataatccttttactatctatgctaggaggagatactattctcaagtatcaaataacatcactgatatagttttttttttttaacattagcattgttaatgccacacttaaagctcaatacattggtattgatactgttgctct

SEQ ID NO: 2270 - DNA, 3082 bp, Populus trichocarpa
gttttgatcttcttgttcggtttcatctttcatcatgggcgacgtttctttggaacagataaagaatgagaatattgatcttgagagaattcctgttgaggaggtatttcagcagctaagatgtacaaaagaaggattgagcaccgcacaaggtgaggagaggcttaagatctttggcccaaacaagcttgaggagaaaagagagagcaaattcctcaagtttttgggtttcatgtggaacccattatcatgggtcatggaagcagctgccataatggccattgctttggctaatggaggaggcaagcctccggactggcaggattttgttggtatcgttgtattgcttatcatcaactccaccatcagcttcatcgaggaaaacaatgcaggcaacgcagctgccgctttgatggctggtcttgcccccaaaacaaaggttttgagggatggaaaatggatggaggaagatgcatcaattctggtaccaggagatatgatcagcatcaagttgggagatatcgtcccagctgatgctcgtctcatgaaaggagatccgctcaagattgatcagtctgctctgactggtgaatcccttccagttacaaagcatcccggcgaaggggttttctctggctcaacctgcaagcaaggtgagattgaggctgttgttattgctactggtgttcacaccttcttcggcaaggcagctcaccttgttgacagcaccaataacgttggccatttccaaaaggtgttgacagctattggtaacttctgtatctgctcaatcgctatcggtatgctggttgagattatagtgatgtacccaatccagaacaggaggtacagagagggtattgataacctcttggtgcttctcattggaggtatcccaattgctatgcctacagtcttgtcagtgacaatggctattgggtctcaccgtctatcacagcaaggtgccatcaccaagagaatgaccgctattgaagaaatggctggaatggatgtcttatgtagtgacaagaccggaactctaaccctcaacaagcttaccgtggacaagagccttattgaggtgtttataaaggatatggacaaggatacccttctattacttgctgctagggcttccagaattgagaatcaggatgccattgatgcttcaattgttgggatgttgggcgaccccaaggaggcaagagcagaaatcaccgaggtgcatttcttacccttcaaccctgtggaaaagcgcactgcaatcacttactatgacaacaacggtgactggcacagaagcagcaagggagctcctgagcagattatcgaactctgcaacgtaaaaggggagacgaagaaaaaggcccatgaaatcattgacaactttgccgagcgtggccttcgttccctaggagttgctcgccagagaattccagagaagaccaaggaaagtgaaggagcaccgtgggagtttgtgggtctcttgcctcttttcgaccctccaaggcatgatagtgctgagactatccgtcgagcccttgaccttggtgtcaatgttaagatgatcactggtgaccaacttgctattggcaaagagactggccgcaggcttgggatgggcacaaacatgtatccttcatcatctctccttggtaatagcaaggatgagagcatttctggcattccagttgatgagctcatcgagaaagctgatggatttgctggagtcttccctgaacacaagtatgagattgtgaagaagctacaagagaggaagcatatctgtggtatgacaggagatggtgttaacgatgccccggcattgaagaaggcagacattggaattgctgtggcagacgcaactgatgctgccaggagtgcttcggatattgtcttgacagaaccaggattgagtgttattattagcgctgtattgacaagcagagccatctttcagaggatgaagaactacacaatctatgctgtttccatcacaattcgtatcgtgctgggattcttgcttgttgcacttatttggaagttcgacttctcgccattcatggttctgatcattgctattctcaatgacggaaccatcatgaccatctccaaagatagagtcaagccatctcctgtgcccgactcatggaagctcaaggaaattttcgccacaggtgttgtccttggaacttacatggcaatcatgactgtgctgttcttctggcttgctcatgacactgattttttccccgagaagtttggtgtgaggacaatcagaggtaaaccagatgagcttacagcagctctttaccttcaagtgagcatcatcagtcaagcactcatctttgtaaccaggtcaaggagctggtcctttgttgaatgccctggtctcttgcttgtcagtgctttcattgcagcacagttggtggcaactctcattgctgtgtatgcaagctggtcctttgcaagaatcgaaggcattggttggggatgggcaggaatcatctggctttttagcattatcacctacatccctcttgatatcataaagttcattatccgctatgcattgactgggaaggcctgggataatatgctacaaaacaagactgctttcacaaacaagaaggactatggaaagggtgagagggaggctcaatgggctactgctcaacgtactcttcacggtcttcaacctccagaaaccatgttcaatgacaagaccacctacagagagttgagtgagcttgcagagcaggctaagaagcgtgccgaagtagcaaggctcagagagcttcacacgttgaagggacatgttgactcagtggttaagatgaagggacttgacattgagaccatccaacaacactacacagtctaaggaaataaaagagatgtagaaagaagcacatgcaagaggggatcttcataagggagatttgctgtagctcctttggagaatggaagaattctagtgggaaatttgaaagcagtgaagaactcaaggggctacatatataatatatacaatatctgtttgttcttagtttccttcccttcacaagttttggttagccac

SEQ ID NO: 2271 - DNA, 3522 bp, Fragaria vesca
tctctccctcattcttcagtgctcctctctctcgccgaaaacccggacccgaattctaacccgattcggcttctctctctccacctagacgtcgttctcttctcccaccatgactctcgctagggtttcctcactataaattcctccttcgcttcctctcttttctttcgtcaaaaccaaaaaccacagtctcgtttcggctttggagctcctctgagctcagcgctccacctactccgcaaccatgagcggcggcaccaaggccatcagcctcgaggagatcaagaacgagtccgtcgatctggaacggattccaattgaggaagtctttgagcagttgaaatgtacaagggaaggtcttacctcggacgagggtcagaacaggctccaagtttttggtccaaacaagttagaggagaagaaggaaagcaaattactgaagtttttggggttcatgtggaatcccttgtcatgggttatggaagctgctgccttgatggctattgtgttggcaaatggtgatggaaagcctccagattggcaggattttctcggaattacggtcctgctgatcgttaactctaccatcagctttattgaagaaaacaatgctggtaatgcggctgctgcacttatggctggtcttgctcctaaaactaaggtcctcagagacggtcgatggactgagcaagatgcttcaattttggttccaggagacataatcagcattaagttgggagatatagtgcctgctgatgctcgccttcttgagggtgatcctctcaagattgaccagtctgccctaactggcgagtcccttgctgttactaagaatcctggagatgaagtgttttccggctcaacatgtaaacagggtgaaattgaagcagtggtcattgcaactggtgtgcacaccttctttggtaaagctgcacatcttgtggacagcaccaacaatgttgggcatttccagaaagttctcacagcaattgggaacttctgcatttgttcaattgctgttggaatagctattgagattgttgtgatgtacccaattcagcatcgcaagtacagggatgggattgataatttgctggttcttttgattggaggaatccccattgctatgcctactgtcttatccgtcacgatggctataggttcacacaggctttctcagcaaggtgctattaccaagagaatgactgccattgaggaaatggctggtatggatgtcctgtgcagtgataagactgggaccttgaccctgaacaagctgacagttgatagaaatctgatcgaagtatttcccaagggtgtggagaaagaacatgtcatccttcttgcggcaagggcttctaggactgaaaatcaggatgctattgatgctgccatagtaaatatgcttgctgatccaaaagaggcgcgtgctggtgtcagagaaattcatttccttccattcaaccctgttgacaagaggactgctttgacctacattgattccgatgggaattggcatcgagctagcaaaggtgcccctgagcagatattggagctatgcaactgcaaggaagatttcaagagaaaggttcatgccgtgattgataaattcgctgaacgtgggcttcgatctcttggtgttgcaagacagcaaatacctgagaaaacaaaagagagtccaggagcaccatggcagtttgttggtttgttgccgttatttgatcctcccaggcatgacagtgcagaaactattcgcagagctctcaatcttggtgtgaatgtgaagatgatcactggggatcagcttgccattggcaaggaaactggacgacggcttggtatgggaacaaacatgtatccatcttctgcattgctcggccaagacaaggatgcagccatttcttccctccccattgatgaattgattgagaaggctgacggatttgccggagtatttccagagcacaaatatgaaattgtaaggaggctacaagagaggaagcacatctgtgggatgacaggagatggtgtcaatgatgctcctgctttgaaaaaagcagacattggaattgctgtagctgatgctactgatgctgctagaggtgcttcagatattgttctgactgaacctggattgagtgtcatcataagcgcagtacttacaagcagagccatattccaaagaatgaagaactatactatctacgccgtttcaatcaccatacgtatagtgtttggctttatgttcatcgctttgatatggaagtttgacttttctccgttcatggtattgatcattgccatactaaatgatggaacgatcatgacaatatccaaggaccgagtgaaaccatctccagtgccagacagctggaaactgaaagaaatttttgctactggcattgttcttggcggttacatggcccttatgacagtagtgttcttttggttgatgcaagatacagacttcttttcggaaaagtttcaagtacgttctttgaggaataaccctagtgaaatgatggcagcattatacttgcaagtcagtattattagccaagcccttatctttgtcacaaggtcccgcagcttttcctttttggaacgccctggacttctcttgcttggagctttcatcgttgctcagttggtggctactctgatagctgtctatgccaactgggaatttgcacggatacatggatgtggctggggttgggctggtgtagtctggcttttcagtgtggtgacatactttcctcttgatcttttaaaatttgcaatccgctacatccttagtggaaaagcttgggataatcttttggagaacaagaccgcgtttactacaaagaaagactatggaaaagaggagagggaagcacagtgggctaccgcacagaggactctacatggtcttcaaccaccggaaagctccaatatcttcagtgacaagagcagttaccgggaactgtcagagattgcagaacaagccaagagaagggctgaggttgcaaggcttagggagttgaacacactaaagggccatgttgagtctgttgtgaagctgaaagggctggacatagataatatccaacaacattatacagtttgaggagaggagctttctgtagggaacaaagaggccaggagcttccatgatgatgatgatgaatcaagactttagtaaccttgtgtttagattagagctaaagtaataaccaaatgagagctaaactagtgtactagtttacgtttttatggttacttatttagcaggccaaataacaacataaattacagttttcgtttttgctcatcggttatctttcatgtcagttcttgatgctttgcattattattgtacatatgcaagggtttcacattctgggatcttaatgaaatcggatgggaggattcttctgtcacccttctggatttcattagaaatatttgtagttctctaacttccaattaggaagtacccgattttccgagctcttttcaagattgacatcatatgat

SEQ ID NO: 2272 - DNA, 1479 bp, Sorghum bicolor
gtactcctctctactcgccttcttcggttcttcctccccgagcagccacttccgtctctaaccctactgcgacgacgagagcgaggccatgagggggaaaaagccgctcaaggacctcaagctctccgtgccggcgcaggagacccccgtcgacaagttcctgacggcaagtggtacgttcaaggatggtgagctgcggctcaatcaaagtggcttgcggcttatctccgaggaaaatgggggtgaagatgaatcaacaaagctgaaggtggaagatgtgcagttatcaatggatgatcttgagatgattcaagtcattggcaaaggaagtggtggcgttgtccagctagtgaggcacaaatgggtggggacattgtatgccttaaagggtatacaaatgaacattcaggagtcagttcgtaaacaaatagtacaggagctcaaaataaaccaagcaacacagagccctcatatagttatgtgccatcaatctttttaccacaatggtgtaatatatcttgttcttgagtacatggaccgtggatcgcttgcagacattgttaagcaagtgaagactgttctggagccataccttgcggtactttgtaagcaggtcttggagggtttattgtatcttcatcatgaaaggcacgtgattcacagggacataaaaccatctaacttgttggtcaaccgtaaaggtgaagttaagattactgacttcggcgtgagtgctgttctagcaagctcaataggacagcgagatacatttgttggaacctacaactatatggcgcctgagcggattagtggtagttcttatgactacaaaagtgacatatggagtttgggcttagttatacttgagtgtgccattggccggttcccttatataccttcagaaggtgaaggttggttaagcttttatgaactactggaggctattgtggatcagccaccaccttctgcacctgcagatcagttctctccagaattctgctcatttatctcctcttgcatacaaaaagatccggctcagcggatgtctgcttcagaactcttgaaccacccttttttgaagaagtttgaggataaggatctagacctgcggattctcgtcgaggacctggaacctccaatgaatatacccgaatagcctgccgtgttgggtgatgaagcctttgttgtgccttcagggtttgacatcgatgcatctagcttggcatctgctcctgaactgcagcctccctacatgaacatgccataacatcgatcattgtatgatccaagacccttgtggctagctgagcataagagcagagggaatcatgctgcattccgtatggtcaccttattgtagctattgttgcgttggccttgtgattgcgagtcttgttttaactttttgcagtcttattattggcagacgattcaaaagggacgaactgaatattcaaaacatgcttgccaacatgattc

SEQ ID NO: 2273 - DNA, 1495 bp, Echinochloa colona
cccggtctactcgccttcttcggttcttccttcctccccgagcacgagcagccagtcccgtctctaaccctactgcgccgacgacgaggaggccatgagggggaagaagccgctcaaggagctcaagctctccgtcccggcgcaggagacccccgtcgacaagttcctgacggcgagcggtaccttcaaggatggtgagctgcggcttaatcaaagcggcttgcggcttatctccgaggaaaatggggatgaagatgaatcaacaaagctgaaagtagaagatgtgcagttatcaatggatgaccttgagatgattcaagtcattggtaaaggaagtggtggtgttgtccagctagtgaggcacaaatgggtggggacattgtatgccttaaagggtattcaaatgaacattcaagagtcagttcgcaaacaaatagtgcaagagctcaaaataaaccaggcaacccagagccctcatatagttctttgccatcaatcattttaccacaatggtgtaatatatcttgttcttgagtacatggatcgtggatctcttgcggacatcattaagcaagtgaagacaattctggagccataccttgcagtactttgtaagcaggtcttggagggtttattatatcttcatcatgaaaggcatgtgatccacagggatataaagccttctaacttgttagtcaaccgcaaaggggaagtcaagattactgactttggggtaagtgccgtgctagcaagctcaatgggtcagcgagatacatttgttggaacctacaactatatggcgcctgagcggattagtggaagctcatatgactacaaaagtgacatatggagtttgggcttagtaatacttgagtgcgccattgggcggttcccctatataccttcagaaggagaaggttggttgagcttttatgaactactggaggctattgttgatcagccaccaccttctgcacctgcagatcagttctctccagaattctgctcatttatctcctcttgcatacaaaaggatccggctcagcggatgtctgcttcagaactcttggatcatcctttcttgaagaagtttgaggataaggatttagacctgcggattcttgtggagagcctggaacctccaatgaatatacccgaatagccctgttgtcagccttcaggggggataagtaggcctttgttgtgctttcagggtcgcatcaggcatcagcacatattctcctgaactgcagcctctacatgaacatgccagaacatcatcgtatgatccaagtcccttttggctagttgagcataagtatagagggaatcatgctgcattccttctggtcgccttattgtagctatttgcgacgggccatgtgattgtgaagttgtgttttaccttcgtgttataattaagggacataaattgaatattttgaacatgctttgccaatgtgcagcgaaaaggatagcaccgcctctcacagca

SEQ ID NO: 2274 - DNA, 1548 bp, Setaria italica
acattcccccggtctactcgccttcttcgtttcttcctccccgagcacgagcagccagccagtcccgtcccaaaccctacagcgccgacgacgacgaggccatgaaggggaagaagccgctcaaggagctcaagctctccgtgccggcgcaggagatccccgtcgacaagttcctgacggcgagtggtacattcaaggatggcgaactgcgccttaatcagagcggcttgcggcttacctccgaggaaaatggggatgaagatgaatcaacaaagctgaaagtggaagatgtgcaattatcaatggatgatcttgagatgattcaagtcattggtaaaggaagtggtggtgttgtccagctagtgaggcacaaatgggtggggacattgtatgccttaaagggtattcaaatgaacattcaggagtcagttcgcaaacaaatagtacaagagctcaaaataaaccaggcaacacagagccctcatatagttttgtgccatcaatctttttaccacaatggtgtaatatatcttgttcttgagtacatggatcgtggatcacttgcagacatcattaagcaagtgaagacagttctggagccataccttgcggtactttgtaagcaggtattggagggtttattatatcttcatcatgaaaggcacgtgattcacagggacataaagccttctaacttgttagtcaaccgtaaaggggaagtcaagattactgacttcggggtaagtgccgtgctagcaagctcagtgggtcagcgagatacttttgttggaacctacaactatatggcgcctgaacgcattagtgggagctcgtatgactacaagagtgacatatggagtttgggcttagtaatacttgagtgtgcaattgggcgattcccctatataccttcagaaggagaaggttggtcaagcttttatgaactactggaggctattgtcgatcagccaccaccttctgcacctgcagatcagttctctccagaattctgctcatttatctcctcttgcatacaaaaggatccagctcagcggatgtctgctgcagaactcttgaatcaccctttcctgaagaagttcgaggataaggatttagacctacggatacttgtggagagcctcgaacctccaatgaatatacccgagtaatcatgtcgtcagccttcaggggtattgagtctttgttgtttcagggtcgaggcggctcttggcatcaggcatctggcatcagcacatattctcctgaactgcaacctccacatgaacgtgccagaacatcattgtatggtcaagtcccttttgactgtttgagcataagaatagagggaatcatgcagcattccttctggtcgccttattgtagctattgttgcgacgggccttgtgattgtgaagctgtgttttacctttttcttattagcaagggatgaatcaaactgaatattcaaaacatgcttgccagtgttctgcgaggaggatacagacgttttgaggtcaaatatgacgcatttcgagtaatcttaaacgt

SEQ ID NO: 2275 - DNA, 1580 bp, Setaria italica
ggcttttcctcctcacattcccccggtctactcgccttcttcgtttcttcctccccgagcacgagcagccagccagtcccgtcccaaaccctacagcgccgacgacgacgaggccatgaaggggaagaagccgctcaaggagctcaagctctccgtgccggcgcaggagatccccgtcgacaagttcctgacggcgagtggtacattcaaggatggcgaactgcgccttaatcagagcggcttgcggcttacctccgaggaaaatggggatgaagatgaatcaacaaagctgaaagtggaagatgtgcaattatcaatggatgatcttgagatgattcaagtcattggtaaaggaagtggtggtgttgtccagctagtgaggcacaaatgggtggggacattgtatgccttaaagggtattcaaatgaacattcaggagtcagttcgcaaacaaatagtacaagagctcaaaataaaccaggcaacacagagccctcatatagttttgtgccatcaatctttttaccacaatggtgtaatatatcttgttcttgagtacatggatcgtggatcacttgcagacatcattaagcaagtgaagacagttctggagccataccttgcggtactttgtaagcaggtattggagggtttattatatcttcatcatgaaaggcacgtgattcacagggacataaagccttctaacttgttagtcaaccgtaaaggggaagtcaagattactgacttcggggtaagtgccgtgctagcaagctcagtgggtcagcgagatacttttgttggaacctacaactatatggcgcctgaacgcattagtgggagctcgtatgactacaagagtgacatatggagtttgggcttagtaatacttgagtgtgcaattgggcgattcccctatataccttcagaaggagaaggttggtcaagcttttatgaactactggaggctattgtcgatcagccaccaccttctgcacctgcagatcagttctctccagaattctgctcatttatctcctcttgcatacaaaaggatccagctcagcggatgtctgctgcagaactcttgaatcaccctttcctgaagaagttcgaggataaggatttagacctacggatacttgtggagagcctcgaacctccaatgaatatacccgagtaatcatgtcgtcagccttcaggggtattgagtctttgttgtttcagggtcgaggcggctcttggcatcaggcatctggcatcagcacatattctcctgaactgcaacctccacatgaacgtgccagaacatcattgtatggtcaagtcccttttgactgtttgagcataagaatagagggaatcatgcagcattccttctggtcgccttattgtagctattgttgcgacgggccttgtgattgtgaagctgtgttttacctttttcttattagcaagggatgaatcaaactgaatattcaaaacatgcttgccagtgttctgcgaggaggatacagacgttttgaggtcaaatatgacgcatttcgagtaatcttaaacgtcaatttcgacttctgaga

SEQ ID NO: 2276 - DNA, 1755 bp, Panicum virgatum
tgcatactcactgtcccgaaaagacaggctttatttccctggtctactcgccttcttcggttcttcctccccgagcacgagcagccagtccggtgactccggtcccgtctctaaccctacagcgccgacgacgacgaggccatgagggggaagaagccgctcaaggatctcaagctctccgtgccggtgcaggagagccccgtcgacaagttcctgacggcgagtggcacattcaaggatggcgaactgcggcttaatcaaagcggcttgcggcttatctccgaggaaaatggggatgaagatgaatcaacaaagctgaaagtggaagatgtgcagttatcaatggatgatcttgagatgattcaagtcattggtaaaggaagtggtggtgttgtccagctagtgaggcacaaatgggtgggtacattgtatgccttaaagggtattcaaatgaacattcaggagtcagttcgcaaacaaatagtacaagagctcaaaataaaccaggcaacacaaagccctcatatagttctgtgccatcaatctttttaccacaatggtgtaatatatcttgttcttgagtacatggatcgtggatctcttgcagacatcattaagcaagtgaagacagttctggaaccataccttgcggtactctgtaagcaggtcttggagggtttattatatcttcatcatgaaaggcacgtgattcacagggacataaagccttctaacttgttagtcaaccgtaaaggggaagtcaagattactgactttggggtaagtgcggtgctagcaagctcaatgggtcagcgagatacatttgttggaacctacaactatatggcgcctgaacgtattagcggaagctcatatgactacaagagtgacatatggagtttgggcttagtaatacttgagtgtgccattgggcggttcccctatataccttcagaaggagaaggttggttaagcttttatgaactacttgaggctattgtcgatcagccaccaccttctgcacctgcagatcagttctctccagaattctgctcatttatctcctcctgcatacaaaaggatccagctcagcggatgtctgcttcggaactcttgaaccaccctttcttgaagaagttcgaggataaggatctagacctgcggggtcttgtggagaccctggaacctccaatgaatatacccgagtaaccctgtcgtcaaccttcagtgtgggtatgcgtgggcttttgttgtgttttcagggtcgtcctggcggacggccctcggcatcaggcatcagcgcatattctcctgaactgcaaccgccacatgaacatgccagaacaccatcgtgtggtccaagtccacaggaatagagggaatcgtgcttcgttccttcttgtcgcctttattgtagctattgttgcgacgtgcgacgggccctgttattgtgaagtcgtgtgttaccttttttttttggtcttgtgagtaagggatgaattgaaatattcacatcatgcttgccaatatgctgcgaagactgccccgccttttaccgaaatttgacctcaaacttcatttatgggtgtactctgtaggtttgaatagagtaaacttaggctgcaaatttcaacattacaattttgatttccgacataaatgggaaactgggaattcagcttgagttacaaatgcgctgacctctggactaaaaacatcaagcaacagagatccacataacggaacacattcaaa

SEQ ID NO: 2277 - DNA, 6518 bp, Setaria italica
ggcgtactgcaggtctgaggcgcaccggcaagagctgccgtctccggtgggtcaactacctccacccgggcctccgccgcggccgcatcaccgccgacgaggagcgcctcatcctcgagctccacgcgcagtacggcagcaggtggtcgcgcatcgccaggagcctccccggccgcaccgacaacgagatcaagaactactggaggacgcgcaccaggaagcagaaggcagcgaagacggcggcgtcggcggcatcggtgtcctcgtcgtcgaccgtgaccaccaccaccgcgtcctgctccggctctccgagcagcggctgcggcacggccgcgtcgtcgtcggcggtcaccggttcagcgctgcgagagagcggcggcggcggcggcgcagaggacgacgccgagctcgacgaggcgtccaccaccgcggcaagccagcatcaccaccaccagcagcagcagcagcaggaagcgtcgtcctacaccatggaccagttctggaacgagatcgcggcagccgaggcggcggcgagctacatggtcgacggctgggtaggagcgtgtcaccccgccgccgccgagccgccggtgatgccgtcgtcgccggtgtgggaatactgctcggattactcgctctggaggatcgacgacgaagagtactacaagaagatgctcgacgcctcttgatgagccatcagccatgcttatatatcagatcatccaccatgcatcttcttctgccttatattaatcaatcagttagctttatttttctgtctactagctacgatttcaaaaggctaggttcgtctttcgttgcatctgtttcgtacgttctatgtatactacagtacatatatatttgcatctgtgtatactgtaattatacctgtaacaccttgcttgacgcatgcatgctatgtacgtcgtcatcaggtcaggacatgtagttcagtagttcaccatcttatgttgaatcagataattcagatcagaacacacctgtagggatctgctgccttttgtgttcatgcatgtaagagtgtgatgatgggattgtacttatgagtactcctatatgagagcagttacattaatcagtaagtgctgtctgaacagctgtgttgtcctgaatcttgatgatgatcttggtgctcttttcgtgcaaccacagtacttccttcattacttgtgtattgtatagtatgtaaataagaactcaatgagacaaaaaaaaagtagcaagcatgatgttgcaatgatcaaaattaagtgacaatatagacaaagcagagctaatatagacagatacagaccctagctaaaagaattaaattaaattgttccctgaaatcttatgctacgaatcagcctaaacgagaggaggcagttgaagggcactgttctgcaattctccttcagtaccactagatcttggagttggtacaccatgaatataaggaagctaaaggcactcaagcgcggcacgcaagtaatgcagaatctgcatctcgaaaatttttacacaatcatatattcatattccattccaagataccagtccaactaactgacggacggagtacatgcatgggaatgggaatctagctctcgctaacccccatgccatggaaatggaatgacgggagggacaagggacagcggcatccaatcggggaatgccatgcgcgccatttgtacgtgcagtgcaggtccctgtccgacttttctgtgcgccatatccacctttcctcccctccaattgtagaagcagctgagccccatcccaaacagtgacatttgacatcaagcgagagcgattagtgagtgatttagaccacctgtgggatcacaaaggcattatctatcgcaaaatgctacaccaacaggcaaagtgtcccattgaatagagccttgattcccatggattgcggccttcgtcgatggagcccacatgtcagtgacacatatagagttggagctaatgaagaaggcactgtatctttgcaagatggagatcgtaacagcggcggaaagctagtgataggatggcaggtcgttgcccacatgtacttcttgtttcttcctttccaaattgctgcggtcctaactcctgatcctcattaacctagcattatcgttgcgctttctttcacaccctctagctagtccattgttcatcacaattatctttttggaatctaccactcatgaattagtaacgatcacaaaaccaaagatctataattaggatgtcttacatcaccccgtacaaattataaaaagggtcaaattttgtttatgcgatcaaagccattggcgtagatattagcactcaaagaaaacattgtttatagttccgaattattctatatatacatcatctttatcattttcatgttgttaacttgtaactcaactagagatagctcttgtctattacaatctaagccactcgatatgatattggtgttgtcgacaatcttgacaccacaactctctagtgaggggctgaggacatgtgactccattcgcagaagtctagtatatttctctaaactggagccactctagaatgttgtagaagggaaggtatcctagagtaaataaaatggaactcgagcaatgctcgtggatgttggatttaaatgggcttgatccaaattaattcaattaatctatttaatattacaagacccatattaatgctagggaattaaagtaggtaatcccacattggttattgaggaggatactaaccaacttattagatggatttcgtgtctctaaagttggaaaaggagaatggggagtcacacgcgcgtgctcgctcctcttgctaaaacttgcttaattttgaaattaaaatataccaaaactttaaatttctaacagtgtgtggtgcaagggcgatggtggtagggcttgttgttgaattgtggtttggtaattttccatgcgccgatctgctccttgttaattggatacttggattttgaggataatgaaatttgagtcttttgtttgtttattaaacagtctatctcctcaattttcttatagttattttataatctagctaatgagtgaagcataagttcatttctctagtattagtcaacctagcatatttcttcctttagaaaggaaacaagaacttaaagaaagacagccatttactttttgatattctctctttctaataatcaatctgctgaagctattcgcgagggccttagcatttaaagtggatgatagggagatctgagatgacaaatgaaggtgagacagcaactccataccaccagattcatcgatgaacttcgcaaatgaatcacaaactaattaagcagaaagataaatgtctaccatgccaggaaaagctagctaacgaaatggtataatctaaaatggtacgagctttgggtggtatttggatgaaataaagtggattgtttcggtggtgaaaagcctaaagtgagtggatttgccagagagaaaaacacacacagagtctagtgtacacatcagtaacagtgaccgtcggatggaaatcagatgacggatgttgccctagacattaaaaaaataaaaaaaaatctcgacaccaacctctcctctgactccgagtctcgagcccgtcaccgccgccgccgctccaacccgatcccgccgccccacctgccgcctcatctccccgcaggcgtcggctccgctcctggtactcccgaagcaacaagaactagcttctgtctccttgatcctcccggagccgcgagtcctatccccatcttccactaagaaaccctaactctccctgccaaggggcgaggaggccatgagggggaagaagccggtaatggagctgaagctcgcggtgccggcgcaggagacccccgtcgacaaattcctgacggcgagtggtacattcaaggatggtgaactacggcttaatcaaagaggcttgcggcttatctccgaggaaaatggagatgaaaatcaatcgacaaacctgaaggtggaagatgtacagttatcaatggatgatcttgagatgattcaagtcattggtaaagggagtggtggtgttgtccagctagtgcggcacaaatgggtggggacattgtatgccttgaagggtattcaaatgaacattcaggagtcagtgcgcaaacaaatcgtacaagagctcaagattaatcaagcaacacagagtccacatatagttatgtgccatcaatctttttaccacaatggtgtgatatatcttgttcttgagtacatggatcgcggatctcttgcggacatcattaagcaagtgaagactgttctggagccataccttgcagtactttgcaagcaggtattggagggtttgttgtatcttcatcatgaaaggcatgtgattcacagggacataaagccgtctaacttgttagtcaaccgtaaaggtgaagtaaagattactgatttcggggtcagtgcagtgctagcaagttcaatgggtcagcgggatacatttgttggaacctacaactatatggcacctgagaggattagtggaagctcttacgactacaagagcgacatatggagtttgggactggtgatacttgagtgtgccattggccggttcccctatataccttcagaaggagaaggttggataagcttctatgaacttcttgaagcaattgttgatcagccaccaccttctgcacctgcagatcagttctctccagaattctgctcatttatctcctcttgcatacagaaggatccagcagagaggatgtctgcttcagaactcttgaatcaccctttcatcaagaagtttgagggtaaggatttggacctgcggactcttgtggagagcctggagcctccgatgaacatacccgagtagactgccattaagatggatcgacgatccttttgcaatgtattcaggatcaccgtggtggcctcttgatatccgcacatatttctcctgaaccgcgtgcatcatgtccctaatcgtgggatgctgtgtgtatgttcttgattgctgcagaaaaatgtcccatggatcattttgacacccaagctccttttattgtgttccttaatagaatgtttcttgtagcagagtatctcttgaaaaggctctccatctagttcctgatgcattagactggtttcactgtgaatgtttcttgtgacaaatttgatttttcattgtaagttgcatgagtctacgcatcaaatggagggagaaaatgtgatgggagttgaaacaagacagaaaatgcaggatatatctgggcattctaagcatgacgcgagcatgcatgatttgcatctttaatttcgcgttgatccccaataattagaagagaacagattccctcattattttatttcaaaaggatgcaaggatatgcttacgaattgcaacatgctgattaacaagcatagcctgtttcaaccgccatcactcatatcagtgaatatgcttaatgataaggtagccatcgtccatcagtgtaatcgtctagaagcaaagctttcaagaatcacatcgacgactaatggtaagatgaagctagccattatgaggtgactcattaggctaatcccaatgaaattcccaatgaggatttcattttgatgtttccaagatagccacataagcaacaagaaaatgaaatagtatttgaaactgcatttcccaatacaaaatttcatggtgtggtttcatagactcctaataacatttagtttcatgaatcatagagagctggtttctgtgtataggtggtttcatctagatgaaactggtatcatctctctcttcttaaattaaataccatgtcatcaaaaaatcctatgtggcatgctaattaatggtaataaaactctatgaaacttcccattggaagtagccttagtagttaagcaattaagattggcttccgtctgatattttcttgtctgatcttctcactaaattccgtggacttcattacggagtagctctttttcttgttcctgagcaccaaataaggatatgactctcgccagctgtttatacccactccagtataaaaaaaaagatacaagtgaagttctagattagttttgtcagcttacatttaaattttgaccgaacttttaaaggtggtatggctaagcctgttttcaaaatcaaaagtagtttaaaaatatcatttagtcatattttgtacacattttacactagtcataattggtcaaagcagttgcttgtattgtatcactgatcaaaattaaacgacacttgtttgtaaatgtaggtattaggcaagatatgcagctagcttctatcatgcgggcggcactgatccagccgctgagctcaccacgcaccattcggcactcacctgcctgctcgatccatctctaatctgttagccatatccaccattaattatattctgctcatgctttctctctctctctctaatctctctccctctaacctcatgtgaacctgat

SEQ ID NO: 2278 - DNA, 1638 bp, Setaria italica
ctctgactccgagtctcgagcccgtcaccgccgccgccgctccaacccgatcccgccgccccacctgccgcctcatctccccgcaggcgtcggctccgctcctggtactcccgaagcaacaagaactagcttctgtctccttgatcctcccggagccgcgagtcctatccccatcttccactaagaaaccctaactctccctgccaaggggcgaggaggccatgagggggaagaagccggtaatggagctgaagctcgcggtgccggcgcaggagacccccgtcgacaaattcctgacggcgagtggtacattcaaggatggtgaactacggcttaatcaaagaggcttgcggcttatctccgaggaaaatggagatgaaaatcaatcgacaaacctgaaggtggaagatgtacagttatcaatggatgatcttgagatgattcaagtcattggtaaagggagtggtggtgttgtccagctagtgcggcacaaatgggtggggacattgtatgccttgaagggtattcaaatgaacattcaggagtcagtgcgcaaacaaatcgtacaagagctcaagattaatcaagcaacacagagtccacatatagttatgtgccatcaatctttttaccacaatggtgtgatatatcttgttcttgagtacatggatcgcggatctcttgcggacatcattaagcaagtgaagactgttctggagccataccttgcagtactttgcaagcaggtattggagggtttgttgtatcttcatcatgaaaggcatgtgattcacagggacataaagccgtctaacttgttagtcaaccgtaaaggtgaagtaaagattactgatttcggggtcagtgcagtgctagcaagttcaatgggtcagcgggatacatttgttggaacctacaactatatggcacctgagaggattagtggaagctcttacgactacaagagcgacatatggagtttgggactggtgatacttgagtgtgccattggccggttcccctatataccttcagaaggagaaggttggataagcttctatgaacttcttgaagcaattgttgatcagccaccaccttctgcacctgcagatcagttctctccagaattctgctcatttatctcctcttgcatacagaaggatccagcagagaggatgtctgcttcagaactcttgaatcaccctttcatcaagaagtttgagggtaaggatttggacctgcggactcttgtggagagcctggagcctccgatgaacatacccgagtagactgccattaagatggatcgacgatccttttgcaatgtattcaggatcaccgtggtggcctcttgatatccgcacatatttctcctgaaccgcgtgcatcatgtccctaatcgtgggatgctgtgtgtatgttcttgattgctgcagaaaaatgtcccatggatcattttgacacccaagctccttttattgtgttccttaatagaatgtttcttgtagcagagtatctcttgaaaaggctctccatctagttcctgatgcattagactggtttcactgtgaatgtttcttgtgacaaatttgatttttcattgtaagttgcatgagtctacgcatcaaatggagggag

SEQ ID NO: 2279 - DNA, 1625 bp, Panicum virgatum
gctctagacatttaaaaaaaatctcaacaccaacctctctctgactccgagtctcgagcccgtcaccgccgccgccgctccaacccgatcccgccgccccagctgccgccgcatctcccctagccgtcggacctcccggtactcccggaatcaacaagaactagtttttcccttcttgatcctccctgagcagcgagtcccatccccatctcccaccaagaaaccctaagactccctgctacggggcaaggaggccatgagggggaagaagccggtgaaggagctaaagctcgccgttccggcgcaggagacccccgtcgacaagttcctgacggcaagtggtacattcaaggatggtgaactgcggcttaatcaaagaggtttgcggcttatctccgaagaaaatggagatgaaaatcaatcaacaaacctgaaggtggaagatgtacagttatcaatggatgatcttgagatgatccaagtcattggtaaagggagtggtggtgttgtccagctagtgcggcacaaatgggtggggacattgtatgccttgaagggtattcaaatgaacattcaggagtcaatgcgcaaacaaatagttcaagagctcaaaattaatcaagcaacacagagtccacatatagttctgtgccatcaatctttttaccacaatggtgtcatatatcttgttcttgagtacatggatcgcggatctcttgcggacatcattaaacaagtgaagaccattctggagccataccttgcagtactttgcaagcaggtcttggagggtttattatatcttcatcatgaaaggcatgttattcacagggacataaagccgtctaacttgttagtcaaccgtaaaggtgaagtaaagattactgatttcggggtcagtgcagtgctagcaagttcaatgggtcagcgggatacatttgttggaacctacaactatatggcgcctgagaggattagtgggagctcttatgactataagagcgacatatggagtttgggactagtaatacttgagtgtgccattggtcggttcccttatataccttcagaaggagatggttggttaagcttctatgaacttcttgaagcaattgttgatcagccaccaccttctgcacctgcagatcagttctctccagaattctgctcatttatctcctcttgcatacagaaggacccagcagagaggatgtctgcttcagaacttttgaatcaccctttcatccagaagtttgagggtaaggatttagacctgcggactcttgtggagagcctggaacctccgatgaacatacccgagtagagtgccattaggatggatgacaatccttttgcaatgtattcagggtcaccttggtggccttttgatatccgcacatatttctcctgaacagcgtgcatcaccccccgtaacgcgtgatgctgtgtgtatgtttttgaccgtgtcaaaaaaactcccagagatcattgtgacaccccaagttttccttgtggcagagtgtttctcttgataaggctctccatctctatgtggcccgtgatgcatcttacaagactgttttcactgtgaatgtttctggtgacgaatttagtgagttgccaag

SEQ ID NO: 2280 - DNA, 1583 bp, Oryza sativa
cacacgctctccttccttccttccttcttcgcttcttccgacgccacttcacctctccttcctccctccctcgccgccgcgggctgcttccaccctccctcccgccgcgtcccgccactcccggctgattactcgagccgccacggggcagatccgtgccgggataggcctctcgctcgcgcttcggtcccccgtctcttaccggcggataaaccctaaccggagaggaggaggagggggaggccatgagggggaagaagccgcacaaggagctcaagctctccgtgcctgcgcaggagacgcccgtcgacaagttcctgaccgcgagtggtacattcaaggatggtgaactgcggcttaatcaaagaggtttgcagcttatatccgaggaaactgcagatgaacctcagtcaacaaacctgaaggtggaagatgttcagttgtcaatggatgaccttgagatgattcaagtcattggtaaggggagtggtggtatcgtccaactagttcggcacaagtgggtggggacattatatgccttgaagggcattcaaatgaacattcaagaggcagttcgcaaacaaatagtacaagagctcaaaataaatcaagcaacacagaacccacatatagtcctttgccaccaatctttctaccataatggtgtaatatatctcgttctagaatacatggaccgtggatctcttgcagatatcattaaacaagtcaaaacaattctggagccatacctggcagtactttgcaaacaggttttggagggtctactgtatcttcatcatgaaaggcatgtgattcacagggatataaagccatctaacttgttagttaaccgtaaaggtgaagtaaagattaccgattttggggtaagtgcggtgctagcaagttcaatgggtcagcgggatacgtttgttggaacctacaactatatggcgcctgagcgtattagtggaagctcctatgactacaagagtgacatatggagtttgggcttagtaatactcgagtgtgccattggtcggttcccctatataccttcagaaggggaaggttggttaagcttctacgaattattagaagcaattgttgaccagccaccaccctctgcaccagcggaccagttctctccagaattttgtgcatttatctcctcctgcatacaaaaggatcctgcggagcggatgtctgcttcagaactcttgaatcatcctttcatcaagaagtttgaggataaggatttagacctgcgtattcttgtcgagagccttgaacctccaatgaatatatccgagtaacttgtcattgggaggaatgaggttttgtcggtctcttggtagcggcacatgttccctgcatgcgatgtagtgtgtatgatgttgaaaattcgggaggagttgcagtaatgtatcggtataatttttctttacctaaggcccttttgttgcctctttttatggtcctgtgacttgcgagcatgacaatagagggaatcatgatttcaccttcgtattgcatggtgtcttatggtagttcttgctgcgagtaattggtccccaatgtccttt

SEQ ID NO: 2281 - DNA, 1715 bp, Pseudoroegneria spicata
gtccccggccgacccgaccacccctcgccgccggaccgcatctccgctcacccctcacgcctccagatccgcgcgcctccctagcctccctccgcccgccgccgccgggaactttcctccgagctcgatcgatccagtggccggcgagagcgaccgaccgccgcgcggatcgatccagcgaccaacctggagcacggctgctgtcccctctcagccagtcaactcaagtcgcaccacgtgctaccattttgaccagctctgccgctgctatctttctccctaaattcctccccgggctttccctcacaccgacggcgccccggccgctcctccccgtccgacgcgcctccgctacgcgtccatctcccgcccgagaaaccctagccagaggaaggaggacaccatgagggggaagaaaccgctcaaggagctcaccctctccgtgccggcgcaggagacgcccgtggataagttcctgacggcgagcggtacatttaaggatggtgagctgcgacttaatcaaagaggtttgcagcttatctccgaggaaaacggagatgaacatcaatcaacaaaaatgaaggtggaagatgtgcagttatcaatggatgacctcgagatgattcaggtcattggtaagggaagtggtggcgtcgtccaactagtgcggcacaagtgggtgggcacattttatgccttgaagggcattcaaatgaacattcaggagtcagttcgcaaacaaatagtgcaggagctcaaaataaatcaagcaacacagagcccacatatagtcctttgccatcaatctttttaccacaatggtgtaatatatcttgttctggaatatatggatcgtggatctcttgcagacataattaaacaagtcaaaaccattctggagccatacctcgcagtactttgcaagcaggttttggagggactgttatatcttcatcatgaaaggcatgtgattcacagggacataaagccatctaacttgttagtcaaccataaaggtgaagtaaagattactgattttggtgtgagtgcagtgttagcaagttcgatcggtcagcgtgatacatttgttggaacctacaactatatggcgcctgagcggattagtggcagctcctatgactacaagagtgatgtatggagtttgggcttggtaatacttgaatgcgccattggtcgcttcccttatactcctccagagggagaaggttggttaagcttctatgaactattagaagcaattgttgatcagccaccaccttctgcacctgcagatcagttctctccagaattctgctcatttatctcttcctgcatacaaaaggaccccgccgaacgaatgtctgcttcagagctcttgaaccatgccttcatcaagaagttcgaggacaaggatctagacctccggatcctggtcgagagccttgagcagcccatgaacgtgcccgagtgaggccgttgctcgtagaggtgaggctttgcagcgagtttcttccagggctgccctcctaacggcaattgtgtattgctgtgaacctgatgagtgatgaatggccccccacccctgtatgtgatgatgttatgttggaaaaattcccagaggattcgaatggattattaatgtatggtaatgacttgaggcccttttgttgtgtgtcttgttatgaatgaatgggtgattgaatctggtgtggtta

SEQ ID NO: 2282 - DNA, 1487 bp, Avena sativa
ctatttttccgcttctgtccgcctaaaatcgcgcctcgaccccgctcgctcccttcactccggcttctccccgccccatccgccgtgcccccgagtttgggcttttgaccagttccgtacccatctcccgccccgaggaaccctagccggagggagagaccatgagggggaagaaaaccctcaaggacctcaagctcgatgtgccggcgcaggagacgcccgtcgataagttcctgactgcgagcggtacattcaaggatggtgaactgcgacttaatcaaagaggtttgcagcttatctccgaggaaaacggcgatgaacatcaatccacaaacatgaaggtggaagatgtacagttatcaatggatgacctcgagatgatccaggtcattggtaagggaagtggtggtgtcgtccaactagtgcagcacaagtgggtggggacattttatgccttgaagggcattcaaatgaacattcaggaggcagttcgcaagcaaatagtgcaggagctcaaaataaatcaagcaacacagagcccacatatagtttcttgccatcaatcgttttaccacaatggtgtaatatatcttgttctggaatacatggaccgtggatctcttgcagacataattaaacaagttaaaaccattctggagccatacctcgcagtactttgcaagcaggttttggagggtctattataccttcaccatgataggcatgtgattcacagggacataaagccatctaacttgttagttaaccataaaggtgaagtaaagattactgattttggtgtaagtgcagtgctagcaagttcaattggccagcgtgatacatttgttggaacctacaactacatggcgcctgagcggatcagtggcagctcctatgactacaagagtgatgtatggagtttgggcttagtaatacttgaatgtgccattggccgcttcccctatattcctccggaaggagaaggttggttaagcttctatgaactattagaagcaatcgttgaccagccaccaccttctgcacccgcagatcagttctctccagagttctgttcattcatctcttcctgcatacaaaaggatcccgctgaacggatgtctgcttcagaactcttgaaccatcctttcatcaagaagttcgagggtaaggatctggacctgaagatcctggtggagaccctggagccacccatgaacgtgccagaataaggtctttcacttggaggggtgatgctttggagcgagtttcagggtccgtcattctgacagcgtcacatgtttgtcctggaccgcatcatcttccgccgtatatgtgaagatgtatgtttgaatttggcgagtcagtcgcctcgttggatcattaatgtatggagacttgaggcccttttgttgtgtgtgtcttgacatgaacggatctactgtatgactagttgagcatgagaatagaaggaacctcgtgatgtttgc

SEQ ID NO: 2283 - DNA, 1269 bp, Avena sativa
tttgaccaactgtgccgctatttttccgcttctgtccgcctaaaatcgcgcctcgaccccgctcgctcccttcactccggcttctccccgccccatccgccgtgcccccgagtttgggcttttgaccagttccgcacccatctcccgccccgaggaaccctagccggagggagagaccatgagggggaagaaaaccctcaaggacctcaagctcgatgtgccggcgcaggagacgcccgtcgataagttcctgacggcgagcggtacattcaaggatggtgaactgcgacttaatcaaagaggtttacagcttatctccgaggaaaacggcgatgaacatcaatccacaaacatgaaggtggaagatgtacagttatcaatggatgacctcgagatgatccaggtcattggtaagggaagtggtggtgttgtccaactagtgcagcacaagtgggtgggcacattttatgccttgaagggcattcaaatgaacattcaggaggcagttcgcaagcaaatagtacaggagctcaaaataaatcaagcaacacagagcccacatatagtttcttgccatcaatctttttaccacaatggtgtaatatatcttgttctggaatacatggaccgtggatctcttgcagacataattaaacaagttaaaaccattctggagccatacctcgcagtactttgcaagcaggttttggagggtctattataccttcaccatgataggcatgtgattcacagggacataaagccatctaacttgttagttaaccataaaggtgaagtaaagattactgattttggtgtaagtgcagtgctagcaagttccataggtcagcgtgatacatttgttggcacctacaactacatggcgcctgagcggatcagtggcagctcctatgactacaagagtgatgtatggagtttgggcttagtaatacttgaatgtgccattggccgcttcccctatattcctccggaaggagaaggttggttaagcttctatgaactattagaagcaatcgttgaccagccaccaccttctgcacccgcagatcagttctctccagagttctgttcattcatctcttcctgcatacaaaaggatcccgctgaacggatgtctgcttcagaactcttgaaccatcctttcatcaagaagttcgagggtaaggatctggacctgaagatcctggtggagaccctggagccacccatgaacgtgccagaataaggtctgtcacctggacgcgtgag

SEQ ID NO: 2284 - DNA, 1270 bp, Avena sativa
ccaccccaggtcgcagcacgtgcccaccattttgaccaaccgtgctgctatttttccgcttctgtctgccgaaaatcgcgcctcgacctcgctcgctccttcacaccgactgctcctcccccgtccgccgtgcccccgagttgtctgggcttttgaccagttccgtacccatctcccgccccgaggaaccctagccggagggagagaccatgagggggaagaaaaccctcaaggacctcaagctcgatgtgccggcgcaggagacgcccgtcgacaagttcctgactgcgagcggtacattcaaggatggtgaactgcgacttaatcaaagaggtttacagcttatctccgaggaaaacggcgatgaacatcaatccacaaacatgaaggtggaagatgtacagttatcaatggatgacctcgagatgatccaggtcattggtaagggaagtggtggtgtcgtccaactagtgcagcacaagtgggtggggacattttatgccttgaagggcattcaaatgaacattcaggaggcagttcgcaagcaaatagtgcaggagctcaaaataaatcaagcaacacagagcccacatatagtttcttgccatcaatcgttttaccacaatggtgtaatatatcttgttctggaatacatggaccgtggatctcttgcagacataattaaacaagttaaaaccattctggagccatacctcgcagtactttgcaagcaggttttggagggtctattataccttcaccatgataggcatgtgattcacagggacataaagccatctaacttgttagttaaccataaaggtgaagtaaagattactgattttggtgtaagtgcagtgctagcaagttccataggtcagcgtgatacatttgttggcacctacaactacatggcgcctgagcggatcagtggcagctcctatgactacaagagtgatgtatggagtttgggcttagtaatacttgaatgtgccattggccgcttcccctatattcctccggaaggagaaggttggttaagcttctatgaactattagaagcaatcgttgaccagccaccaccttctgcacccgcagatcagttctctccagagttctgttcattcatctcttcctgcatacaaaaggatcccgctgaacggatgtctgcttcagaactcttgaaccatcctttcatcaagaagttcgagggtaaggatctggacctgaagatcctggtggagaccctggagccacccatgaacgtgcc

SEQ ID NO: 2285 - DNA, 1414 bp, Brachypodium distachyon
aaatccaaaatcagtccatccgatctccaacctacttcccaactagaccttgggctttgaccagtcccggcgtatccatctcccacccgagaaaccctaaccagaggagaggagaccatgagggggaagaaaccgctcaaggagctcaagctctctgtgccggcgcaggaaacatccgtcgataaatttctgacggcgagtggcacattcaaggatggagaactgcgacttaatcaaagaggtttgcggctgatctccgaggaggaaaacggagatgaacatcaatcaacaaacatgaaggtggaagatgtgcagttgtcaatggatgacctcgagatgattcaagtcattggtaagggaagtggtggcgtcgtccaactcgtgcagcacaagtgggtgggcacattttatgcgttgaagggcattcaaatgaacattcaggaggcagttcgcaaacaaatagtacaggagctcaaaataaatcaagcaacacagagcccacatatagtttcttgccatcaatcgttttaccacaatggtgtaatatatcttgttctagaatacatggatcgtggatctcttgcagacataattaaacaagttaaaaccattctggagccatacctcgcagtactttgcaagcaggttttggagggtcttctatatctgcatcatgaaaggcatgtgattcacagggacataaagccatctaacttgttagtcaatcataaaggtgaagtaaagattactgattttggggtaagtgcagtgctagcaagttcgattggccagcgtgatacatttgttggaacctacaactacatggcgcctgagcggataagtggcagctcctatgactacaagagtgacgtatggagtttgggcttagtaatacttgaatgtgccattggccgcttcccctatactccttcagaaggagaaggttggctaagcttctatgaactattagaagcaattgttgaccagccaccacctggtgcacctgcagatcagttctctccagaattctgctcatttatctctgcctgcatacaaaaggaccccgcggaacgcatgtctgcttcagaactcttgaaccatgctttcattaagaagttcgagggcaaggatctagacctacgaattcttgtcgagagccttgaaccacctatgaatgtacctgaataaggatgaggctttgcagtgagtttcagggtcgccctcctgacagcatcacatattcgtcctgaactgtaaaatcttccctaaatgtggtgtatgttcaaaattcccaagaggagtcggattattattaatgtacgactcacggcccttttgttgtgtgcggtcatatgaatctgtgactagttgagcatgagaatacaaggaacctgagatgttgcttgccttcgta

SEQ ID NO: 2286 - DNA, 1690 bp, Brachypodium distachyon
ccgcagcgtgcgtccccggcggccgctccctcccctcccttctcgcgcctcgcagcccctcaagtagctacccgcctctcctgcaagtcccgggccgaccagcaccgctctctcgccgcctccccacgccgcccctcgccgtcggactgcatctccgccgggcccccatctccagatccgcgcgttcccaacctccctccgccagccgccgccgtcgggaccccgacatccagccgtggccgtcgggaactttcgctaaccaaaatccaaaatcagtccatccgatctccaacctacttcccaactagaccttgggctttgaccagtcccggcgtatccatctcccacccgagaaaccctaaccagaggagaggagaccatgagggggaagaaaccgctcaaggagctcaagctctctgtgccggcgcaggaaacatccgtcgataaatttctgacggcgagtggcacattcaaggatggagaactgcgacttaatcaaagaggtttgcggctgatctccgaggaggaaaacggagatgaacatcaatcaacaaacatgaaggtggaagatgtgcagttgtcaatggatgacctcgagatgattcaagtcattggtaagggaagtggtggcgtcgtccaactcgtgcagcacaagtgggtgggcacattttatgcgttgaagggcattcaaatgaacattcaggaggcagttcgcaaacaaatagtacaggagctcaaaataaatcaagcaacacagagcccacatatagtttcttgccatcaatcgttttaccacaatggtgtaatatatcttgttctagaatacatggatcgtggatctcttgcagacataattaaacaagttaaaaccattctggagccatacctcgcagtactttgcaagcaggttttggagggtcttctatatctgcatcatgaaaggcatgtgattcacagggacataaagccatctaacttgttagtcaatcataaaggtgaagtaaagattactgattttggggtaagtgcagtgctagcaagttcgattggccagcgtgatacatttgttggaacctacaactacatggcgcctgagcggataagtggcagctcctatgactacaagagtgacgtatggagtttgggcttagtaatacttgaatgtgccattggccgcttcccctatactccttcagaaggagaaggttggctaagcttctatgaactattagaagcaattgttgaccagccaccacctggtgcacctgcagatcagttctctccagaattctgctcatttatctctgcctgcatacaaaaggaccccgcggaacgcatgtctgcttcagaactcttgaaccatgctttcattaagaagttcgagggcaaggatctagacctacgaattcttgtcgagagccttgaaccacctatgaatgtacctgaataaggatgaggctttgcagtgagtttcagggtcgccctcctgacagcatcacatattcgtcctgaactgtaaaatcttccctaaatgtggtgtatgttcaaaattcccaagaggagtcggattattattaatgtacgactcacggcccttttgttgtgtgcggtcatatgaatctgtgactagttgagcatgagaatacaaggaacctgagatgttgcttgccttcgtattttcgcagcctgc

SEQ ID NO: 2287 - DNA, 1340 bp, Festuca arundinacea
ccatctcccgctagataaaccctaaccgggggaagggaccatgagggggaagaaagcgctcaaggacctcaagctcgatgtgccggcgcaggagacgcccgtcgataagttcctgacggcgagtggtacattcaaggatggtgaactgcgacttaatcaaagaggtttgcagcttatctcagaggaaaatggagatgaaaatcagtcaacaaacatgaaggtggaagatgtacagttatcaatggatgacctagagatgattcaggtcatcggtaagggaagtggtggggtcgtccaactcgtgcagcacaagtgggtgggcacattttatgccttgaagggcattcaaatgaacattcaggaggcagttcgcaaacaaatagtacaggagctcaaaataaaccaagcaacgcagagcccacatatagtttcttgccatcaatctttttaccacaatggtgtaatatatcttgttctggaatacatggatcgtggatctcttgcagacataattaaacaagttaaaaccattctggagccatacctcgcagtactttgcaagcaggttttggagggtctgttatatcttcatcatgaaaggcatgtaattcacagggacataaagccatctaacttgttagtcaaccataaaggtgaagtaaagatcaccgattttggcgtaagtgcagtgctagcaagttcaataggtcagcgtgatacatttgttggaacctacaactacatggcgcctgagcggattagtggcagctcctatgactacaagagtgatgtatggagtttgggcttagtaatacttgaatgtgccattggccgcttcccctatattcctccagaaggagatggttggttgagcttctatgaactattagaagcaattgttgaccagccaccaccttctgcacctgcagatcagttctcaccagaattctgctcattcatctcttcctgcatacagaaggatcctgcagaacggaagtctgcttcagaactcttgaaccatcctttcatcaagaagttcgagggccaggatctagacctaaaaatcctcgtcgagagcctggaaccgcctatgaatgtgcccgagtaaggtggtcacctggaggcgtgagtgaggctctggagtgagtttcagggtcgccattctgacagcgtcacatatttgtcccgaaccgcatcatcttgccctatagtatgtgaagatgtatgctcagatttccagagttctcggattattaatgtatgacttaaggcccttttgttgtgtgtcttgacatgaatctgttacttgttgagcatgagaatagaaggaatcggtgatg

SEQ ID NO: 2288 - DNA, 1876 bp, Festuca arundinacea
ggcacgaggccttcccgtcgctcgccagccgcctctccccaccgcacgcccctccccggccgaccagcgccgctccctcgccgacccaccacccccacaccgtcccttgccgccactccgctcgccgccccgaccccagatccgcgcaccccccgacccccatcccaagccgtcgccgtcgggatcttcggcgtcgacccggagggagagctcgattcacttcccggcgagagcaacggccgagcggatcaagccaggcgcgagcaacttgcagcgcggctgctgtcagtccaacccaagtcgccgcacgtgcctccattttgaccaaccgtgctgctattttcggttttatcaacccaagatcgcgcctttacaccaacgctccggctcctcgtcccccgtctgccgtgcccccgttctgcccatctcccgctagataaaccctaaccaggggaagggaccatgagggggaagaaagcgctcaaggacctcaagctcgatgtgccggcgcaggagacgcccgtcgataagttcctgacggcaagcggcacattcaaggatggtgaactgcgacttaatcaaagaggtttgcagcttatctccgaggaaaacggagatgaaaattcaaccaacatgaaggtggaagatgtacagctatcaatggatgacctagagatgattcaggtcattggtaagggaagtggtggggttgtccaactcgtgcaacacaagtgggtgggcacattttatgccttgaagggcattcaaatgaacattcaggaggcagttcgcaaacaaatagtacaggagctcaaaataaatcaagcaacacagagcccacatatagtttcttgccatcaatctttttaccacaatggtgtaatatatcttgttctggaatacatggatcgtggatctcttgcagacataattaaacaagttaaaaccattctggagccataccttgcagtactttgcaagcaggttttggagggtctgttatatcttcatcacgaaaggcatgtgattcacagggacataaagccatctaacttgttagtcaaccataaaggtgaagtaaagattaccgattttggcgtaagtgcggtgctagcaagttcaataggtcagcgtgatacatttgttggaacctacaactacatggcgcctgagcggattagtggcagctcctatgactacaagagtgatgtatggagtttgggcttagtaatacttgaatgtgccattggccgcttcccctatattcctccagaaggagatggttggttaagcttctatgaactattagaagcaattgttgaccagccaccaccttcagcacctgcagatcagttctctccagaattctgttcattcatctctttctgcatacagaaggatcctgcagaacggaagtctgcttcagaactcttgaaccatcctttcatcaagaagttcgagggccaggatttagacctaaaaatcctcgtcgagagcctcgaaccgcctatgaatgtgcccgaataaggtggtcgtcacttggaggcgtgaggctttagagtgagtttcagggtcaccattctgacagcgtcacatatttgtcccggaccgcagcatcttccctatatgtgaagatgtatgttcgaaattgcgagagtcgtcggattattaatgtatgacctaaggcccttttgttgtgtgtcttgacatgaatctgttacttgttgagcatgagaatagaaggaaccggtgatgttgccccggtattgttgcatgtatgctttatgtggttaatatgacgcctggaccttgtgtttatgtggttcaacttgggaacttcgggatcaaacactatttggtttgttcgcctcgtgcc

SEQ ID NO: 2289 - DNA, 1164 bp, Avena sativa
gactgcgagcggtacattcaaggatggtgaactgcgacttaatcaaagaggtttgcagcttatctccgaggaaaacggcgatgaacatcaatccacaaacatgaaggtggaagatgtacagttatcaatggatgacctcgagatgatccaggtcattggtaagggaagtggtggtgtcgtccaactagtgcagcacaagtgggtggggacattttatgccttgaagggcattcaaatgaacattcaggaggcagttcgcaagcaaatagtgcaggagctcaaaataaatcaagcaacacagagcccacatatagtttcttgccatcaatcgttttaccacaatggtgtaatatatcttgttctggaatacatggaccgtggatctcttgccgacataattaaacaagttaaaaccattctggagccatacctcgcagtactttgcaagcaggttttggagggtctattataccttcaccatgataggcatgtgattcacagggacataaagccatctaacttgttagttaaccataaaggtgaagtaaagattactgattttggtgtaagtgcagtgctagcaagttccataggtcagcgtgatacatttgttggcacctacaactacatggcgcctgagcggatcagtggcagctcctatgactacaagagtgatgtatggagtttgggcttagtaatacttgaatgtgccattggccgcttcccctatattcctccggaaggagaaggttggttaagcttctatgaactattagaagcaattgttgaccagccaccaccttctgcacctgcagaccagttctctccagagttctgttcattcatctcttcctgcatacaaaaggatccggctgaacggatgtctgcttcagaactcttgaaccatcctttcatcaagaagttcgagggtaaggatctggacctgaagatcctggtggagaccctggagccacccatgaacgtgccagaataaggtctgtcacctggacgcgtgagaggcctcggagtgagtttgagggtccgtcattctgacagctgtcaccacatgtttgtcccggaccgcatcatcttctccctcccctatatgtgaagatgtatgttcgaatttggcatagtcgtcggatcattaatgtatgacttaag

SEQ ID NO: 2290 - DNA, 1034 bp, Panicum virgatum
acagcgccgccgacgacgaggccatgagggggaagaagccgctcaaggatctcaagctctccgtgccggcgcaggagagtcccgtcgacaagttcctgacggcgagtggcacattcaaggatggcgaactgcggcttaatcaaagcggcttgcggcttatctccgaggaaaatggggatgaagatgaatcaacaaagctgaaagttgaagatgtgcagttatcgatggatgatcttgagatgattcaagtcattggtaaaggaagtggtggtgttgtccagttagtgaggcacaaatgggtggggacattgtacgccttaaagggtattcaaatgaacattcaggagtcagttcgcaaacaaatagtacaagagctcaaaataaaccaggcaacacaaagccctcatatagttctgtgccatcaatctttttaccacaatggtgtaatatatcttgttcttgagtacatggatcgtggatcccttgcagacatcattaagcaagtgaagacagttctggaaccataccttgcggtactctgtaagcaggtcttggagggtctattatatcttcatcatgaaaggcacgtgattcacagggacataaagccttctaacttgttaatcaaccgtaaaggggaagtcaagattactgactttggggtaagtgcggtgctagcaagctcaatgggtcagcgagatacatttgttggaacctacaactatatggcgcctgaacggattagcggaagctcatatgactacaagagtgatatatggagtttgggcttagtaatacttgagtgtgccattgggcggttcccctatataccttcagaaggagaaggttggttaagcttttatgaactactggaggctattgttgatcagccaccaccttctgcacctgcagatcagttctctccagaattctgctcatttatatcctcctggtacgctaaacattcttttcttaagttggacgtgaaaattaatttagttagtacctttatgcttgttagcagaaatatttga

SEQ ID NO: 2291 - DNA, 1524 bp, Hordeum vulgare
cccgagcccgtcatagcccagtcggcttcactgagcgcgaccactgtctgactctgcactgagtctactgaccagggcagagcccctcccctccgtccgccagccgccacgtccccggccgacccgaccacccctcgccgccggaccgcatctccatctccatctccatctccatcccctcccctcatccccacctccagatccgcgcgctcccccagcatccctccgcccgccgggaactttcctccgagctcgatccatccagtggccggcgacagcgaccgcccgccgcgccgatcgatccagccagcaacctggagtcccagtcaacccaagtcgcaccacgtgccaccattttgacgagctccgccgctgctaccccgtagtatttttctccctaaattcctgcccccggcctcccctcacaccgacggcgccccggccgcccctccccgcccgccgcacctccgctccgcgtccacctcccgcccgagaaaccctagccacagcaaggaggaggccatgagggggaagaagccgctcaaggagctcacgctctccgtgccggcgcaggagacgcccgtcgataagttcctgacggcgagcggtacattcaaggatggtgaactgcggcttaatcaaagaggtttgcagcttatctccgaggaaaatggggatgaacaccaatcaacaaaaatgaaggtggaagatgtgcagttatcaatggatgacctcgaaatgattcaggtcattggtaagggaagtggtggcgtcgtccaactagtgcggcacaagtgggtgggcacattttatgccttgaagggcattcaaatgaacattcaggagtcagtacgcaaacagatagtacaggagctcaaaataaatcaagcaacacagagcccccatattgtcctttgccatcaatctttttaccacaatggtgtaatatatcttgttctggaatatatggatcgtggatctcttgcagacataattaaacaagtcaaaaccattctggagccataccttgcagtactttgcaagcaggttttggagggtctgttatatcttcatcatgaaaggcatgtgattcacagggacataaagccatctaacttgttagttaaccataaaggtgaagtaaagattactgattttggggtgagtgcagtgctagcaagttcaatcggtcagcgtgatacatttgttggaacctacaactatatggcgcctgagcggattagtggcagctcctatgactacaagagtgatgtatggagtttgggcttggtaatacttgaatgcgccattggccgcttcccctatactcctccggaaggagaaggttggttaagcttctatgaactattagaagcaattgttgaccagccaccaccttctgcacctgcagatcagttctctccagaattttgctcatttatctcttcctggtatgtcaaacattattctgaggaactacacatgaaattagctcagtcactgcatttctgtttttttttcttg

SEQ ID NO: 2292 - DNA, 3712 bp, Ananas comosus
ctgtgggggtgctccgccgccacgcccgccgcgtcgcctccccgctctccgttcctcaccctctcggccttcgccccctctcctccggcgagagccttccacgtgtcggcgcggtactcacactccttgaggcccttcgcggggttcttcgtgaacctcagggggtttcggaaggtgcggcggaggcaagccgcggcgaagaagcagccgacgaaggagaagcagctcgagctcgatgttcagatcgccatcgaagaagagctccctgatgatcccgaagtcttgggcattgctgaaatgctaaagctgaatgttccgatggcaatgaaaattgcatttgatggcctcaaggattcagaatataaaacaagggatacttctattagtgatgttggtaaatacgagaaggtcgagttatctgtgttgctttgcaatgacaatttcattcagaatctcaataaagattggagaggcgaggaccatgctactgatgtgctctccatgtctcaacacatacccgatcttgatcttcccattctgatgctaggtgatatagtgatttctgttgagactgccactagacaagcagaggagagaggtcacacgcttctcgacgaagttcggatcctcatggttcatggtctgttgcatcttcttggctttgatcatgagattaatgatgaggctgaggcagaaatggagaaggaggaagaactagtattgaaaagtcttggttggaaagggaaaggactaattaagagtgctcatgatgctgcgaatgatagcaaacttcacgcagaaagttcagatggacaagctcgcgatgatttgaagaaagcaggaagtttgagattctataaaccaaaattcagccatatcttttgtgatatggatggtacacttttgaacagtaaaagtcaaattactacaacaacagcagaagctttgagagaagcaatatcgagaggagtgaatatcgttattgctactggaaaggcacgtcccgctgttattagtgccttgaagatggttggattagctggaaaaaatggtgtggtttctgaattttcacctggcatatttcttcagggtttgcttgtttacggaagacgaggaagggagatttgtagaagaaacttagacaaaggcgtttgccggaaggcattttcatattctgtggagcatgagattcctctggtagcattttgtcaggatcgatgtttcacattatttgatcacccgttgatcgattcgttgcatactgtatatcacgagccaaaggcagaagttttgtcttcagttgagcaactcttagcatccaatgatatacagaaattactgtttgtcgacactcctgaggggattacctctactttgcggccacattgggaagaagcaaccgacgggctcgctggtgtggtccaagcagtgcctgatatgcttgaaatcgtgccagctggaacttcaaaaggaagtggtgtaaaaatgttgctggatcaccttggcatttctccaaaagaggtaatggctattggcgacggggagaatgatgttgagatgctccaagtagcatcattaggggttgctcttgcgaatggatcagagaagactaaggctgtggcgaatgtcattggagctaccaatgatgaagatggcgcggcgaaggctatctatgaatatgccttttaacattcatttttgcattaatcggtaatttaatgccggtttgtgctttcatcagaaattttcaggggatccaacccagattgaactttcaatttattttcattgttttgagctcgccgcccttcatacgcgagctctcctttttatgtaatatgaaattgttactcttcctgtctctaaggaagggcagccccttttgttttgaattgtttccggcttcttttcgatttaaaggcggaaaagtttgcaatctaatttgagatggaaatatattgttgtcacggagacagtcaccagtaagccaatttcaaatagactccacattacttactgtggcaattttatgtgttgtatcatgggcatctcctttgttcgttttgattttgagttatgacttgagtaactatgatcatataaaattggcatttatgaaacttggaagaagtaattcataaaagaactgcattttaagcaaaaagcaagatttatcaataccaatttctcaactggtaccttgctgcctctattatctgctgaatcacggcaacaggtaacatccggagctaattttaatgaatatctccacctcaaatctagcaatacaacattacccccatcacttgcaacactatctttgatcaatatcgatgagttgccctaacttgcaatatacttcggaccaattttcatcttgtttgccatcactgaaattttgacacttttcatggtatttataatctccctgcgggaggatacgaggactgttgcagcaatttggtcttttcacatcatgcagctgagaaaaatgcctgctctagagctccaacgcagcaaaatctgggagattgcacgcatatcaaaccacaaggatattaagcatcagtctactacattcacaggaggatctaagctgctgacgagaattcccagatcgatatccttgtcctcgaattttttgataaaggggtgattcaggagttccaaacaggacagtctctgttgaggatccttttgaatgcaagctgatacgaatgaacagaactctggagagaattgatctggcggtgcacaaggtgctggctgatccacgatagcctccaaaagttcataaaagctcagccaaccttcttcctcttcagatggtatataaggaaaacggccaatagcacattccagtattaccaagcccaaactccatatatcactcttgtaatcataagagcttccgcttattcgctcaggcgacatataattgtaagttcccacgaatgtatctcgctgacccatggagctagcaagtacagcactcactccaaaatcagtaattttcacttcacctttgtggttaactaacaagtttgacggtttgatatccctgtggattacatgcctttcatgatgaagatacactaaaccctccaaaacctgcttacaaagaactgccaggtatggctcaagaattgttttaacttgcttaattatgtctgcgagagatccccgatccatgtactccaaaacaagagaaatcacaccattgtggtagaaggaatggtagcaaacaactatatgtgggcacagcgatgcttggtttattttcagctcttgcactatttgtttacgaactgtctcttgaatattcatctggatgcccttcaaagcgtataaggtccccatccatttatgccgcacaagttggacaacaccaccacttccttttccaataacttttatggtctcgaggtcctccaatgcaaactgcatatccacctcctccgcatctggtgtacgagtttccttttcctcagagatcaaccgcaatcctctctgattcaaccgcagatcaccatcctggaatgtaccactcgccgtcaggaatttgtccacgggagtctcctgcgcgggcaccgcgagcttcagctgcttcagtggcttcgtccctttcatgatctagggtttccgcttgggcgaatccacggggtagggttagggcttctaacaaatctctccgaggagggggagagagaga

SEQ ID NO: 2293 - DNA, 2892 bp, Ananas comosus
ctctctctccccctcctcggagagatttgttagaagccctaaccctaccccgtggattcgcccaagcggaaaccccagatcatgaaggggacgaagccactgaagcagctgaagctcgcggtgcccgcgcaggagactcccgtggacaaattcctgacggcgagtggtacattccaggatggtgatctgcggttgaatcagagaggattgcggttgatctctgaggaaaaggaaactcgtacaccagatgcggaggaggtggatatgcagtttgcattggaggacctcgagaccataaaagttattggaaaaggaagtggtggtgttgtccaacttgtgcggcataaatggatggggaccttatacgctttgaagggcatccagatgaatattcaagagacagttcgtaaacaaatagtgcaagagctgaaaataaaccaagcatcgctgtgcccacatatagttgtttgctaccattccttctaccacaatggtgtgatttctcttgttttggagtacatggatcggggatctctcgcagacataattaagcaagttaaaacaattcttgagccatacctggcagttctttgtaagcaggttttggagggtttagtgtatcttcatcatgaaaggcatgtaatccacagggatatcaaaccgtcaaacttgttagttaaccacaaaggtgaagtgaaaattactgattttggagtgagtgctgtacttgctagctccatgggtcagcgagatacgttcgtgggaacttacaattatatgtcgcctgagcgaataagcggaagctcttacgattacaagagtgatatatggagtttgggcttggtaatactggaatgtgctattggccgttttccttatataccatctgaagaggaagaaggttggctgagcttttatgaacttttggaggctatcgtggatcagccagcaccttgtgcaccgccagatcaattctctccagagttctgttcattcgtatcagcttgcattcaaaaggatcctcaacagagactgtcctgtttggaactcctgaatcacccctttatcaaaaaattcgaggacaaggatatcgatctgggaattctcgtcagcagcttagatcctcctgtgaatgtagtagactgatgcttaatatccttgtggtttgatatgcgtgcaatctcccagattttgctgcgttggagctctagagcaggcatttttctcagctgcatgatgtgaaaagaccaaattgctgcaacagtcctcgtatcctcccgctgggagattataaataccatgaaaagtgtcaaaatttcagtgatggcaaacaagatgaaaattggtccgaagtatattgcaagttagggcaactcatcgatattgatcaaagatagtgttgtaagtgatgggggtattgttgtattgctagatttgagatggagatattcattaaaattagctccggatgttacctgttgccgtgattcagcagataatagaggcagcaaggtaccagttgagaaattggtattgataaatcttgctttttgcttaaaatgcagttcttttatgaattacttcttccaagtttcataaatgccaatttcatatgatcatagtaactcaagtcataactctaaatcaaaacgaacaaaggagatgcccatgatacaacacataaaattgccacaataagtaaagtggagtctatttgaaattggcatactggtgactgtctccatgacaacaatatatttccatctcaaattagattgcaaacttttccgcctttaaatcgaaaagaagccggaaacaattcaaaacaaaaggggctgcccttccttagagacaggaagagtaacaatttcatattacataaaaaggagagctcgcgtatgaagggcggcgagctcaaaacaatgaaaataaattaaaagttcaatctgggttggatcccctgaaaatttctgatgaaagcacaaaccggcattaaattaccgattaatgcaaaaatgaatgttaaaaggcatattcatagatagccttcgccgcgccatcttcatcattggtagctccaatgacattcgccacagccttagtcttctctgatccattcgcaagagcaacccctaatgatgctacttggagcatctcaacatcattctccccgtcgcctatagccattacctcttttggagaaatgccaaggtgatccagcaacatttttacaccacttccttttgaagttccagctggcacgatttcaagcatatcaggcactgcttggaccacaccagcgagcccgtcggttgcttcttcccaatgtggccgcaaagtagaggtaatcccctcaggagtgtcgacaaacagtaatttctgtatatcattggatgctaagagttgctcaactgaagacaaaacttctgcctttggctcgtgatatacagtatgcaacgaatcgatcaacgggtgatcaaataatgtgaaacatcgatcctgacaaaatgctaccagaggaatctcatgctccacagaatatgaaaatgccttccggcaaacgcctttgtctaagtttcttctacaaatctcccttcctcgtcttccgtaaacaagcaaaccctgatttcaagttcaacagagattaaaaagactgaattccaccgtctctgcagagtaagactaccagaaacttgaaactgcaatgcagaaaaatttttcatgctattacatacaggtagcaatgactggtttagtgataaatgctttcccattactaaatccccaacctttctttgtagtcaactaaatcagatctcataaagataaaatgtatgcactagtaatttaatatatgtcattgactgactgattccaccccagccgcccacg

SEQ ID NO: 2294 - DNA, 1371 bp, Elaeis guineensis
agacagtctctctctctcgataacactccagaagacctagctcggattcgtcctcgcgaaaccctacatgatgaagggcccgaagccactgaagcagctccaggtcgccgtgccggcccaagaaacacccgtggacaagttcttgacggcaagcgggacattcacggacggtgatctgcgactgaatcagaaaggaatgcggttgatctctgaggcaactgagagtcgtcaacccgatgttaaggaagaggatatgcagttctcattggaagacctggagaccatcaaagttattgggaaggggagtggaggtgttgttcagcttgcacggcacaaatggttggggactctctatgccttgaagggcattcagatgaatattcaagaggcagttcgtaaacaaatagtgcaagagcttaaaataaatcaagcatcgcagtgtccgcatgttgttgtttgctaccattctttctatcataatggcataatctatcttgtcttggaatacatggatcggggatctctggctgatataattaaacaagtgaaaacaattcttgagccgtatcttgcaattgtttgcaaacaggttttgaagggtttagtgtatctgcatcatgaaaggcatgtaatccacagggacataaagccatcgaacttgttggtaaatcacagtggtgagataaagataactgactttggagtgagcgcagtgcttgctaactccatgggtcaacgtgatacatttgtgggcacctacaattatatgtcgcctgagcggatcagtggaagctcatacgattataagagtgacatatggagtttgggcttggtcatacttgagtgtgctataggccgctttccttacataccgtctgaacaagaagaaggctgcctgagcttttatgaacttttggaggctatcgtggatcagccaccaccttctgccccatcagatcaattttctccagagttttgttcatttatatcagcatgcttacagaaggatcctcaggaaagaatgtcatctttggagctcctgagtcaccccttcatcaaaaaatttgaggacaaggacatcggtctggcaatcctcgtcagcagcttagatcctcctgtaaatatacctggtgatgtgtaagtatatatgatggtttctacatgcacattacatgtaaaataacaatctgagctaaagatgttgcaagttcaccttgccctcctggagctctctggtttgctgcttgctctagttcaagtcaatcatatactcaaccgcatgattttcacgtgagcataccttggagtgcataaatgcgccatttagtttttaaatcatgaatatattcaggtgcatgagttttagatgag

SEQ ID NO: 2295 - DNA, 1414 bp, Setaria italica
tcatcaagcacacacacacgcacagcaaattaagcaagcacgagagtgttctggagaggatctgaggaggaacagctagcatcacctgcgacgacgatcgacgatgggcccgaacatgtcggcgttcagcagcaagcagcaggcgtcggcgaagcggcgggcgtacgtgacgttccttgccggcgacggcgactactggaagggcgtggtgggtctggccaagggcctgcggaaggcgaggtcggcctaccccctggtggtggccgtgctccccgacgtccccgaggagcaccgccgcaagctgcgggagcagggctgcgtcgtccgcgagatccagccggtgtacccgccggagagccagacgcagttcgccatggcgtactacgtcatcaactactccaagctccggatctgggagttcgtggagtacgagcgcatggtgtacctcgacgcggacatccaggtgtacgagaacatcgaccacctgttcgacctggagaagggccggttctacgcggtgatggactgcttctgcgagaagacgtggagccacaccccgcagtacaagatcggctactgccagcagtgccccgacaaggtcacctggccggagcatgagctgggccctccgccgccgcgctacttcaacgccggcatgttcgtgcacgagccgagcctgggcacggccaaggacctcctggacgcgctggtggtgacgccgccgacgccgttcgcggagcaggacttcctcaacatgttcttccgcgacgtctacgagcccatcccgccggtgtacaacctggtgctggccatgctgtggaggcaccccgagaacgtgaagccgctcgacaaggtcaaggtcgtgcactactgcgcagcgggttccaagccttggaggtacacgggtgaggaggccaacatggaccgcgaggacatcaagatgctggtgagcaagtggtgggacatcttcaacgacgagagcctggactacaagggcccggcggtggacgacgacggggcggaggtggtggaccaggcgagggagccgctgcggcaggctctggccgaggccggcgccgccaagttcttcccggcgccgtcggcagcctaggcggagcgatcggttccgttgaaggaggccgttaataatactgtacggatttaccagtagttaattagcggtctacaggttttggtattgtagacgatcatcatcaggtcatatcagtaccgtgcaaacattgtacagtacccccgttaactttgcaggttacctattttggtatttgggtttgtaaagagtacgtaattaattaaggtcggtctaaccatagatcttcctgctatgtacgtaccacatgcattttgaagccaattaaataataaatattttcctagtttgctttgatgttca

SEQ ID NO: 2296 - DNA, 1413 bp, Setaria italica
tcatcaagcacacacacacgcacagcaaattaagcaagcacgagagtgttctggagaggatctgaggaggaacagctagcatcacctgcgacgacgatcgacgatgggcccgaacatgtcggcgttcagcagcaagcagcaggcgtcggcgaagcggcgggcgtacgtgacgttccttgccggcgacggcgactactggaagggcgtggtgggtctggccaagggcctgcggaaggcgaggtcggcctaccccctggtggtggccgtgctccccgacgtccccgaggagcaccgccgcaagctgcgggagcagggctgcgtcgtccgcgagatccagccggtgtacccgccggagagccagacgcagttcgccatggcgtactacgtcatcaactactccaagctccggatctgggagttcgtggagtacgagcgcatggtgtacctcgacgcggacatccaggtgtacgagaacatcgaccacctgttcgacctggagaagggccggttctacgcggtgatggactgcttctgcgagaagacgtggagccacaccccgcagtacaagatcggctactgccagcagtgccccgacaaggtcacctggccggagcatgagctgggccctccgccgccgcgctacttcaacgccggcatgttcgtgcacgagccgagcctgggcacggccaaggacctcctggacgcgctggtggtgacgccgccgacgccgttcgcggagcaggacttcctcaacatgttcttccgcgacgtctacgagcccatcccgccggtgtacaacctggtgctggccatgctgtggaggcaccccgagaacgtgaagccgctcgacaaggtcaaggtcgtgcactactgcgcagcgggttccaagccttggaggtacacgggtgaggaggccaacatggaccgcgaggacatcaagatgctggtgagcaagtggtgggacatcttcaacgacgagagcctggactacaagggcccggcggtggacgacgacggggcggaggtggtggaccaggcgagggagccgctgcggcaggctctggccgaggccggcgccgccaagttcttcccggcgccgtcggcagcctaggcggagcgatcggttccgttgaaggaggccgttaataatactgtacggatttaccagtagttaattagcggtctacaggttttggtattgtagacgatcatcatcaggtcatatcagtaccgtgcaaacattgtacagtacccccgttaactttgcaggttacctattttggtatttgggtttgtaaagagtacgtaattaattaaggtcggtctaaccatagatcttcctgctatgtacgtaccacatgcattttgaagccaattaaataataaatattttcctagtttgctttgatgttc

SEQ ID NO: 2297 - DNA, 1789 bp, Panicum virgatum
gcgcgcgatggtggacgacaccaccacaccagaccggccggctgcctataaattaagagcacttgcccaggcatcatcgttcatcatcaagcacaacgtacgagagcgtaagagttttctggagagtagctagctagctagctagggatcggatcggaggaacacgtacccgggcaacacctagcctgcaatgtcgtcggcgtacagcagcaagcagcaggcggcggcgaagagagcgtacgtgacgttcctggccggcgacggcgactactggaagggcgtggtggggctggccaagggcctgcgccgggtgcgctcggcctacccgctggtggtggccgtgctccccgacgtgccggaggagcaccgccgcaagctgcgcgaccagggctgcgtcgtccgcgagatccagccggtgtacccgcccgacagccagacgcagttcgccatggcctactacgtcatcaactactcaaagctcaggatctgggagttcgtggagtacgagcgcatggtgtaccttgacgcggacatccaggtgttcgacaacatcgacgagctgttcgagctcgacaagggccgcttctacgcggtgatggactgcttctgcgagaagacgtggagccacaccccgcagtacaagatcggttactgccagcagtgcccggagcccgtggcctggccggccgcggagctcggccccccgccgccgctctacttcaacgccggcatgttcgtgcacgagcccagcctgggcacggccagggacctcctggacgcgctggtggcgacgccgccgacgcccttcgcggagcaggacttcctcaacgtgttcttccgggacgtgtacacgcccatcccgccggcgtacaacctggtgctggccatgctgtggaggcacccggacaagatgccggagctcggcaaggtcaaggtggtgcactactgcgccgcggggtccaagccttggaggtacacggggcaggagcccaacatggagcgcgacgacatcaagatgctggtcaccaagtggtgggacgtcttcaacgacgacaccctcgactacaagggcgacgagccgctgctgcaggctctggcggaggccggcgccgccaactacttcccggcgccctcggcagcctagctgctactagcatatggatctgatcggccgccggccaaattaattattatcattagggggtctgatctacatgcatacaggtttttggtattgtacatcatgcatgagtactacatacctagctaccaagtttaaaagtattcatcaggttatctatcgatcttttctttaattttgagtgtggtgaaaaactaaacaaggaaaaaaaaagaaggaaacaagagttgagtttgtacgtactgcgtgcattttgaaaccaattaataatagtataaatctttttttcatatatttatacttttggctcatgcatgcttgagcattattggtcagttctctttatttaatttcttgctgcttttatttgttgatgagttgatgagtaaataaattagacaccgtatcttatggaaaccaagctctctgtggaaactttggaaactttaaaggaggccactggatctccatctaagagcagcggagagaggtgagaaattttttcatctagccgcccgcctccccctcttcgttgactgctcattttgcaattagctccctccctcccgttcacggacgcgccgtccgcctccgttaccctctgtcacgagcgcacgggccgcgccgttcttcgtctcgccaaaacgc

SEQ ID NO: 2298 - DNA, 1655 bp, Panicum virgatum
ccagatggagactggagccgtacgtagcgatctccggcgccttcccgcgatttgatgaaatgatctttaatttgttcccctcccgtcctttgcatcggggccgtccgctcacccggctccgacacgcgtacggccaggattaggataggatcccacgcggcaaccggcagaaccggcgctggtggacacgaccagatatcgctgccggctgcgcgcgggatgcctactataaaaagcacggcgacctcgatcgcttgcccaggcatcatccatccatcgttcatcatcattcatcgatcaagcgcacgcacacacacaaccacaaccacaaccacaacgagagagtttaattagttttctggagaggaagctagctaagggatcggagggcgtacacgatgatgagcagcaagcagcagcagcagcagcagcagcaggcggcgccgaataataagcggcgggcgtacgtgacgttcctggccggcgacggcgactactggaagggcgtggtggggcttgccaagggcctgcgccgggtgcggtcggcctacccgctggtggtggccgtgctccccgacgtgccggaggagcaccgccgcaagctgcgcggccagggctgcgtcgtccgcgagatccagccggtgtacccgcccgagagccagacgcagttcgccatggcctactacgtcatcaactactcaaagctaagaatatgggagttggtggagtacgagcgcatggtgtaccttgacgctgacatccaggtgttggacaacatcgaccacctgttggacctggacaagggccgcttctacgcggtgatggactgcttctgcgagaagacgtggagccacaccccgcagtacaagatcggctactgccagcagtgcccggagcgcgtgccctggccggagcagcagctcggccccccgccgccgccctacttcaacgccggcatgttcgtgcacgagccgagcctgggcacggccaaggagctcctggacgcgctggtggcgacgccgccgacgcccttcgcggagcaggacttcctcaacatgttcttccgcgacgtgtacacgcccatcccgccggtctacaacctggtgctggccatgctgtggaggcaccccgacaaggtggagccgctcgccgaggtcaaggtggtgcactactgcgccgcggggtccaagccgtggaggttcacggggcaggagcccaacatggagcgccaggacatcaagatgctcgtcgccaggtggtgggacgtcttcaacgacgacagcctcgactacaagggcgacgacgccgaccagccgctgctgcgccaggctctggcggaggccggcgccgccaactacttcccggcgccctcggcggcctaataagtaggagtatatattattagggggtaccggtctggtccacatacagacatactttactacagggttttggtattttacatctagatcatgagtacgcgcgtagtgtactcgtctgaagtattgatctgcaggtttcgccaacaagctagtactgctccatcttttcttttgaaaaattgtggggaaaaacaagagttagtttgtacgacgacgtactgcatgcattttgaaaccaattatattaataataatataaatattttataattt

SEQ ID NO: 2299 - DNA, 2202 bp, Sorghum bicolor
ctcaccgcaggcaggcgcacacgcccgaagacacccgagggtttaaagccaactcctcttcacatctcgccgcgaccgcgaagccagctccccgacgcgatctgccgcgggaagatggcgactccgccgccgcccctccgccgcgccgctgcgcttctcctcgtcgtcctcgccggcgtcctcgcctccaccgcgcgcgccgatctcgtcatctccaaggcagatcggagggttgatctgacctcgcatatcgtccgcatcctcgcttcccttaaggttgaaaatgttggaccggaccctgtctctcaagttttactgtcttttcccaatatccaagccaagaacttggcagctattagagcattcggcagtgaaggaaaagtgaagggtcaaagtactattctgccaattgaagttgttcaaccttctggagctccaccggacctgacgttcttttcagcattgttgcccaaacctttggagaagggaaagactctgtacttggatgtcttgactgtgttcacacactctcttcaaccattcccagaagaaatcactcaagctgaagcacaacttgttgtctatcaggatagtgctcattacttgtcaccttaccctgttaaggcacagacacttgctatcagattgcctggcgggagggttgaatcatacacaaggcatccaaatgcaaaacttgtggattcagaactgaaatatggaccatttcatgatcttcccccgttttcctacttacctgtgattgttcattttgagaacaacaatccttttgcagtcgcaaaggaagttataagggagattgaaatatcccactgggggaatgtacagattacagaacactacaacattgcccatggtggtgccagactcaagggtgaattttccaggatcgattatcaatctagaccttacgtaaggggtgtttcatcttttaggcatcttattgcaaaactgcctccaagggcacactctatttattacagagatgagattggtaatatttcaacatcacatgtgtggagtgattctatgaagacccaactggaaattgaaccaaggtttccattgtttggtgggtggcaaacaaccttcactgttggttatggtttaccacttgaagactttgttttctattctgatggaaagagatttctcaatatcacatttggttctccattggaggaagttctcattgaaaagcttgttgtaaaggttgttctacctgaaggatcaaaggatatcgaagtttcagctccctttccaacacagcagcggcaagaggttaagtattcacaccttgacattgttggaaggccagttgttgtcttggagaaacctgatgttattccagagcataatttatatttccaggtttactacaaattcagcaacatatccttgctcacagagccgttgatgctgattactggtttcttcctcctgtttgtggcctgtattgtttacatgcgtactgatatgtcaatatccaagagctctccttcctacttggccaagctgcaatgggatgaggtgcaagccactgttcagaaaatccagggtatctttgagcaatgcttagcagttcatgataaactggaggcctcgttgcgtgatttgtctaggacaggagacattcagtcttgcaaggcagctcgtaaagctgctgacgcacagtttaaggagctatcaaaagatctgaagccgctgttgatgactctacagtcatctccccagtcttatcagatatggccaaaggtagaggacttgattgcaaaggagagagagatgcaggagaagctcatgacaaggcattccaccgttgtcgacagctttgagaagaagttgcgtgggcaagatgtagagaacaggattgctttgcagcagcagaaagttgccgcactgaggcaggaggttgaatctcttttagagtacattagtgagatttgagcaaatgagtggtgctgtggcgtgatacatctttagcgattagactgtctttgctgggtttatggtttaccccaatattgaaatctactacagagagattgtgtcggtaaccatcatgtttcccagttgaggactggaagttgcaatgaccatgtaacatgataatcactgtaatccttctgagctgactcaattttgcatttgataacaatatcacagggaacgtcatcatttgaa

SEQ ID NO: 2300 - DNA, 2485 bp, Saccharum officinarum
cgagggtttaaagcccaactcttcttcacatctcctccgcgaagacaatctccccgacgcgatctggccgcgggaagatggcgactccgccgccgcacctccgccgcatcgccgcgcttctcctcgtcgtcctcgccggcctcctcgcctccaccgcgcgcgccgatctcgtcatctccaaagcagatcggagggttgatctgacctcgcatatcgttcgcgtcctcgcttccctcaaggttgaaaatgttggaccggaccctgtctctcaagttttactggcttttcccaatatccaagccaagaacttggcagctattagagcattcggcagtgaaggaaaagtgaagggtcaaagtactgttctgccaattgaagttgttcaaccttctggagctcccccagagctgacgttcttttcagcattgttgcccaaacctttggaaaaggggaagactctgtacttggatgtcctgactgtgttcacgcactctcttcaaccattcccagaagaaatcactcaagccgaagcccagcttgttgtctatcaggatagtgctcactatctgtcaccttaccctgttaaggcacagacacttgctatcagattgcctggcgggagggttgaatcatacacaaggcatccaaacgcaaaacttgtggattcagaactgaaatatggaccatttcatgatctccccccgttttcctacttacctgtgattgtccattttgagaacaacaatccttttgcagtcgcaaaggaagttataagggagattgaaatatctcactggggaaatgtacagattacagaacactacaacattgcccatggtggtgccagactcaagggtgaattttccaggatcgattatcaatctagaccttacgtaaggggtgtttcatcttttaggcatcttattgcaaaactgcctccaagggcacactctatttattacagagatgagattggtaatatttcaacatcacatttgtggagtgattctatgaagacccaactggaaattgaaccaaggtttccattgtttggtgggtggcaaacaaccttcactgttggttatggtttgccacttaaagactttgttttctattctgatggaaagagatttctcaatatcacatttggttctccattggaggaaattctcattgaaaagcttattgtaaaggttgttctacctgaagggtcaaaggatatcgaagtttcagctccctttccaacacagcagcggcaagaggttaagtattcacaccttgacattgttggaaggccagttgttgtcttggagaaacctgatgttattccagagcataatttatatttccaggtttactacaaattcaacaacatatccttgctcagagagccattgatgctgattagtggtttcttcctcctgtttgtggcctgtattggttacatgcgtactgatatgtcaatatccaagagctctccttcctacttggccaagctgcaatgggatgaggtgcaagccactgttcagaaaatccagggtatctttgagcaatgcttagcagttcatgataaactggaggcctcgttgcgtgatttgtctaggacaggagacattcagtcttgcaaggcagctcgtaaagctgctgacgcacagtttaaggagctatcgaaagatctgaagccgctgttgacgactctacagtcatcttcccagtcttatcagatatggccaaaggtagaggacttgattgcaaaggagagagagatgcaggagaagctcatgacaaggcattccaccgttgtcgacagctttgagaggaagctgcgtgggcaagatatagagaacaggattgctttgcagcagcagaaaattgctgctctgaggcaggaggttgaatctcttttagagtacattagtgagatttgaacaaatgagtgctgctgtggcgtgatacatctttagcgattagactgtctttgctgggtttatggtttaccccaatattgaaatctactacactgagattgtgtcggtaaccatctagtttcccagttgaggactggaagttgcaatgaccatgtaacatgataatcactgtaatccttctgagctgactaaattttgcatttgataacaatatcacaggaaaccttcatcttaaaaaagaaaataaatagtttggctggttcgtgtggctgtctctgtggctcgtgctcgtggttgatccggtccgtctgtgttctttctgcggttttcatctctggtctgggggttgtcatcgcatgttatgctagtttcctccgtctctgtggtggagggatatgtgcgatagtgctcaatagcttgtaatgtctagcacggggatggagtgcatgcgtgggcagtggttatcgatagtgtttgaatagaaataggctggtattggatggtttagcttaagggccgtcgacgcgatagggtacggacagggttagcgttaagtt

SEQ ID NO: 2301 - DNA, 2086 bp, Echinochloa colona
gccgcgaagccagactccccgacgcgatctggccgcgggaagatggccccgactccgccgcccctccgccgcgccaccgccctcctcctcgcggtcctcgtcggcgtcctcgcctccaccgcgcgcgccgatctcgtcatctccaaggcagatcggagggttgatctgacttcgcatatcgttcgcgtcctcgcttccctcaaggttgaaaatgttggaccagaccctgtctctcaagttttactatcttttcccaatatccaagcgaagaacttagcagctataagagcatttggtactgaaggaaaagtgaagggtccaagtactgttctgccaattgaagttgttcagccttctggagctcccccagagctaacattcttttcagcattgttacccaaacctttggaaaagggaaagactctgcacttggatgtcctgactgtattcacgcactctcttcaaccattcccagaagaaatcactcaagctgaagcacaacttgttgtatatcaggatagtgctcattatctgtcaccttaccctgtcaaggtacagacacttgctatcagattgcccggtggaagggttgaatcatacacaaggcatccaagcgcaaaacttgtggattcagaactgaaatatggatcatttgaagatcttcccccattttcctacttacctgtgattgtgcactttgagaacaacaatccttttgcagttgcaaaggaagttataagggagattgagatatctcactggggaaatgtacagattacggaacactacaacattgcccacggtggtgccagactcaagggtgaattttccaggattgattatcagtctaggccttacgtaagaggtgtttcatcttttaggaatcttattgcgagactgcctccaagggcccactctatttattacagagatgagattggtaatatttcgacatcgcatctgtggagtgattctaagaagacccaactggaaattgaaccaaggtttccattgtttggtgggtggcaaacaaccttcactgttggctatggtttaccacttcaagactttgtcttctattctgatggaaagaggtttctcaatatcacatttggttctccacttgaggaaattctcattgaaaagcttatcgtaaaggttgttctacctgaagggtcgaaggatatcgaagtttcagctccctttccaacaaagcagtggcaagaggtgaagtattcacaccttgacattgttggaagaccagttgttgtcttggagaagcctgatgttattccagagcataatttgcatttccaggtttactacaaattcaacaatatatccttgctccgagagccgttgatgcttattactggtttcttcctcctgtttgtggcctgtattgtttacatgcgcactgatatgtcaatttccaagagctctccttcttacttggctaagctgcaatgggatgaggtgcaagccactgttcagaaaatccagggtatctttgagcaatgcttagcagttcatgataaactggaggcctcattgcgtgatttgtccaggaccggggacattcaatcttgcaaggctgctcgtaaagctgctgatgcacagtttaaggagctatccaaagagctgaagccattgttgacatctctacagtcatctccccagtcttatcagatatggccaaaggtagaggacttgatcacaaaggagagggagatgcaggagaagctcatgacaaggcattccactgttgtcgacagctttgagaagaaactgcgtgggcaagatgtagagaacaggatcgctttgcagcaacagaaaattgctgccctgagacaggaggtcgaatctcttttagagtacattagtgaaatttgagcaaacctgcgcctagcggttagactgcctttgctgggtttacccgtgttgaaatctggtacactgagattgtgtcggtaaccatccagtttcccagtcgaggcctggaaatcgcaatgaccttgtaacatgagaatcactgtaatcgttctggagctgactaaattttgcatttgataacaatatcacaggg

SEQ ID NO: 2302 - DNA, 2152 bp, Setaria italica
cacctctccctcgatctggccgggaagccaaactccccgacgcgatctggccgcgggaagatggcgactccgctgccgcctctccgccgcgccaccaccaccctcctcctcgtcgtcctcgtcgccgtcctcgcctccaccgcccgcgccgatctcgtcatctccaaggcagatcgcagggttgatctgacttcgcatatcgttcgcgtcctcgcttccctcaaggtcgaaaatgttggaccggaccctgtctctcaagttttactatcctttcccaatatccaagcgaagaacttagcagctataagagcatttggaactgaaggaaaagtgaagggtccaagtactattctgccaattgaagttgttgagccttctggagctcccccagagctaacattcttttctgcattgttacccaaacctttgggaaagggaaagactctacacttggatgtcctgactgtattcacacactctcttcaaccctttccagaagaaatcactcaagctgaagcacaacttgttgtctatcaggatagtgctcactatctatcgccttaccctgttaaggtacagacacttactatcagattgcctggtggaagggttgaatcatacacaaggcatccaagcgcaaaacttgtggattcagaactgaaatatggacaatttgaagatcttcccccgttttcctacttgcctgtgatcgtgcactttgagaacaacaatccttttgcagtcgcgaaggaagttataagggagattgagatatctcactggggaaatgtacagattactgaacactacaacattgcccatggtggtgccaaactcaagggtgaattttccaggatcgattatcagtctagaccttacgtaagaggtgtttcatcttttaggaatcttattgcgagactgcctccaagggcccactctatttattacagagatgagatcggtaatatttcgacatcacatttgtggagtgattctaagaagacccatctggaaattgaaccaaggtttccattgtttggtgggtggcaaacaacctttactgttggttatggtttaccgcttcaagactttgttttctattctgatggaaagaggtttctcaatatcacatttggttctccaatggaggaaattctcattgaaaagcttatcgttaaggttgttctacctgaagggtcaaaggatatcgaagtttcagctccctttccaacaaagcagtggcaggaggtgaagtattcacaccttgacattgttggaaggccagttgttgtcttggagaagcctgatgttattccagagcataatttgtatttccaggtttactacaaattcaacaatatatccttgctccgagagccgttgatgcttattactggtttcttcctcctgtttgtggcctgcattgtttacatgcgcactgatatgtcaatttccaagagctctccttcttacttggccaagctacaatgggatgaggtgcaagccactgttcagaaaatccagggtctctttgagcaatgcttggcagttcatgataaactggaggcctcattgcgtgatttgtcaaggactggggacgtccagtcttgcaaggctgctcgtaaagctgctgatgcacagtttaaggagctatggaaagagctgaagccattgttgacatctctacagtcatctccccagtcttatcagatatggccaaaggtagaggacttgatcacaaaggagagagagatgcaggagaaactcatgacaaggcattccaccgttgtcgacagctttgagaagaagctgcgtgggcaagatgtagagaacaggattgctttgcagcagcagaaaattgctgccctgaggcaggaggtcgaatctcttctagagtacattagtgagatttgagcaaatctgcgccatagcgattagactgttttgctgggttcatcccgatgttgaaatctagtactctgagattgtgtcggtaaccatccagtttcccagttgagtcctggaaattgcaatgaccatgtaacatgataatcactgtaatcattctggagctgactaaattttgcatttgatagcaatatcacagggaaccttcatcttttggactgaacccattgttttccaagtttta

SEQ ID NO: 2303 - DNA, 2131 bp, Setaria italica
cacctctccctcgatctggccgggaagccaaactccccgacgcgatctggccgcgggaagatggcgactccgctgccgcctctccgccgcgccaccaccaccctcctcctcgtcgtcctcgtcgccgtcctcgcctccaccgcccgcgccgatctcgtcatctccaaggcagatcgcagggttgatctgacttcgcatatcgttcgcgtcctcgcttccctcaaggtcgaaaatgttggaccggaccctgtctctcaagttttactatcctttcccaatatccaagcgaagaacttagcagctataagagcatttggaactgaaggaaaagtgaagggtccaagtactattctgccaattgaagttgttgagccttctggagctcccccagagctaacattcttttctgcattgttacccaaacctttgggaaagggaaagactctacacttggatgtcctgactgtattcacacactctcttcaaccctttccagaagaaatcactcaagctgaagcacaacttgttgtctatcaggatagtgctcactatctatcgccttaccctgttaaggtacagacacttactatcagattgcctggtggaagggttgaatcatacacaaggcatccaagcgcaaaacttgtggattcagaactgaaatatggacaatttgaagatcttcccccgttttcctacttgcctgtgatcgtgcactttgagaacaacaatccttttgcagtcgcgaaggaagttataagggagattgagatatctcactggggaaatgtacagattactgaacactacaacattgcccatggtggtgccaaactcaagggtgaattttccaggatcgattatcagtctagaccttacgtaagaggtgtttcatcttttaggaatcttattgcgagactgcctccaagggcccactctatttattacagagatgagatcggtaatatttcgacatcacatttgtggagtgattctaagaagacccatctggaaattgaaccaaggtttccattgtttggtgggtggcaaacaacctttactgttggttatggtttaccgcttcaagactttgttttctattctgatggaaagaggtttctcaatatcacatttggttctccaatggaggaaattctcattgaaaagcttatcgttaaggttgttctacctgaagggtcaaaggatatcgaagtttcagctccctttccaacaaagcagtggcaggaggtgaagtattcacaccttgacattgttggaaggccagttgttgtcttggagaagcctgatgttattccagagcataatttgtatttccaggtttactacaaattcaacaatatatccttgctccgagagccgttgatgcttattactggtttcttcctcctgtttgtggcctgcattgtttacatgcgcactgatatgtcaatttccaagagctctccttcttacttggccaagctacaatgggatgaggtgcaagccactgttcagaaaatccagggtctctttgagcaatgcttggcagttcatgataaactggaggcctcattgcgtgatttgtcaaggactggggacgtccagtcttgcaaggctgctcgtaaagctgctgatgcacagtttaaggagctatggaaagagctgaagccattgttgacatctctacagtcatctccccagtcttatcagatatggccaaaggtagaggacttgatcacaaaggagagagagatgcaggagaaactcatgacaaggcattccaccgttgtcgacagctttgagaagaagctgcgtgggcaagatgtagagaacaggattgctttgcagcagcagaaaattgctgccctgaggcaggaggtcgaatctcttctagagtacattagtgagatttgagcaaatctgcgccatagcgattagactgttttgctgggttcatcccgatgttgaaatctagtactctgagattgtgtcggtaaccatccagtttcccagttgagtcctggaaattgcaatgaccatgtaacatgataatcactgtaatcattctggagctgactaaattttgcatttgatagcaatatcacagggaaccttcatcttttggactgaa

SEQ ID NO: 2304 - DNA, 2201 bp, Pennisetum glaucum
ccagaccctgtcttggcaggcaggcgcacgcgcacccgagggttttaagcgcctcctcctcgatctggccgcgacgcgatctggcggccgtgggaagatgatggcgactccgctgccgcctctccgccgcgccacagccacagccactctcctccccttcctcctcctcgccgccgtcctcgcctcaacggcccgcgccgacctcgtcatctccaaggcagatcgaagggttgatctgacttcgcatatcgtccgcgtcctcgcttccctcaaggttgaaaatgtcggaccagaccctgtctctcaagttttactatccttccccaatatccaagcgaagaacttagcagctataagagcatttggtactgaaggaaaagtgaagggtccaagtactgttctgccaattgaagttgttgagccttctggagctcccccagagttaacattcttctcagcattgttacccaaacctctgggaaagggaaagactctacacctggatgtccttactgtatttacacattctcttcaaccctttccagaagaaatcactcaagctgaagcgcaacttgttgtctatcaggatagtgctcactatctatcaccttaccctgttaaggtacagactcttactatcagattgcctggcggaagggttgaatcatatacaaggcatccaggcgcaaaacttgtggattcagaacttaaatatggacaattcgaagatcttcctccgttttcctacttgcctgtgatagtgcactttgagaacaacaatccttttgcagttgcaaaggaagttataagggagattgagatatctcactggggaaatgtacagattactgaacactacaacattgcccatggcggtgccaaactcaagggtgaattttccaggattgattatcagtctagaccttacgtaagaggtgtttcatcttttaggaatcttattgcgagactgcctccaagggcccactctatttattacagagatgaaatcggtaatatttcgacatcacatttgtggagtgattctaagaagacccatctggaaattgaaccaaggtttccattgtttggtgggtggcaaacaacctttactgttggttatggtttaccacttcaagactttgttttctattctgatggaaagaggtttctcaatatcacatttggttctccaatggaggaaattctaattgaaaagcttattgttaaggttgtcctacctgaagggtcaaaggatatagaagtttcagctccctttccaacaaagcagtggcaagaggtgaagtattcacaccttgacattgttggaaggccagttgttgtcttggagaagcctgatgttatcccagagcataatttgtatttccaggtttactacaaattcaacaatatatccttgctccgagagccgttgatgcttattaccggtttcttcctcctgtttgtggcctgcattgcttacatgcgaactgatatgtcaatttccaagagctctccatcttacttggcgaagctgcaatgggatgaggtgcaagccactgcacagaaaatccaggctctctttgagcaatgcttggctgttcatgataaactggaggcctcattgcgtgatttgtcaaggactggggatgtccagtcttgcaaggctgctcgtaaagctgctgatgcacagtttaaggagctatcaaaagagctgaagccattgttgacatctctacagtcgtctccccagtcttatcagatatggccaaaggtagaggacttgatcgcaaaggagagagagatgcaggagaagctcatgacaaggcattccactgtcgtcgacagctttgagaagaagttgcgtgggcaagatgtagagaacaggattgctttgcagcagcagaaaattgctgccctgaggcaggaggtcgaatctcttctcgagtacattagtgagatttgagcaaatctgcaccgtagcgattagactgctttgctgggctcattccaatgttgaaatctagtacactgagattgtgtcggtaaccaccttttcccagttgaatcctcgaaattgcaatgaccaatgtaacatgataaccactgtaatcattctggagctgactgaattttgcatttgatagcaatatcacagggaattttttacaaaaaaaaaaaaaaaaaaagtaaaaacgttaact

SEQ ID NO: 2305 - DNA, 2153 bp, Brachypodium distachyon
gcaaccccccatccatctcgccgcgaagccgcccaacacacacctccgcggcgcgatctggccgccgaggatggcgccgccgccccgcctcgccgcgctcctcctcctactcctcgccggcgcctccgcctccgccgtacgcgccgatctggtcatctccagggcagatcgcaaggttgatttgacttctcacatcgtccgcgtcctcacttcgctcaaggttgaaaatgtcgtgtcagagcctgtttctaaagtcttgctggcttttcccaatattcaagcaaagaacttggcagcgataagagcatttggtaccgagggaaaagtgaagggtccaagtgttgttcttccgattgaaactgttcaaccttctggagttcccccagaactaacgttcttttcagtatctttacacaaacctttgcaaaaggggaagatccttcacttagatgtcttgactgtatttacacactctctccaaccattcccagaagagatcacccaagccgaatcgcagcttgttgtatttcaggatagctctcactatctgtcaccttaccctgttaaggtccagacactcagtatcagattgcctggtggaagggttgaatcatacacaaagtatgcaaatacaaaacttgtggattctgagctaaaatatggaccgtttgaagaccttcccccattttcctactcccctgttattgtccactttgagaacaacaacccatttgcagttgcaaaggaacttgttagggagatagagatatcccactgggggaatgtacagattactgaacattacaacattgctcatggtggtgccagacttaagggcgaattctccaggattgactaccaatctagaccatatgtgagaggggtttcgtcatttaggcatcttattgctagattgcctccaacggcccactctatttgttacagggatgaaatcggtaacatttcgacgtcacacttgtggagtgattctaagaagacccaactcgaaattgaacccaggtttccattgtttggtggttggcaaacaacctttaccattggttatggtttacctcttcaagattttgttttcacttctgatggaaagcgatttctcaatatcacatttggttctccagtggaagagattctcatagaaaagcttattgtaaaggttgttctacccgaaggttcaaaggatattgatgtttcagttccatttccaacaaagcaatggcaagaggtgaagtactcacatcttgacattgctggacgaccagtgcttgtcttggagaaacctgatgttattccagagcataatttacacttccaggtgtattacaaattcagtaacatctcgctgcttattgagccgatgatgttgattactggcttcttcctcctgtttgttgcctgtattgcctacatgcacactgacatgtcaatttctaagaactctccttcttatctggcaaagctgcaatgggacgaggtgcaagccactgttcagcaaatccagagcatctttggccaatgcttagcagttcacgataaactagaggtctcattgcatgatttgtctaggaccggagacactaaatcttgcaaagcagctcgtaaagctgccgatgcacagtttaaggaactagcgaaagagctgaagccactgttgatatctctacaatcatcaactcagtcttatcagatatggccaaaggtagaggacttggttgcaaaggagagagagatgcaggagaagctcatggcaaggcattccactgtggttgacagctttgagaagaagctgcgcgggcaagatatagagaacaggattgcttcccagcagcagaaaattactgtgctgaggcaagaggtcgaatctcttttagagtaccttagtgagatatgaggaagtccagtgccaccttatatcattagtgattagaccaaagattgtcttctttggtttcatagtttcttgagttttatatgttgaaagcctgaatgctccgagatgctgttgttggttacccgtcatcctagttcttgagactggaaattaagaaggattgtgtaggatgataagcactgtaatcattctggaactgaaagaaattttgaatttgataacaaaaaacatggggaaccttatc

SEQ ID NO: 2306 - DNA, 2158 bp, Brachypodium distachyon
tgcaaccccccatccatctcgccgcgaagccgcccaacacacacctccgcggcgcgatctggccgccgaggatggcgccgccgccccgcctcgccgcgctcctcctcctactcctcgccggcgcctccgcctccgccgtacgcgccgatctggtcatctccagggcagatcgcaaggttgatttgacttctcacatcgtccgcgtcctcacttcgctcaaggttgaaaatgtcgtgtcagagcctgtttctaaagtcttgctggcttttcccaatattcaagcaaagaacttggcagcgataagagcatttggtaccgagggaaaagtgaagggtccaagtgttgttcttccgattgaaactgttcaaccttctggagttcccccagaactaacgttcttttcagtatctttacacaaacctttgcaaaaggggaagatccttcacttagatgtcttgactgtatttacacactctctccaaccattcccagaagagatcacccaagccgaatcgcagcttgttgtatttcaggatagctctcactatctgtcaccttaccctgttaaggtccagacactcagtatcagattgcctggtggaagggttgaatcatacacaaagtatgcaaatacaaaacttgtggattctgagctaaaatatggaccgtttgaagaccttcccccattttcctactcccctgttattgtccactttgagaacaacaacccatttgcagttgcaaaggaacttgttagggagatagagatatcccactgggggaatgtacagattactgaacattacaacattgctcatggtggtgccagacttaagggcgaattctccaggattgactaccaatctagaccatatgtgagaggggtttcgtcatttaggcatcttattgctagattgcctccaacggcccactctatttgttacagggatgaaatcggtaacatttcgacgtcacacttgtggagtgattctaagaagacccaactcgaaattgaacccaggtttccattgtttggtggttggcaaacaacctttaccattggttatggtttacctcttcaagattttgttttcacttctgatggaaagcgatttctcaatatcacatttggttctccagtggaagagattctcatagaaaagcttattgtaaaggttgttctacccgaaggttcaaaggatattgatgtttcagttccatttccaacaaagcaatggcaagaggtgaagtactcacatcttgacattgctggacgaccagtgcttgtcttggagaaacctgatgttattccagagcataatttacacttccaggtgtattacaaattcagtaacatctcgctgcttattgagccgatgatgttgattactggcttcttcctcctgtttgttgcctgtattgcctacatgcacactgacatgtcaatttctaagaactctccttcttatctggcaaagctgcaatgggacgaggtgcaagccactgttcagcaaatccagagcatctttggccaatgcttagcagttcacgataaactagaggtctcattgcatgatttgtctaggaccggagacactaaatcttgcaaagcagctcgtaaagctgccgatgcacagtttaaggaactagcgaaagagctgaagccactgttgatatctctacaatcatcaactcagtcttatcagatatggccaaaggtagaggacttggttgcaaaggagagagagatgcaggagaagctcatggcaaggcattccactgtggttgacagctttgagaagaagctgcgcgggcaagatatagagaacaggattgcttcccagcagcagaaaattactgtgctgaggcaagaggtcgaatctcttttagagtaccttagtgagatatgaggaagtccagtgccaccttatatcattagtgattagaccaaagattgtcttctttggtttcatagtttcttgagttttatatgttgaaagcctgaatgctccgagatgctgttgttggttacccgtcatcctagttcttgagactggaaattaagaaggattgtgtaggatgataagcactgtaatcattctggaactgaaagaaattttgaatttgataacaaaaaacatggggaaccttatcgtct

SEQ ID NO: 2307 - DNA, 2041 bp, Avena sativa
ggggtttaaagcgctaattcctccggtccaccccgcatctcgccgcgaaaccacaccgagcgactcgatctggccgccgaacatggcgccgccgctccgcctcgccgcgctcctccttgtcatcgtcgcagtcttcgcctcctccgcgcgcgccgatctcgtcatctccagggcggatcggaaggttgatctgacttcgcatatcgtccgcgtcctcagttcgctcaaggttgaaaatgccgggtcagaacctgcatctaaagtcttggtggcttttcccaatatccaagcaaaaaacttggcagcgatacgagcatttggcactgagggaaaagtgaagggcctgagctctgttcttccgattgaagttgttgagccttctggagcgccaccagaactgacattcttttcagtatctttacaaaaacctttggagaaggggaggattcttcacttagatgtcttgactgtgtttacgcactctctccaaccattcccagaagaaatcacccaagccgattcgcagcttgttgtcttccaggatagctcttactatctttcaccttaccctgttaaggttcagacacttagtatcagattgcctggtggaagggttgaatcgtacacaaagcatgcaaacactaaacttgtggattccgagctaaaatatggaccgtttgaagatcttcccccattctcctacaaccctattattgtgcactttgagaacaataacccatttgcagttgcaaaggaacttatacgggagatagaaatttcccactgggggaatgtacaaattacagaacattacaccattgttcatggtggtgccagactgaagggtgaattctccaggcttgactaccaatctagaccttacgtaagaggggtttcgtcatttaggcatcttattgctaaattgcctccaagggcccactctatttattacagagatgaaattggtaatatttcaacatcgcacttgtggagtgattctaagaagacccaactggaaattgaaccgaggtttcccttgtttggtggttggcaaacaacctttactgttggttatggtttacctcttcaagacttcgttttcagttctgatggaaggagatatctcaatatcacatttggttctccagtagaggagattctcatagaaaagcttatcgtcaaggtgattttacctgaaggttcaaaggatattgatgtttcagccccatttccaacaaagcaatggcaagaggtgaagtattcgcaccttgacattgttggaaggccagtgattgtcttggagaagcctgatgtcattccagagcataatttacatttccaggtgtactacaaattcagtaacatctccctgctcatagagccgatgatgttgattactggcttcttccttctgtttgttgcttgtattgcctacatgcacactgacatgtcaatctctaagaactctccttcgtatctggcgaagctacaatgggatgaggtgcaagccactatccagcaaatccagggtatctttgaccagtgcttagcagttcacgacaagctagagacctcactgcacgatttgtctaggacaggagacactaaatcttgcaaagcagctcgtaaagctgctgatgcacagtttaaggaattagcgaaagagctgaagccactgttgacttctgtacagtcatcccctcagtcttatcagatatggccaaaggtagaggagttggttgcaaaggagagggagatgcaggagaagctcatggcaagacattccacagtggttgacagtttcgagaagaagctgcgtgggcaagatatagagaaccggattgcttcccagcaacagaaaattggtgcgttgagacaagaggtcgaatccctactagagtacctcagcgagatatgagcagacccggtgccatattataccattagtgcttagaactgaatatcacctaagctttattttgttgaaaccttagatcttgtgttcggtaaatggtacatctacatagttggtgacactttg

SEQ ID NO: 2308 - DNA, 2034 bp, Avena sativa
cgtctaccgagcccaaggagggtttaaagcgctaattcctcaggtccaccccgcatctcgtcgctaaacaacaccgagcgacgcgatctggccgccgagcatggcgccaccgctccgcctcgccgccctcctcctggtcatcgtcgcagtcttcgcctcctccgcgcgcgccgatctcgtcatctcaagggcggatcggaaggttgacctgacttcgcatatcgtccgcgtcctcagttcgctcaaggttgaaaatgctgggtcagaacctgcatctaaagtcttggtggcttttcccaatatccaagcaaaaaacttggcagcgatacgagcatttggcactgagggaaaagtgaagggcctgagctccgttcttccgattgaagttgttgagccttctggagcgcccccagaactgacattcttttcagtatctttacacaaacctttggagaaggggaggattcttcacttagatgtcttgactgtgtttacgcattctctccaaccattcccggaagaaatcacccaagccgattcgcagcttgttgtctttcaggatagctcttactatctgtcaccttaccctgttaaggttcagacacttagtatcagattgcctggtggaagggttgaatcatacacaaagcatgcaaacactaaactcgtggagtccgagctaaaatatggaccgtttgaagatcttcccccattctcctacaaccctattattgtgcactttgagaacaataacccatttgcagttgcaaaggaacttatacgggagatagagatttcccactgggggaatgtacaaattacagaacattacaccattgttcatggtggtgccagactgaagggtgaattctccaggcttgactaccaatctagaccttacgtaagaggggtttcgtcatttaggcatcttattgctaaattgcctccaagggcccactctatttattacagagatgaaattggtaatatttcaacatcacacttgtggagtgattctaagaagacccaactggaaattgaaccgaggtttcccttgtttggtggttggcaaacaacctttactgttggttatggtttacctcttcaagacttcgttttcagttctgatggaaggagatatctcaatatcacatttggttctccagtagaggagattctcatagaaaagcttatcgtcaaggtgattttacctgaaggttcaaaggatattgatgtttcagccccatttccaacaaagcaatggcaagaggtgaagtattcgcaccttgacattgttggaaggccagtgattgtcttggagaagcctgatgtcattccagagcataatttacatttccaggtgtactacaaattcagtaacatctccctgttcatagagccgatgatgttgattactggcttcttccttctgtttgttgcttgtattgcctacatgcacactgacatgtcaatctctaagaactctccttcgtatctggcaaagctacaatgggatgaggtgcaagccactatccagcaaatccagggtatctttgaccagtgtttagcagttcacgataagctagagacctcgctgcacgatttgtccaggacaggagacactaaatcttgcaaagcagctcgtaaagctgctgatgcacagtttaaggaattagcgaaagagctgaagccactgttgacttctgtacagtcatcccctcagtcttatcagatatggccaaaggtagaggacttggttgcaaaggagagggagatgcaggagaagctcatggcaagacattccacagtggttgacagtttcgagaagaagctgcgtgggcaagatatagagaaccggattgcttcccagcaacagaaaattggtgcgttgagacaagaggtcgaatccctactagagtaccttagcgagatatgagcaaatccggtgccaccttataccattagtgcttagactgaatatcacctaagctttattttgtcgaaaccttagatcttgtgtttggtaaatggtac

SEQ ID NO: 2309 - DNA, 2176 bp, Oryza sativa
aggaagggtttaaagcgcttcttcactcgatctcgccgcgagagacccaccgatctgccctccgccccccaacatggcgacgccaccgccgctccgccgcgtcgccgccctcctcctcctcctcgtcgccgccgcctccacccccaccgcacgggccgatctcgtcgtcaccagggcggatcggaaggttgacctgacttcgcacatcgttcgtgtcctcacttcgctcaaggttgagaatagtggaccggaggctgtttctcaatttctactggcgtttcccaatgtccaagcaaagaacttagcagctataagagcatttggtactgaggaaaaggtgaaaggtccaagtatggtccttccgattgaagttgttcagccttctggagtgcccccagaacttacattcttttcggcatctttatccaaacctttggagaaggggaagactcttcacttagatgtcctgaccgtatttacgcactctgtccagccattccccgaagaaatcacacaagctgaatcgcagcttgttgtctatcaggacagtgctcagtatctgtcaccttaccctgttaaggtacagacacttagtatcagattgcctggtggaagagttgagtcctacacaaagtacccaaacacaaaacttgcagagtcagaactaaaatatggaccatatgaagatcttccaccgttttcctactcccctatggttgtgcactatgagaacaataacccttttgcagttgcaaaggaagttataagggagatagagatatctcactgggggaatgtacagattacagaacattacaacattgctcatggtggtgccaaactcaagggtgaattttccaggattgattaccaatctagaccgtacataagaggggtctcatcttttaggcatcttattgctagactgcctccaagggcacattctatatactacagagatgagattggtaacatttcaacatcacatttatggagtgattccaagaagactcaacttgaagttgagccaaggtttcctttgtttggtggttggcaaacgacctttaccattggttatggtttacctcttcaagactttgttttcaattctgatggaaagagattcctcaatatcacatttggttctccagtggaggagattctcatagaaaagcttattgtgaaggttgttctgcctgaaggttcaaaggatattgatatttcagttccatttccaacaaagcaagagcaagaggtgaagtattcacaccttgatatttctggaaggccagtggttgtcttggagaagcttgatgttattccagagcataatctatatttccaggtttactacaggttcaacaacatctctctactcagagaaccgatgatgttgataactggcttctttctcctcttcatggcctgtattgtttacatgcgcactgacatgtcaatctctaagaattctccttcttatctggcaaaggtgcagtgggatgaggtacagagcatcatccagcaaatccaggctatcttcaaccaatgtctagcagctcatgataaactggagacctcattacacgagttatctaggtcaggagatgttaaatcatgcaaagtggctcgtaagacagctgatgcacagtttaaggaattagcaaaagagttgaagccattgttgacatccctgcagtcatcctctcagtcttaccagatatggccaaaggtagaggaattggttgccaaggagagagagttgcaggataagctcatgacaaggcattccactgtggttgacagctttgaaaagaagttgcgagggcaagatgtggagaacaggattgctgcccagcagcagaaagttgctgccctgaggcaagaggtcgaatctcttttagagtacatcagtgagatctgagcgaatccggcgctgcatggtatgtcaatttagcaattagactggagaatggatcacctggtttctcattgtgcgaatttgatatgctcgaattcgaatcaaatactcgtagatttcctgttgataacctgtctcagtcattcaggctgggagtttcaaaggaccttgtaacatgataagcacttgtgaccgcctgaaactgattgaaattttgcacttaatagcaaatcacgcgacctttcaccttgtttcata

SEQ ID NO: 2310 - DNA, 2033 bp, Festuca arundinacea
ccgcgcgcgccgatctcgtcatctccaaggcggatcggaaggttgatttgacttcgcatatcgtccgcatcctcacttcgctcaaggttgaaaatgtcgggtcagaacctgtctcaaacgttttgctggcattccccaatatccaagcaaaaaacctggcagcgatacgggcgtttggtactgaaggaaaagtgaagggtctgagcaccattgttccgattgaagttgttcagccttctggagcgcctccagaactgacattcttttcagcatctttacacaaagctttggagaaggggaggattcttcacttagatgtcttgactgtgttcacgcactctctccagccattcccagaagaaatcagccaagccgattcacagcttgttgtcttccaggatagctctcactacctgtcaccttaccctgttaaggttcagacacttagtatcagattgcctggtggaagggttgaatcgtacacaaagcatgcaaacactaaacttgtggattccgagctgaaatatggaccatttgaagatcttgccccgttctcctacaaccccataattgtgcactttgagaacaacaacccatttgcagtcgcaaaggaacttataagggagatagagatatctcactgggggaacgtacagattacagagcattacaacattgttcatggtggtgccagactgaagggtgaattctccaggcttgactaccagtctagaccttacgtaagaggggtttcatcatttaggcatcttgttgctaaattgcctccaagggcccactctatttatttcagagatgaaatcggtaacatttcaacctcacacttatggagtgatgctaagaagacccagctggaaatcgaaccaaggtttcccttgtttggtggttggcaaacaacctttaccatcggttatggtttacctcttcaagactttgttttcagttctgatggaaagagatttctcaatatcacatttggttctcccatggaggaaattctcatagaaaagcttatcgtaaaggttgttctacctgaaggttcaaaggatattgatgtgtcggctccatttccaacaaaccaacggcaagaggtgaagtattcacaccttgatattgctgggaggccagtgcttgtcttggagaaacccgatgtcattccagagcataacttacatttccaggtgtactacaaattcaataacatctcgctactcatagagccgatgatgttgattattggcttcttcctcctgttcgttgcctgtattgcttacatgcacactgacatgtcaatttctaaaagctctccttcttatctggcaaagctgcaatgggatgaggtgcaagctactgtccagcaaattcagggcatctttgaccagtgcttagcagttcatgataaactagagacctcattgcacgatttgtctaggacaggagatactaagtcttgcaaagcagctcgtaaagctgctgatgcacagttcaaggaattagcaaaagagctgaaaccactgttgatgtctgtacagtcgtcccctcagtcttatcagatatggccaaagttggaggacttggttgcaaaggagagggagatgcaggataagctcatggcaaggcattccaccgtggttgacagtttcgagaagaagctgcgtgggcaagatatagaaaaccggattgcttcccagcagcagaaaattgctgcgctgaggcaagaggttgagtctctcttagagtaccttagcgagatatgagcaaatctggtgccatcttatatcattagtgattagtctgaataccatctaagctttattttggtgaaactatatgtactcttagatgttgtgtttggtaaatggtaacctttcatcctagttcgtgagacttggatttgaaaaggccatgtaacatgatgagcacggtaacctttttggaactgctttaaattttgcatcatgaaatattctgggggaaccggtccctttggactccaaaaaaaaaaaaaaaaaaaa

SEQ ID NO: 2311 - DNA, 2011 bp, Lolium multiflorum
gcgcgccgatctcgtcatctccagggcggatcggaaggttgatttgacttcgcatatcgtccgcatcctcacttcgctcaaggttgaaaatgtcgggtcagaacccgtctcaaacgttttgctggcattccccaacatccaagcgaaaaacctggcagcgatacgtgcgttcggtaccgaggggaaagtgaagggtctgagcaccattgttccgatcgaagttgttcagccatctggagcgcctccggaactgacattcttttcagcgtctttgcacaaagctttggagaaggggaggattcttcacttggatgtcctgactgtgttcacgcactctctccagccgttcccagaagaaatcggccaggccgattcgcagcttgttgtcttccaggacagctctcactacctgtcgccttaccctgttaaggtgcagacacttagcatcagattgcctggtggaagggttgagtcgtacacaaagcatgcaaacactaaacttgtggactccgagctgaaatatggaccatacgaagatcttgccccgttctcctacaaccccatgattgtgcactttgagaacaacaacccatttgcagtcgcaaaggaacttgtaagggagatagagatatctcactgggggaacgtacagattacagagcattacaacattgttcatggtggtgccagactgaagggtgaattctccaggcttgactaccagtctagaccttacgtaagaggggtttcatcatttaggcatcttgttgctaaattgcctccaagggcccactctatttatttcagagatgaaatcggtaacatttcaacatcacacttgtggagtgatgctaagaagacccagctggaaatcgagccaaggtttcctttgtttggtggttggcaaacaacctttaccatcggttatggtttacctcttcaagactttgttttcagttctgagggaaagagatttctcaatatcacatttggttctcccatggaggaaattctcatagaaaagcttatcgtaaaggttgttctacctgaaggttcaaaggatattgatgtgtcggctccatttccaacaaaccaacggcaagaggtgaagtattcacaccttgatattgctgggaggccagtgcttgtcttggagaaacccgatgtcattccagagcataacttacatttccaggtgtactacaaattcaataacatctcgctactcatagagccgatgatgttgattattggcttcttcctcctgttcgttgcctgtattgcttacatgcacactgacatgtcaatttctaaaagctctccttcttatctggcaaagcttcaatgggatgaggtgcaagctactgtccagcaaattcagggcatctttgaccagtgcttagcagttcatgataaactagagacctcattgcacgatttgtctaggacaggagatactaagtcttgcaaagcagctcgtaaagctgctgatgcacagttcaaggaattagcaaaagagctgaaaccactgctgatgtctgtacagtcgtcccctcagtcttatcatatatggccaaagttggaggacttggctgcaaaggagagggagatgcaggataagctcatggcaaggcattccaccgtggttgacagtttcgagaagaagctacgtgggcaagatatagaaaaccggattgcttcccagcagcagaaaattgctgcgctgaggcaagaggttgagtctctcttagagtaccttagcgagatatgagcaaatctggtgtcatcttatatcattagtgattagactgaagaccacctaagctttattttgttgaatctatatatactcttagatgttgtgtttggtaaatgataacccatcatcctagttcgtgagacttggatttgaaaaggccatgtaacatgataagcacggtaacctttttggaactgctttaaattttgcatcatgaaatattcttggggtacctgcccgggcggccgctcg

SEQ ID NO: 2312 - DNA, 2079 bp, Triticum aestivum
catctccagggcggatcggaaggttgatttgacttcgcacatcgtccgcgtcctcacttcgctcaaggttgaaaatgccggctcggagcctgtctctaaagtcttgctggcttttcccaacatccaagcaaaaaacctggcagcgatcagagcattcggtactgagggaaaagtgaagggtctcagtagtattcttccgattgaagttgttgagccttctggtgttcccccagaactaaccttcttttcagcatcgttacacaaacctttgacaaaggggaagattcttcacttagatgtcttgaccgtatttacacactttctccagccgttcccagaagagatcacccaagccgattcgcagcttgttgtctttcaggatagctctcactacctgtctccttaccctgttaaggtccagacgcttagtatcagattgcctggtggaagggttgaatcatacacaaaatatggaaacacaaaacttgtggattccgagcttaaatatggaccgtatgaagatgttcccccgttttcctacaaccctattattgtgcactttgagaacaacaacccatttgcagttgcaaaggaacttataagggagattgagatatctcactggggcaatgtacagattacagaacattacaacattgttcatggtggtgccagactgaagggtgaattctccaggcttgactaccagtctagaccttatgcaagaggggtttcatcatttaggcatctcattgctagattgcctgcaagggcccactctatttattacagagatgaaatcggtaatatttcaacatcacacttatggagtgattctaagaagacccaactggaaattgaaccgaggtttcccttgtttggtggttggcaaacaacctttaccattggttatggtttacctcttcaagactttgttttcagtgctgatggaaagagatttctcaatatcacatttggttctccaatggaggagattctcatagaaaagctcatcgtaaaggtggttctacctgaaggttcaaaggatattgatgtttcagctccatttccaacaaatcaatggcaagaggtgaagtattcacaccttgacattgctggaaggccagttcttgtcttggaaaagcctgatgttattccagagcataatttgcatttccaggtgtactacaaattcaataacatctcgttgctcatagagccgatgatgttgattactggcttcttcctcctgtttgttgcatgtattgcctacatgcacactgacatgtcaatctctaagaactctccttcttatctggcaaagctgcaatgggatgaggtgcaagccactgttcagcaaatccagggcatctttcaccagtgcttagctgttcatgataagctagagacatcattgcacgatttgtctaggactggagacgctaaatcttgcaaagcagctcgtaaagccgctgatgcacagtttaaggaattagcgaaagagctgaagccgctgttgttatctgtacagtcatcccctcagtcttatcagatatggccaaagctagaggacttggttgcgaaggagagggagttgcaggagaagctcatggcgaggcatgccaccgtggttgacagcgtcgagaagaagcagcgcgggcaagacatagaaaaccggatttcatcccagcagcagaagatcgctgcgctgaggcaagaggtcgaatctcttctagagtaccttagcgagatatgagcgaatccggtctcatcctatatcattagtgattagactgaaggtcatcttctgcactttgtgtagatgttgtgttggtaacccattatcctagttcctgaggctaggttttgaatagaccgtgtataacatgatataagcaccgtaatcattttggaactgattagttttttttgttttgcatcatgataaaaagaaatcatgcggaaccaccccccctctggactcctttttcttaagtggtagcataattgttccagattagtggtgcatttgcatgggtgcagttatcatggtagtactgatgcatttctgtgattccc

SEQ ID NO: 2313 - DNA, 2324 bp, Setaria italica
gtccaacccctccaaaacccccctttccttctggcgcacacgctctcccgtcccctccgtccggccgtccctgcccgcgcccgcatcctctacggctgcgccccccccggatcttcaaccgccggttgcgagattttccagtattggttgttcattcatttcacaagtaaaaagacctcaatttctggacctgagtagcaaaataagttctttccgctgtagtcagtcccgactggtagcaatggctacagctccagccaatggtgattcagagagtggccctcagaggaactatcaggttgttgtggctgccactcgtgacatgggcattggtaaggatggggttttgccatggaagcttcttggtgaccttaagttcttcaaggagcttacacttgctacatctgaccctgccaagaaaaatgcagttataatgggaaggaaaacatgggagagcattcctgttaagtcaaggccattgcctggtcgtttgaatgtcatacttactcgatctggtagttttgattttgcaacagtagaaaatgttgttatctgtggaagcatgaagtctgccttagaactgctagcgtcaactccatattgcttatcaattgagaaagtttttgttatagggggtgggcaggtactgagggagtatcttaatagacctgcttgtgaggccatccatctaactgatattcagtcgagcattgagtgtgacactttcatccctcctattgacttctcagtgttccagccatggtattcatcttttccggtggtagagagcaacattaggcattcatttgtgacctttgttcgtgttagaaaatcactggcagaaactcacgagtcaaatggaaaggaatcaactgaagttgataccaagaatgacaagtttgaaacagagaatttctcttttctccccaagatgatatttgaccggcatgaggagtatcattatcttaatcttgttgaagatattataaggtctggtgctcagaaaaatgacaggacaggaacaggaacattgtcaaaatttgggtgtcagatgcggttcaacttacggaaaaattttcctctgctgacaacaaagagggtattttggcgtggtgttgtcgaagaactcctgtggttcatcagtggttcaacaaatgcaaaggttctacaagagaaaggtattcatatctgggatggcaacgcttcaagagagtatcttgacagtgttggcttggcacacagggaggaaggtgatctaggtccggtttatggatttcaatggcgacattttggtgctgaatatacagacatgcatgctgactacactggaaaaggttttgatcagctaatggatgtgatcgacaagatcaagaataatcctgatgatcggcgaataattttgtcggcatggaatccttcagatctcaagaagatggctcttcctccttgccacatgtttgcacaattttacgttgagaatggggagctatcctgccagatgtatcaacgctctgcagacatgggacttggtgttccattcaacattgcatcgtactctcttctcacgtacatgattgctcaagtttgtgatctttctcctggggattttgtccatgttataggggatgcacatgtctacagaactcatgttcgagctttggaggagcaaattcagaagatgcctaagccattcccaattttgaagataaatccttcaaagaaggatatagattcttttgtggcatcagacttcaagctggttggctatgatcctcaccagaagatagagatgaaaatggcaatataatggtggctcagctggagccccagtctatgagcttggcgaaattattcggactgctactatattaaaattaaccggacatcgcactagcttgtttttggtgatggtgccgaatgttcgcgattgtactctggcttcgtatctgaactctacaaaacctgctccccttttatctggagccggtgttgatggctcgttgcgagtgagagctgctttttgggtaacgccctgtcgcaagggtcgactggcgcgtgccccgcgagacgatgtattacctcgtgagatatacccaagtcactgaattcgtctacttgctaatactcggtactgtttgatatgtacacgtgtgctgtctggtttttttccctttcgacgtcagatatcgacctgcatgctttaaacatgcgttctgctgcgtttgttgtgcattggctatttggcctccgttttcagttttttttttctagtcgggttttccaggctcagacacgtacaccacactcttgcttgcatgagcgca

SEQ ID NO: 2314 - DNA, 2322 bp, Setaria italica
ccaacccctccaaaacccccctttccttctggcgcacacgctctcccgtcccctccgtccggccgtccctgcccgcgcccgcatcctctacggctgcgccccccccggatcttcaaccgccggttgcgagattttccagtattggttgttcattcatttcacaagtaaaaagacctcaatttctggacctgagtagcaaaataagttctttccgctgtagtcagtcccgactggtagcaatggctacagctccagccaatggtgattcagagagtggccctcagaggaactatcaggttgttgtggctgccactcgtgacatgggcattggtaaggatggggttttgccatggaagcttcttggtgaccttaagttcttcaaggagcttacacttgctacatctgaccctgccaagaaaaatgcagttataatgggaaggaaaacatgggagagcattcctgttaagtcaaggccattgcctggtcgtttgaatgtcatacttactcgatctggtagttttgattttgcaacagtagaaaatgttgttatctgtggaagcatgaagtctgccttagaactgctagcgtcaactccatattgcttatcaattgagaaagtttttgttatagggggtgggcaggtactgagggagtatcttaatagacctgcttgtgaggccatccatctaactgatattcagtcgagcattgagtgtgacactttcatccctcctattgacttctcagtgttccagccatggtattcatcttttccggtggtagagagcaacattaggcattcatttgtgacctttgttcgtgttagaaaatcactggcagaaactcacgagtcaaatggaaaggaatcaactgaagttgataccaagaatgacaagtttgaaacagagaatttctcttttctccccaagatgatatttgaccggcatgaggagtatcattatcttaatcttgttgaagatattataaggtctggtgctcagaaaaatgacaggacaggaacaggaacattgtcaaaatttgggtgtcagatgcggttcaacttacggaaaaattttcctctgctgacaacaaagagggtattttggcgtggtgttgtcgaagaactcctgtggttcatcagtggttcaacaaatgcaaaggttctacaagagaaaggtattcatatctgggatggcaacgcttcaagagagtatcttgacagtgttggcttggcacacagggaggaaggtgatctaggtccggtttatggatttcaatggcgacattttggtgctgaatatacagacatgcatgctgactacactggaaaaggttttgatcagctaatggatgtgatcgacaagatcaagaataatcctgatgatcggcgaataattttgtcggcatggaatccttcagatctcaagaagatggctcttcctccttgccacatgtttgcacaattttacgttgagaatggggagctatcctgccagatgtatcaacgctctgcagacatgggacttggtgttccattcaacattgcatcgtactctcttctcacgtacatgattgctcaagtttgtgatctttctcctggggattttgtccatgttataggggatgcacatgtctacagaactcatgttcgagctttggaggagcaaattcagaagatgcctaagccattcccaattttgaagataaatccttcaaagaaggatatagattcttttgtggcatcagacttcaagctggttggctatgatcctcaccagaagatagagatgaaaatggcaatataatggtggctcagctggagccccagtctatgagcttggcgaaattattcggactgctactatattaaaattaaccggacatcgcactagcttgtttttggtgatggtgccgaatgttcgcgattgtactctggcttcgtatctgaactctacaaaacctgctccccttttatctggagccggtgttgatggctcgttgcgagtgagagctgctttttgggtaacgccctgtcgcaagggtcgactggcgcgtgccccgcgagacgatgtattacctcgtgagatatacccaagtcactgaattcgtctacttgctaatactcggtactgtttgatatgtacacgtgtgctgtctggtttttttccctttcgacgtcagatatcgacctgcatgctttaaacatgcgttctgctgcgtttgttgtgcattggctatttggcctccgttttcagttttttttttctagtcgggttttccaggctcagacacgtacaccacactcttgcttgcatgagcgca

SEQ ID NO: 2315 - DNA, 2264 bp, Zea mays
acacagccgccgctgtttcttcatcttactcgtgctcggcacgcaggcgacggcgacggcggcggcgttcaggctcgggctctcagcgacggtatcagtggtctcccgcctctcgccagtcgcgtcgcgccctcgcctccggtcctctgcacaccgtccggtgaccttgtgttgtaagtttttccagcactgcttgctcacccatttctcaattagaaaacctcaaattctgtccctgagcaccaaatcaagaccataccaatttagtgagtccggacagatggcaatggccgcagttctggccaatggtgattcacagggtcgtcctcagaggaactatcaagttgttgttgctggcactcgtgacatgggcattgggaaggatggggtcttgccatggaagcttcctggtgatcttaaattctttaaagagcttacactaattacatctgatcctgtcaaaaagaatgcagttataatgggaaggaaaacatgggagagcattccagttaagtcaaggccattgcctggtcgtttgaatgtcatacttactcgatctggtagttttgattttgcaacagtagagaatgttgttatctgtggaagtatggagtctgccttagaactgctagcatcaactccatattgcttatcaattgagaaagtgtttgttataggaggcgggcaggtactgagagaatatcttaaaggacctgcatgtgaggctatccatctaactgacattcagtcgagcattgagtgtgacactttcatccctccggttgacttctcagtgttccagccatggtattcatctttcccggtgatagagagcaacattaggcattcgtttgtgtcttttgttcgtgttagaaagtcagtggcagaaactcatgagtcaaatggcaaggaatcaaccgaggttgataccaagaatgacaaatttgaaacagagaatttctcttttctccccaagatggtatatgaccgccatgaggagtaccaatatctcaatcttgttgaagatattataaggtctggtgctcagaaaaacgacaggacaggaactggaacattgtcaaaatttgggtgtcagatgcggttcaacttaaggaaaaattttcctctgctgacaacaaagagggtattttggcgtggtgttgtcgaagaactcctttggttcatcagtggctcaacaaatgcaaaggttttgcaagagaagggtattcatatctgggatggcaatgcttcaagagagtatctcaacagtgttggcttggcacacagggaggaaggtgatttaggtccaatttatggatttcagtggcgtcactttggtgctgaatacactgacatgcatgctgactatacgggaaaaggttttgatcagctaatggatgtgattgacaagatcaagaatgatcctgacgaccgtcgaataattttgtcggcgtggaatccttcagatctcaagaagatggctcttcctccttgccacatgtttgcacaattctatgtggaaaatggggagctatcttgccagatgtatcaacgctctgcagacatggggcttggtgttccattcaacatcgcatcatattctctcctgacatacatgattgctcaagtttgtgatctttctcctggagattttgtccatgttataggggatgcccatgtctatagaaaccatgttcgagcactggaggagcaaattcagaagatgcctaaaccatttccaattttgaagataaatccttcaaaaaaggatatagattcttttatggcatcagacttcaagctggttggctatgacccccaccagaagatagagatgaaaatggcagtgtaatggtggcttggctggagccccccatcctatggactcggtggatgtaatcagtaggactggtactacataaaaattaaccggacaccgcactagcttgtttttggtgatggtgctgaatgttcagtgggagacgttttctctgatttatcagttgcgatttgcgtactatggtcgcttaagtcaactctacaaaatcggctcccttttatctggagccagttgattactcgattgcgagtgtgagggatgatctaggcataccctgttgcaagggcctactgggtgtgtgccggcccccatgaggctgtgacgattgcgccagtccagtacctcgtgagaattatgtaaccgaagttgccgtgtacctgggagaactcccgtactgtttggtgtttgattgcctatttcactt

SEQ ID NO: 2316 - DNA, 2436 bp, Setaria italica
gcacagcacacggtttcacactgcccaacccctccaaaccccgctctttccttctcgcgcaacttcgccgtcccctccaccccgcgcccgcgtcgtctccggccgcgcgccgccggatccctcgccgccggttgcaagattttccagcattggttattcatctatttcacaagttaagaaacatcaaattctggatgtgagcaacaaaataagttctttcctctttagccagccccgaccgatatcaatggctacagctccggccaatggtgattcacagagtggccctcagaggaactatcaggttgttgttgctgctactcgtgacatgggcattgggaaggatggggtcttgccatggaagcttcttggtgaccttaagttcttcaaggaggttacactttcaacatctgaccctgccaagaagaatgcagttataatgggaaggaaaacgtgggagagcattcctgtaaagtcaaggccattgcctggtcgtttgaatgtcatacttactcgatctggtagttttgattttgctacagtagaaaatgttgttatctgtggaagcatgaagtctgccctggaactgctagcatcaactccatattgcgtatcaattgagaaagtttttgttatagggggtgggcaggtactgagggagtatcttaatggacctgcatgtgaggccatccatctaactgacgttcagtccagcattgagtgtgacacattcatacctccaattgacttctcagtgttccagccatggtattcatctttcccggtggtagagagcaacattaggcattcttttgtgacctttgttcgtgttagaaaatcactggaagaaactcatgtctcaaatggaaaggaatcaactgaggtggataccaagaatgacaagtttgaaacagagaacttctcttttcttcccaagatgatatttgatcgccatgaggaatatcattaccttaatcttgctgaagatattataaagtctggtgctcagaaaaatgacaggacaggaacaggaacgttgtcaaaatttgggtgtcagatgcgattcaacttaaggaaaatttttcctctgttgacaacaaagagggtattttggcgtggtgtcgttgaagaactcctatggttcatcagtggttcaacaaatgcaaaggttctacaagagaaaggtattcatatctgggacggcaatgcttcaagagagtatcttgacagtgttggcttggcacacagggaggaaggtgatctaggtccagtttatggatttcaatggcgacactttggtgctgaatacacagacatgcatgctgactacactggaaaaggttttgatcagctaatggatgtgattgacaagatcaagaataatcctgatgaccggcgaataattttgtcggcatggaatccttcagatctcaagaagatggctcttcctccttgccacatgtttgcacaattttatgttgagaatggggagctatcctgccagatgtatcaacgctctgcagacatgggacttggtgttccattcaacattgcatcatattctcttcttacatacatgattgctcaagtttgtggtctttctcctggggatttcgtccatgttataggggatgcacatgtctacagaactcatgttcgagctttggaggagcaaattcagaagatgcctaagccatttccaattttgaagataaatccttcaaagaaggatatagattctttcgtggcatcagacttcaagctagttggctatgatcctcaccagaagatagagatgaaaatggcaatataatggcggctcagcttgagccccagcctacgagcttggcgaaattcgttggactgctactatatatttaagattaaccggacatggcaccaacttgtttttggtgatggtgccgaatgttcgttcaactgggagatcttccccacctcccctatttggggttgcactcaggctgcttatctgaactctacaggacctgctccccttttatccggagccggtgttgttgcgcgtgagctgcttccgggcaacgccctgttccaaagggtcgactggcgtgtgccccgtgacgatgtactatccgtgtcactgaattcgttttacttgttaaaactcgttactgtttgatgcctacatgtgtgttctgtctggttctatttcctttcgacgtcagataacgacctgcatgctttaagcatgcgatccgctgctgtttttctccagacatgtgctggaagtgcgagcggcgtgcttgacaaaggtactagccgctggttgtgcgttggccgttggccccagtttctcagggtcttcttgcccacctacgtgctgaagcagaaactgcagagtcggtttttccaagctcacagccatgtgggtcagggtctgcaaatgtggcataccag

SEQ ID NO: 2317 - DNA, 2443 bp, Setaria italica
cagcacacggtttcacactgcccaacccctccaaaccccgctctttccttctcgcgcaacttcgccgtcccctccaccccgcgcccgcgtcgtctccggccgcgcgccgccggatccctcgccgccggttgcaagattttccagcattggttattcatctatttcacaagttaagaaacatcaaattctggatgtgagcaacaaaataagttctttcctctttagccagccccgaccgatatcaatggctacagctccggccaatggtgattcacaaagtggccctcagaggaactatcaggttgttgttgctgctactcgtgacatgggcattgggaaggatggggtcttgccatggaagcttcttggtgaccttaagttcttcaaggaggttacactttcaacatctgaccctgccaagaagaatgcagttataatgggaaggaaaacgtgggagagcattcctgtaaagtcaaggccattgcctggtcgtttgaatgtcatacttactcgatctggtagttttgattttgctacagtagaaaatgttgttatctgtggaagcatgaagtctgccctggaactgctagcatcaactccatattgcgtatcaattgagaaagtttttgttatagggggtgggcaggtactgagggagtatcttaatggacctgcatgtgaggccatccatctaactgacgttcagtccagcattgagtgtgacacattcatacctccaattgacttctcagtgttccagccatggtattcatctttcccggtggtagagagcaacattaggcattcttttgtgacctttgttcgtgttagaaaatcactggaagaaactcatgtctcaaatggaaaggaatcaactgaggtggataccaagaatgacaagtttgaaacagagaacttctcttttcttcccaagatgatatttgatcgccatgaggaatatcattaccttaatcttgctgaagatattataaagtctggtgctcagaaaaatgacaggacaggaacaggaacgttgtcaaaatttgggtgtcagatgcgattcaacttaaggaaaatttttcctctgttgacaacaaagagggtattttggcgtggtgtcgttgaagaactcctatggttcatcagtggttcaacaaatgcaaaggttctacaagagaaaggtattcatatctgggacggcaatgcttcaagagagtatcttgacagtgttggcttggcacacagggaggaaggtgatctaggtccagtttatggatttcaatggcgacactttggtgctgaatacacagacatgcatgctgactacactggaaaaggttttgatcagctaatggatgtgattgacaagatcaagaataatcctgatgaccggcgaataattttgtcggcatggaatccttcagatctcaagaagatggctcttcctccttgccacatgtttgcacaattttatgttgagaatggggagctatcctgccagatgtatcaacgctctgcagacatgggacttggtgttccattcaacattgcatcatattctcttcttacatacatgattgctcaagtttgtggtctttctcctggggatttcgtccatgttataggggatgcacatgtctacagaactcatgttcgagctttggaggagcaaattcagaagatgcctaagccatttccaattttgaagataaatccttcaaagaaggatatagattctttcgtggcatcagacttcaagctagttggctatgatcctcaccagaagatagagatgaaaatggcaatataatggcggctcagcttgagccccagcctacgagcttggcgaaattcgttggactgctactatatatttaagattaaccggacatggcaccaacttgtttttggtgatggtgccgaatgttcgttcaactgggagatcttccccacctcccctatttggggttgcactcaggctgcttatctgaactctacaggacctgctccccttttatccggagccggtgttgttgcgcgtgagctgcttccgggcaacgccctgttccaaagggtcgactggcgtgtgccccgtgacgatgtactatccgtgtcactgaattcgttttacttgttaaaactcgttactgtttgatgcctacatgtgtgttctgtctggttctatttcctttcgacgtcagataacgacctgcatgctttaagcatgcgatccgctgctgtttttctccagacatgtgctggaagtgcgagcggcgtgcttgacaaaggtactagccgctggttgtgcgttggccgttggccccagtttctcagggtcttcttgcccacctacgtgctgaagcagaaactgcagagtcggtttttccaagctcacagccatgtgggtcagggtctgcaaatgtggcataccagccaaatccac

SEQ ID NO: 2318 - DNA, 2619 bp, Zea mays
cggggagcgacccatgaaactgatcaaacgtgggctgcatccacgagcctggctcggggtcgggccggagaaccaatcagcccgttaactgctccagcgaaggcacacagcccgacagccgccgccgtttcttcatcttcctcgcaacgccgacgctgcaacttccgctccctccccgactcgcgctcggcacgcaggcaggcgactgcggtggcgctcaggctcgggctctcagcaacggcggggttgcaagattttccagcatagcttgctcacctacttctcaatttagaagacttcaatttctggatctgagcatcaaatcaagaccataccactttagtcagtcctgtctgatggcactggctgcagctccagccagtggtgattcacagagtggtcctcagaggaactatcaggttgttgtggctgccactcgtgacatgggcattggcaagggtggggtcatgccatggaagcttcttggtgatcttaaattcttcaaagaacttacactaactacaactgatcctgccaaaaagaatgcagttataatgggaaggaaaacatgggagagcattcctgttaagtcaaggccactgcctggtcgtttgaatgtcatacttactcgatctggtagttttgattttgcaacagtagagaatgttgttatatgtggaagtatgaagtctgccttagagctgctagcatcaactccatactgcttatcaattgagaaagtttttgtcataggaggtgggcaggtactgagagaatatttgaatggacctgcatgtgaggctatccatctgactgatattcagtcaagcattgagtgtgatactttcatccctccagttgacttttcagtgttccagccatggtattcatctttcccagtggtagagagcaacattaggcattcttttgtgacttttgttcgtgttagaaagtcagtggcagaaactcatgagtcaaatggcaaggaatcaactgagattgataccaagaatgacaaatttgaaatagagaatttctcttttctccccaagatagtatatgaccgccatgaggagtatcaatatctcaatcttgttgaagatattataaggttcggtgctcagaaaaatgacaggacaggaactggaacattgtcaaaatttgggtgtcagatgcgattcaacttaaggaaaaattttcctctgctgacaacaaagagggtgttttggcgtggtgttgtcgaagaactcctttggttcatcagtggctcaacaaatgcaaaggttttgcaagaaaagggtattcatatctgggatggcaatgcttcaagagagtatcttgaccgtattggcttggcacacagggaggaaggtgatctaggtccagtttatggatttcaatggcgacactttggtgccgaatatactgacatgcatgctgactatactggaaaaggctttgatcagctaatggatgtgattgacaagattaagaacaatcctgatgaccgccgaataattttatcggcgtggaatccttcagatctcaagaagatggctcttcctccttgccacatgtttgcacaattttatgtggagaacggggagctatcctgccagatgtatcaacgctctgcagacatggggcttggtgttccattcaacatcgcatcatattctcttttgacatatatgattgctcaagtttgtgatctttctccaggagattttgtccatgttataggggatgctcatgtctatagaaatcacgttcgagctctggaggaacagattcagaagatgcctaaaccatttccaattttgaagataaatccttcgaaaaaggatatagattctttcatggcgtcagacttcaagctggttggctatgatcctcaccagaagctagagatgaaaatggcagtgtaacggtggcttagctctggagcccccagccttggaacctcggtgggtgaaatcagtcgaacgaactggtactacataaaaaatgaaccggacatcgcactagcttgtttttggtgatggtgctgaatgttgtgcgggaggcgttttcccccgttattagtagcgatctgcgtgctatatatggtcgctgaagtcaaaattggctctcttttattttttatctactactactactcatttgcgagtgagagatggtctgggcacaccattcaattgcaacggcctactggtgtgttgccccccaatgagggctgtgacgattgcgccactacctcgtgagaaacatgatgtgaccgaaattgctgtgtacctgcatggtagaacaacgcactctttggtatctggttgccttaatacgtgacctggttaattcagtttccagtttggatgggcacaagatagcgatttgctgtggcgttttagttgttgtgctgtgctgggggcagaaagtctagtgccgtgcttgacgaagacggggtcaaagcgcttgcagcgacgatgtacgatttggagccatgcaactagctcgtcagcattactctaaagtaatactgcaactgcagtcagttgagctcgaagacgctgagagagtaataggataccattagcctttccgtcgctcctagtacttggc

SEQ ID NO: 2319 - DNA, 2018 bp, Festuca arundinacea
ggcacgaggctcgtctgcttcctcccagcgagcgacggcgtgcggccaccgtccaccaccaccgccgacgaatcccgcttcaggctgcaagatttttcagcgttacttgtgcacccgtttctcggcttgcaaaacttcagtctctggacatcagcagcctaagaagatcttacagcttcaatcaaccttggctgattgccatggcagctgctcttgccaatggcgattcaccgaacagccttcagaggaactaccaggttgtcgttgctgctacccgtgacatgggcatcgggaaggatggagtcttgccgtggaagcttcctggcgaccttaagttcttcaaggagcttacgctgactacgtctgaccctgcaaagaagaacgcggtcataatgggacggaaaacctgggagagcataccccttaaagcaaggcccttacctggtcgtctgaatgtcatattgactcggtctggtagttttgattttgcaactgctgagaatgttgttatctgtggaagcatgaactctgccttggaacttctagcgtccactccgtattgcttgtcgattgagaaggttttcgtgatagggggtgggcagatactgagggattcacttaatggacctgcatgtgaggccatccatctaactgacattcagtcaaacattgagtgcgacaccttcattcctccagttgacttctcggtgttccaaccatggtgttcatctttgccagtggttgagagcaacattaggcattcttttgtgacctatgttcgtgtgagaaaatcagttttggaatctcatgactcgaatggcaaggaatcaactgagaatgataccaagagtagcaagtttgaaatcgagaacttctcttttctccctaagatgatattcgagcgccatgaagagtattactacctcaaccttgttgatgatattataaggtgtggtgctcagaaaggtgacaggactggaacagggacattgtctaaatttggttgtcagatgcggtttaacctaaggaagagcttccccttgctgacaacaaagagggtgttttggcgtggtgttcttgaagaactactgtggttcatcagtggctcgacaaatgcaaaggttttgcaggaaaagggtattcatatatgggatggcaatgcgtcaagagaatatcttgacagtgtcggcttagcaaatagaggggaaggtgatttaggccctgtttatggatttcaatggcgacactttggtgctgaatacaccgacatgcatgctgactatactggaaaaggttttgatcagctaatggatgtgattgacaagatcaagaataatcctgatgatcgacggatcatcatgtctgcatggaatccttcagatctaaaaaagatggcccttcctccctgccacatgtttgcacaattttatgttgagaatggggagctatcgtgccagatgtatcagcgctctgcagacatgggacttggtgttcctttcaacattgcatcatattctcttctgacatgcatgattgcccaagtctgtggtctctcccctggagatttcatccatgtcataggggacgcccatgtgtacagaacgcatgttcgagctctagaggagcagatccagaagctgcccaaaccgttcccaattctgaagataaaccctttgaagaaggacattgattctttcgtggcgtcggacttcaagctggatggctacgacccgcacaagaagatagagatggagatggcgatatagtggtagcagttgtaccagtaagaaggcatgtatggcgttctccggcaattgtactcgatttaggtcgcgtatccagagtctacagaactgtctcccctttttgtttggagctcagtgatgactcaagaatgtgagtgagagctgtttgagcagtgcaacgtgttgggtttgtgctcggcgatgatcgatatagctattaaactcgaatatttaaagagattcatctgtctggtaaaaaaaaaaaaaaaaaaa

SEQ ID NO: 2320 - DNA, 2107 bp, Avena sativa
cgcagcacgcgcgggcaagattaacaagacaacgggcgacctccatcccgatctatccattccctgctgaaactagattcaggctgcaaggtttttcagcattacttctactcccgttcctcggtttggaaagcgccaatctgtggacgacatcagcagcctaagatctggtcacttcaatcggtctcggtggatagccatggcaactgctctcgccaatggcgattcgcacaacagccttcagaggaactaccaggttgtcgttgctgctacgcgtggcatgggcattgggaaggatggggtcttgccgtggaagcttcctggcgaccttaaattcttcaagaagcttacactgactacgtctgaccctgcgaagaagaatgcggttataatgggacggaaaacctgggagagcataccacttaaagcaaggccgttacctggtcgtttgaatgtcatattgactcgatctggtagttttgattttgccacggctgagaatgttgttatctgtggaagcatgaactctgccctagaacttctagcatccactccatattgcttgtcgatcgagaaggtttttgtgatagggggtggccagatactgagggaatcactgaatggacctgcatgtgaggccatccatctaactgacattcagtcaaacattgagtgcgacactttcattcctccagttgacttctcggtgttccagccatggtgttcatctttgccagtaactgagagcaacattaggcattcttttgtgaccttcgttcgtgtgagaaaatcagttcctgaatcgaatggcaaggagtcaactgagcatgataccaagagtaacaagtttgaaatcgagaacttctcttttctccctaagatgatattcgatcgccatgaagagtattactacctcaaccttgttgatgatattataaggtgtggtgcacagaaaggtgacaggactggaacagggacattgtctaagtttggttgtcagatgcggttcaacctaaggaagagcttccccttgctgacaacaaagagggtgttttggcgtggtgttcttgaagaactgctgtggttcatcagtggctcgactaatgcaaaggttttgcaggaaaagggtattcatatatgggatggcaatgcgtcaagagaatatcttgatagtgtcgacctagcaaatagggaggaaggtgatttaggcccggtttatggattccaatggcgacactttggcgctgaatacacagacatgcatgctgactatactggaaaaggttttgatcagctaatggatgtgattgacaagatcaagaataatcccgacgatcggcggatcatcctgtctgcatggaatccttcagatctaaaaaagatggcccttcctccctgccacatgtttgcacaattttatgttgagaatggggagctatcgtgccagatgtaccaacgttctgcagacatgggacttggtgttccattcaacattgcatcatattcccttctgacatgcatgattgctcaagtttgtggcctctcccctggagattttgttcatgtcataggggacgcccatgtctacagaacacacgttcgagctctagaggagcagatcgagaagctgcccaaaccattcccaattctcaagataaacccttcgaagaaggatattgattcttttgtggcatcggacttcaagctggacagctacgacccgcacaagaagattgagatggagatggcgatatagtggtggctttaaccggacccttggtctgagtttggaaacattaatccaactgctataatatcagaatatcgcaccggctttttgttgggaggtgctgaaagttcattctgaggtgtaattgtactcgagttagaccgtgtatccctactgtagaaaactatgtgtccccttttatttggagcatagtggcgactcgaatgtggggagctgttttagtgttgaaagggccaactggtttgtgcctcgcgatgatcgatatactgtatacccattagacctgaacttgtaggagatccacatcaagaattttattcaggaacacattgaaaaagacttttgctatgtctgggc

SEQ ID NO: 2321 - DNA, 2553 bp, Oryza sativa
aagaaaaccccccttttcacactaacctctactctcccccgtctcagttcccgatctgcagcggcggaggagagagagacaccgccgccgccgccgccgccctccggcgaactcggccgggaggcgcacggcgtgggacggacaccagcaccaccctccctctcttcctctccttcctcaccccccaacccccgacccccgacccccgacccccgtctcggttcatccgcgcggcctccattccatctcggcggttcgaatccaaccgaaggttgcaagattttcgggcattagctgtgcacccatttctcaattcagaagacctcaatctctggagggcagcagaaaactaaggtcttgctgctttattcaaacccgactgatagccatggctacaactctctccaatgatgtttcacagaatggccctcagaggaactatcaggtagttgttgctgctactcgcgacatgggcattggaaaggatggggtcttgccatggaagctccttggcgaccttaaatttttcaaggagcttacagtgactacagctgatcctgtgaagaaaaatgctgttataatggggaggaaaacatgggagagtttaccccttaaggctaggccattgcctggccgtttgaacatcatattgactaggtctggtagttttgagtttgcaacagtcgaaaatgttgttatctgtggaagcatgaactctgcattggaactactatcatcaactccatactgtttatccattgagaaagtttttgttatagggggtggacaagtactaagggaatctcttaatggaccttcatgtgaggcagtccatttaactgacattcagtcaagcattgagtgtgacacctttattcctccgattgacttatcggtgttccaaccatggtattcatctttgcctgtggtagagagcaacattaggcattcgtttgtgacctatgttcgggttagaaaaacaatggcagaaacacatgactcaaatggcaaggaatcagctaatgatggtatcaagagtgacaaatttgaaaccgagaatttctcttttctccctaagttgatatttgaccgccatgaggagtatcactatctcaatcttgttgaagatattataaggagtggtgctcagaaaaatgacagaacaggaacagggacattatcgaaatttggttgtcagatgcggttcaacttaaggaatagcttcccattgttgacaacaaagaaggtattttggaggggtgttgttgaagaactcctgtggttcatcagtggctcgacaagtgcaaaggttttacaagagaaaggcattcatatttgggatggcaatgcttcgagagagtatcttgacagtgttggcttagcacatagggaagaaggtgatctaggtccagtttatggatttcaatggcgacactttggtgctgaatataccgacatgcatgctgactatactggtaaaggctttgatcagctaatggatgtgattgacaagatcaagaataatcctgacgataggcgaattatcctatctgcgtggaatccttcagatctcaagaagatggcccttcctccttgccacatgtttgcacaattttatgttgagagcggggagctatcgtgccagatgtatcaacgctctgctgatatgggacttggtgttccattcaacattgcatcatattctcttctgacatacatgattgctcatgtttgcggtctttctcctggagagtttgtccatgttattggtgatgcccatgtctatagaacacatgtgcgagctctggaggagcaaatccagaagctacctaaaccatttccaattttgaagattaaccctttgaagaaggatatagattctttcgtggcatcagacttcaagctggtcggttatgatcctcaccagaagattgaaatgaaaatggcaatataatttggtggctaagctgggacccccagtcactatgtgagcttggagaaaattaagcaggaaaaccttatgcgaacatcgcactagcttacttttttttttttagtggtggtgctggatgttcatttggacctatgttctccatttatccgcgattgtacttttatctcggtcgccgatccaaaccctacgaaaacaccggtcactggctcccccttttatttggacccagtgaatgatgttagagcttgtttcgagtagacaccatgttggaagaggccaaccgggcgttatgtgtacctcggcgatggatgtcatgtaccctgactgcgacacacattttggtcattttggtgaagcttcggagtgcctctggtgttgctggacgacacctactaattgtctccatctgagatttttctttccacatgtttggaacaccagatgatgggtgatgatgctgacctgtggatttggagttgttcagcatatgttggcactttttctgatgtttgtgaaatgagttgtgttgcgtgcttggaaattgcgcttggtggcggcgcttgcagcaaggactgaaaatgagatcttttgacattgac

SEQ ID NO: 2322 - DNA, 1994 bp, Avena sativa
tcccaattcaggctgcaaggtttttctgcattacttctactcccgttcctcggttcggaaaacgccaatatctggacaacatcagcagcctaagatcttgccacttcaatcaatctcggtggatagccatggcaaccgccctcgccaatggcgattcgcagaacagccttcagaggaactaccaggttgtcgttgctgctacgcgtgacatgggcattgggaaggatggggacttgccgtggacgcttcctatcgaccttaaattcttcaagaatgttacactgactacgtctgaccctgcgaagaagaatgcagttataatggggcggaaatcctgggacagcttaccacttaaagcaaggccgttacgtggtcgtttgaatgtcatattgactcgatctggtagttttgattttgccacggctgagaatgttgttatctgtggaagcatgaactctgccctagaacttctagcatccactccatattgcttgtcgatcgagaaggtttttgtgatagggggtggccagatactgagggaatcactgaatggacctacatgtgaggccatccatctaactgacattcagtcaaacattgagtgcgacactttcattcctccagttgacttctcggtgttccagccatggtgttcatctttgccagtaactgagagcaacattaggcattcttttgtgaccttcgttcgtgtgagaaaatcagttcctgaatcgaatggcaaggagtcaactgagcatgatatcaagagtaacaagtttgaaatcgagaacttctcttttctccctaagatgatattcgatcgccatgaagagtattactacctcaaccttgttgatgatattataaggtgtggtgctcagaaaggtgacaggactgggacagggacattatctaaatttggttgccagatgcggttcaacctaaggaagagcttccccttgctgacaacaaagagggtgttttggcgtggtgttcttgaagaactgctgtggttcatcagtggctcgactaatgcaaaggttttgcaggaaaagggtattcatatatgggatggcaatgcgtcaagagaatatcttgacagtgttggcttagcaaatagggaggaaggtgatttaggcccggtttatggattccaatggcgacactttggcgctgaatacacagacatgcatgctgactatactggaaaaggttttgatcagctaatggatgtgattgacaagatcaagaataatcctgacgatcggcgaatcatcctgtctgcatggaatccttcagatctaaaaaagatggcccttcctccctgccacatgtttgcacaattttatgttgagaatggggagctatcgtgccagatgtaccaacgttctgcagacatgggacttggtgttccattcaacattgcatcatattcccttctgacatgcatgattgctcaagtttgtggtctctcccctggagatttcatccatgtcataggggacgcccacgtttacagaacgcacattcgagctttagaggagcagatccagaagcagcccaaaccgttcccaattctgaagataaacccttcgaagaaggatattgattcttttgaggcatcggacttcaagctggccggctatgacccgcacaagaagatagagatggagatggcgatatagtggtggctttggctagacccttggtctgagcttggaaacattaatagaactgctatggtatcagaatatcgtactggcttttttgtgagatgctgaaagttcattctgaggtgcaattgtactcggttagatcgcgtatccgactctagaatactgtctccccttttatttggagaacagtgatgactcgaatgtgagagttgtttgagtgttggaagggccaactggtttgtgccttgcgacgaaatacccattagactcgaacttgtgagagattcatctgtctggtaatgagctgaagtgtctgcc

SEQ ID NO: 2323 - DNA, 1985 bp, Avena sativa
tcccaattcaggctgcaaggtttttctgcattacttctactcccgttcctcggttcggaaaacgccaatatctggacaacatcagcagcctaagatcttgccacttcaatcaatctcggtggatagccatggcaaccgccctcgccaatggcgattcgcagaacagccttcagaggaactaccaggttgtcgttgctgctacgcgtgacatgggcattgggaaggatggggacttgccgtggacgcttcctatcgaccttaaattcttcaagaatgttacactgactacgtctgaccctgcgaagaagaatgcagttataatggggcggaaatcctgggacagcttaccacttaaagcaaggccgttacgtggtcgtttgaatgtcatattgactcgatctggtagttttgattttgccacggctgagaatgttgttatctgtggaagcatgaactctgccctagaacttctagcatccactccatattgcttgtcgatcgagaaggtttttgtgatagggggtggccagatactgagggaatcactgaatggacctacatgtgaggccatccatctaactgacattcagtcaaacattgagtgcgacactttcattcctccagttgacttctcggtgttccagccatggtgttcatctttgccagtggttgagaacaacattaggcatgcttttgtgacctttgtccgtgtgagaagatcagtttccgaatctcatgactcgaatggcaaggcgtcaactgagcatgataccaagagtaacaagtttgaaatcgagaacttctcttttctccctaagatgatattcgatcgccatgaagagtattactacctcaaccttgttgatgatattataaggtgtggtgctcagaaaggtgacaggactgggacagggacattatctaaatttggttgccagatgcggttcaacctaaggaagagcttccccttgctgacaacaaagagggtgttttggcgtggtgttcttgaagaactgctgtggttcatcagtggctcgactaatgcaaaggttttgcaggaaaagggtattcatatatgggatggcaatgcgtcaagagaatatcttggcagtgttggcttagcaaatagggaggaaggtgatttaggcccggtttatggatttcaatggcgacactttggtgctgaatacacagacatgcatgctgactatactggaaaaggttttgatcagctaatggatgtgattgacaagatcaagaataatcccgacgatcggcggatcatcctgtctgcatggaatccttcagatctaaaaaagatggcccttcctccctgccacatgtttgcacaattttatgttgagaatggggagctatcgtgccagatgtaccaacgctctgcagacatgggacttggtgttccattcaacattgcatcatattcccttctgacatgcatgattgctcaagtttgtggtctctcccctggagatttcatccatgtcataggggacgcccacgtttacagaacgcacattcgagctttagaggagcagatccagaagcagcccaaaccgttcccaattctgaagataaacccttcgaagaaggatattgattcttttgtggcatcggacttcaagctggacagctacgacccgcacaagaagatagagatggagatggcgatatagtggtggctttggctagacccttggtctgacttggaaacattaatagaactgttatggtatcagaatatcgtactggcttttttgtgagatgctgaaagttcattctgaggtgcaattgtactcggttagatcgcgtatccgactctagaatactgtctccccttttatttggagaacagtgatgactcgaatgtgagagttgtttgagtgttggaagggccaactggtttgtgccttgcgacgaaatacccattagactcgaacttgtgagagattcatctgtctggtaaa

SEQ ID NO: 2324 - DNA, 1718 bp, Lolium multiflorum
tcagaggaactaccaggttgttgttgccgctacgcgtgacatgggcattgggaaggatggagtcttgccttggaggcttcctggcgaccttaagttcttcaaggagcttacgctgactacgtctgaccctgcaaagaagaacgcggtcataatgggacggaaaacctgggagagcataccccttaaagcaaggcctttacctggtcgtctgaacgtcatattgacccggtctggtagttttgattttgcaactgctgagaatgttgttatctgtggaagcatgaactctgccttggaacttctagcgtccactccgtattgcttgtcgattgagaaggttttcgtgatagggggtgggcatatactgagggattcacttaatggacctgcatgtgaggccatccatctaactgacattcagtcaaacattgagtgcgacaccttcattcctccagttgacttctcggtgttccaaccatggtgttcatctttgccagtggttgagagcaacattaggcattcttttgtgacctttgttcgtgtgagaacatcagtttcagaatctcatgactcaaatggcaaggaatcaaccgagcaagataccaagagtagcaagtttgaaatcgagaacttctcttttctccctaagatgatatttgagcgccatgaagagtattactacctcaaccttgttgatgatattataaggtgtggtgctcagaaaggtgacaggactggaacaggaacattgtctaaatttggttgtcagatgcggtttaacctaaggaagagcttccccttgctgacaacaaagagggtgttttggcgtggtgttcttgaagaactgctgtggttcatcagtggctcgacaagtgcaaaggttctgcaggaaaagggtattcatatatgggatggcaatgcgtcaagagaatatcttgacagtgtcggcttagcaaatagggaggaaggtgatttaggccccgtttatggatttcaatggcgacactttggtgctgaatacaccgacatgcatgctgactatactggaaaaggttttgatcagctaatcgatgtgattgacaagatcaagaataatcctgacgatcggcgaatcatcatgtctgcatggaatccttcagatctaaaaaggatggcccttcctccctgccacatgtttgcacaattttatgttgagaatggggagctatcatgccagatgtatcaacgctctgcagacatgggacttggtgttcctttcaacattgcatcatattctcttctgacatgcatgattgctcaagtctgtggtctctcccctggagatttcatccatgtcataggggacgcccatgtgtacagaacgcatgttcgagctctagaggagcagatccagaagctgcccaaaccgttcccaattctgaagataaaccctttgaagaaggacattgattctttcgtggcgtcggacttcaagctggatggctacgacccgcacaagaagatagagatggagatggcgatatagtggtagcagttgtagtggtaagaagacatgtatggcgttctccggcaattgtactcgatttaggtcgcgtatccagagtctacagaactgtctcccctttttgtttggagctcagtgatgactcgagaatgtgagtgagagctgtttgagcagtgcgacgtgttgggtttgtgctcggcgatgatcgatatag

SEQ ID NO: 2325 - DNA, 2197 bp, Brachypodium distachyon
tgccttgacgacgacggagtgctgaagctagggccgccccgcacgccgccgctggtcgtccactgccgcgcgcccctgcgccgcctcgccgcgcccgtagccgtgcgtccgcagggcactgctggccagcttctccgccgcgcgcgctgccctgcacgccgccgctgctcagcccgtagcagtgctgcccttcgcccactgctcctcctctccccaatttctccccaaatccttagtttgctcactcgtgctccagcttccaggtcacccggtttttcagcaagcgtatcatcccattttttgctttgcgaaggattaaatctgttgaagcaagcaacaaaccaaggttttaccgcttccaccaatctcaagcgatggccatgtttgcaaatgtcgccaatggcagttcatataatcctgatattcggaggaactatcaagtggtggttgctgcaacccatgagatgggcattgggaaggatggagcgttaccatggaaactgcctagtgatctaaatttttttaaggagcttacaatggccacatcagatccatcaaagaaaaatgcagtcataatgggaaggaaaacatgggaaagcatacctgctaagtttagaccactgcctggtcgcttgaatgttatactgactcgttctggtagttttgattttgcaacagtggagaatgttgttatatgtggaagcttggattcttccttggaactactagcatcaactccctacagcttaacaattgagaaagcttttttaatagggggtggccaggtgctgagggattctctaaatgcgccggcatgtgaggccatccatcttactgacatagagtcaaccattgaatgcgatacttacattcctcctattgatctatcggttttccacccttggtattcatcttttccagttgtggaaaacaacattaggcactctttcgtgacttttgtccgcgttagaaaaccagtaacagaagttaatgattcaaatggcaatgatgctaagaaggaaaggtttgaaataaagaatttttcatttctaccaaaaatgatctttgaaaggcatgatgagtatcagtatctcaaccttgttcaagatataatacagagtggtgcaagaaaaaatgacagaacaggaacaggaacattatcaaaatttggttgccagatgcggtttaacttgaggagaaactttccattactaacaacaaagagagtgttttggcgtggtgttcttgaagagcttctgtggttcatcagtggctcaacaaatgcaaaggttttacaggaaaaaggcattcatatatgggatggcaatgcttcaagggagtatcttgacagtattggtttatctcaaagagaggagggtgatttgggaccagtttatggatttcagtggagacacttcggtgctgaatataccgacatgcatgccgattatacaggaaaaggttatgatcagttaattgatgtcattaacaaaatcaggaataaccctgatgataggcgaatcattctttctgcatggaatccgacagatctcaagaagatggcacttccaccttgccacatgtttgcacagttttatgttgagaatggggagttatcatgtcagatgtatcaacgttctgctgatatgggccttggtgtaccattcaacattgcttcatattctcttctgacatgtatgattgcacaagtttgtgatctttctcctggagattttgtccatgttattggtgatgcccatgtctacagtacacatgttcgagctttggaggaacaaatcaagaagcagcctaagccatttcctattttgaagataaatcctgtgaagaaggatatcgattcatttgttgcatcggattttgaactggtttgctatgatcctcaccagaaaatagaaatgaagatggcagtataaggagtttccaacttagcatccaccattggtaccagtaatatgtcagctgttttttttttcagaagcaaagtttcgctttggtgctgccacatgtacttgtattatggatggtgtctttaatatttatttggatagttggatttgagtttcgttgacatccggtccagtggcatttgtgcttctaggtctctaggactcgagagccttgaggaatcttttgcaccctttggatatatgaatgggaagttagaagtatgatgact

SEQ ID NO: 2326 - DNA, 2206 bp, Brachypodium distachyon
cgctgccttgacgacgacggagtgctgaagctagggccgccccgcacgccgccgctggtcgtccactgccgcgcgcccctgcgccgcctcgccgcgcccgtagccgtgcgtccgcagggcactgctggccagcttctccgccgcgcgcgctgccctgcacgccgccgctgctcagcccgtagcagtgctgcccttcgcccactgctcctcctctccccaatttctccccaaatccttagtttgctcactcgtgctccagcttccaggtcacccggtttttcagcaagcgtatcatcccattttttgctttgcgaaggattaaatctgttgaagcaagcaacaaaccaaggttttaccgcttccaccaatctcaagcgatggccatgtttgcaaatgtcgccaatggcagttcatataatcctgatattcggaggaactatcaagtggtggttgctgcaacccatgagatgggcattgggaaggatggagcgttaccatggaaactgcctagtgatctaaatttttttaaggagcttacaatggccacatcagatccatcaaagaaaaatgcagtcataatgggaaggaaaacatgggaaagcatacctgctaagtttagaccactgcctggtcgcttgaatgttatactgactcgttctggtagttttgattttgcaacagtggagaatgttgttatatgtggaagcttggattcttccttggaactactagcatcaactccctacagcttaacaattgagaaagcttttttaatagggggtggccaggtgctgagggattctctaaatgcgccggcatgtgaggccatccatcttactgacatagagtcaaccattgaatgcgatacttacattcctcctattgatctatcggttttccacccttggtattcatcttttccagttgtggaaaacaacattaggcactctttcgtgacttttgtccgcgttagaaaaccagtaacagaagttaatgattcaaatggcaatgatgctaagaaggaaaggtttgaaataaagaatttttcatttctaccaaaaatgatctttgaaaggcatgatgagtatcagtatctcaaccttgttcaagatataatacagagtggtgcaagaaaaaatgacagaacaggaacaggaacattatcaaaatttggttgccagatgcggtttaacttgaggagaaactttccattactaacaacaaagagagtgttttggcgtggtgttcttgaagagcttctgtggttcatcagtggctcaacaaatgcaaaggttttacaggaaaaaggcattcatatatgggatggcaatgcttcaagggagtatcttgacagtattggtttatctcaaagagaggagggtgatttgggaccagtttatggatttcagtggagacacttcggtgctgaatataccgacatgcatgccgattatacaggaaaaggttatgatcagttaattgatgtcattaacaaaatcaggaataaccctgatgataggcgaatcattctttctgcatggaatccgacagatctcaagaagatggcacttccaccttgccacatgtttgcacagttttatgttgagaatggggagttatcatgtcagatgtatcaacgttctgctgatatgggccttggtgtaccattcaacattgcttcatattctcttctgacatgtatgattgcacaagtttgtgatctttctcctggagattttgtccatgttattggtgatgcccatgtctacagtacacatgttcgagctttggaggaacaaatcaagaagcagcctaagccatttcctattttgaagataaatcctgtgaagaaggatatcgattcatttgttgcatcggattttgaactggtttgctatgatcctcaccagaaaatagaaatgaagatggcagtataaggagtttccaacttagcatccaccattggtaccagtaatatgtcagctgttttttttttcagaagcaaagtttcgctttggtgctgccacatgtacttgtattatggatggtgtctttaatatttatttggatagttggatttgagtttcgttgacatccggtccagtggcatttgtgcttctaggtctctaggactcgagagccttgaggaatcttttgcaccctttggatatatgaatgggaagttagaagtatgatgactataatt

SEQ ID NO: 2327 - DNA, 1926 bp, Oryza sativa
cccgccaaaaaaaagaaaaaaaaacgcggctcctcgcgcctccccccgaccaccacctcggcgattcgacggcgaccgctcgctgctggcctccgccggcttggtttcggctcgcggcgccatctcggtctcaaatatcttgaattcagggacaaactcaatttctcccgctttcacaaatctcaagtgatagtcatgtctacaaatgttaacaatggtaactcagagagcaaccttaagagaagttatcaagttgtggtttctgctactcgcgacatgggtattgggaaggatgggacgctgccatggaagctgccgggtgacctgaagttttttaaagatattacagtgactacgtcagacccttcaaagaaaaatgctgttgtaatgggaaggaaaacatgggaaagcataccccttaagtttagaccactccctggtcgtttgaatgtaatattgactcgttctgggagttttgattttgcaactgcagaaaatgttgttatctgtgggagtttggattctgccttgcaactgctagcaacaactccatactgtttgacagttgagaaaacttttataataggaggtggcgagattctgaggcaatctttaaatgcgcctgcttgtgaggccatccatcttaccgacatagagtccagcattgaatgtgatactttcattcctccaattgatctctccatgttccacccatggtattcatcatttccagtggtagaaaacggcatcaagcattctttcatttcctttgttcgtgttacaaaatcaattgcagaagctaatgattctagtggcaaggaattgactggaaatgattctaagaaggtcaagtttgaaattgagaatttttcctttttacctaaaatgatatttgaaaggcacgaggagtatcaatatctcaatcttgttcaagatataataagaaatggtgctaagaaaaatgacagaacaggaacagggacagtatcaaagtttggttgccagatgcggttcaacttaaggaggaactttccattgctcacaacgaagagggtattttggcgtggtgtacttgaagagctattgtggttcattagtggctcaacaaatgcaaaggttttacaggagaaaggtattcacatatgggatggcaatgcttcaaggcagtatcttgacagtattggtttaacacaaagggaggagggggacttgggaccagtttatggatttcagtggagacactttggtgctgaatatactgacatgcatgctgactacgtgggaaaaggttttgatcagttaatggatgtcattgacaagatcaagaataatcccgatgatagaagaatcattttatctgcatggaatccaacagacctgaaaaagatggccctgccaccatgccacatgtttgctcagttttatgttgagaatggggagttgtcatgccagatgtaccaacgctctgctgatatggggctcggtgtgccattcaacattgcatcatattctcttctgacatgtatgattgcacaagtgtgtgatctttctcctggggattttgtccatgttataggtgatgcccatgtttaccgtacgcatgttgaagcgttagaggagcaaatgcggaagcagcctaaaccattccctattttgaagataaatcctgtgaagaaagatattgattcttttgtaacatcagacttcaaactggttcgctatgatcctcaccataagatagaaatgaagatggcagtatgagttggtagcttctatttgcagacttctgttgtatatttgatggcaaattgatatggttgattggattgaagtgccttgtcatcctgtcttacaaatatgtcttacaaattgatatatttgctgttgtactggatgattggtataagatggatcatttccaccaaa

SEQ ID NO: 2328 - DNA, 2612 bp, Cocos nucifera
gaggcgctataaaatcgcggcctccacctcattcccccaaattccccgtttcgcaatccccgcttccatcggaagagtgaccggtccccgccctccgtcgccgcgcccttcgatctccaccggccccctcctcaccattcactcccctgtctcacgcttgtcctccaagattgtaccagtttcaagcaaaagttgctcatcttacattggacttaagaggcattgcccggtagttggaattttaagaaaagggataaagtgcagctattgccattctgttccagttatggctgatgacattcccgcaagcatttcaaatggtaatacacaacatgatcctaaaaggacttttcaggtagttgttgctgccactcgagatatgggtattgggaaggatgggaagttgccatggaagctgccatctgaccttaaattttttaaggaggttactatgactgtgtcagatcctgtaaaaaagaatgctgtgataatgggtaggaaaacatgggaaagcattcctcttcagaataggcctctgcctggtcggttgaatgttgtgctgacacgctctgggagttttgatattgcaacggctgagaatgttgttatctgcggaagcatgaattctgctttaaagctgctagcagcaaccccttattgtctgtcaattgagaaagtgttcgttataggtggtggccaggtattaagggaatctcttaatgcacctgaatgtgaagccattcatctcacagacatagaaacaaacattgaatgtgacactttcatccctccaattgatttttcagtatttcaaccatggtattcatccttcccattggtagagaacaatatcaggtactcttttgtgacatatgttcgtgtgcgaaattcggctgccgagcttcatactctgcatgatgaggataaaactgatgttaaattatacttgaataagtttgaggttgaaaagttctcatttcttcctaaaatgatacatgaaagacatggggaatatatgtatcttagacttgtccaagatatcatagcaaatggtgcccaaaagaatgacaggacagggactggaacattgtcaaaatttggttgtcagatgcggtttaatttgcgaagatcttttccgctgcttacaaccaagaaagtattttggcgaggtgttgttgaggaactcttgtggttcatcggtggttcaacaaatgcaaaggttttacaggaaaagggtatacatatctgggatggcaatgcatcaagagagtaccttgatagtgttggcttatcatgtagagaagaaggcgacttaggaccaatatatgggtttcaatggagacactttggtgccaagtatactgacatgcatgctgattacactgggaaaggatttgatcagctattggatgtaattgacaaaataaagagcaatccagatgatcgtcgcatcattctctcagcttggaatccttcggatctcaagaaaatggcccttcctccttgccacatgctcgcacaattttatgtggagaatggggagttatcatgccaaatgtaccaacggtctgcagacatgggacttggtgtgccatttaacattgcgtcgtattcacttttgacatgcatgattgctcaagtttgtgatctcttgcctggagattttatccatgttataggagatgctcatgtttatagaactcatgtgaggcctttagaagagcagcttcaaaagcaaccaaaaccattcccgattctgaaggtgaaccctttgaagaaggatatagattcctttgttgcatctgacttcgagcttgttggatatgacccgcactacaagatagaaatgaaaatggcagtataacgccttcagctttggagaagagaacttgtcttactgttctgcatcatgtggtcagaagcataggttacagaggtaactacactttcacgcccttctttgtttagcgagttatctaaatactgtcagttaatcaaaagtcagttataaactttatattatggactcaatctaatggtagtggatccaatataagcgggcaagctcgggagaggttcctttgagcttgcgttgagtgagaaatggcttgacagccggataacatatccacgtactgatatcgcacgctctggctactgaccaaaggcttgaggcaggccctacctagataaaatttttcgttgcatcaaaatagagacttatcttggtaagcggtatcattgcccaggaggatattatgatttcgatggctcacgcaaggtagaaataattttttatatcatattttgcccccacttgtctcaggtacggctgcatgcctatttgccttctttttattcaatttgagcctatctgtgagttccgatgtcccaggaaacaagaatgtgtctacgtgcttgtttagtgccttggtctatgtgcgcatctgatcttgtctagtgccttcactcgtgcactttgtgttaaacagggctaaatgtttgtgatcgcatgtcttatattctccgtatttaaaatctaattagcttccaattattgagtctacctattgaagacgtggcggttggcaggatggaaggtgatgccggag

SEQ ID NO: 2329 - DNA, 1452 bp, Echinochloa colona
ttgcaaggttttccagcattggttctccacccgtttctcaatttagaaaacatcaatttctggatctgaacagcaaaacaagaccttaccactttagtctgtcccgaacaatggcgatggctacagctcccaccaatggtgattcacagagtggtcctcagaggaactatcaggttgttgttgctgccacccgtgacatgggcattgggaaggatggggtcttgccatggaagcttgttgatgaccttaaattcttcaaggagcttacactaactacatctgaccctgccaagaagaatgcggttatcatgggaaggaaaacatgggagagcattcctgttaagtcaaggccattgcctggtcgtttgaatgtcatactcactcgatctggtagtttcgactttgcaacagtagaaaatgttgttatctgtggaagcatgaagtcttccttagaactgcttgcatcaactccatattgcttatcgattgagaaagtttttgttataggaggcgggcaggtactgagggaatatcttaatggacctgcatgtgaggccatccatctaactgacattcagtctagcattgactgtgacactttcatccctccaattgacttctcagtgttccagccatggtgctcatctttcccagtggtagagagcaacattaggcattcttttgtgacctttgttcgtgttagaaaatcagtgccagaaactcatgactctaatggcaaagaatcaactgagtttaataccaagaacgacaagtttgaaacagagaacttctcatttcttcccaagatgatatttgaccgtcatgaggagtatcactatctcaatcttgtcgaagatattataaggtctggtgctcagaaaaatgacaggacaggaactggaactttgtcaaaattcgggtgtcagatgcggttcaacttaaggaaaaatttcccactgctgacaacaaagagggtattttggcgtggtgttctggaagaactcctgtggttcatcagtggctcaacaaatgcaaaggttttgcaagagaaaggtatccatatctgggatggcaatgcttcaagagaatatcttgacagtgttggcttggcacacagagaggaaggtgatctaggtccagtttatggatttcaatggcgacattttggtgctgaatacactgacatgcatgctgactatactggaaaaggttttgatcagctaatggatgtgattgataagatcaagaataatcctgatgaccggcgaataattttgtcagcatggaatccttcagatctcaagaagatggctcttcctccttgccacatgtttgcacaattttatgttgagaatggggagctatcctgccagatgtatcaacgctctgcagacatgggacttggtgttccattcaacattgcatcttactctcttcttacatacatgattg

SEQ ID NO: 2330 - DNA, 2060 bp, Cocos nucifera
cgtttcgcaatccccgcttccatcggaagagtgaccggtccccgccctccgtcgccgcgcccttcgatctccaccggccccctcctcaccattcactcccctgtctcacgcttgtcctccaagattgtaccagtttcaagcaaaagttgctcatcttacattggacttaagaggcattgcccggtagttggaattttaagaaaagggataaagtgcagctattgccattctgttccagttatggctgatgacattcccgcaagcatttcaaatggtaatacacaacatgatcctaaaaggacttttcaggtagttgttgctgccactcgagatatgggtattgggaaggatgggaagttgccatggaagctgccatctgaccttaaattttttaaggaggttactatgactgtgtcagatcctgtaaaaaagaatgctgtgataatgggtaggaaaacatgggaaagcattcctcttcagaataggcctctgcctggtcgtttgaatgttgtgctgacacgctccgggagttttgatattgcaacagctgagaatgttgttatctgtggaagcatgaattctgccttaaagctgctggcagcaaccccttattgtttgtcaattgagaaagtgtttgttataggcggtggccaggtattaagggaatctcttaacgcaccggaatgtgaagccattcatctcacagacatagaaacaaacattgaatgtgacactttcatccctccaattgatttttcggtgtttcaaccttggcattcatccttcccattggtagagaacgatatcaggtattcttttgtgacatatgttcgtgtgcgacattcagctactgagcttcatgctctacatgatgggggaaaaactgatggtaaattgtatttgaataagtttgaggttgaaaggttctcatttcttcctaaaatgatacatgaaagacatgaggaatatgtgtatcttagacttgtgcaagatatcatagcaaatggtgcccaaaagaatgacaggacagggactggaacattgtcaaaatttggttgtcagatgcggtttaatttgcgaagatcttttccgctgcttacaaccaagaaagtattttggcgaggtgttgttgaggaactcttgtggttcatcggtggttcaacaaatgcaaaggttttacaggaaaagggtatacatatctgggatggcaatgcatcaagagagtaccttgatagtgttggcttatcatgtagagaagaaggcgacttaggaccaatatatgggtttcaatggagacactttggtgccaagtatactgacatgcatgctgattacactgggaaaggatttgatcagctattggatgtaattgacaaaataaagagcaatccagatgatcgtcgcatcattctctcagcttggaatccttcggatctcaagaaaatggcccttcctccttgccacatgctcgcacaattttatgtggagaatggggagttatcatgccaaatgtaccaacggtctgcagacatgggacttggtgtgccatttaacattgcgtcgtattcacttttgacatgcatgattgctcaagtttgcgatcttttgcctggggattttatccatgttgtaggagatgctcatgtttatagaactcatgtgaggcctttagaagagcagcttcaaaagcaaccaaaaccattcccgattctgaaggtgaaccctttgaagaaggatatagattcctttgttgcatctgacttcgagcttgttggatatgacccgcactacaagatagaaatgaaaatggcagtataacgccttcagctttggagaagagaacttgtcttactgttctgcatcatgtggtcagaagcataggttacagaggtacggctgcatgcctatttgtggagaggcccttaaaataatactcaagaggtctttactccatcggcacatattctagaaagcgatcgtctgctaagaggtgaatgaaatttgttctctttgttttgatatctggaccctgacattttatggatggaactctggccttc

SEQ ID NO: 2331 - DNA, 2560 bp, Cocos nucifera
ggtgtggttggtgggtggtggggaagattagcaggttagcgggaggttccgataacaggcgaacccgatccgcgttccgccgttcccattcccaattccgtttggccctcagtcctcactcgtcttcggagccttcgagcgtccaaggccggctagggttcgttcccactttcgcgctcctcccctcctcccgagcggcaaccagcgagaagagcatccaagcgcggtgccagggatttgcatcatttttggtgtatcttgggtcttgtcaagtttctccaatcatcacaagacaatatagaattaggagaacagattgtaccagttttgagcaaaagttgcttatctcgcattggacttgagtggccttgcccagcagttggaatttttaacaaagggataaagtgcggttcttgccattctgttccagttatggcaggtgacattcccacaaacatttcaaatggtaatacccaacatgatcctaaaaggacttttgaggttgttgttgctgccactcgaaatatgggtattggaaaggatgggaagttaccatggaagctgccatccgaccttaatttttttaaggaggttactgtgactgcatcagattctgtaaaaaagaatgctgtgataatgggtaggaaaacatgggaaagcattcctcttcagaataggcctctgcctggtcggttgaatgttgtgctgacacgctctgggagttttgatattgcaacggctgagaatgttgttatctgcggaagcatgaattctgctttaaagctgctagcagcaaccccttattgtctgtcaattgagaaagtgttcgttataggtggtggccaggtattaagggaatctcttaatgcacctgaatgtgaagccattcatctcacagacatagaaacaaacattgaatgtgacactttcatccctccaattgatttttcagtatttcaaccatggtattcatccttcccattggtagagaacaatatcaggtactcttttgtgacatatgttcgtgtgcgaaattcggctgccgagcttcatactctgcatgatgaggataaaactgatgttaaattatacttgaataagtttgaggttgaaaagttctcatttcttcctaaaatgatacatgaaagacatggggaatatatgtatcttagacttgtccaagatatcatagcaaatggtgcccaaaagaatgacaggacagggactggaacattgtcaaaatttggttgtcagatgcggtttaatttgcgaagatcttttccgctgcttacaaccaagaaagtattttggcgaggtgttgttgaagaactcttgtggttcatcagtggttcgacaaatgcaaaggttttacaggaaaaggatatacatatttgggatgggaatgcatcaagagagtaccttgatagtgttggcttatcgtgtagagaagaaggcgacttagggccaatatatgggtttcaatggagacactttggtgccgagtacactgacatgcatgctgattacactggaaaaggatttgatcagctattggatgtcattgacaaaataaagaacaatccaaatgatcgtcgcatcattctctcagcttggaatccttcagatctcaagaaaatggcccttcctccttgccacatgtttgcacaattttatgtggagaatggcgagctatcatgccaaatgtgccaacggtctgcagacatgggtcttggtgtgccatttaacattgcatcgtattcacttttgacatgcatgattgctcaagtttgtgatctcttgcctggagattttatccatgttataggagatgctcatgtttatagaactcatgtgaggcctttggaagagcagcttcaaaagcagccaaaaccatttccaattctgaagatcaaccctttgaagaaggatatagagtccttcattgcatctgatattgagcttgttgggtacgaccctcactacaagatagaaatgaaaatggcaatataacgccttcagctttggagaagagaacttgtcttactgttctccataatgtggtcagaagcatagtttatagaggtacagctgcatgcctgtttgtggagaggcccttaaaatattaatcaagaggtctttactccatcggcacatatatttctgcaaagtgatcagcttgtaagtttctgaaagatgataccaagaggtgactgaaattattctcgttgatttgatttctggctcatcagttaacttttgtccatgaccctgacattttatggatggaactctggctttatctttttcaatttgagcctatatgcgagttccgatgtcttaatgtctgagtgcccatctgatcttatctagtaccttcagtcatgcactttgtgttaaacagcggtaaatgtttgtgatcgtctgtcttatatttttccttattcaaaatctaatgagcttccatgttattgagattgagttaattgagttgcgttaagtgtcactcatgttactgagggctctcatcctcggtattttttggaatggaagatcaaaatct

SEQ ID NO: 2332 - DNA, 2762 bp, Ananas comosus
gacccaatctctccctctcactctcttttaaaaccctaatctcggctattttagggttttaatcgatcttcttctactcgcttttgcccatttggctccgattcagatgttgagatgttgattttcaaactattctgcacagcaagcgtacctctcaaggtgaaatcaaacatacatgtccatttcatatgattttcttttgacatttgttactctttattcaattttctattcttctcttgtataattatttctgataacttgtattctcttaccactcactatagtcgaaactgatgcttctcagttatctttagaagcttaggctgtaagattattcagagaaagctgcctctctcgttttggtcttcagaaacgtcgttcactgggcgaaacggcaggtagagctgtaaaatatacctactctcataaaacaccagttatggctgctgagattaacaggcactacagtaatggtaatttacaaaatcaaccccaaaggaactatcaaattgttgttgctgctactcgagatttgggtatcggcaaggacgggaagttgccttggaagctcccatccgacctcaaatattttaaagaagtcacagtgtcaacgttagatccctcaaagaagaatgcagttatcatgggtaggaaaacatgggaaagcattcctcttcagtataggccattgcctggtcgcttgaatatcatccttactcgttcgggaagttttgatatcgcaacactacagaatgttatttgttgtgcaagcttgagttctgcattggagctgttatcatcgacaccttattctttgtcgattgaaaaggtgtttgtcataggaggtggccaggtgttaagggatgctcttaatgctcctgaatgtgaggccattcatctcacagatatagaaacaagcttcgactgcgacactttcattccttcaattgatttttcagtgttccagccatggtactcatccatccctacggtggagaacaacataagatattcttttgtgacgtatgttcgtgtacgtagttcagctccggacaagcttcatgcctcaaatggttgtgaaccaactgaaaacaactcacataaggatcaatttgaggttgagaagttctcatttcttcctaaagtgatattcgaaagacatgaggagtatatgtatttaaaacttgtccaagatataatagaaaatggtgctacgaagaatgataggacaggaactggaacattgtccaaatttggttgccagatgcggttcaacttgcgaagatcttttcctttgcttacaaccaagaggatattctggcgtggtgttgttgaagagctcctgtggttcatcagtggttcgacaaatgcaaaggttttacaggacaagggcatatatatatgggatggaaatgcttcgagggagtatctggacagtgctggcttagctcatcgggaagaaggtgatttagggccaatatatggattccagtggagacattttggtgctgaatatattgacatgcatgctgactatactgggaagggttttgatcagctactggatgtaattgacaagataaagaataatccgaatgatcgccgtatcatcctttctgcgtggaacccttcagatctcaagaaaatggctcttcccccctgccacatgtttgcacaattctatgttgagaagggagagttgtcatgccaaatgtaccaacgatctgcagatatgggtcttggcgtgccatttaatatcgcatcttattctcttttgacatgcatcatagctcaagtctgtggtctatctcctggggattttgtccatgttatcggggatgctcacgtgtataggactcatgtcaggcctttggaggagcaaattcagaagcaacctaaaccatttccgatattgaagatcaatcctttgaagaatgatatagattcctttgtggcatctgattttaagcttattgggtatgatcctcaccacaagatagaaatgaaaatggcagtgtagagcctcaagctattttagtactttgacctacagtcatcgttctaagttcaaactttgtggaggtacagctactacctgatgtggtgggggcttgagaataagaaactaaagatgatgttgaaaggtgaattgagtgtgtctttgtcgtgttgtcttcctttggtttcacattgaaatctgatggatgaaattctgggttcttttattttatgttgagcctggacttgcataatatattcattgacttatacattactagggtggtataactgcatctttgctgttttcagctattgacgtttctttttaatacaattgaaaaattgtttacagctatttattatacttcctgctgataagttggatgataatgtccgtttcaagcttggtcagaagattggcatttaggttaagtttaagtatttaaccaggttgacagttcaagagttcaggaaaatttgtcgatggcttagcttgtataataaaaatatgcagcacttaaaatataaaatatcctgaaatttttatgtagcatttttacttgcattaacttcaacgtatgaagaaacatatgaagtacttaaattagatttggtaatgtgtaatgtatgaagtacttacattagttgatccatttataggttatccataagttttatgatgttttggtccacaattataaattaataaatacactcagacagcagaactctcgtgtacaatttgtaatcttttcagg

SEQ ID NO: 2333 - DNA, 2601 bp, Ananas comosus
ctctccctctcactctcttttaaaaccctaatctcggctattttagggttttaatcgatcttcttctactcgcttttgcccatttggctccgattcagatgttgagatgttgattttcaaactattctgcacagcaagcgtacctctcaagaaacttaggctgtaagattattcagagaaagctgcctctctcgttttggtcttcagaaacgtcgttcactgggcgaaacggcaggtagagctgtaaaatatacctactctcataaaacaccagttatggctgctgagattaacaggcactacagtaatggtaatttacaaaatcaaccccaaaggaactatcaaattgttgttgctgctactcgagatttgggtatcggcaaggacgggaagttgccttggaagctcccatccgacctcaaatattttaaagaagtcacagtgtcaacgttagatccctcaaagaagaatgcagttatcatgggtaggaaaacatgggaaagcattcctcttcagtataggccattgcctggtcgcttgaatatcatccttactcgttcgggaagttttgatatcgcgacactacagaatgttatttgttgtgcaagcttgagttctgcattggagctgttatcatcgacaccttattctttgtcgattgaaaaggtgtttgtcataggaggtggccaggtgttaagggatgctcttaatgctcctgaatgtgaggccattcatctcacagatatagaaacaagcttcgactgcgacactttcattccttcaattgatttttcagtgttccagccatggtactcatccatccctacggtggagaacaacataagatattcttttgtgacgtatgttcgtgtacgtagttcagctccggacaagcttcatgcctcaaatggttgtgaaccaactgaaaacaactcacataaggatcaatttgaggttgagaagttctcatttcttcctaaagtgatattcgaaagacatgaggagtatatgtatttaaaacttgtccaagatataatagaaaatggtgctacgaagaatgataggacaggaactggaacattgtccaaatttggttgccagatgcggttcaacttgcgaagatcttttcctttgcttacaaccaagaggatattctggcgtggtgttgttgaagagctcctgtggttcatcagtggttcgacaaatgcaaaggttttacaggacaagggcatatatatatgggatggaaatgcttcgagggagtatctggacagtgctggcttagctcatcgggaagaaggtgatttagggccaatatatggattccagtggagacattttggtgctgaatatattgacatgcatgctgactatactgggaagggttttgatcagctactggatgtaattgacaagataaagaataatccgaatgatcgccgtatcatcctttctgcgtggaacccttcagatctcaagaaaatggctcttcccccctgccacatgtttgcacaattctatgttgagaagggagagttgtcatgccaaatgtaccaacgatctgcagatatgggtcttggcgtgccatttaatatcgcatcttattctcttttgacatgcatcatagctcaagtctgtggtctatctcctggggattttgtccatgttatcggggatgctcacgtgtataggactcatgtcaggcctttggaggagcaaattcagaagcaacctaaaccatttccgatattgaagatcaatcctttgaagaatgatatagattcctttgtggcatctgattttaagcttattgggtatgatcctcaccacaagatagaaatgaaaatggcagtgtagagcctcaagctattttagtactttgacctacagtcatcgttctaagttcaaactttgtggaggtacagctactacctgatgtggtgggggcttgagaataagaaactaaagatgatgttgaaaggtgaattgagtgtctttgtcgtgttgtcttcctttggtttcacattgaaatctgatggatgaaattctgggttcttttattttatgttgagcctggacttgcataatatattcattgacttatacattactagggtggtataactgcaacctatatctttgctgttttcagctattgacgtttctttttaatacaattgaaaaattgtttacagctatttattatacttcctgctgataagttggatgataatgtccgtttcaagcttggtcagaagattggcatttaggttaagtttaagtatttaaccaggttgacagttcaagagttcaggaaaatttgtcgatggcttagcttgtataataaaaatatgcagcacttaaaatataaaatatcctgaaatttttatgtagcatttttacttgcattaacttcaacgtatgaagaaacatatgaagtacttaaattagatttggtaatgtgtaatgtatgaagtacttacattagttgatccatttataggttatccataagttttatgatgttttggtccacaattataaattaataaatacactcagacagcagaactctcgtgtacaatttgtaatcttttcagg

SEQ ID NO: 2334 - DNA, 2450 bp, Zea mays
atcacacatcccaccgccgccgccaccaccaccacccgccctatacccgtatataattactcgtacccggacgccaccgccgcctgcgccatgggcgactcctcggtggccggcgcgctcgtgccgtccgtgcccaagccggagcccgcgccgtccggtgacacctccgcggcggccgcggcgactacagcggcgctggcgatgccggaggaggcgggtatgcgcgcggcgtcggcgtcgcctcaggggcctgcggaggagggggagggccccgccgatagggacctcctctgcccgatctgcatggccgtcatcaaggacgccttcctcaccgcatgcggccacagcttctgctacatgtgcatcgtcacgcatctcagcaacaagagcgactgcccctgctgcgggcactaccttaccaaggcccagctctaccccaactttctccttgacaaggttctgaagaaaatatcagcccaacaaatagcaaaaacagcatcgccgatcgatcaatttcgatgtgcattgcaacagggaaatgaaatgggggttaaagagttggatagccttatgactttgattgctgagaagaagcggcaaatggaacaacaagaatcagagacaaatatgcaaatattgctagtcttcttacactgccttagaaagcaaaagctagaagagttgaatgagattcaaactgatctacaatacatcaaagaggatataagttctgtggagagacatagggcagaattatatcgcacaaaagaaaggtactccatgaagctgcgcatgcttttagatgagcctactgcgcaaaaaatgtggccctctcctatagacaaagctagctgtcgctttcttcccaactctcggacaccacttagtggatcatgtccaggaactttacagaataagaagcttgatttgaaagctcaagtaagccatcaaggatttcaaaggagagatgctctaacttcttctgatcctcctaactcccctatacaatcgggtaatgttattgctaggaagaggcgagttcaagcacagttcaatgagcttcaagaatactacctgcaaagacgtcgtactggagcacaggcacgcagacaagaagaaagagatatagttgcaatgaatagagaaggctatcatgcaggtcttcaggatttccagtctgtgctaacaacgttcactcgatacagtcgtctacgtgtcattgcggaactaagacatggagacttgtttcactctgccaatattgtatccagtattgaatttgatcgtgatgatgaactatttgctaccgctggagtctcgaaacgtattaaagtcttcgaattttccactgttgttaatgaaccatcagatgtgcattgcccagttgttgaaatggctaccagatctaaacttagctgcctaagctggaacaagtactcaaaaaatattattgcaagcagtgactatgagggtatagtaactgtgtgggatgttcagacccgtcagagtgtgatggaatatgaagagcatgagaagagagcatggagtgttgatttttctcgcacagactcttcaatgctagtatctgggagtgatgattgcaaggtgaaagtgtggtgcacaaatcaagaagcaagtgtgatcaatattgatatgaaagcaaatatttgctcggttaaatataatcctggatcaagcttctacgttgcagtcggatctgctgatcaccatattcattactttgatttacgtaatccaagttcgcctgtccatattttcggggggcacaagaaagcagtatcatatgtgaaattcttatctaacaatgagcttgcgtctgcatcaacagatagcacattacgcttatgggatgtcaaggataactgcccggtacggacattcagagggcacaaaaatgaaaagaactttgttggcttgtctgtgaacaatgaatatattgcttgtggaagtgagacaaatgaggtttttgtttatcacaaggctatctcgaaaccggcagcaagccatagatttgtatcttctgacctggatgatgccgatgatgatcctggttcttatttcattagtgctgtctgctggaagagtgatagccctacgatgttaactgctaacagtcaggggaccataaaagttcttgtacttgctccttgatgttatggagggcgttcaagaggttcacagtactgtccagttgtttcctttcgtgtcattatattcccccaaaattgggaacgggggcataattgatctccggttagggaatgaagttttgcagatggtcagctgacgtagggttttgaggtatcagaatgtgcatagtcatgtttatgttgtataggtgtaattgtgtaaagcagccaagttattggttacaagtgtaacacgagaaatacacattaataaaaaaaaaacctccagctcgtttgtac

SEQ ID NO: 2335 - DNA, 2576 bp, Sorghum bicolor
tcccaccgccgcccgccaccaccaccacgcgccccacacccggatgcaattattcgcacccggagccggacgccaccgccaccgccaccgcctctgcctccactgccgccgcctgcgccatgggcgactcctcggtggccggcgcgctcgtgccgtccgtgcccaagccggagcccgcgcggtccggtgacacctccgtggcggccgcggcgaccacggcggcgctggcgctggcgctgccggaggaggcggggacgcgcgcggcgtcggcgtcgccgcaggggccgccggcggaggacgagggccccgccgatagggacctcctctgcccgatctgcatggccctcatcaaggacgccttcctcaccgcctgcggccacagcttctgctacatgtgcatcgtcacgcacctcagcaacaagagcgactgcccctgctgcgggcactacctcaccaaggcccagctctaccccaactttctccttgacaaggttctgaagaaaatatctgcccggcaaattgcaaaaacagcatcaccgatcgatcaatttcgatgcgcactgcaacagggaaatgaaatgggggttaaagagttagatagccttatgactttgattgctgagaagaagcggcaaatggaacaacaagaatcagagacgaatatgcaaatattattagtcttcttgcactgccttagaaagcaaaagctggaagagttgaatgagattcaaactgatctacagtacatcaaagaggatataagtgctgtggaaagacataggaaagaattatatcgcacaaaagaaaggtactccatgaagctgcgcatgcttttagatgagcctactgcacaaaaaatgtggccctctcctatagacaaagctagctgtcgctttcctcccaactctcggacaccacttagcgcatcatgtccaggaactttacagaataagaagcttgatttgaaagctcaagtaagccatcaaggatttcaaaggagagatgctctaacttcttctgaccctcctaacccccctatacaatcgggtaatgtcattgctaggaagaggcgagttcaagcacagttcaatgaacttcaagaatactacctgcaaagacggcgcaccggagcacaggcacgcaggcaagaagaaagagatatcgttgcaatgaatagagaaggctatcatgcaggtcttcaggatttccagtctgtgctaacaacgttcactcggtacagtcgtctacgtgtcattgcggaactaagacatggagacttgtttcactctgccaatattgtatccagtattgaatttgatcgtgatgatgaactatttgctactgctggagtctcaaaacgtattaaagtctttgaattttctactgttgttaatgaaccatcagatgtgcattgcccggttgttgaaatggctaccagatctaaacttagctgcctaagctggaacaagtactcaaaaaatgttattgcaagcagtgactatgagggtatagtaactgtgtgggatgtccagacccgtcagagtgtgatggaatatgaagaacatgagaagagggcatggagtgttgatttttctcgtacagacccttcaatgctagtatctggtagcgacgattgcaaggtgaaagtgtggtgcacaaaacaagaagcaagcgtgatcaatatcgatatgaaagcaaatatttgctcggttaaatataatcctggatcaaacttctacgttgcagttggatctgctgatcaccatattcattactttgacttacgtaatccaagtgcgcctgtccatatttttggtggccacaagaaagcagtatcgtatgtgaaattcttatctaacaatgagcttgcatctgcatcaacagatagcacattacgcttatgggatgtcaaggataattgtccggtacggacgttcagagggcacaaaaatgaaaagaacttcgttgggttgtctgtgaacaatgagtatattgcttgtggaagtgaaacaaatgaggtttttgtttatcacaaggctatctcaaaaccggcagcaagccatagatttgtatcctctgacctggatgatgccgatgatgatcctggttcttatttcattagtgctgtctgctggaagagtgatagccctaccatgttaaccgctaacagtcagggaaccataaaagttcttgtacttgctccttgatgttatggaaggcgttcaagagatttacagccagcttgtatgtcttaatgtccagttgtttcctttcatgccattatatttccccaaaagtgggaacggaggcattgctgatctccggttagggcatgaagttttgcagatggtcagctgacgtagggttttgaggtatcagaatgtgcataatcatgttaatgtcgtataggtgtaaagcagccaagttatcggttacaagtgtaacacgagaaatacacattaataaaactccagcccgtttgtacagaggttgtgtttgaacccagaaacttatgtggttatgccggttgataatacatctacctgatatgaatgatcaaactgatgccacaataa

SEQ ID NO: 2336 - DNA, 2963 bp, Panicum virgatum
aactactccgcgcgggcgggggcgcggcagcagccggtccagtccttggcgctctcgcagcttcgcttccgcccagtcgccttccccgacgtggtctcctcccacccatacgcccttcccctcccacacccacagaacccaattccctcgcgcttcctcttccccctcccgcatcacacatcccccccaccaggccaccaccaccaccaccacccaccgcctgatcccgtatgcaattattcgcacccggacgccaccgcccccaccaccaccgcatccgccatgggcgactcctcggtggccggcgcgctcgtgccgtccgtgcccaagccggaggccgcgccgtccggtgacgcctccgcggcggcgctggcgctggcggaggaggcgggcacgcgcgcggcgtcggcgtccccgcagggcccggcggaggagggggagggacccgccgacagggacctcctctgcccgatctgcatggcggtcatcaaggacgccttcctcaccgcctgcggccacagcttctgctacatgtgcatcgtcacgcacctcagccacaagagcgactgcccctgctgcgggcactacctcaccaaggcccagctctaccccaatttcctcctcgacaaggttctgaagaaaatttcggcccggcaaattgctaaaacagcatcaccaatcgatcaatttcaatatgcattgcaacagggaaacgaaatgggggttaaagagttagatagtcttatgactttgatttctgagaagaagcggcaaatggaacaacaagaatcagagacaaatatgcaaatattgttagtcttcttgcactgccttagaaagcaaaagctggaagagttgaatgagattcaaactgatctacagtacatcaaagaagatataggcgctgtggagagacataggttagaattgtatcgcacaaaagaaaggtactccatgaagctgcgcatgcttttggatgatcctgctgcacaaaaaatgtggccctctcctatagacaaagctagcagtctctttcttcccaattctcggacaccacttagcgcatcatgcccaggaagtttacagaataagaagcttgatttgaaagctcaagtaagccaccaaggatttcaaaggagagacgctctaacttgttcagaccctccaaactcccctatacaatcgggtaacatcattgctaggaagaggagagttcaagcacagtttaatgagcttcaagaatactacctgcaaagacggcgcactggagcacaggcacgcaggcaagaagaaagagacattgttgcaatgaacagagaaggttatcatgcaggtcttcaggatttccagtctgtgctaacaacattcactcgatacagtcgtctacgtgtcatcgcggaactaaggcatggagacttgtttcactctgccaatattgtatcaagcattgaatttgatcgtgatgatgaactattcgctactgctggcgtctcgaagcgtattaaagtttttgaattttctagtgttgttaatgagccatcagatgtgcattgcccggctgttgaaatggctacgagatctaaacttagttgcctcagctggaacaagtactcaaaaaatgttatcgcaagcagtgactatgagggtattgtaactgtttgggatgtccagacccgtcagagtgtgatggagtatgaagagcatgagaagagagcgtggagcgttgatttttctcgtacagaaccttcaatgctagtatcagggagtgatgattgcaaggtgaaagtgtggtgcacaaaacaagaagcaagcgtgatcaatattgatatgaaagcaaatatttgctcagttaaatataatcctgggtcaagcttctatgttgcagtcggatctgctgatcaccatattcattactttgatttacgtaatccaagtgcacctgtccatgtttttggtgggcacaagaaggcagtatcgtatgttaaattcttatctaacaatgagcttgcgtctgcatcaacagatagcacattacggttatgggatgtcaaggatcattgcccggtacggacgtttagagggcacaaaaatgaaaagaactttgttgggttgtctgtgaacagtgagtatattgcttgtggaagtgaaacaaatgaggtttttgtttatcacaaggcaatctcaaaacctgcagcgagccatagatttgtatcctctgacctgggcgatgctgaggatgatcctggttcttatttcattagtgctgtctgctggaagagtgatagccctaccatgttaactgctaacagccagggaacgattaaagttcttgtacttgctccttgatgttaccaaggggttacagccagcttgtatatcttattaggattttgagggatttcgtgccattatattccctaagtgggatttggagcatcattgatctccggtttagggcacgaagttttggagctggtcacctgacgtaggattttgaggtttcagaatgtgcataatcattgttatgttgtataggtgtaaaagcagcgaagttattgattacaagtgtaacatgagaaatacaccttaataaaatccattatttctacattgatgaggatgcttgtgtttgaactcagaaacttatgtggctatgtcggttgcccatactactaaccaccttatcacccatcgttactttgtccacctttgagtttatcctgatttaatcctttttcagaagaaatcctgatttaatcttggtggcttgcaagtcgtttttttttaacgtccagtgttagcttcctgaagcatgttttgtttgttcgattaggcgatcttacgaaccgagtgtacacaaaaatacagatttgatttctttgtcgtggggcagcagtttccgagtcctcttccagaaatggtgaagatgtgctgtctagtttcttcgttgaaatttgaagccg

SEQ ID NO: 2337 - DNA, 2821 bp, Setaria italica
atcaccacatcccaccaggccattcccaccaccatcaccacccaccccgaccccgtatgcaattattcgcacccggacgccaccgcctccgcctccaccaccaccgcatccgccatgggcgactcctcggtggccggcgcgctcgtgccgtccgtgcccaagccggaggccgcgccgtccggtgacgcctccacggcggccgcggcgaccacggcggcgctggcgctggcgctggcggaggaggcgggggcgcgcgccgcgtcggcgtcggcgtccccgcagggcccggcggcggagggggaggggcccgccgatagggacctcctctgcccgatctgcatggcggtcatcaaggacgccttcctcaccgcctgcggtcacagcttctgctacatgtgcatcgtcacgcacctcagccgcaagagcgactgcccctgctgccgccactacctcaccaaggctcagctctaccctaacttcctcctagacaaggttctgaagaaaatatcagcccggcaaatcgctaaagcagcatcaccaatcgatcaatttcgatatgcattgcaacagggaaacgaaatgggggttaaagagttagatagccttatgactttgatttctgagaagaagcggcaaatggaacaacaagaatcagagacaaatatgcaaatattgctagtcttcttgcactgccttagaaagcaaaagctggaagagttgaatgagattcaaactgatctgcagtacatcaaagaagatatcagcgctgtggagagacataggttagaattgcatcgcacaaaagaaaggtactccatgaagctgcgcgtgcttttggatgatcctgccgcacaaaaaatgtggccctctcctatagagaaagctagcagcctctttcttccaaaccctcggacaccacttagcgcatcatgtccaggaagtttgcagaataagaagcttgatttgaaagctcaagtaagccaccaaggatttcaaaggagagatgctctaacttgttcagaccctccaaattcccctatacaatcgggcaacgtcattgctaggaagaggcgagttcaagcacagtttaatgagcttcaagaatactacctgcaaagacggcgtactggagcacagtcacgcagacaagaagaaagagacattgttgcaatgaacagagaaggttatcatgcaggccttcaggatttccagtctgtgctaacaacattcactcgatacagtcgtctacgtgtcattgcggaattgaggcatggggacttgtttcactctgccaatattgtatcaagtattgaatttgatcgtgatgatgaactattcgctacggctggagtctcgaagcgtattaaagttttcgaattttccagtgttgttaatgagccatcagatgtgcactgcccggttgttgaaatggctaccagatctaaacttagttgcctcagctggaacaagtactcaaaaaatgttattgcaagcagtgactatgagggtatagtaactgtttgggatgtccagacccgtcagagtgtgatggagtatgaagagcatgagaagagagcatggagcgttgatttttctcgtacagaaccttcaatgctagtatcagggagtgatgattgcaaggtgaaagtgtggtgcacaaaacaagaagcaagcgtgatcaatattgatatgaaagcaaatatttgctcagttaaatataatcctggatcaaacttctatgttgcagtcggatctgctgatcaccatattcactactttgatttacgtaatccaagtgcacccgtccatatttttggtgggcacaagaaggcagtatcgtatgtgaaattcttatctaacaatgagcttgcgtctgcatcaacggatagcacattacggttatgggatgtcaaggataattgcccggtacggacattcagagggcacaaaaatgaaaagaactttgttgggttgtctgttaacaatgagtatattgcttgtggaagtgaaacaaatgaggtttttgtttatcacaaggcaatctcaaaacctgcagcaagccatagatttgtatcttctgacttggacgatgctgatgatgatcctggttcttatttcattagcgccgtctgctggaagagcgatagccctaccatgttaactgctaacagtcaggggacaatcaaagttcttgtacttgccccttgatgttatcaagggctttcacgagatttacagtcagcttgtatatcttactgtccagttgtttcttttcgtgccattatattcccaaagtgggagtggaggtattattgatctccggtttagggcacgaagttttgaagctggtcagctgacgtagggtttgaggtctcagaatgtgcatattcatgttgatgttgtatatatgtaaaagcagccaagatattgattacaagtgtaacatgaggaatacaccttgataaagccccttatttctacattgagggtatttgtgtttaaactcagaaacttatgtggttatgacggttgcccatacttcttcccaccttgatcaccaattgttacctttttccagttttgttttaagtttctgcttaaattttgttggcggtttgccagtggtttttaacatcctattgtttagcttcctgaagtatgttcagtttgtccggttaggcgtgcacaaatatatactgtattacatttctttgttttggggcagcattttcagggtcctcttcctggtttctgcagtggtgaagatgtggcgctgtgtaagtttcttctttgaaatttgaaattggtgtaggttttgtga

SEQ ID NO: 2338 - DNA, 2813 bp, Setaria italica
atcccaccaggccattcccaccaccatcaccacccaccccgaccccgtatgcaattattcgcacccggacgccaccgcctccgcctccaccaccaccgcatccgccatgggcgactcctcggtggccggcgcgctcgtgccgtccgtgcccaagccggaggccgcgccgtccggtgacgcctccacggcggccgcggcgaccacggcggcgctggcgctggcgctggcggaggaggcgggggcgcgcgccgcgtcggcgtcggcgtccccgcagggcccggcggcggagggggaggggcccgccgatagggacctcctctgcccgatctgcatggcggtcatcaaggacgccttcctcaccgcctgcggtcacagcttctgctacatgtgcatcgtcacgcacctcagccgcaagagcgactgcccctgctgccgccactacctcaccaaggctcagctctaccctaacttcctcctagacaaggttctgaagaaaatatcagcccggcaaatcgctaaagcagcatcaccaatcgatcaatttcgatatgcattgcaacagggaaacgaaatgggggttaaagagttagatagccttatgactttgatttctgagaagaagcggcaaatggaacaacaagaatcagagacaaatatgcaaatattgctagtcttcttgcactgccttagaaagcaaaagctggaagagttgaatgagattcaaactgatctgcagtacatcaaagaagatatcagcgctgtggagagacataggttagaattgcatcgcacaaaagaaaggtactccatgaagctgcgcgtgcttttggatgatcctgccgcacaaaaaatgtggccctctcctatagagaaagctagcagcctctttcttccaaaccctcggacaccacttagcgcatcatgtccaggaagtttgcagaataagaagcttgatttgaaagctcaagtaagccaccaaggatttcaaaggagagatgctctaacttgttcagaccctccaaattcccctatacaatcgggcaacgtcattgctaggaagaggcgagttcaagcacagtttaatgagcttcaagaatactacctgcaaagacggcgtactggagcacagtcacgcagacaagaagaaagagacattgttgcaatgaacagagaaggttatcatgcaggccttcaggatttccagtctgtgctaacaacattcactcgatacagtcgtctacgtgtcattgcggaattgaggcatggggacttgtttcactctgccaatattgtatcaagtattgaatttgatcgtgatgatgaactattcgctacggctggagtctcgaagcgtattaaagttttcgaattttccagtgttgttaatgagccatcagatgtgcactgcccggttgttgaaatggctaccagatctaaacttagttgcctcagctggaacaagtactcaaaaaatgttattgcaagcagtgactatgagggtatagtaactgtttgggatgtccagacccgtcagagtgtgatggagtatgaagagcatgagaagagagcatggagcgttgatttttctcgtacagaaccttcaatgctagtatcagggagtgatgattgcaaggtgaaagtgtggtgcacaaaacaagaagcaagcgtgatcaatattgatatgaaagcaaatatttgctcagttaaatataatcctggatcaaacttctatgttgcagtcggatctgctgatcaccatattcactactttgatttacgtaatccaagtgcacccgtccatatttttggtgggcacaagaaggcagtatcgtatgtgaaattcttatctaacaatgagcttgcgtctgcatcaacggatagcacattacggttatgggatgtcaaggataattgcccggtacggacattcagagggcacaaaaatgaaaagaactttgttgggttgtctgttaacaatgagtatattgcttgtggaagtgaaacaaatgaggtttttgtttatcacaaggcaatctcaaaacctgcagcaagccatagatttgtatcttctgacttggacgatgctgatgatgatcctggttcttatttcattagcgccgtctgctggaagagcgatagccctaccatgttaactgctaacagtcaggggacaatcaaagttcttgtacttgccccttgatgttatcaagggctttcacgagatttacagtcagcttgtatatcttactgtccagttgtttcttttcgtgccattatattcccaaagtgggagtggaggtattattgatctccggtttagggcacgaagttttgaagctggtcagctgacgtagggtttgaggtctcagaatgtgcatattcatgttgatgttgtatatatgtaaaagcagccaagatattgattacaagtgtaacatgaggaatacaccttgataaagccccttatttctacattgagggtatttgtgtttaaactcagaaacttatgtggttatgacggttgcccatacttcttcccaccttgatcaccaattgttacctttttccagttttgttttaagtttctgcttaaattttgttggcggtttgccagtggtttttaacatcctattgtttagcttcctgaagtatgttcagtttgtccggttaggcgtgcacaaatatatactgtattacatttctttgttttggggcagcattttcagggtcctcttcctggtttctgcagtggtgaagatgtggcgctgtgtaagtttcttctttgaaatttgaaattggtgtaggttttgtga

SEQ ID NO: 2339 - DNA, 3106 bp, Panicum virgatum
ccatcacagataaaagagtgataacccagcatgtccccatccactcgtgttgctgaagaacgcatccgtgcgtccagccttcaaaatccggcaaaattttggacttttcagtcctgagcgaaaaacctttagcccgcaaacacaacgtttcaatggggcatatgaattttttttacttaaatttggccgaatcaagtcggtcccgcacaattccatagcgacttcacaaggatttcggttcagacttcagaggcgttgtgcgcgtgatcatctcggttccccgtcgacggttggtgcgcgcggcgcggctcaccgtctccctggcgtgcagcggcggcgccaagccacctagcgctggcgggggcgcggcagcagccctggcgctctcgcagcttcgcttccgcccagtcgccttccccgacgtggtctcctcccacccatacgcccttccccttccacacccacagaacccaattcccccgcgcttcctcttccccctcccgcatcacacatcccccaccaggccaccacccaccgcccgaccccgtatgcaattattcgcacccggacgccaccgcctccaccaccatcgcatccgccatgggcgactcctcggtggccggcgcgctcgtgccgtccgtgcccaagccggaggccgcgccgtccggtgacgcctccacggcggccgcggcgaccacggcggcgctggcgctggcggaggaggcgggcacgcgcgcggcgtcggcgtccccgcagggcccggcggcggagggggaaggccccgccgacagggacctcctctgcccgatctgcatggcagtcatcaaggacgccttcctcaccgcctgcggccacagcttctgctacatgtgcatcgtcacgcacctcagccacaagagcgactgcccctgctgcgggcactacctcaccaaggcccagctctaccccaatttcctcctcgacaaggttctgaagaaaatatcggcccggcaaattgctaaaacagtgtcaccaatcgatcaatttcgatatgcattgcaacagggaaatgaaatgggggttaaagagttagatagccttatgactttgattgctgagaagaagcggcaaatggaacaacaagagtcagagacaaatatgcaaatattgttagtcttcttgcactgccttagaaagcaaaagctggaagagttgaatgagattcaaactgatctgcagtacatcaaagaagatataggcgctgttgagagacataggttagaattgtatcgcacaaaagaaaggtactccatgaagctgcgcatgcttttggatgattctgctgcacaaaaattgtggccctctcctatagacaaagctagcagtctctttcttcccaattctaggacaccacttagcgcatcatgtccaggaagtttacagaataagaagcttgatttgaaagctcaagtaagccaccaaggatttcaaaggagagatgctctaacttgttcagagcttccaaattccactatacaatcgggtaacgtcattgctaggaagaggcgagttcaagcacagtttaatgagctacaagaatactacctgcaaagacggcgcactggagcacagtcactcaggcaagaagaaagagacattgttgcaatgaacagagaaggttatcatgcaggtcttcagaatttccagtctgtgctaacaacgttcactcgatacagtcgtctacgtgtcattgcggaactaaggcatggagacttgtttcactctgtcaatattgtatcaagcattgaatttgatcgtgatgatgaactattcgctactgctggagtctcgaagcgtattaaagtttttgaattttctagtgttgttaatgagccatcagatgtacattgcccggttgttgaaatggctaccagatctaaacttagttgcctcagctggaacaagtactcaaaaaatgttatcgcaagcagtgactatgagggtattgtaactgtttgggatgtccagacccgtcagagtgtgatggagtatgaagagcatgagaagagagcatggagcgttgatttttctcgtacagaaccttcaatgctagtatcagggagtgatgattgcaaggtgaaagtgtggtgcacaaaacaagaagcaagcgtgatcaatattgatatgaaagcaaatatttgctcagttaaatataatcctggatcaagcttctatgttgcagtaggatctgctgatcaccgtattcattacttcgatttacgtaatccaagtgcacctgtccatgtttttgatgggcacaagaagacagtttcgtatgttaaattcttatctaacaatgagcttgcatctgcatcaacggatagcacgttacggttatgggatgtcaaggataattgcccggtaaggacgttcagagggcacaaaaatgaaaagaacttcgttgggttgtctgtgaacaatgagtatattgcttgtggaagtgaaacaaatgaggtttttgtttatcacaaggcaatctcaaaacctgcagcgagccatagatttatatcctctgacctggatgatgctgatgatgatcctggttcttatttcattagtgctgtctgctggaagagtgatagccctaccatgttaactgctaacagccagggaacgattaaagttcttgtacttgctccttgatgttaccaaggggttagaaccagcttgtgtatcatattagtccagttgtttcttttggtgccattatattccctaagtgggatttggaggcatcattgatctccggtttagggcacgaagttttggagctggtcacctgacgtagggttttgaggtctcagaatgtgcataatcattgttgtgtataggtgtaaaagcagcgaagttattgattacaagtgtaacatgagaaataaaccttaataaaatccattatttctacattgatgaggatacttgtgtttgaactcatcagaaacttatgtggttatgtcggttgcccatactactatccaccttaccacccatcgttactttgtccacctttgagtttatcctgatttaatctttttttagagtaaaatcttgctttaatcttggtgac

SEQ ID NO: 2340 - DNA, 2494 bp, Zea mays
cggcccttgagcccttccaccctctcccaggcatcacacattccaccaccaccgccgccgccatcaccactgtgaccaccagccccacactcgtatgtgattattggcacccggacgccaccgcctccgcctccaccaccgactgcgccatgggcgactcctcggtggccggcgcgcttgtgccgtccgtgcccaagccggagaccgcgccgtccggtgacaactctacggcggcgctggcgctgccggaagaggcggggacgcgcgcggcgtcggcgtcgccgcagggacctgcggaggaagagggccccgccgatagggacctcctctgcccgatctgcatggccgtcatcaaggatgccttcctcaccgcctgcggccacagcttctgctacatgtgcgtcgtcacgcacctcagcaacaagagcgactgcccctgctgcgggcactaccttaccaaggcccagctctacccaaactttctccttgacaaggttctgaagaaaatatcagcccgacaaatcgcaaaaacagcgtcaccggtcgatcaatttcgatgtgcattgcaacagggaaatgaaatgggagttaaagagttagatagccttatgactttgattgctgagaagaagcggcaaatggaacaacaagaatcggagacaaatatgcaaatattgttagtcttcttgcactgccttagaaagcaaaagctggaagagttgaatgagatccaaagtgatctacagtacatcaaagaggatataagtgctgtggagagacatagggtagaattataccgcacaaaagaaaggtactccatgaagctgcgcatgcttttagatgagcctactgcacaaaaaatgtggccctctcctatggacaaagctagttgtcgctttcctcccaactctcggacaccacttggcggatcatgtccaggaactttacagaataagaagcttgatccgaaagctcaagtaagccatcaaggatttcaaaggagagatgctctaacttcttctgaccctcctaactcctctattcaatcgggtaatgtcattgctaggaagagacgagttcaagcacagttcaatgagcttcaagaatactacctgcaaagacggcgtactggagcacaggcacgcagacaagaagaaagagagaccgttgcaatgaatagagaaggctatcatgcaggtcttcaggatttccagtctgtgctaacaacattcactcgatatagtcgtctacgtgtcattgcggaactaagacatggagacttgtttcactctgccaatattgtgtccagtattgaatttgatcgtgatgatgaactatttgctactgctggagtctcgaaacgtattaaagtcttcgaattttctactgttgttaatgaaccatcagatgtgcattgcccggttgttgaaatggctaccagatctaaacttagctgcctaagctggaacaagtactcaaaaaatattatcgcaagcagtgactatgagggtatagtaactgtgtgggatgtccagacccgccagagtgtgatggaatatgaagagcatgagaaaagagcatggagtgttgatttttctcgaacagagccttcaatgctagtatctgggagtgacgattgcaaggtgaaagtgtggtgcacaaaacaagaagcaagcgtgatcaatattgatatgaaagcaaatatttgttcggttaaatataatcctgggtcaagcttctatgttgcagtcggatctgctgatcaccatattcattacttcgatttacgtaatccaagtgcgcctgtccatgtttttggggggcacaagaaagcagtatcgtatgtcaaattcttatctaacaatgagcttgcatctgcatcaacagatagcacgttacgtttatgggatgtcaaggataatttgccggtacggacattcagagggcacaaaaatgaaaagaacttcgttggattgtctgtgaacaatgagtatattgcttgtggaagtgaaacaaatgaggtttttgtttatcacaaggctatctcaaaaccagcagcaagccatagatttgtatcctctgacctggatgatgccgatgatgatcctggttcttatttcattagtgctgtctgctggaagagtgatagccccaccatgttagctgctaacagtcagggaaccataaaagttcatgtacttgctccttgatgtcgtggagggcgttcaagagatttacagccagcgcgtgtatgtcgtactgtccaggtgttccctttcgtgccattatattccccaaaagcgagaatggaggcattattgatctccggttagggcatgaatttttgcagacgatggccagctgacgtagggttttgaggtatcagaatgtgcataatcatgtttatgttgtacaggtgtaaatcagccaagttattgattacaagtgtgacatgagaaatacacattaataaaaactccagctcggttgtaca

SEQ ID NO: 2341 - DNA, 2393 bp, Secale cereale
gcaattattcccccctcacacccggccgcggcaccaccaccaccacatccccatgggcgactcctcggtcgcccccgccggcgcgctcgtgccgtcggtgcccaagccggagcacgcgccgtccgggggggacgcggcggcccagctccaggccctggcggcggcggcgacggacgacgcgtgcgcgggcgcggccgcctcgccgtcgacgtcgccgggggagcggcggcggagggggcggaggcccagggcgacagggacctgctctgcccgatctgcatggggctcatcaaggacgccttcctcaccgcctgcggccacagcttctgctacatgtgcatcgtcacgcacctcaaccacaagagcgactgcccctgctgcgccaactacctcaccaaggcgcagctctaccccaacttcctcctcgacaaggtcgtgaagaaaatgtcggcacggcaagttgcaaaaacagcgtctcccattgatcaattccgacatgttgtgcaacagggaaacgacatgacagttaaagagctagacagccttatgactttgattgctgagaagaagaggcaaatggaacaacaagagtcagagacaaatatgcaaatattgctagtcttcttgcactgccttagaaagcaaaagcttgaagagttgaacgagattcaaactgacctgcagtacatcaaagatgatataagcagtgtggagagacataggttagatctgcatcgaacaaaagaaaggtactccatgaggcttcgcatgcttttggatgaacctgctgcatcaaagatgtggccttcgcctatggacaaacctagtagtccctttgttcccaactctcgggcaccacctagcacatcatctccaggggggttaaataataggaggtttgatttgagagctccggcaatccatcaaggacatcaaagaagagatgcccttgccagctcagaccctcccaatccccctatacagtcggctaatgttattgctcggaagaggcgagttcaagcgcagtttaacgagcttcaagaatactatctgcaaagacggcgtactggagcgcaatctcacagacaggaggatgttacgatgaatagagaaggttatcatgaaggtcttgaagattttcagtctgttcttacaacattcactcgatatagtcgcttacgtgtaattgcggaacttagacatggagatctgttccattcagcaaatattgtatccagtatcgaatttgatcgtgatgatgagctattcgctactgctggagtctcgaagcgtattaaagtcttcgaattttctacagttgttaatgagccatcagatgtccactgtccagttgttgaaatggctaccagatctaaactcagctgccttagctggaacaagtactccaaaaatgttatagcaagtagtgattatgaaggcatagttactgtttgggatgttcaaacccgccagagtgtgatggagtatgaagagcatgagaaaagagcatggagtgttgatttttcacgtacagagcccaagatgctagtatctggcagtgatgattgcaaggtcaaagtgtggtgcacaaatcaggaagcgagtgctattaacattgatatgaaggcaaatatttgctctgttaaatataatcctggatcgagctactatgtcgcagtgggatctgctgatcaccacattcattattttgatttacgaaatccaagtgcacctctccatgtttttggtgggcacaagaaagctgtttcttatgtgaaattcttatctaataatgagcttgcatctgcatcgaccgatagcacgttacggttatgggatgtcaaggacaatttgccactaaggactttcagagggcacaaaaatgagaagaacttcgtaggactatctgtaaataacgaatatattgcttgcgggagtgaaacaaatgaggtttttgtttaccacaaggctatctcaaaacctgcttccagccataggtttctatccacggacctggacgacgccgaagatgatcccgggtcttacttcattagcgctgtctgctggaagagcgatagccctactatgctaaccgctaacagccaggggaccattaaagttcttgtgctcgccccttgacgcgatcaggggagatctgtagctagcttgtatatcctatgtatcccgtcgtttcattgttgtgccattatatgtcccgaagtgggaagtggaggcatattgatctccagcctagggcgcgaaatttttgtggaggtaatcgtctgacgtagggttccaagggctcggaatgtgcatagtggtggtgactcttgtataggtgcaaagcagtcggcttgtctattatagtactatacatctgtaacgtgagaaaa

SEQ ID NO: 2342 - DNA, 2237 bp, Avena sativa
gccgtcgccgtcgtcctcgccgcggcgagcagcaggacgaggaggatggggacggggcggaggccgccgcggccgccgacagggagctgctctgcccgatctgcatggcgctcatcaaggacgccttcctcaccgcctgcggccacagcttctgctacatgtgcatcgtcacgcacctcacccacaagagcgactgcccctgctgcagcaactacctcaccaaggcgcagctctacccaaacttcctgctcgacaaggtcttgaagaaaatgtcggcccggcaagttgcaaaaacagcatctccgattgagcaacttcgacatgttgtgcaacagggaaatgatatgtcggttaaagagctagacagccttatgactttgattgctgagaagaagaggcaaatggaacaacaagagtccgagacaaatatgcaaatattgctagtcttcttgcactgccttagaaagcaaaagctggatgagttgaatgagattcaaactgatctgcagtacatcaaagatgatataaacagtgtggagagacatagattagatttgtatcgaacaaaagaaaggtactccatgaagctgcgcatgcttttggatgaacctgctgcatcaaagatgtggccctcacctatggacaaacctagcagtctctttctccccaactctcgggcaccacttaatgcatcatctccagggggtttaaataatcggaagcttgatttgagaggtcaagtaagtcatcaaggatatcaaagaagagatgcccttgcttgcccagaccctcctaacccccctatacagtcgagtaatgttattgctcggaagaggcgagttcaagcacagtttaacgagcttcaagaatactatctgcaaagacggcgtactggagcacagtcccgcaggcaggaggacgttacgatgaatagagaaggttatcatgaaggtcttgaagattttcagtctgtgctaacaacattcactcgatatagtcgattacgtgtaattgcggaacttagacatggagatctgtttcacactgcaaacattgtatccagtatcgaatttgatcgtgatgatgagctatttgctaccgctggagtctcgaagcgtattaaagtcttcgaattttctacagttgttaacgagccatcagatgtccactgtccagttgttgaaatggctaccagatctaaactcagctgccttagctggaacaagtactcaaagaatattatagcaagcagtgattatgagggaatagttactgtctgggatgttcaaacccgccagagcgtgatggagtacgaagagcatgagaaaagagcatggagtgttgatttttcgcgtacagagccctcaatgctagtatctgggagtgatgattgcaaggtcaaagtgtggtgcacaaaacaggaagcaagcgccattaacattgatatgaaggcaaatatttgctccgttaaatataaccccggatcgagctactatgtcgctgttggatctgcagatcaccatattcattattttgatttgcgaaatccaagtgcgcctctccatgtttttggtgggcacaagaaagctgtttcatatgtgaagttcttatcgaataatgagcttgcatctgcatcgaccgatagcacattacggttatgggatgtcaaggacaattgcccagtaaggacgttcagaggtcacaaaaacgaaaagaactttgttgggctatcggtaaataacgagtatattgcttgtgggagtgaaacaaatgaggttttcgtgtaccacaaggccatctcgaaacctgcttccagccatcggtttgtatcctccgacctggacgacgccgatgatgatcctgggtcttatttcattagcgctgtctgctggaagagcgatagccctaccatgttaactgctaacagtcaggggaccattaaagttcttgtgctcgccccttgatgtgatcaagggctttggtgggatccataggtagcctgtatatcctatatgtcctgtcgtatcattgttgtgccgttatatgtcccaaagtgggagtggaggcatattgatctccattgcagggcgcggaatttttggaggtaatcttctgatgtaggggttcgatggctcggaatgtgtgcatagttggtgattctgttgtataggcgcaaagcagccagcttgtctgtcggttacatgtgtaatgtgagagaatagaacttaaataaaggt

SEQ ID NO: 2343 - DNA, 2260 bp, Triticum aestivum
cagggacctgctctgcccgatctgcatggcgctcatcaaggacgccttcctcaccgcctgcggccacagcttctgctacatgtgcatcgtcacgcacctcaaccacaagagcgactgcccctgctgcgccaactacctcaccaaggcgcagctctaccccaacttcctcctcgacaaggtcgtgaagaaaatgtcggcccggcaagttgcaaaaacagcatctcccattgatcaattccgacatgttgtgcaacagggaaatgacatgacagttaaagagctagacagccttatgactttgattgctgagaagaagaggcaaatggaacaacaagagtcagagacaaatatgcaaatattgctagtcttcttgcactgccttagaaagcaaaagcttgaagagttgaatgagattcaaactgacctgcagtacatcaaagatgatataagcagtgtggagagacataggttagatctgtatcgaacaaaagaaaggtactccatgaggctgcgcatgcttttggatgaacctgctgcatcaaagatgtggccttcgcctatggacaaacctagtagtccctttgttcccaactctcgggcaccacctagcacatcatctccaggggggttaaataataggaggtttgatttgagagctccggcaagccatcaaggacatcaaagaagagatgcccttgctagctcagaccctcccaatccccctatacagtcgggtaatgttattgctcggaagaggcgagttcaagcgcagtttaacgagcttcaagaatactacctgcaaagacggcgtactggagcgcagtctcacaggcaggaggatgttgttacgatgaatagagaaggttatcatgaaggtcttgaagattttcagtctgtgcttacaacattcactcgatatagtcgcttacgtgtaattgcggaacttagacatggagatctgttccactcagcaaatattgtatccagtatcgaatttgatcgtgatgatgagctattcgctactgctggagtctcgaagcgtattaaagtcttcgaattttctacagttgttaatgagccatcagatgtccactgtccagttgttgaaatggctaccagatctaaactcagctgccttagctggaacaagtactcaaaaaatgttatagcaagtagtgattatgaaggcatagttactgtttgggatgttcaaacccgccagagtgtaatggagtatgaagagcatgagaaaagagcatggagtgttgatttttcacgtacagagcccaagatgctagtatctggtagtgatgattgcaaggtcaaagtgtggtgcacaaatcaggaagcaagtgccattaacattgatatgaaggcaaatatttgctctgttaaatataatcctggatcgagctactatgtcgcagtcggatctgctgaccaccatatccattattttgatttacgaaatccaagtgcacctctccatgtttttggtgggcacaagaaagctgtttcttatgtgaaattcttatcgaataatgagcttgcatctgcatcgaccgatagcacgttacggttatgggatgtcaaggacaattgcccactaaggactttcagagggcacaaaaatgagaagaacttcgtaggactatctgtaaataacgaatatattgcttgcgggagtgaaacaaatgaggtttttgtttaccacaaggctatctccaaacctgcttccagccataggtttctgtccacggacctggacgacgccgaagatgatcccgggtcttatttcattagcgctgtctgctggaagagcgatagccctactatgctaactgctaacagccaggggaccattaaagttctcgtgctcgccccttgacgtgatcaggggagatctgtagctagcttgtatatcctatgtatcccgtcgtttcattgttgtgccattatatgtcccgaagtgggagtggaggcatattgatctccagcctagggcgcgaaatttttgtggaggtaatcgtctgacgtagggttccaagggctcggaatgtgcatagtgggggtgaccctgttgtataggtgcaaagcagtcggcttgtctattatagtactaacatctgtaacgtgagaaaataaatcttgaataaagagtccggcttggtttctgagtaactgactgttagtgctggggtttgggaacatatgccttctgagctgaattgcgccccgaaacagaatatgaaaactttgc

SEQ ID NO: 2344 - DNA, 2237 bp, Festuca arundinacea
ggccgccgcgtccacgcccgacagggagctgctgtgcccgatctgcatcacgctcatcaaggacgccttcctcaccgcctgcggacacagcttctgctacatgtgcatcgtcacgcacctcacccacaagagcgactgcccctgctgcagcaactacctcaccaaggcgcagctctaccccaacttcctgctcgacaaggtcttgaagaaaatgtcggcccggcaagttgcaaaaacagcatctcccattgatcaacttcgacatgttgtgcaacagggaaatgatatgtcggttaaagagctagacaaccttatgactttgattgctgagaagaagaggcaaatggaacaacaagagtcagagacaaatatgcaaatattgctagtattcttgcactgccttagaaagcaaaagctggatgagttgaatgagattcaaactgatctgcagtacatcaaagatgatataagcagcgtggagagacatagattagatttgtatcgaacaaaagaaaggtactccatgaagctgcgcatgcttttggatgaacctgctgcatcaaagatgtggccctcgcctatggacaaacctagcagtccctttctccccaattcccgggcaccacttaatgcatcatctccagggggtttaaataataggaaacatgatttgagagctcaagtaagccagcaaggatatcaaagaagagatgcccttgtttgcccagaccctcctaatccccctatacagtcgggtaacgtaattgctcggaagaggcgagttcaagcacagttcaacgagcttcaagaatactatctgcaaagacggcgtaccggaggacagtcacgcaggcaggatgacattgttgcgatgaatagagaaggttatcatgaaggtcttgaagatttccagtctgtgctaacaacattcactcgatacagtcgcttacgtgtaatagcagaactgagacatggagatcttttccacactgcaaacattgtatccagtatcgaatttgatcgtgatgatgagctattcgctactgctggagtgtcgaagcgtattaaagtcttcgaattttctacagttgttaacgagccatcagatgttcactgtccagttgttgaaatggctaccagatctaaactcagctgccttagctggaacaagtactcaaaaaatattattgcaagcagtgattatgagggcatagttactgtttgggatgttcaaacccgccagagcgtgatggagtacgaagagcatgagaaaagagcatggagtgttgatttttcgcgtacagagccctcaatgctcgtatctgggagtgatgattgcaaggtcaaagtgtggtgcacaaaacaggaagcaagtgccattaacattgatatgaaggcaaatatttgctccgttaaatataatcctggatcgagctactttgtcgccgtcggatctgctgatcaccatattcattatttcgatttgcgaaatccaagtgcgcctctccatgtttttggtgggcataagaaagctgtttcgtatgtgaagttcttatctaacaatgagcttgcatctgcatcgaccgatagcacgttacggttatgggatgtcaaggacaattgcccagtaaggacgttcagagggcacaaaaatgagaagaacttcgttgggctatcggtaaataacgagtatattgcatgtgggagtgaaacaaatgaggtttttgtttaccacaaggctatctcaaaacctgcttccagccataggtttgtatcctccgacctggacgatgccgaagatgatcctgggtcttatttcattagcgctgtctgctggaagagcgatagccctactatgctaactgccaacagtcaggggaccattaaagttctcgttcttgctccttgacgtgatcaagggcttccgtcagatccataggtagcttgtatatcctatatatactgtcgtgccattgtgttgtgctgttatatgtcccgaagtgggagtggaggcatatcgatctccagtgtagggcgcggaatttttggagataatcatctgacataggggtttgagggctcggaatgtgtgcatagtgttgattctgttatataggtgtaaagcagccagcttgtcggttacatgtgtaccgtgagaaatagaccttaaataaaagttcagcttggtttcaaaaaaaaaaaaaaaaaaaaaaaaaaacaaaaaaaaaaaaaaaaaa

SEQ ID NO: 2345 - DNA, 2157 bp, Sorghum bicolor
acactggacacagcgctctcggatctgcctcgccggctcgccccatgctctcccgtctcgctcgcgtgacaccaccctccattggccgacagggacgacacgccgtcgtggctgctcacgtgttctcaccctgcgctctcgccggccgaggcaagcgccgagtgtgccgccttccgctccgagcaaacgccaacgtcaggcgccaacgccatttattaatcgacaccccccaccgcaaccccaaagcccacgcttccgaattcaccaactcctcctcctcgcctcgtcgagatcgctctcacgccttccatagttccgctccagcaactccaccactcagcccgcccgccggagcaatggggagcacggggcgcgacccggaggtgacccgcgccgacttccccgacggcttcgtcttcggcgtcgccacctccgcgtaccagattgagggagcgagaagggagggaggcaaaggagacagcatatgggatgtatttacagatgacaaagaacgtgtcttagacaaaagcaatgcagaaattgcagttgaccactaccatcgatacaaggaagacattgagctcatggcaagtctaggttttagcgcgtacagattttctatatcttgggcacgtatatttcctgatggcttgggggaaaaggtcaatgagcaaggagtcgccttctacaatgacctcatcaactttatgatttcgaaaggtattgagccttacgcaactctgtatcattgggatcttccaaacaatcttcaaaaaactctggggggctggatttctgacaagattgtggagtactttgcattgtatgcagaagcttgctttgcaaattttggagacagagtaaagcgttggataacaatcaatgagcctctccaaactgcaatcaatggttatggtattggaatatttgcacctggtggatgccaaggtgaaactgcaagatgttacttggctgcccatcaccaaatcttggctcatgctgctgctgttgatgtttatagaagaaaattcaaggctgcacaaggtggtgaagtaggcttcgttgtggactgtgaatgggcagagcctttttctgaaaaagcggaagaccaaattgctgcacaacggaggattgactttcaacttggatggtacctagatccgatatattttggtgattacccagaaagcatgcgtcaacgactgggcagtgatcttccaaccttctcagagaaagataaagaattcatcaggaacaaaattgattttattggactgaatcattatacttcgagactcattgctcatcaccaaaatccagatgatgtttatttctaccaagtgcaacaaatggagagaatagaaaaatggaatagtggtgaaaaaattggtgaaagggctgcatctgaatggcttttcatagttccttggggccttcgtaaagtacttaattatatagtgaagaaatacaataatccagtaatttatattactgagaatggcatggatgatgaagatgatcaatccgcaacacttgaccaggtcctaaatgacacgacaagagtcggttacttcaaaggatacctcaattcagttgcacaagccatcaaggacggagctgatatccgtgggtactttgcgtggtcattcctggacaactttgagtgggctatgggctacaccaagaggtttggtatagtttacgtcgattacaagaatgggctgtccaggcatcctaaagcatcggccctgtggttctcgcgcttcctgaagggcgaggctgccgaaaacaaacctgatacaaactgagcgaacagcccgcagcaagtacagaacattacatatacacacactacacgtctcttctgttgttgtatcttacagtgagcaccggtgtatgtatgtatgtacgtaatagtctcagatgtgcttcctgcctatacctagtctgtcattgatccaacactagctgaaatgtattctccgagaatcagagcctcagcaccaataagctttgaattcatgccaggcagcagtctggttacagatagctcacacttgtcttctgaacacccatgcattcggcattattacactgtactgtcactgttgtactattcacctgtaagtaaggctgtattggcattaccgattcaga

SEQ ID NO: 2346 - DNA, 1847 bp, Zea mays
gagcgagtgtggctgccgcttcctctccgagtcaggcgccatttaataattcaattctacccccaagcccacgcttccgaattcaccgactcctcctccacgccgcgtcgagatcgctcaggccttcgcttccagcaactccaccactcagcccacccgccggagcaatggggagcacggggcgcgagccggaggtgacccgcgccgacttccccgacggcttcgtcttcggcgtcgctacctccgcgtaccagattgagggagcgagaagggagggaggcaaaggagacagcatatgggatgtatttacagatgacaaagaacatgtcttagacagaagcaatggagaaattgcagttgatcactaccatcgatacaaggaagacattgagctcatggcaagtctaggttttagcgcatacagattttctatatcttgggcgcgtatatttcctgatggcttggggggaaaggtcaatgatcaaggagtcgccttctataatgacctcatcaactttatgatttcgaaaggtattgagccttacgcaactctatatcattgggatcttccaaacaatcttcagaagactctggggggctggatttctgacaagattgtggagtactttgcattgtatgcagaagcttgctttgcaaattttggagacagggtaaagcattggataacaatcaatgaacctctccaaactgcaatcaatggttatgggattggaatttttgcacctggaggatgccaaggtgaaactgctagatgttacttggctgcccatcaccaaatcttggctcatgctgctgctgttgatgtttatagaagaaaattcaaggctgcacaaggtggtgaagtagggttggttgttgattgtgaatgggcagagccattttctgaaaatgtggaagaccaaattgctgcacagcggaggcttgactttcaacttggatggtacctagatccaatatattttggtgattacccagaaagcatgcgtcagcgactgggcagtgatcttccaaccttttcagagaaagataaagagttcatgaggaacaaaattgattttgttggagtaaatcattatacttcaagactcattgctcatctccaaaatccaaatgatgtttatttctaccaagtgcaacaaatggagcgaatagaaaaatggaatagtggtgaaaaaattggtgaaagggctgcatctgaatggcttttcatagttccttggggccttcataagtcacttaattatatagcgaagaagtacaataatccagcaatttatgttactgagaatggcatggatgaagaggacgatcaatccgcaacgcttgaccaggtcctaaacgacacgacgagggtcggttacttcaaagggtacctcaattcagttgcgcaagcgatcaaggacggagctgatgtccgcgggtactttgcgtggtcgttcctggacaacttcgagtgggcaatgggctacaccaagaggttcggcatagtctacgtggactacaagaacgggctgtccaggcacccgaaagcatcggcgctgtggttctcgcgcttgctcaggggcgaggctggcactggcacaagctgagcgaactgcacgcaggaagcaagcacagaacgtcgttattacaatataaatattccacacaactagacgtttttctcctgttgttgtatcgtactactgtacagtaagcgccaataagctagcctcagatgtgtgctgcctgcctatacctctagtgactgccattgatccagcactagctgaaatgtacccggcctccaagaatcagcaccagaatatatgctttgaattgaactc

SEQ ID NO: 2347 - DNA, 1753 bp, Echinochloa colona
cacgcccacgcttccaggctcacccaccccacgcttcctcgagatcgctcacgcctttcggcggctccaccacccagcgcaaccgccggagcaatggggagcacggggcgcgaggcggaggtggcccgcgccgacttccccgacggcttcgtcttcggcgtcgccacctccgcgtaccagattgagggagctaggagggagggaggcaaaggagacagtatatgggatgtcttcacagaagacaaagaacgtgtcttagacaaaagcaatgcagatgttgcagttgatcattaccatcgatacaaggaagacattgagcttatggcaagtttaggttttggcgcatacagattttctatatcttgggcacgcatatttcctgatggattgggggaaaaggttaatgagcaaggagttgccttctataacgaccttatcaactttatgatttcaaaaggtattgagccatatgcaactctgtatcactgggatcttccaaacaatcttcaaaagactttggggggctggctttctgacaagattgtggattactttgcattgtatgcagaagcttgctttgcaaattttggagacagagtaaagcgttggataacaatcaatgagcctctccaaactgcagttaatggttatgggattggagtttttgcacctggaggatgcgaaggtgaaactgctcgatgttacttggccgctcatcaccaaatcttggctcatgcagctgctgttgatgtttacagaagaaaattcaaggctgcgcaaggtggtgaagtagggctggttgttgattgtgagtgggcagagccattttctgataaagtggaagaccagattgcttcacaacggaggattgactttcaacttggatggtacctagacccaatatatttcggtgattacccagaaagcatgcgtgagcggctgggcagtgatctcccaaccttctcagagaaagataaagaattcatcaggaacaaaattgattttgttggacttaaccattatacttcgagattcattgctcaccatcagaatccagaagatatttatttctatcaagtacagcaagtggagagaatagagaaatggaatagtggtgaaaaaattggtgaaagggctgcatctgaatggcttttcatagttccttggggccttcataaattacttaattatatagcgaagaaatataataatccagcaatttatgttactgagaacggcatggatgaggaagatgatcagtctgcaacactagaggaggttttaaatgacacaacaagagttggttacttcaaaggatacctctcttcagttgcacaagcaataaaggatggagctgatgtccgtggatacttcgcatggtcattcttggacaacttcgagtgggctatgggctacaccaagaggttcggcattgtttatgtggattacaagaatgggctctccaggcaccctaaagcatcggccctgtggttctcacgcttcctgaagggcgaggctgccgaaaacaaaagctgatacgaagtgagcaaacagccactggcaaagtaaaggaacattacacgtacagtacatgtttctcctgttgtcgtaccttacagtgactgctagtgtatgtattcatcataataatctcagatgcgctgtgtagcctgtcattggtctaatattactaattcaaatactgtcccgaagatccagaactctgcatcaataagtttagaattcgtgccag

SEQ ID NO: 2348 - DNA, 2000 bp, Setaria italica
gtgccacgctggacacagcgctcgcggatctgccacctctgtcagcgccctcgccggccggggcaactggggcagcagcaagcgccgggtgccgcttccgctgccgagtactagtaaatgccagccgctatatattcaactccccccacccgcattccccccaagcccagcttccaagttcgcccacgcccccacgctttgccgagatcgctcacgccttccagttcaagcaaccccaccacccagcccccaacccgccggagcaatggggagcacggggggcgaggcggaggtggcccgcgccgacttccccgacggcttcgtcttcggcgtcgccacctccgcataccagattgagggagcgagaagggagggaggcaaaggagacagcatatgggatgtcttcacagaggacaaagaacgtgtcttagatagaagcaatggagatgttgctgtagatcattaccatcgatacaaggaagacattgagctcatggcaagtttaggttttgccgcataccgattttctatatcttgggcacgcatatttcctgatggcttggggggaaaggtcaatgagcaaggagttgccttctataacaaccttatcaactttatgattgcaaaaggaattgagccttatgcaactctgtatcactgggatcttccaaaccatcttcaaaagactctggggggctggctttctgacaagattgtggattactttgcattgtatgcagaagcttgctttgcaaattttggagacagagtaaagcgttggataacaatcaatgagcctctccaaactgcatttaatggttatgggattggagtttttgctcctggaggatgcgaaggcgaaactgctaggtgttacttggccgcccatcaccaaatcttggctcatgctgctgctgttgatgtttacagaagaaaattcaaggttgcacaaggtggtgaagtagggctggttgtcgattgtgaatgggcagagccattttctgagaaagtcgaagaccaaattgctgcacaacggaggattgactttcaacttggatggtacttagacccaatatattttggtgattacccagaaagcatgcgtcagcgactgggcagtgatcttccgaccttctcagagaaagataaagaattcatcaggaacaaaattgattttgttgggctgaaccattatacttcaagattcattgctcatcatcagaatccagaagatatttatttctatcaagtacagcaagtggagagaatagaaaaatggaatagtggtgaaaaaattggtgaaagggctgcatctgaatggcttttcatagttccttggggccttcgcaaagtacttaattatgtagcgaagaaatataataatccaacaatttatgttactgagaatggcatggatgaggaagatgatcagtctgcaacactggatcaggttttaaatgacacaacgagagtcggttacttcaaaggatacctcgcttcagttgcacaagcaatcaaggacggagctgatgtccgtggatatttcgcgtggtcattcttggacaactttgagtgggctatgggctacaccaagaggttcggcattgtttatgtggattacaagaatgggctctccaggcaccctaaagcatcggccctgtggttctcacgcttcctgaagggtgaggctgccgaaaacaaagctgatacaaactgagcaaacacagcccgtgtcaagtaaaggaacatttacacatacagtcagtacatgtttttcctgttgttgtatcttacagtgaccaccaatgtatgaatttatcataataatctcagatgtgctgtgtatcttctcatttggtcggacacttgttcaaatgtagtctttaagattcagaactctgcaccaataagtttcaaaatcttgccaggctgcactggagttgcagataactcacgcttgtcatctgaacaccccatgcattcggcattgctgtgctgta

SEQ ID NO: 2349 - DNA, 1908 bp, Setaria italica
gtcagcgccctcgccggccggggcaactggggcagcagcaagcgccgggtgccgcttccgctgccgagtactagtaaatgccagccgctatatattcaactccccccacccgcattccccccaagcccagcttccaagttcgcccacgcccccacgctttgccgagatcgctcacgccttccagttcaagcaaccccaccacccagcccccaacccgccggagcaatggggagcacggggggcgaggcggaggtggcccgcgccgacttccccgacggcttcgtcttcggcgtcgccacctccgcataccagattgagggagcgagaagggagggaggcaaaggagacagcatatgggatgtcttcacagaggacaaagaacgtgtcttagatagaagcaatggagatgttgctgtagatcattaccatcgatacaaggaagacattgagctcatggcaagtttaggttttgccgcataccgattttctatatcttgggcacgcatatttcctgatggcttggggggaaaggtcaatgagcaaggagttgccttctataacaaccttatcaactttatgattgcaaaaggaattgagccttatgcaactctgtatcactgggatcttccaaaccatcttcaaaagactctggggggctggctttctgacaagattgtggattactttgcattgtatgcagaagcttgctttgcaaattttggagacagagtaaagcgttggataacaatcaatgagcctctccaaactgcatttaatggttatgggattggagtttttgctcctggaggatgcgaaggtgaaactgctaggtgttacttggccgcccatcaccaaatcttggctcatgctgctgctgttgatgtttacagaagaaaattcaaggttgcacaaggtggtgaagtagggctggttgtcgattgtgaatgggcagagccattttctgagaaagtcgaagaccaaattgctgcacaacggagggttgactttcaacttggatggtacttagacccaatatattttggtgattacccagaaagcatgcgtcagcgactgggcagtgatcttccgaccttctcagagaaagataaagaattcatcaggaacaaaattgattttgttgggctgaaccattatacttcaagattcattgctcatcatcagaatccagaagatatttatttctatcaagtacagcaagtggagagaatagaaaaatggaatagtggtgaaaaaattggtgaaagggctgcatctgaatggcttttcatagttccttggggccttcgtaaaatacttaattatatagcgaagaaatataataatccaacaatttatgttactgagaatggcatggatgaggaagatgatcagtctgcgacactggatcaggttttaaatgacacaacgagagtcggttacttcaaaggatacctcgcttcagttgcacaagcaatcaaggacggagctgatgtccgtggatatttcgcgtggtcattcttggacaactttgagtgggctatgggctacaccaagaggttcggcattgtttatgtggattacaagaatgggctctccaggcaccctaaagcatcggccctgtggttctcacgcttcctgaagggtgaggctgccgaaaataaagctgatacaaactgagcaaacacagctcgtgtcaagtaaaggaacatttacacatacagtcagtacatgtttttcctgttgttgtatcttacagtgaccaccaatgtatgaatttatcataataatctcagatgtgctttgtatcttctcatttggtcggacacttgttcaaatgtagtctttaagattcagaactctgcaccaataagtttcaaaatcttgccaggctgcactggagttgcagat

SEQ ID NO: 2350 - DNA, 2027 bp, Oryza sativa
aggcagaaaccacgcgaggcgcgcgactcacctgccgagccacgcgtcgcgcacgctgcggagatcgcctcctcctcgccgccgccgccggggggaatggggagcacggggcgcgacgcggaggtgacccgcggcgacttccccgacggcttcgtcttcggcgtcgccacctccgcttaccagattgaaggggcgagacgggagggaggcaaaggagataacatatgggatgttttcacagaaaacaaagaacgtatcttagatggaagcagtggagaagttgcagttgatcattaccatcgatacaaggaagacattgaactcatggccagtttgggtttccgtgcttatagattttctatatcttggccacgcatatttcctgatggcctggggaaaaatgtcaatgagcaaggagttgccttttataatgaccttataaatttcatgattgagaaaggtattgagccatacgcaactctgtatcattgggatcttccacataatcttcagcagactgtgggtggttggctttctgataagatcgtggagtactttgcactgtatgcagaagcttgctttgcaaattttggagacagagtaaagcattggataacaatcaatgagcctcttcaaactgcagttaatggttacggaattggacattttgcacctggaggatgtgaaggggaaactgctagatgctacttggccgcccactaccaaatcttggctcatgctgctgctgttgatgtttacagaaggaaatttaaggctgtgcaaggtggtgaagtaggcttggttgtcgattgtgaatgggcagagccattttcagagaaaacagaagatcaggttgctgcagaacgaaggcttgactttcagctaggatggtacctggacccaatatatttcggtgattacccagaaagtatgcgtcagcgactgggcgatgatcttccaaccttctcggagaaagataaagaatttatcaggaacaaaattgactttgttggaataaatcattatacttcaagattcattgctcatcatcaggatccagaagatatttatttttaccgagtacaacaagtggagagaatagaaaaatggaacaccggtgaaaaaattggtgaaagggccgcatctgagtggcttttcatagttccttggggcctccggaaattacttaattatgcagcaaagagatatggaaatcctgtgatatatgtaactgagaatggcatggatgaggaagatgatcaatcggcaacgcttgaccaagtcttgaatgatacgacgagggttggttacttcaaaggatacctcgcgtcagttgcacaagcaatcaaggatggtgctgatgttcgtgggtacttcgcatggtcgttcctggacaacttcgagtgggctatgggatacaccaagaggtttggcattgtttatgttgattacaaaaatgggctttcccggcatcccaaagcatcggcccggtggttctcgcgcttcttaaagggcgatgacgctgagaacaaagctgacatgaactaggccatcctgaagaaagtcactgatgatggactgatggttggtgaaggacaaagtgacctgccattattgccccccatggaacctgtatagaagctattggccccttcactttcttttctgttcaggggcctatctgttgtaggatttgcctctttattctgtcaacaagaatctacggatactcatcaagagcatggcccctttgcaaaattgcaatggttctctcgtcactttatatggagcttcatgccgttgcattgctgctttggattttgatgatggtagcgtcaggagcaggaatcaggccgttgcaagggcctagctgttcagagctttcagatgtactctgatgctggcactcttagaattgttggttatactctttctgtttctgtagaggggttgctacagggatggactctacctgttgagccactctggtttttaaccaaataaagtataaatacacaacactggct

SEQ ID NO: 2351 - DNA, 1614 bp, Echinochloa colona
cccacgcccacgcttccaggctcacccaccccacgcttcctcgagatcgctgctcacgcctttcggcggctccaccacccagcccaaccgccggagcaatggggagcacggggcgcgaggcggaggtggcccgcgccgacttccccgacggcttcgtcttcggcgtcgccacctccgcgtaccagattgagggagctaggagggagggaggcaaaggagacagtatatgggatgtcttcacagaagacaaagaacgtgtcttagacaaaagcaatgcagatgttgcagttgatcattaccatcgatacaaggaagacattgatctcatggcaagtttaggttttggcgcgtacagattctctatatcttgggcacgcatatttcctgatggaatgggggaaaagattaatgagcaaggagttgccttctataacgaccttatcaactttatgatttcaaaaggtattgagccatatgcaactctgtatcactgggatcttccaaacaatcttcaaaagactttggggggctggctttctgacaagattgtggattactttgcattgtatgcagaagcttgctttgcaaattttggagacagagtaaagcgttggataacaatcaatgagcctctccaaactgcagttaatggttatgggattggagtttttgcacctggaggatgcgaaggtgaaactgctagatgttacttggccgctcatcaccaaatcttggctcatgcagctgctgttgatgtttacagaagaaaattcaaggctgcacaaggcggtgaagtagggctggttgttgattgtgagtgggcagagccattttctgataaagtggaagaccaaattgcttcacaacggaggattgactttcaacttggatggtacctagacccaatatatttcggtgattacccagaaagcatgcgtgagcggctgggcagtgatcttccaatcttctcagagaaagataaagaattcatcaggaacaaaattgattttgttggacttaaccattatacttcgagattcattgctcaccatcagaatccagaagatatttatttctatcaagtacagcaagtggagagaatagagaaatggaatagtggtgaaaaaattggtgaaagggctgcatctgaatggcttttcatagttccttggggccttcataaattacttaattatatagcgaagaaatatgataatccagcaatttatgttactgagaatggcatggatgaggaagatgatcagtctgcaacactagagcaggttttaaatgacacaacaagagttggttacttcaaaggatacctcgcttcagttgcacaagcaatcaaggacggagctgatgtccgtggatacttcgcatggtcattcttggacaacttcgagtgggctatgggctacaccaagaggttcggcattgtttatgtggattacaagaatgggctctccaggcacctaaagcatcggccctgtggttctcacgcttcctgaagggcgagtctgcagaaaacaaagctgatacgaagtgagcaaacagccactggcaaagtaaggaacattacacgtacagtacatgtttctcctgttgttgtac

SEQ ID NO: 2352 - DNA, 1962 bp, Brachypodium distachyon
cggcgcaacttccaaaatttgcccacttcctcctcttcctcacgactccactcgtccctcttcctcaggagccacgacgcaccaccggatcgagatcactagctagcctagcgatcctcggcggcctcgcgcggggaatcaatggggagcaccgggcgcgacgaggaggcggtggcggcggcggaagtgacccgcgccgacttccccgagggcttcatcttcggcgtcgccacctccgcctaccagattgagggggcgagaaaagagggtggcaaaggtgatagcatatgggatgtatttgcagataataaagaacatatcctagacggaacatctggagaagttgcagttgatcattaccatcgatacaaggaagacattgaactgatggccaaattgggttttggagcctatagattttccatatcttggtcacggattttccctgatggcctggggaaagaaatcaatgagcaaggagttgctttctataacaatcttatagattttatgattgagaaaggtattcagccttatgcaactctgtatcactgggatcttccacataatctgcaacagaccatggggggttggctttcggacaagattgtagaatacttcgcattatatgcagaagcttgctttgccaattttggagacagagttaagcattggatgacaatcaatgaaccacttcaaacatcagttaatggttatggcattggaatatttgcacccggagtatgtgaaggtgcagctgctgaacctttcttggctgctcatcaccagatcttagctcatgctgcttctgttgatgtctacagaaggaaattcaaggctgtacaaggtggccaagtagggtttgttattgattgtgaatgggcagagccattttctgacaaaatggaagatcaggctgctgcagcacgacgcattgacttccaacttggatggtacctggacccaatatactttggtgattacccagaaagcatgcgccagagattgggtgatcatcttccaaaattctctgagaaagaacgtgaactgatcaggaacaaaattgattttattggattaaatcactatacatcaagattcattgctcatcagcaggacccacaagctatccatttctatcaggttcaacaaatggagagaatagaaaaatggaataccggtgaaggaattggtgaaagagctgcttctgagtggcttttaatagttccttggggtcttcgaaaagctattaattatatagtgaagaaatacaataatccagtgatatatgtaacagagaatggcatggatgatgaagacgatcagtcagcaccacttgatcaggtgttaaatgatacaaagagggttggtttcttcaaaggatatgttggagccgtcgcacaagcaataaaggatggtgccgatattcgtggatactttgcatggtcattcttggataactttgagtgggctatgggctacaccaagaggtttgggcttgtctatgttgattacaaggatgggctctcccgacaccctaaagcatcagccatgtggttctcacgtttcttgaatggcgaggctgctgacatcaaacctgacacaaactaagcaagcattcaccaagggggtggcatcgctgtttgaggatagtttgcatggtcatttccggacaactttgggtgggttataggatacaccaagaggtgtggtagtgttcatgttcaagaatgggctcgcttgacatcccaaatcgtcgtcagcactgtggttctcacacttgttgcaaacaaagcggatacgagacgagctgagtcatccttcagcaagtaaatgaatattacacagtaactgtttgtcctgttcacctgttgttgtatcatacagtaactgctagtatatccgttcacaataatactcagatctgctacggtctgccatttatccaagaactgttcgatg

SEQ ID NO: 2353 - DNA, 2073 bp, Brachypodium distachyon
ggcgcaacttccaaaatttgcccacttcctcctcttcctcacgactccactcgtccctcttcctcaggagccacgacgcaccaccggatcgagatcactagctagcctagcgatcctcggcggcctcgcgcggggaatcaatggggagcaccgggcgcgacgaggaggcggtggcggcggcggaagtgacccgcgccgacttccccgagggcttcatcttcggcgtcgccacctccgcctaccagattgagggggcgagaaaagagggtggcaaaggtgatagcatatgggatgtatttgcagataataaagaacatatcctagacggaacatctggagaagttgcagttgatcattaccatcgatacaaggaagacattgaactgatggccaaattgggttttggagcctatagattttccatatcttggtcacggattttccctgatggcctggggaaagaaatcaatgagcaaggagttgctttctataacaatcttatagattttatgattgagaaaggtattcagccttatgcaactctgtatcactgggatcttccacataatctgcaacagaccatggggggttggctttcggacaagattgtagaatacttcgcattatatgcagaagcttgctttgccaattttggagacagagttaagcattggatgacaatcaatgaaccacttcaaacatcagttaatggttatggcattggaatatttgcacccggagtatgtgaaggtgcagctgctgaacctttcttggctgctcatcaccagatcttagctcatgctgcttctgttgatgtctacagaaggaaattcaaggctgtacaaggtggccaagtagggtttgttattgattgtgaatgggcagagccattttctgacaaaatggaagatcaggctgctgcagcacgacgcattgacttccaacttggatggtacctggacccaatatactttggtgattacccagaaagcatgcgccagagattgggtgatcatcttccaaaattctctgagaaagaacgtgaactgatcaggaacaaaattgattttattggattaaatcactatacatcaagattcattgctcatcagcaggacccacaagctatccatttctatcaggttcaacaaatggagagaatagaaaaatggaataccggtgaaggaattggtgaaagagctgcttctgagtggcttttaatagttccttggggtcttcgaaaagctattaattatatagtgaagaaatacaataatccagtgatatatgtaacagagaatggcatggatgatgaagacgatcagtcagcaccacttgatcaggtgttaaatgatacaaagagggttggtttcttcaaaggatatgttggagccgtcgcacaagcaataaaggatggtgccgatattcgtggatactttgcatggtcattcttggataactttgagtgggctatgggctacaccaagaggtttgggcttgtctatgttgattacaaggatgggctctcccgacaccctaaagcatcagccatgtggttctcacgtttcttgaatggcgaggctgctgacatcaaacctgacacaaactaagcaagcattcaccaagggggtggcatcgctgtttgaggatagtttgcatggtcatttccggacaactttgggtgggttataggatacaccaagaggtgtggtagtgttcatgttcaagaatgggctcgcttgacatcccaaatcgtcgtcagcactgtggttctcacacttgttgcaaacaaagcggatacgagacgagctgagtcatccttcagcaagtaaatgaatattacacagtaactgtttgtcctgttcacctgttgttgtatcatacagtaactgctagtatatccgttcacaataatactcagatctgctacggtctgccatttatccaagaactgttcgatgaatgtttaaagaaccacagttccctgaaacctttgctacttagctgctgctgttgtactagtaacagtaaggttggtccttcataggccaaagtaagcaattaccagaatgt

SEQ ID NO: 2354 - DNA, 1080 bp, Sorghum bicolor
cggcggccggtctgcctcttcctccaagttcgccccgccccgtctctcggttctctcccgtgcccccacgccgcctcggtgctcccactctcctcccagcgccctcacccctggcgcacctctccctctctctcgttgtcccgtgcccctcgcgtgcgctctgtctctttgtggcggcggcccagacctacgccacaggtgcctagatcgccatcttcaggaccttcgccggtgacgagcacccaccagctgatacaggaaatttacttttatccatactccacctactttgttgactatggcactagcagctatctataaccttttcatcattaacaaatctggcggtcttatatactacaaggactatggttcagcagggaggatggataccaatgacagtctaagattagcaagtctctggcattcgatgcatgctatctcccagcaactctcccctacccctggttgtaatggcattgatctcttacaagctcataactttgatctccattgctttcaatccctcacagggacaaaatttttcgttgtatgcgaaactggagctccaaatatggaaatgctgctgaaagtgatttatgagctgtacacggactttgttttgaagaatccgttctatgagatggagatgccgattcggtgtgagctgtttgatcacaatctggctcaggtgatccagaaggaccgtgttgcacttctgggtcggtgaaactcgaaaacttatagcctcaaccttatcatgtatcttgtactttttcctttttctacattattaccctggacttgctctgctggaaagttctaccggtgcataaccgataacttgaatagtgtgttgctcgcatgtaatcttcttttgatgtaaatgggatgtagagctttgcgtgcataaaatgctgctgcaaatagcaactccatggaagcagcttttgttctagcatgttttgcctgcgaggatcttgagcatgcccgcatgatcagtgatatagttaaaggtttgtttagaatgttggaattttatggcctatttggaatgcgggaaataaatttctgtttctg

SEQ ID NO: 2355 - DNA, 814 bp, Zea mays
agtctttttagatgaatcgaatgttacaggagaagatatcatttatgtttatgcttttatattttattaggataataaaatgtattcacaaattcattgatatgttgcttagacaaatcgagtctctttataaacaaaagaagccatattgattttctgatacaggaagattacttttatctatactccaccttctttcgtggctatggcactagcagctatctataaccttttcatcattaacaaatccggcggccttatatactacaaggactatggttcagcagggaggatggataccaatgacagtttaagattagcaagcctctggcattcgatgcatgctatctcgcagcaactgtcccctaccactggctgtactggcattgatctcttacaagctcataactttgatctccattgctttcaatccctcacagggacgaaatttttcgtcgtatgcgaaactggagctccaaatatggaaatgctgctgaaagcgatttacgagctgtacacagacttcgttctgaagaatccgttctatgagatggagatgccgattcggtgcgagctgtttgatcacaacctggctcaggtgatccagaaggaccgtgttgcgctcctgggtcggtgaaattggaaagcttttggtcctaaccataccatgtatcttgtactttcccccctttttctacattatgctcggacttcctgtgcaattgtctcggcagaagacagctggcgaccaacaactgtttggtcctgactattagcaccgtatttggaacagatctatggacgatccgccgtg

SEQ ID NO: 2356 - DNA, 685 bp, Panicum virgatum
ctgcagctgacaggaaatttacctttatctatctattccacattcttttgcgattatggcactagctgctatctacagccttttcatcattaacaaatccggtggccttatatactacaaggactatggttcagcagggaggatggacaccaatgacagtctcagattggcaagtctctggcattcaatgcatgccatctcccagcaactctcccctacccctggctgtactggcattgacctcctacaagcccataatttcgatcttcattgcttccaatccctgacaggtacaaaattttttgttgtatgcgagactggcgcaccaaatatggaaatgctgctgaaagtgatctatgagttatacactgactttgttttgaagaacccgttctatgagatggagatgccgattcggtgtgagctctttgatctcaacctggcacaggtgatccagaaggaccgtgttgcactcttgggtcggtgaaatttaaaaactctaaatggtctcaaccgcatcatgtatcgtcgtttttcctctctctaaaaccccacactcagatttgcacagccggaattctgaaatctagcggtgtatatgtaatcgataattgttgcttatctgtaatattcctgtgatgtgatggaaatgaagagttctgcgtacagaaaatgttgctgccaa

SEQ ID NO: 2357 - DNA, 1000 bp, Setaria italica
ctccttacgatcggtctgtactgtctactccgttgcaggcgcgcacacttgacacaacctccgcccatctcaacgcagccgagcgccgcgcgcccccgccggcggccccctcccgcagccactcccgcccgcgcccccgcagcctgatcctccagctcgccgctccttggtcctacaacggccgctcccgcggcgccgcaccccctcgatcgacaggagcgaagcggagtggagatccaaccggacgtgggtcgcgatctcctttttagctgctgatacaggaaatttacctttatctctactccaccttcttttgcgactatggcattagcagctatctacagccttttcatcattaacaaatccggtggccttatatactacaaggactatgtttcagcagggaggatggacaccaatgacagtctaagattggctagtctctggcactcgatgcatgctatctcccagcaactctcccctacccctggttgtactggcattgacctcctacaagcccataacttcgatctccattgcttccaatctctcacaggtacaaaatttttcgttgtatgcgaaactggtgctccaaatatggaaatgctactgaaagtgatctacgagttgtacacagactttgttttgaagaacccgttctatgaaatggagatgccgattcggtgtgagctgtttgatctcaacctggcacagttgatccagaaggaccgtgttgcgcttctgggtcggtgaaacttggaaacctatggtctaaaccccatcatgtaccctgtagtttttcctttctctaaattacacagatttgctcagatggaattctaagatctaccggtgtgtatcatcgattacttgaatagtgtgttgctcatctgtaatcttctccgtgatgtgatgtaactttgagttttgcgtacagaaaaatgttgctgcaaataatagctctatgcaaaggagcttttgttcttgcatagagtacctg

SEQ ID NO: 2358 - DNA, 904 bp, Setaria italica
cttgacacaacctccgcccatctcaacgcagccgagcgccgcgcgcccccgccggcggccccctcccgcagccactcccgcccgcgcccccgcagcctgatcctccagctcgccgctccttggtcctacaacggccgctcccgcggcgccgcaccccctcgatcgacaggagcgaagcggagtggagatccaaccggacgtgggtcgcgatctcctttttagctgctgatacaggaaatttacctttatctctactccaccttcttttgcgactatggcattagcagctatctacagccttttcatcattaacaaatccggtggccttatatactacaaggactatgtttcagcagggaggatggacaccaatgacagtctaagattggctagtctctggcactcgatgcatgctatctcccagcaactctcccctacccctggttgtactggcattgacctcctacaagcccataacttcgatctccattgcttccaatctctcacaggtacaaaatttttcgttgtatgcgaaactggtgctccaaatatggaaatgctactgaaagtgatctacgagttgtacacagactttgttttgaagaacccgttctatgaaatggagatgccgattcggtgtgagctgtttgatctcaacctggcacagttgatccagaaggaccgtgttgcgcttctgggtcggtgaaacttggaaacctatggtctaaaccccatcatgtaccctgtagtttttcctttctctaaattacacagatttgctcagatggaattctaagatctaccggtgtgtatcatcgattacttgaatagtgtgttgctcatctgtaatcttctccgtgatgtgatgtaactttgagttttgcgtacagaaaaatgttgctgc

SEQ ID NO: 2359 - DNA, 747 bp, Saccharum officinarum
cctcttcctccaacttcgccgcgccccgtgtctcggttctctctccctcgccgcctcggtgctcccactctcccagcgctctccccccggcatacttcctcagtccctctccctctctcggttgtcccgtgcccctcgcgtgcgttctgtctctctgtggcggcggctcagacctacgccaggtgcctagatcgccatcttcaggaccttcgccggcgacgagcactcaccagctgatacagaaaatttacttttatctctactccgccttctttggtgactatggcattagcggctatctataaccttttcatcattaacaaatctggcggccttatatactacaaggactatggttcagcagggaggatggataccaatgacagtctaagattagcaagtctctggcattcgatgcatgctatctcccagcaactctcccctacccctggctgtactggcattgatctcttacaagctcataactttgatctccattgctttcaatccctcacagggacaaaatttttcgttgtatgcgaaactggagctccaaatatggaaatgctactgaaagtgatttatgagctgtacacggactctgttttgaagaatccgttctatgagatggagatgccgattcggtgtgagctgtttgatcacaacctggctcatgtgatccagaaggaccgtgttgcgcttctctgtcggtgatactcgaaaacctatggcctcaaaccctatcat

SEQ ID NO: 2360 - DNA, 652 bp, Echinochloa colona
ccccctcggtctacggggaggagcggagatccattcggacgtgggtcgcgatctcttctcttgctgttgatacaggaaatttacttttatctctactccatcttattttgcgactatggcattagcggctatctacagccttttcatcattaacaaatctggtggccttatatactacaaggactatggttcggcagggaggatggacaccaatgacagtctaagattggcaagtctctggcattcaatgcatgctatctcccagcaactctcccctatccctggctgtactggcattgaccttctacaagcccataacttcgatcttcattgcttccaatccctcacaggtacaaaatttttcgctgtatgtgaaactggcgcaccaaatatggaaatgctgctgaaagtgatctatgagttgtacactgactttgtcttgaagaacccgttctatgagatggagatgccgattcggtgcgagctgtttgatctcaacctagcacaggtgatccagaaggaccgtgttgcccttctgggtcggtgaaacttgaagacctatggtcccaagcccgtcatgtatcttgtagtgcttcctttctcttaattacactcagattcactcagctgtaattctactatctacccgcgc

SEQ ID NO: 2361 - DNA, 819 bp, Pennisetum glaucum
cgactatggcactggtcgccgctccttggttctacaacggccgctcccgcagcgccgcaccccgtcgatctacaggagctaagcggagcagagatccaaccggacgtggatcgcgatctcttttttagctgactgtagcacaacaggaaatttaccttttatttctactccaccttcttttgcgactatggcactggcggctatctacagccttttcatcatcaacaaatccggtggccttatatactacaaggactatggttcatcagggaggatggacaccaatgacagtctaagattagctagtctctggcactcgatgcatgctatctcccagcaactctcccctatccctggttgtactggcattgacctcctacaagcccataactttgatctccattgcttccaatctctcacaggtacaaaatttttcgttgtgtgcgaaactggcgctccaaatatggaaatgctgctgaaagtgatctatgagttgtacaccgactttgttctgaagaacccgttctatgagatggagatgccgattcggtgtgagctgtttgatctcaacctggcgcaggtgatccagaaggaccgtgttgcgcttctgggtcggtgaaacttgaaaacatatgatctcaatcccataatgcatcatgtagtttctcgtttctctgaattacatggatttgctcagctgtaattctaagatataccggtgtgtataactgataacttgagtagtttgttgctcaactgtaatcttctctgtgatgtgatggaactttgagttttgcgtaagaaagacgttgctgcaaa

SEQ ID NO: 2362 - DNA, 743 bp, Panicum virgatum
tcgtggtgtttctctgcagctgacaggaaattgacctttatctatctattccacattcttttgcgattatggcactagcagctatctacagccttttcatcattaacaaatccggtggccttatatactacaaggactatggttcagcagggaggatggacaccaacgacagtctaagattggcaagtctctggcattcaatgcatgctatctcccagcaactctcccctacccctggctgtaatggcattgacctcctgcaagcccataatttcgatcttcattgcttccaatccctgacaggtacaaaattttttgttgtatgcgagactggcgcaccaaatatggaaatgctgctgaaagtgatctatgagttgtacactgactttgtttcgaagaacccgttctatgagatggagatgccgattcggtgtgagctctttgatctcaacctggcacaggtgatccagaaggaccgtgttgcactcttgggtcggtgaaatttaaaaactctaaatggtctcaaccgcatcatgtatcgtagtttttcctctctccctaaaaccacactcagatttgctcagctggaattctgagatctagcgatgtatatgtaattgataacttgagtagtttgttgcttatctgtaatattcctgtgatgtgatggaaatgaagagttctgcgtacagaaaatgttgctgccaatagctactctacggaaagcagcttttgttcttgca

SEQ ID NO: 2363 - DNA, 921 bp, Setaria italica
cgacctcgcactcctccgccactccggacccgtcgtcgtcctgcggtcctgcctggcgcctgcgggtgcgggatcccaacgcccgtcgcccgccggccgctgtcgcccccggctgcccgcggcatcccaaggccgcgtaacggactgaggtaactgggagccgccctccagagaaatcaccgccttcaccctgcggggagccggttgcaagctgatacaggaaatttacctttatctctaccccaccctttgtgattatggcactagcagctatctacagccttttcatcattaataagtctggtggccttatatactacaaggactattgttcagcagggaggatggacaccaatgacagtcttagattggcaagtctttggcattcaatgcacgctatctcccagcagctctcccctatccctggctgtacaggcattgacctcctacaagcccacaacttcaatctccactgcttccaatctctcacagggacaaaaattttcgttgtatgtgaaactggcgcacaaaatatggagactctgctgaaggtgatatacgagctttacacggactttgttctgaagaacccgttctacgagatggagatgccgattcggtgtgagctgtttgatctcaacctggctcaggtgatccagaaagaccgggttgctcttttgggtcggtaaaacatgaacgctgcagtcctagtcccatcctatatattgtaatttcttttcctttctatgagacattctcatatttgctcagctggaattaaactatactttctactggtgtaatttatagcttcaatagtgtgttgctcacctgtaatctttttgatgtaccagaatttagggattagcatacagaaaatgtagctgcaaatagttcctccatatcaatttttgctcctac

SEQ ID NO: 2364 - DNA, 914 bp, Setaria italica
cgacctcgcactcctccgccactccggacccgtcgtcgtcctgcggtcctgcctggcgcctgcgggtgcgggatcccaacgcccgtcgcccgccggccgctgtcgcccccggctgcccgcggcatcccaaggccgcgtaacggactgaggtaactgggagccgccctccagagaaatcaccgccttcaccctgcggggagccggttgcaagctgatacaggaaatttacctttatctctaccccaccctttgtgattatggcactagcagctatctacagccttttcatcattaataagtctggtggccttatatactacaaggactattgttcagcagggaggatggacaccaatgacagtcttagattggcaagtctttggcattcaatgcacgctatctcccagcagctctcccctatccctggctgtacaggcattgacctcctacaagcccacaacttcaatctccactgcttccaatctctcacagggacaaaaattttcgttgtatgtgaaactggcgcacaaaatatggagactctgctgaaggtgatatacgagctttacacggactttgttctgaagaacccgttctacgagatggagatgccgattcggtgtgagctgtttgatctcaacctggctcaggtgatccagaaagaccgggttgctcttttgggtcggtaaaacatgaacgctgcagtcctagtcccatcctatatattgtaatttcttttcctttctatgagacattctcatatttgctcagctggaattaaactatactttctactggtgtaatttatagcttcaatagtgtgttgctcacctgtaatctttttgatgtaccagaatttagggattagcatacagaaaatgtagctgcaaatagttcctccatatcaatttttg

SEQ ID NO: 2365 - DNA, 636 bp, Panicum virgatum
agctgataaaaaaaaatcttttatctctaccccaccttttctgatggcacaagcagctatctatagccttttcatcattaacaagtctggtggcctcatatactacaaggattatggttcagctgggaggatggacaccaatgacagtcttagattggcaagtctctggcattcaatgcatgctatctcccaacaactctcccctatccctggttgtactggcattgacctcctacaagcccataacttcgatcttcactgcttccaatccctcacagggacaaaattttttgttgtatgcgaaaccggcgcacaaaatatggagactctgctgaaagcgatatacgagctgtacacagactttgttctgaagaacccattctatgagatggagatgccgatccggtgcgagctgtttgatctcaacctagctcaggtgatccagaaggaccgtctcgcccttctgggtcggtgaaactgaaacatgaaaacactaccgtcccaatagtgtgattgataattaattcatttctctaagttactctcagctatgctcagcttgaatcgtactttatactggtgcagaatcgataacttcactatggtgtttgtgattgctgtaatacagagttttgc

SEQ ID NO: 2366 - DNA, 1009 bp, Oryza sativa
ccccccccccccccaccacgcatcgcctccaccacccccatcacgccgctgtcgccgtcgccatcccgctgctcgtctccgttgccgtccccgcccctccgcccccgatctacgcctgggcgcccgcctccgcgcccctacatcaccgtcggcctgagtcgccgggctcgtcgtcgccaagccgatcccctccgcagggagtttctactcagcattcttgtgtgataatggcgttagcagcaatctacagccttttcatcattaacaaatctggtggccttatatactacaaggactatggctcagcagggaggacggacaccaatgacagtctacgcttggcaagtctttggcattccatgcatgctatctcccagcagctgtcccctacacctggctgtgaaggcattgaccttctacaagcccacaactttgatctccattgcttccagtccctcacagggacaaagttttttgctgtatgcgaaactggtgctcaaaatatcgagactctactgaaagtcatatacgagctctacacggattttgttctgaaaaatccattctacgagatggagatgccaattcgttgtgagctttttgatctcaacctggctcaggtcattcagaaggaccgcgtcacacttctgggtcgatgaatcatttagaaaacatgacgcaccatgtctttgtatgtggcttatatgacatgtatggtgtcagtagggtacttggaattcaggcaagtcattacactgcatcacaaagtccatatacagtgtgcagtcgattccttctagttctgaaaattactttattcctgaagtatcatttgtgccattttggactttatatgtttccagtcgcaccaaccaattcaggaaggtgcatcacacccgtatttgcatttgcatctggcaatgaattcttattgaagagaacatatgaacaatgggcaatttgttttgcaccaatctccatactcaatataacatcctgaatactaccg

SEQ ID NO: 2367 - DNA, 1613 bp, Panicum virgatum
ggtggcggcgcagaccacacgggttgctgcgtcgcgagctgcgcgggcgcaggggacagccgggtggagatgcagctggcgactgggggccaactgccagtgagaggagctgcgggacccagagagggagaagagaggagattagaggtagaggacatttcgcgcattgagctaggtagaggacatttcgtgacctgagctgaccgtgcgtacatatgaggtctgcgtgccgtgacacatagataaatgtggtaaaaatgaaatagctccaaaataaagacgctaaaattgtaaacgtcgttgtaagagttatatttggatgattgcgtaatggtaaaaattgtaaaaaaaaaccccagcacttccgtcactccgtcaggccatgctggcatgctgctggggccacagcccacagccgcgctgcttcgtccccgccgcgccgtcctcccgcggcagcgccagccaagacggggccgcgtgctggcgccggttccagcggaggcgagcatggctagcggagctgcaggcctagcgcggcggcgccgctgttgctttcagccttgaggtgggttgcagatagggtgtaatttttgtgaagtaaggagctaggctcgctcgagctcggctcattcacagccctccctctgtttcttaaaactttcccttcgctcggactctctcctctccctttctcttccttccctggcggcgacggctgggcgagcggcgtcgccattcgtcctgtcttcgcccagccctttgccggcgacgagcgcatcctccagcttacacaagaaattttcttttatctccactccaccttcttttctgatggcacaagcagctatctgcagccttttcatcattaacaagtctggtggcctcatatactacaaggagtatggttcagctgggaggatggacaccaatgacagtcttagattggcaagtctctggcattcaatgcatgctatctcccagcaactctcccctatccctggttgtactggcattgacctcctacaagcccataactttgatctccactgcttccaatccctcacagggacaaaaattttttgttgtatgcgaaaccggcgcgcaaaatatggagactctgctgaaagcaatatatgagctgtacacggactttgttctgaaaaacccgttctatgagatggagatgccgatcaggtgcgagctgtttgatctcaacctagctcaggtgatccagaaggatcgactcgcccttctgggtcggtgaaactgaaacatgaaaacactaccgtcccaatagtgtgattgataattaattcttttttctaagttattactctcagctatgctcagctggaatcgtacttgtactggtgcataatcgataacttcaatatggtgtatgtgtttgctggaatatagagttttgcatacaggaaatgctgctgcaaataacaactccatggaatgcagctcccaatcgcccattcatacatctacacatgttttgcctgtgatgagcttcgaggcttgagattgcttgcatcagcagtgttgcagtaatgttcaggtggcattctattcttggtccgtcaatctgaatcctaattggagtc

SEQ ID NO: 2368 - DNA, 1078 bp, Hordeum vulgare
gctattcgctcaaagagaaagaaaaagaaaaaacctgaaggcgccgctctcctcctcactcgtctccgacgcctttggatctcgccgagccgtcgccatcgcgcctccttctctctctcctctctctctctctctctctctctctctctctctctctctctctctctctctctctctctctctcgtccgcacgaacgaaggagctagggttctccttctccgccaccgacactgcagccggccctccggcgaacttccagcccgcgccgccgcccggagcagcgctcccctgccggcccaggaatttagctgttaattctcctcagccttctcctgtggccatggggacagttgcgatctacagccttttcatcatcaataagtctggtggcctcatatactacaaggactatggctcggcagggagaatggacaccaacgacagtttacgcctcgcgagtctctggcactctatgcacgcaatctcccagcagctgtcccctaccactggctgtactggcattgacctcttacaagcccacaattttgacctccattgcttccaatccctcacagggacgaaatttttcgttgtatgcgaaacaggcgctcaaaatatggaaatcctgctgaaaacaatatatgagctgtacactgagtttgttttgaagaacccattctacgagatggaaatgccgatccggtgtgagctctttgacctcaacctagcccaggtcatccagaaggaccgtgtcgctcttctgggccggtgaagcatgaaaggaacatacggagcaccgtctcttgcaatctcgtgtgtgtttttctaccatctttgtatttggtcacctagaacatgtttcatcttgaaagtgattctggctcataacatgaatgcggtacagactttcatatctgtaaatctgatatacaacgctgggttacagcattcccaagacagacaatgtgtgtagactttgacattgctcagtttgaatttgcatgcctccatgatttgaacaagattatgtgttggtggccatgtgggtaaataacctgtattctggttcatgaatcc

SEQ ID NO: 2369 - DNA, 868 bp, Hordeum vulgare
catctgatacaggaatttagctgttaattctcctcagccttctcctgtggccatggggacagttgcgatctacagccttttcatcatcaataagtctggtggcctcatatactacaaggactatggctcggcagggagaatggacaccaacgacagtttacgcctcgcgagtctctggcactctatgcacgcaatctcccagcagctgtcccctaccactggctgtactggcattgacctcttacaagcccacaattttgacctccattgcttccaatccctcacagggacgaaatttttcgttgtatgcgaaacaggcgctcaaaatatggaaatcctgctgaaaacaatatatgagctgtacactgagtttgttttgaagaacccattctacgagatggaaatgccgatccggtgtgagctctttgacctcaacctagcccaggtcatccagaaggaccgtgtcgctcttctgggccggtgaagcatgaaaggaacatacggagcaccgtctcttgcaatctcgtgtgtgtttttctaccatctttgtatttggtcacctagaacatgtttcatcttgaaagtgattctggctcataacatgaatgcggtacagactttcatatctgtaaatctgatatacaacgctgggttacagcattcccaagacagacaatgtgtgtagactttgacattgctcagtttgaatttgcatgcctccatgatttgaacaagattatgtgttggtggccatgtgggtaaataacctgtattctggttcatgaatcctcgaatacttggtaacaccatgaatatcagatctcgtatgatggctatgtttttggaccgtgggaaccggctgtgggct

SEQ ID NO: 2370 - DNA, 1025 bp, Brachypodium distachyon
ccagaaccatcgaaaatccttctacacatctcctctcaaccattccatacctttttctcccccaagctgctctctcttgccccaacgctccgatccaacccagtgcggctctaaaatctctcctctagtccaccgccgacgtgccgcaagctcggggaccggggtcaccgtcgccgcctcccccctccccaaccctgcgcctctcacgtgagtcgccgccatcgctgtttccgttctgcctcttcgcgtccctgctgtctccggtctccaccccgcgcacaatatcttggattttggttttcgagctaatacaggaaatttgcccttatctttgctacaccttttgtcgctatggggacagttgcaatctacagccttttcataattaacaagtctggtggccttatatactacaaggactatggctcggcagggagaatggacactaacgacagcctgcgcctagcaagtctctggcattcaatgcatgctatctcccagcagctgtcccctaccactggctgtactggcattgacctcctacaagcccacaacttcgacctccattgcttccaatccctcacagggacaaagttcttcgttgtatgcgaaacaggtgctcaaaacatggaaatcctactgaaaacgatatatgagctgtacacggagttcgtcttgaaaaacccattctatgagatggagatgccgattcggtgtgagctctttgatctcaacttggctcaggtcattcagaaggatcgtgtcgcgcttctgggccgatgaaacataaaaaaaaaacataacgttcaccgtttcttgtaacgttttgtattcatgtactagcttttgtatttgctcagctagaatatgtttattcttgaatgtgttcctgatgaccaatgggagaaatgtgctgcaggcttgcacatctgtaaatcttgtttacataactctgggttacaacattttgatgacagcctatgtgtctgagtctaatattggtcagcttggattttccatttctc

SEQ ID NO: 2371 - DNA, 1031 bp, Brachypodium distachyon
cgaaaaccagaaccatcgaaaatccttctacacatctcctctcaaccattccatacctttttctcccccaagctgctctctcttgccccaacgctccgatccaacccagtgcggctctaaaatctctcctctagtccaccgccgacgtgccgcaagctcggggaccggggtcaccgtcgccgcctcccccctccccaaccctgcgcctctcacgtgagtcgccgccatcgctgtttccgttctgcctcttcgcgtccctgctgtctccggtctccaccccgcgcacaatatcttggattttggttttcgagctaatacaggaaatttgcccttatctttgctacaccttttgtcgctatggggacagttgcaatctacagccttttcataattaacaagtctggtggccttatatactacaaggactatggctcggcagggagaatggacactaacgacagcctgcgcctagcaagtctctggcattcaatgcatgctatctcccagcagctgtcccctaccactggctgtactggcattgacctcctacaagcccacaacttcgacctccattgcttccaatccctcacagggacaaagttcttcgttgtatgcgaaacaggtgctcaaaacatggaaatcctactgaaaacgatatatgagctgtacacggagttcgtcttgaaaaacccattctatgagatggagatgccgattcggtgtgagctctttgatctcaacttggctcaggtcattcagaaggatcgtgtcgcgcttctgggccgatgaaacataaaaaaaaaacataacgttcaccgtttcttgtaacgttttgtattcatgtactagcttttgtatttgctcagctagaatatgtttattcttgaatgtgttcctgatgaccaatgggagaaatgtgctgcaggcttgcacatctgtaaatcttgtttacataactctgggttacaacattttgatgacagcctatgtgtctgagtctaatattggtcagcttggattttccatttctc

SEQ ID NO: 2372 - DNA, 1084 bp, Brachypodium distachyon
gtccagggcccaaatccatctccacggtttcctcctcttctcttcctcctcatttcgtcctgcgtcctgagtcctgaactcctgatctactccgatctctagagctgccgccgagcgtcggcggctccatcctcccggcccaacccctccgcctcccacgcgcgtcgccgccatcaccattcccgttccatctcatcgcgcccctgctgtctcaacccctttcccgtcgcaatttcggcaattggtttctgactctgagctgacaccggaaatttgctgcgacctcctctcccctccttgtccggtggccatggggacagttgcaatctacagcctcttcatcatcaacaagtccggtggcctcatatactacaaggactatggctcggcagggaggatggacaccaacgacagcctacgcctggcgagtctctggcactcgatgcacgccatctcccagcagctgtcccctaccactggctgtaccggcattgatctcctgcaggcccacaacttcgacctccattgcttccaatccctcacagggactaaattttttgttgtatgcgaaactggtgctcaaaacatggaaatcctgctgaaaacgatttatgagctgtacacagagtttgtcttgaagaacccattttacgagatggagatgccgattcgttgcgagctctttgatctcaacctagctcaggtcatccagaaggaccgtgttgcgcttctgggccgctgaaacatgaaaatgtcataccatacacctttgctgtaactctgtttgttcctgtactgccttttgtatttgctcagctagaacctttcaaaaagtaaaatgcgttttactcataagagcgcgtgctctcatttcatttttgagttatcctaaaattctaaaaatcgttaaaaacatatggatgtacagtatgccctcttgcatgcgttactgatgactaatggcacatgtgtggtacgcgcttgcacatctgtaagactgtaaatcttctctacgtaatgcttgggtcacagcattttgaagagaaacaatgtgtgtaagctttgatattgcttagcttgtatt

SEQ ID NO: 2373 - DNA, 1086 bp, Brachypodium distachyon
ttgtccagggcccaaatccatctccacggtttcctcctcttctcttcctcctcatttcgtcctgcgtcctgagtcctgaactcctgatctactccgatctctagagctgccgccgagcgtcggcggctccatcctcccggcccaacccctccgcctcccacgcgcgtcgccgccatcaccattcccgttccatctcatcgcgcccctgctgtctcaacccctttcccgtcgcaatttcggcaattggtttctgactctgagctgacaccggaaatttgctgcgacctcctctcccctccttgtccggtggccatggggacagttgcaatctacagcctcttcatcatcaacaagtccggtggcctcatatactacaaggactatggctcggcagggaggatggacaccaacgacagcctacgcctggcgagtctctggcactcgatgcacgccatctcccagcagctgtcccctaccactggctgtaccggcattgatctcctgcaggcccacaacttcgacctccattgcttccaatccctcacagggactaaattttttgttgtatgcgaaactggtgctcaaaacatggaaatcctgctgaaaacgatttatgagctgtacacagagtttgtcttgaagaacccattttacgagatggagatgccgattcgttgcgagctctttgatctcaacctagctcaggtcatccagaaggaccgtgttgcgcttctgggccgctgaaacatgaaaatgtcataccatacacctttgctgtaactctgtttgttcctgtactgccttttgtatttgctcagctagaacctttcaaaaagtaaaatgcgttttactcataagagcgcgtgctctcatttcatttttgagttatcctaaaattctaaaaatcgttaaaaacatatggatgtacagtatgccctcttgcatgcgttactgatgactaatggcacatgtgtggtacgcgcttgcacatctgtaagactgtaaatcttctctacgtaatgcttgggtcacagcattttgaagagaaacaatgtgtgtaagctttgatattgcttagcttgtatt

SEQ ID NO: 2374 - DNA, 1060 bp, Avena sativa
ggtatcgtgtatgaacagaactctgaatttctcatcctacctgctcctctcacctacctcctgttcgtctgattctcaccccaaaattctttgatctcatccccttttcttgtaagatcccaccggggccttacatccactactaggcttctcccctccaccgccccgtcctttctctgagctctcaatccccgaagccagccgtctgttcgtccatcgttcctgtctgcccctctccgcgcctctctctgcccgcacccaagagcaaggggagctccaccgcgacgccggcggcgacagggacggcggtagcggcgcctcccggcaactcaaactgatacaagaaattcgccgcttcctcctctctgtcttcttgttgcgactatggggacagttgcaatctacagccttttcatcatcaataagtctggtggccttatttactacaaggactatggctctgcagggagaatggacactaatgatagtctacgcctggcaagtctctggcactcaatgcatgctatatcccagcagctatcccctaccaccggctgtactggcattgacctccttcaagcccacaacttcgacctccattgcttccaatccctcacagggacgaaattttttgttgtatgcgaaacaggagctcaaaacatggagatcctgctgaaaacgatatacgagctttacacagagtttgtcttgaagaacccattctatgagatggagatgccgatccggtgtgagctctttgatctcaacctagctcaggtcatccagaaggaccgtgtcgcgcttatgggccggtgaaacatgaaatcgaccatgcactatctcctgtaccttttttgtgttcatgtactgcatttctggagcttgtttcctgttaaatgccttgttgataaccaatggcgtgaatgcttcgcgcttaacatctgtaaatctctatgcacaatacttgagttacagcatttgaagacagacactgtttagcttcgattttcatctttcattggtttgaacacggttatgctcgtgcaattttgacttttag

SEQ ID NO: 2375 - DNA, 821 bp, Avena sativa
ccagccctctgttcgtccatcgtccctgtctgcccctctccgcgcctctctctgcccgcacccaagagcaaggggagctccaccgcgacgccggcggcaacaggacggcggtagcggcgcctaccggcaactcaaactgatacaagaaattcgccgcttcctcctctctgtcttcttgttgcgactatggggactgttgcgatctacagccttttcatcatcaacaagtctggtggccttatttactacaaggactatggctctgcagggagaatggacaccaatgacagtctacgcctggcaagtctctggcactcaatgcatgctatctcccagcagctgtcccctaccaccggctgtactggcattgacctccttcaagcccacaactttgacctccattgcttccaatccctcacagggacgaaattttttgttgtatgcgaaacaggagctcaaaacatggagatcctgctgaaaacgatatacgagctttacacagagtttgtcttgaagaacccattctatgagatggagatgccgatccggtgtgagctctttgatctcaacctagctcaggtcatccagaaggatcgtgtcgcgcttatgggccggtgaaacatgaaatcgaccatgcactatctcctgtacctttttttgtgttcatgtactgcatttctggagcttgtttcctgttaaatgccttgttgataaccaatggcgtgaatgcttcgcgcttaacatctgtaaatctctatgcacaatacttgagttacagcatttgaagacagacactgtttagcttcgattaacaaaaaaaa

SEQ ID NO: 2376 - DNA, 902 bp, Oryza sativa
tccgtcaaaaaaagcttcttcagctcccgacctcgtcttcagctccgatcgctcgccgcggcagatcccgccgccaagaaagacgccggcggacggagcgggagcgacgacctcgccgggccgcacgcacgcccgcacgcaccaccacctgctgaaatccctgcgtcgtctcgccgtggtgctagctaatacaggaaaattacttcagtttctactcagcattcttgtgtgataatggcgtcagcagcaatctacagccttttcatcattaacaaatctggcggccttatatactacaaggactatggctcagcaggtaggacggacaccaatgacagtctacgcttggcaagtctttggcattccatgcatgctatctcccagcagctgtcccctacacatggctgcgaaggcattgaccttctacaagcccataactttgatctccattgcttccagtccctcacagggacaaagttttttgctgtatgcgaaactggtgctcaaaatatcgagacactactgaaagtcatatacgagctctacacggattttgttttgaaaaatccattctacgagatggagatgccaattcgttgtgagctttttgatctcaacctggctcaggtcattcagaaggaccgcgtcacacttctgggtcgatgaatcatttagaaaacatgatgcaccatgtctttgtaatttttcggattcctgcactgcctttggatttgctcagccacaaaccaaagtattctttcgtatgtgttgctgataattaatgatatgaacatcatgatgtattgctcacttactcatctgtaaatctcttataaggtgctggatcgtagcattttgcagacagaactgtttagactctgaattgttcagcctgaattccc

SEQ ID NO: 2377 - DNA, 853 bp, Secale cereale
cccagcccgccgccgcccgcccggacgcagcgctcctctgccggcccaggaatatagctgttaattctgctcagccttctcctgtggccatggggacagttgcgatctacagccttttcatcatcaacaagtctggtggtcttatatactacaaggattatggttcggcggggagaatggacaccaacgacagtttacggcttgcgagtctctggcactcaatgcatgcgatctcccagcagctgtcccctaccactggatgtactggcattgacctcttacaggcccacaatttcgatctccattgcttccagtccctcacagggacgaaatttttcgttgtatgcgaaacaggcgctcaaaatatggaaatcctgctgaaaacgatatatgagctgtacaccgagtttgttttgaagaacccgttctacgaaatggagatgccaatccggtgtgagctctttgacctgaacttagctcatgtcatccagaaggaccgtgtcgcacttctgggccggtgaaacatgaaaggaacatacggagcaccgactcttacaagttcgtgtgtggttttctaccatatttgtatttggtcacatagaacatgttccctgttgaaagttttgctgcctgatgacatgaatgtggtacgcacttccatatatgtaaatctgctatacagtgctgggttacagcatttcgaagacagataacgtgtctagactttgacattgctcagtttgaatttccatgtctccatgtgtgatttaaacaagaatgtgttggtgtccatgtggtgaataacttgtacgtattctggttcttgaattctcgaatagtcggtaacacctag

SEQ ID NO: 2378 - DNA, 916 bp, Secale cereale
gggaggggacgcactcccgcacgaacgaaggagccggggttctccgccgcctccactgcagccggccctccggcgaacctccagcccgcgccgccgcccggagcagcgctcctctgcctgcccaggaatatagctgttaattctgctcagtcttctcctgtggccatggggacagttgcgatctacagccttttcatcatcaacaagtctggtggtcttatatactacaaggattatggttcggcggggagaatggacaccaacgacagtttacggcttgcgagtctctggcactcaatgcatgcgatctcccagcagctgtcccctaccactggatgtactggcattgacctcttacaggcccacaatttcgatctccattgcttccagtccctcacagggacgaaatttttcgttgtatgcgaaacaggcgctcaaaatatggaaatcctgctgaaaacgatatatgagctgtacaccgagtttgttttgaagaacccgttctacgaaatggagatgccaatccggtgtgagctctttgacctgaacttagctcatgtcatccagaaggaccgtgtcgcacttctgggccggtgaaacatggaaggaacatacggagcaccgactcttgcaatttcatgtgtgtgtttttctaccatctttgtatttggtcacatagaacatgttccctcttgaaagtgattctggctgatgacatgaatgtggtatgcactttcgtatctgtaaatctgctatacagtgttgagctacagcatttcaaagacagatgatgtgtctagactttgacattgctcagtttgaatttccatgtctccatgtgtgatttaaacaagaatatgtgttggtgtccatgtgagtgtaattaactttgttatttcttagtttctaaaaaaaa

SEQ ID NO: 2379 - DNA, 875 bp, Secale cereale
gctcctctgccggcccaggaatatagctgttaattctgctcagtcttctcctgtggccatggggacagttgcgatctacagccttttcatcatcaacaagtctggtggtcttatatactacaaggattatggttcggcggggagaatggacaccaacgacagtttacggcttgcgagtctctggcactcaatgcatgcgatctcccagcagctgtcccctaccactggatgtactggcattgacctcttacaggcccacaatttcgatctccattgcttccagtccctcacagggacgaaatttttcgttgtatgcgaaacaggcgctcaaaatatggaaatcctgctgaaaacgatatatgagctgtacaccgagtttgttttgaagaacccgttctacgaaatggagatgccaatccggtgtgagctctttgacctgaacttagctcatgtcatccagaaggaccgtgttgcacttctgggccggtgaaacatgaaaggaacatatggagcaccgactcttgcaatttcgtgtgtgtttttcaggtgacctagaacatgtttcctcttgaaagtgattctggctgatgacatgaatgtggtacgcactttcatatctgtaaatctgctatacagtgttgagctacagcatttcaaggacagatgatgtgtctagactttgacattgctcagtttgattttccatgtctgcatgtgtgatttaaacaagaatatgtgttggtgtccatgtgggtgaataacttgtattctggttcttgaatcctcgaatactcggtaagaacatgaatgtcagatgtcgtgggccaattcatctctggtggtgaaaccctaatggtctttattgtttgtgctac

SEQ ID NO: 2380 - DNA, 1047 bp, Triticum aestivum
ctcactcgtctccgacgcctttggatctcgccgagccgtcgacatcgtgcctcctcgccgccgcgaagaggagggatcgcactcccgcacgaacgaaggagccagggttctccgccgccgccactgcagccggccctccggcgaacctccagcccgcgccgccgcctcccggagcagcgctcctctgccggcccaggagtttagctgttaattctgctcagccttcttgtgtggctatggggacagtcgcaatctacagccttttcatcatcaacaagtctggcggccttatatactacaaggactatggctcagcggggagaatggacaccaacgacagtttgcgtctggcgagtctctggcactcgatgcatgctatctcacagcagctgtcccctaccactggctgtactggcattgacctcttacaggcccacaatttcgatctccattgcttccaatccctcacagggaccaaatttttcgttgtatgcgaaacaggcgctcaaaatatggaaatcctgctgaaaactatatatgagctgtacacggagtttgttttgaagaacccattctacgagatggagatgccaatccggtgtgagctctttgacctcaacttagctcatgtcatccagaaggaccgtgtcgcacttctgggccggtgaaacatgaaaggaacatacggagcacaatttcgtgtgtgtttctctaccatctttgtatttggtcacatagaacatggttcttcttgaaagtgattctggctggtaacatgaatgtggtttgcactttgatatctgtaaatctgctatacagtgctgggttacagcatttccaagacagacgatgtgtctagactttgacattgctgagtttgaatttccatgcctccgtgatttgaacaagattatgtattggtggccatgtgggtaaataacctgtataacggccggtaataccatgaatatcagatgttttatatactggctgtctttttggaccatgggaaccagctgttggctaattaatttctggtggtgaaaa

SEQ ID NO: 2381 - DNA, 773 bp, Festuca arundinacea
acagacgtgatatcttctccgccggtggtctccttcctcggcggccttctctccgttgatacacttcctattatatcggcttccccttctttctcactatggcgacggtggcaatttacagccttttcatcatcaacaagtctggtggccttatacactacaaggactatggttcagcagggagaatggacaccaacgacagtctacggttggcaagtctctggcattcaatgcatgctatctcacagcagctatcccctacccctggctgtaatggcattgacctcctacaagcccacaacttcgaccttcattgcttccaatctctcacagggacaaaattcttcgttgtatgcgaaaaaggtgctccgaacatggaacttttgctgagagcgatttacgagctctacacggaatttgctttgaagaatccgttctatgagatggagatgccgattcggtgcgagctctttgatttcaacctagctcaagttatccagaaggaccgagtcgcacttctgggccggtgaaacatgtcaaagaaaaatacgttgaaccatcttttcaaatattctgattcttgtagtggctgctgcccttcagtttgttcagccagagaaacctttttttttcctttgaatgtattgctgataacaaatggcgtgagtgccgttttgctcaatcgtgcgtctgtaaattggttcggcggtgttgagttacaacatttcacggagacaatgctcagcttggacttccaaaaaaaaaaaaaaaaa

SEQ ID NO: 2382 - DNA, 738 bp, Lolium multiflorum
accaaggacggcggtagcacccgtgtaccggcaactcaaggttagctgctacctccgctctgccttcttgttgctatggggacagttgcaatctacagtcttttcatcatcaataagtctggtggcctgatttattacaaggactatggctcagcagggagaatggacaccaacgacagtctacgcctcgcaagtctctggcactcaatgcatgctatctcccagcaattgtcccctaccactggctgtactggcattgacctccttcaagccaacaacttcgaccttcattgcttccaatcccttacagggacgaaatttttcgttgtatgcgaaacaggagctcaaaacatggagatcctgctgaagacgatatacgagctgtacacagagtttgtcttgaagaacccattctacgagatggagatgcctattcggtgtgagctctttgatctcaacctagctcaggtcatccagaaggatcgtgtcgcacttatgggccggtgaaacatggcatgcagtatctcctgtaacttttttgtgttcatgtactgcatttatatttgcgcagctagaacctgtttcatgttgaatgtcttgctgataaccaacggcgtgaatgctaagctcttgacgtctgtaaatctctatacacaatattgggttacatcatttcatgacagaagctgaatatactttgatactgtttcgtttggatttccgtctttcattggttta

SEQ ID NO: 2383 - DNA, 968 bp, Triticum aestivum
tgcgacccacgcttccgagaagaaaaaaaaattcaaggcgccgctctcctcagtcgtctccgacgcctttggatctcgccgccgcccgcgtcgccatcgtgcctcctcgccgctgcaaagaggaggggtcgtcccgcacgaccgaaggagccagggttctccgccgcagccggccctccggcgaacctccagcccgcgccgccgcctcccggagcagcgctcctctgccggcccaggaatttagctgttaattctgctcagccttctgctgtggccatggggacagttgcaatctacagccttttcatcatcaacaagtctggtggccttatatactacaaggactatggctcagctgggagaatggacaccaacgacagtttgcgcctcgcgagtctctggcactcgatgcacgcaatctcgcagcagctgtcccctaccacaggctgtactggcattgacctcttacaagcccacaacttcgacctccattgcttccagtccctcacagggacgaaatttttcgttgtatgcgagacaggcactcaaaatatggaaatcctgctgaaaacgatatatgagctgtacacagagtttgttttgaagaacccgttctacgagatggagatgccaatccggtgtgagctctttgacctcaacctagcccatgtcatccagaaggaccgtgtcgcacttctgggccggtgaaacatgaaaggaacatacggagcaccgactcttgcaatttcgtgtttgtttttctaccatatttgtatttggtcacctagaacatgtttcctcttgaaagtgattctggctgataacatgaatgcggtacagacttccatatctgtaaatctgatatacaatgctgggttacagcattttgaggacagaagatgtgtgtagactttgacattgctcagtttgaatttgcatgtctccatgatttgaacaaaaaaaaaaaa

SEQ ID NO: 2384 - DNA, 655 bp, Avena sativa
tgctcggcggcgtcttctctccggtttactgttatctcaactccgccttcttgtgtcactatggggacggtagcaatttacagccttttcatcatcaacaagtctggaggccttatatactacaaggactatggctcagcagggagaatggacaccaatgacactctacgattggcaagtctctggcattcgatgcatgctatctcgcagcagctgtcccctactcttggctgtaatggcattgacctcctacaagcccagaacttcgatctccattgtttccaatctctcacagggacaaagtttttcgttgtatgcgaaacaggcgcccagaacatggaaattttgctgagaacaatttacgagctgtacacggattttgttttgaagaacccgttctatgagatggagatgccgattcggtgcgagctctttgatgtcaacctggctcaagtgatccagaaggaccgtgtcgcgcttctcggccggtgaaacatgtcaaaaaggaataattcgaagaatctcttgtatcttcggattcattgtcgttttgtttagtactccacgagaatatgttatccctcgagagtccaggcaagaaccaccgagggaatagcaggaaataacatagaaataatcagaatgaatgaactaa

SEQ ID NO: 2385 - DNA, 729 bp, Avena sativa
ctccgccttcttgtgtcactatggggacggtagcaatttacagccttttcatcatcaacaagtctggaggccttatatactacaaggactatggctcagcagggagaatggacaccaatgacactctacgattggcaagtctctggcattcgatgcatgctatctcgcagcagctgtcccctacccttggctgtaatggcattgacctcctacaagctcacaactttgatctccattgtttccaatctatcacagggacaaagtttttcgttgtatgcgaaacaggcgcccagaacatggagattttgctgagaacaatttacgagctgtacaccgattttgttctgaagaacccattctatgagatggagatgccgatccggtgcgagctctttgatgtcaacctggctcaagtgatccagaaggaccgtgtcgcgcttctcggccggtgaaacatgtcaaaaaggaataattcgaagaatctcttgtatcttcggattcattgtcgttttgtttagtactccacgagaatatgttatccctcgagagtccaggcaagaaccaccgagggaatagcaggaaataacatagaaataatcagaatgaatgaactaactactacctcgtcagtaaccacaattgttcgatcgagtagatacttgatgtctatagatcatttgatttcacggaggtgccagagttaatagcataaaaagtaccacttcacaa

SEQ ID NO: 2386 - DNA, 732 bp, Avena sativa
ctctgggctctcaatccccacgcggctctcccgaagctctgatccgacccagccgtctgttcgtccatcgttcctgtctgcccctctccgcgcctctctctgcccgcacccaagagcaaggggagctccaccgcgacgccggcggcgacagggacggcggtagcggcgcctcccggcaactcaaactgatacaagaaattcaccacttcctcctctctgtcttcttgttgcgactatggggacagttgcaatctacagccttttcatcatcaataagtctggtggccttatttactacaaggactatggctctgcagggagaatggacactaatgatagtctacgcctggcaagtctctggcactcaatgcatgctatatcccagcagctatcccctaccaccggctgtactggcattgacctccttcaagcccacaacttcgacctccattgcttccaatccctcacagggacgaaattttttgttgtatgcgaaataggagctcaaaacatggagatcctgctgaaaacgatatacgagctttacacagagtttgtcttgaagaacccattctatgagatggagatgccgatccggtgtgagctctttgatctcaacctagctcaggtcatcccgaaggaccgtgtcgcgcttatgggccggtgaaacctgaaatcgaccatgcactatctcctgttacctttttgtgttcatgtactgcatttctggag

SEQ ID NO: 2387 - DNA, 831 bp, Secale cereale
ggaggggacgcactcccgcacgaacgaaggaccccgggttctccgccgcctccactgcatccggccctccggcgaacctccaccccgcgcccccgcccggagcagcgctcctctgccggcccaggaatatagctattaattctgctcagccttctcctgtggccatggggacagttgcgatctacagccttttcatcatcaacaagtctggtggtcttatatactacaaggattatggttcggcggggagaatggacaccaacgacagtttacggcttgcgagtctctggtactcaatgcatgcgatctcccagcagctgtcccctaccactggatgtactggcattgacctcttacaggcccacaatttcgatctccattgcttccagtccctcacagggacgaaatttttcgttgtatgcgagacaggcactcaaaatatggaaatcctgctgaaaacgatatatgagctgtacaccgagtttgttttgaagaacccgttctacgaaatggagatgccaatccggtgtgagctctttgacctgaacttagctcatgtcatccagaaggaccgtgtcgcacttctgggccggtgaaacatggaaggaacatacggagcaccgactcttgcaatttcgtgtttgtttttctaccatctttgtatttggtcacctagaacatgtttcctcttgaaagtgattctggctgataacatgaatgcggtacagacttccatatctgtaaatctgatatacaatgctgggttacagcattttgaggacagaagatgtgtgtagactttgacattgctcagtttgaatttgcatgtct

SEQ ID NO: 2388 - DNA, 651 bp, Avena sativa
gtttactgttatctcaactccgccttcttgtgtcactatggggacggtagcaatttacagccttttcatcatcaacaagtccggaggccttatatactacaaggactatggctcagcagggagaatggacaccaatgacactctacgattggcaagtctctggcattcaatgcatgctatctcgcagcagctgtcccctaccttggctgtaatggcattgacctcctacaagctcacaactttgatctccattgtttccaatctatcacagggacaaagtttttcgttgtatgcgaaacaggcgcccagaacatggagattttgctgagaacaatttacgagctgtacaccgattttgttctgaagaatccgttctatgagatggagatgaccgatccggtgcgagctctttagatgtcaacctggctcaagtgatccagaagaccgtgtcgcgcttctcggccggtgaaatatgtcaaaaaggaataattcgaagcatctcttgtatcgtcggattcattgtcgtttcgttgagagcaagtataataagatccagtcagcaggctatagggcttaaactagtatatttatgtttagtttgacgagagagaagaggagaaagaaaaagagtgggctcttagttaagagtca

SEQ ID NO: 2389 - DNA, 504 bp, Avena sativa
ggtatcttcttgctcggcggcctcttctctccgatttactgttatctcaactccgccttcttgtgccactatggggacggtagcaatttacagccttttcatcatcaacaagtctggaggccttatatactacaaggactatggctcagcagggagaatggacaccaatgacactctacgattggcaagtctctggcattcgatgcatgctatctcgcagcagctgtcccctactcttggctgtaatggcattgacctcctacaagctcacaactttgatctccattgtttccaatctatcacagggacaaagtttttcgttgtatgcgaaacaggcgcccagaacatggagattttgctgagaacaatttacgagctgtacacggattttgttctgaagaacccattctatgagatggagatgccgatccggtgtgagctctttgatctcaacctagctcaggtcatccagaaggatcgtgtcgcgcttatgggccggtgaaa

SEQ ID NO: 2390 - DNA, 659 bp, Musa acuminata
ctcgcgtccgccgcggctcctctccacgctgtggtcgtcgtcaccgccgtctccgagcctcgtacaggccttcgtcttccccactgttcgatatcccccatggcggcgatctatagtctcttcatcatcaacaaatccggcggtctcatcttctacaaggattacggatcggcggggcggatggacacgaatgacagcctgcggttggcgagcttgtggcactcgatgcacgccatctcgcagcagctgtcgcccaccaccggttgcgccggcattgaactcctacaagctcacacctttgatctccactgcttccagtccctcactggaacaaagttttttgttgtctgcgagcctggcacgttgcatatggaagctttgctgaaagtgatctatgagttatacacagattatgttctgaagaacccattctatgagatggagatgccgattcggtgtgaactttttgatctcaacctctctcaagtgatccaaaaagaccgtgttgccttgttagggagatgaacagtattcctgactataattatgtagttttcttcttcttcttcttcttcttttgtgtgtgggtttgtttcattagacaagactacaagttaattcctatggaatattgtattgccaaactatttgagttttct

SEQ ID NO: 2391 - DNA, 751 bp, Musa acuminata
agatgcagcaagtagagaagtatttcttcatttaatgagcatgagcccgtgggtgcgagtctgagaagactctcctcgcgtccgccgcggctcctctccacgctgtggtcgtcgtcaccgccgtctccgagcctcgtacaggccttcgtgttccccaccgttcgatatcccccatggcggcgatctatagtctcttcatcatcaacaaatccggcggtctcatcttctacaaggattacggatcggcggggcggatggacacgaatgacagcctgcggttggcgagcttgtggcactcgatgcacgccatctcgcagcagctgtcgcccaccaccggttgcgccggcattgaactcctacaagctcacacctttgatctccactgcttccagtccctcactggaacaaagttttttgttgtctgcgagcctggcacgttgcatatggaagctttgctgaaagtgatctatgagttatacacagattatgttctgaagaacccattctatgagatggagatgccaattcggtgtgaactttttgatctcaacctctctcaagtgatccaaaaagaccgtgttgccttgttagggagatgaacagtattcctgactataattatgtagttttcttcttcttattcttcttcttcttttgtgtgtgggtttgtttcattagacaagactacaagttaattcctatggaatattgtattgccaaactatttgagttttctctccttacgtaaaag

SEQ ID NO: 2392 - DNA, 463 bp, Aquilegia formosa
cctctccattactttaaatggctgctgcaatttacagtctttttatcatcaataaatctggtggtcttattttctacaaggactatggatcaactggacgaatggatacgaatgatagtctgagattagcaagtttatggcattcaatgcacgcaatctctcaacaattatctcccactgtgggttgttcaggaatcgaattacttcaagctgacacttttgatctccattgcttccaatcactgacaggtactaagttctttgtggtctgtgagcctggtgcacagcatatggaaagtcttttgaaagtgatctatggactatatacagattatgtcttgaaaaatcctttttatgagatggagatgcctatccggtgcgaactctttgatctaaatctctcacaggctacccaaaaggatcgtgttgcattgctgggaagatgagaactccctggactttg

SEQ ID NO: 2393 - DNA, 1124 bp, Ananas comosus
tcgcacacctgacacctccttcttcctcttcgatcccgatctctcgcgcggcctcgccatggcggcgatctacagcctcttcatcatcaacaaatccgggggcctcatcttctacaaggattatggttccgcggggaggatggacacgaacgatagcttgagattggcgagtttgtggcactcgatgcacgcgatctcgcagcagctctcccccatcgtcggatgcaccgggatcgagctactacaggccgataccttcgatctccactgttttcaatccctcactggaacaaaattctttgtcgtctgcgaacctggcacgcagcacatggaagttctgctaaaagttatctacgagctatacacagattatgttttgaagaacccgttctacgaaatggagatgcccatccggtgtgagcttttcgacctcaacctttcccaggcaattcagaaagaccgcgtctccctgctcgggagatgaacttaaggttcctgagtcttcccttttctttgttattgttctcaaaactgatatataagtttctgatatttggttggatccagagtatttattgttttggagagtagcagatactagaaatttcttatgtctcgttcggatatcccttttgttgttctagtttgtatgttgaaaatgaactgtaaaacttcttccatttgtaatgaagaactctcagatgatcagtttctctgcaccaacctccgtgaaagcttttcggcagttttgtgcccgattggccactgtgctgtttttccttgcacaatgatgaactttaatatgtacagaaggaaaattctaataaagttatgatcgttgtacttttctcgacctgtaacaaggcttacatggtgtggcatctagttactcatgctgtggttcgtcgtcgactcctcggtttgcttctaatgctttcatattgtgtgtgaactgtgaagggggggggggggggggggggtaaaggatgtgctttaaattgtggctttcaaattgcaaatttgtttaggacattgtaacggatccaactgcaactatagcaatttcccaagtgacccagcagtgccactaaacctccagctagggaaaatccaccagatcggaa

SEQ ID NO: 2394 - DNA, 596 bp, Elaeis guineensis
aattgctaccgtcaaatttttcttaaaaaatagaacgaaaattcgatctcgtcttcgcaatggcggcgatctacagtctcttcatcatcaacaaatccggcggtctcatattctacaaggattatggatcggctgggcggatggacacgaatgatagcttgaggctggcgagcttgtggcactcgatgcatgcgatctcgcagcagctatcccccaccctcggatgcaacgggattgagctcctccaggccgacaccttcgatctccactgcttccaatccctcactggtacaaaattttttgttgtttgcgagcctggcgcacaacacatggaaggtctgctaaaagttatctatgagttgtacacggattatgttctgaagaaccctttctatgaaatggagatgccaatccgttgtgaactttttgatatgaacctttctcaagcaatccagaaagaccgtgtttctctgtttgggcgttgaaaaagaagccctggctttagtcttttagttgttggtttcccaactttttcattcaagtttgttaatgtggataattgtattgttaatcaatatgaatgaatctgagcactt

SEQ ID NO: 2395 - DNA, 600 bp, Elaeis guineensis
aattgctaccgtcaaatttttcttaaaaaatagaacgaaaatacgatctcgtcttcgcaatggcggcgatctacagtctcttcatcatcaacaaatccggcggtctcatattctacaaggattatggatcggctgggcggatggacacgaatgatagcttgaggctggcgagcttgtggcactcgatgcatgcgatctcgcagcagctatcccccactctcggatgcaacgggattgagctcctccaggccgacaccttcgatctccactgcttccaatccctcactggtacaaaattttttgttgtttgcgagcctggcgcacaacacatggaaggtctgctaaaagttatctatgagttgtacacggattatgttctgaagaaccctttctatgaaatggagatgccaatccgttgtgaactttttgatatgaacctttctcaagcaatccagaaagaccgtgtttccctgtttgggcgttgaaaaagaaattttgactaatcttttagttgttggtttcccaagctttttcattctagttggttcatgtggataattgtattgttaatcaatatgaatgaatctgagcactttcttg

SEQ ID NO: 2396 - DNA, 867 bp, Lippia dulcis
ccccgaaatcggcaaattcggaccaccaccgttcggcgacgctaccgtctcgctgagccgccactatccttcttgatttggtctgacagaagctaattgctaggaacacttcatatttccctctcatctggggcaagataagctacaactacttctgcaactgctttcgtaagcatcaggtaaaagtaacaaacatccaatggcagcaatttacagcctttacatcatcaataaatctggtggcctcattttctacaaggattatggatcagcaggaagaatggacacaaatgatagtttgagactggctagcttgtggcactcgatgcacgccatctctcagcagctttcccctgtttccggatgctctgggattgagctgcttcaggctgatacttttgatcttcactgtttccagtctctcactggtacaaattctttgtggtgtgtgagccaggagcaccgtatatggagggtctgctgaaacatatatatgagttatacactgattatgttctcaagaaccctttctatgagatggagatgccaattcgctgcgagcttttcgacattaatttggcccaagctgttcaaaaggatcgggttgccttattgggaagatgatgaaaccctttcttattcctccttttgtaagagttgtttttgtttgctctgttctgtttctagatttcagaaccaaagggacatggaattcagtttcttgtgtgtgttcatgtttatttacaagtatatactcaaaagcattatggaagaaagatagattaagggcaaaattgaatttttggtctgctaagtagcaacacattcagtcctataaatttgcagattctaattttgaaaaaaaag

SEQ ID NO: 2397 - DNA, 950 bp, Cocos nucifera
ggccgttagtgcatcgacggtgctaatcacggacggcagatcctgcatcctcataaagtttctatgagtaggtacggatttggtgcttgtggaactcggctgaaattgggagcgggatcgagagcggtaatctgcaacctttcctcgccttatctctgtttcttttttatccgatccggaagaaaattgctaccgtcaattttttcttaaaaaattgaacaaaatttcgatctcgtcttcgcaatggcggcgatctacagtctcttcatcatcaacaaatccggtggtctcatattctacaaggattatggatcggcggggcggatggacacgaacgatagcttgaggctggcgagcttgtggcactcgatgcatgcgatctcgcagcagctatcccccaccctcggatgcaacgggattgagctcctccaggccgacaccttcgatctccactgcttccaatccctcacgggtacaaaattttttgttgtttgcgagcccggcacacaacacatggaaggtctgctaaaagttatctatgagctgtacactgattatgttctgaagaaccctttctatgaaatggagatgccaatccgttgtgaactatttgacatgaacctttctcaagcaatccagaaagaccgtgtttccctgtttgggcgttgaaaaagaagtcatgacttcaatcttttagttgttggtttcccaaactttctcattcgagtttgttaatgtggataattatattgtcgatcaatatgaatgaagatctgagtacttcttgtttggcgaaaagaaaaatgcgcctcaaattttcaaaatgctcaaattttggatcggttaattatttttaatcccgtcatgtccaacttttactttgaattgaggcgtgtatcttcttattttgggatggaaagctttatatgatgtttctttgcagatcaaaa

SEQ ID NO: 2398 - DNA, 683 bp, Zostera marina
tatataaactttagattcacggaacggttcaatctccgtggtttctcggaatcgaaaagaaatggccgctgcaattaactgtctgttcatcatcaacaaatccggaggtttgattttctacaaggattgcggatcagcggggagaatggacaccaacgacagtctcagacttgcgagtttgtggcactcgatgcatgcaatctcccaacagctctctcctgtcaatggttgttccggaatccaacttctccaggccgacaccttcgacctccactgcttccaatccctcactggaactaaattctttgttgtctctgagcctggagcacagcacatggaacctctgctgaaagtcatatatgaattatacacggattatgttttgaagaatccattttatgagatggaaatgccaatcagatgtgagctttttgacatcaatctttcccaagctatacagagggaccgagttgcgttattgggacgatgagcatgaactgcatgatacgattagaatctgagttgtcattataaggtaaaaaacaattctaatgctccaaatttgttttcagatatttttgtaaaaaaggtatttatgcttcttttcatttctagtcttctacagttgtaagtgctttcattggaatgttgaaaaattgtgttaagaaattcaattgttttat

SEQ ID NO: 2399 - DNA, 751 bp, Allium cepa
aaagaagcggtgtcttccgaaataattactcgtgcccttcatatttcttcccgatttcatctaaataccaaaccctggatattcataagcaacttcagatttcagaataatggcggcaatctacagtctctttatcatcaacaaatctggcggcctcatcttctacaaagattatggttcgacagggagaatggacacaaatgatagtttgagactggcaagtttgtggcactcgatgcatgcgatttctcagcagctgtctcctgttgttggatgtaatgggatcgagctgctacaggctgacaattttgatttgcattgttttcaatcacttacaggaacaaaattctttgtagtgtgtgagcctggaacgccacaaatggaaaacttgctgaagcttatttacgagctgtatacagattatgtgctgaagaatcctttctacgagatggaaatgcctattcggtgcgaactctttgatctccacctctctcaggcaatccagaaagaccgagtttcactcttaggccggtagataacttgcatgcttctttgaattattggatgacttttttccccttgcactgcttgtaataaatctgtataatactcaagtctatattagaattgtattgactatatataagaatgctttggagcaattcttgtttttccccacctaggcatcacgtgcactaatttagtggtttaaatgttctaatattgatcaagacattaatacaatgtgcac

SEQ ID NO: 2400 - DNA, 900 bp, Amsonia hubrichtii
aactcaatgagtgagggagtgagagaagtcatcaaaattcaagtttgattgagttgagaggggattacttgttgtattgtgaaaatggcagcgatctacagcttatacatcatcaataaatcagggggtttaatcttctacaaggactatggatcagccggacgaatggataccaatgatagtctgagattggccagtctttggcactcaatgcacgccatctctcagcagctttcccctgtcaccaattgtactggaattgaactcctccaagctgatagtttcgatcttcattgctttcaatccctcacaggcaccaagtttttcgttgtatgtgaacctggtacacagcatatggaaagtctcttgaaacatacctacgaattgtatactgattttgtcctgaagaaccctttctacgaaatggagatgccaattcggtgcgagctctttgacatcaatctggctcaggcagtgcagaaggatcgcgttgcattgttggggagatgagctcctcttgttgctgcttaatgtaacctggatagtaataccatgagcaaggaaagcttaattcatttgaactctggtttatattttcggggcaatcatcatgtatgatacaggaaagaatttgcactgggagagttctcatgtttaggaggccttggaaacattgaattccattaaattcgctagactgcttgtactgaaagttctcaacccaatttcaggttgtggtcttctctgaagaaagtgtcgcaaagaaaatctgttgctagttttgtcaaaacatgtggctggttccatacttgtattttaattcatacaagcactgctgtttgatgtttctgcctggctgtactcgaatgattaagaatgttgcatttttcttcctggttt

SEQ ID NO: 2401 - DNA, 1168 bp, Aristolochia fimbriata
catctcgtttatctaaaaatataactaacataaacatcccaaataaattgttcaatatttattttcattaagaggtaaataatcgagtaattggacaatcggataatcgggtaaaattgacaccctaaatttaagctccacgattcggggatgggctgtgaaataaaacccagaggcgggttggaaaatattaatgtaatgttttctttcccatgatctgagcccatcttttttcctcctctctcccacttccggcagcgaacttcgaggaaagtctactctcccagcgacggagggatcggaaaaggtccgggaggagaggtgctgcagtttaacagaatggctgcaatctacagtctttttatcatcaataaatctggtggattgattttctataaggactacggatcagctggacgtatggacacaaatgatagcttgcgagtggcaagcttgtggcattcaatgcatgcaatctcccagcagttgtctcctatggccggctgtactggcatagaactccttgaggcagacacttttgatctccattgctttcagtcactaactggaaccaaattctttgtggtgtgtgagcctggctcgctgcacatgggagctcttctaaaacacatttacgagctgtatactgattttgtgttaaaaaatcctttctacgaaatggaaatgccaatcaggtgtgagctttttgacctgaaccttgcacaagctattcagaaagatcgtgttgcattaatgggacggtgaattaagattatgaagtttgttagtctttcttagatatcttatatctacagagaccctttagatcttattgttacttcttcattgtcatgttcctatgccaagcagtcacaacttatcaatgtatgagctgtgtctttctaaagcaagctatgctggtctcttcttcccttttaattaagcctcttggaggttttccctccccttctcgtggtttgcctacttacctcgcactctacccccagtatttgatgattttgtgtaatcacataaacagtatacaggacaagctagacacagatgcagttatcaacaatatttcaatgctacatttttttccattctagtgttgaacagtgatgaacacctttgttaccaaaacaagcaatttgatattctgctggta

SEQ ID NO: 2402 - DNA, 442 bp, Manihot esculenta
tgactggaaatggctgcgatttatagcttatacattatcaataaatcaggtggtttgatcttctacaaggattatggatctgctggacggatggacacaaatgatagcttacgagtagctagtttatggcattcaatgcatgccatctcccagcagctatcaccaactgtaggttgttcaggcattgaactccttgaagctgatacatttgacctccattgttttcaatctcttactgggacaaagttctttgtggtatgtgaacctgggacatcgcacatggagggtctcttaaaagtcatatatgaattgtacacagattatgttttaaagaaccctttctatgaaatggagatgcctataagatgcgaactctttgacatcaacctaacacaggcgatacagaaagaccgagttgctttgttggggcgataaacttcta

SEQ ID NO: 2403 - DNA, 620 bp, Vitis vinifera
tttctgggaatttccggaaatcaaattccgatggccgcgatctacagtctctacattatcaacaaatccgggggcttaatcttctacaaggattatggatcggcgggacggatggacacgaatgatagcttgcgattagcgagtttgtggcattcgatgcatgcgatttctcagcagttatctccaactttgggttgctcggggatcgagctccttgaagctgatacattcgacctccattgcttccaatcgctcactgggacaaagttctttgtggtatgtgagcctggaacacagcacatggagggtcttttgaaagtcatctatgaattgtacactgattatgtactaaagaatcccttctacgaaatggagatgcccatacgatgtgagctttttgatatcaacctatcccaagccgtacagaaggatcgtgttgccttgttggggcgatgacctacccttgtcttactatgtgttatttttgtctgtaaatttttagaacaatccctttgccaagtttgttcaaacttgatatctgtttaattctagttttatggatgattgaaatactacagctattaacaactttaagagatatggctttcttggggcttgac

SEQ ID NO: 2404 - DNA, 501 bp, Papaver somniferum
atcaaatggctgctgcaatatatagtcttttcattatcaacaaatctggaggtctcattttctataaggattatggatcagcaggaagaatggatactaatgatagtttgagattagcaagtttatggcattcaatgcatgcaatctcacaacaattatcaccagttttaggttgtcaaggaattgaacttcttgaagctgatacttttgatcttcattgttttcagtcacttacagggacaaaattcttcgtcgtatgtgaaccagggacacaacacatggacactctactaaagatcatttatgagctgtacacagactacgtattaaaaaatcccttttacgagatggagatgccaatcaggtgtgaactctttgatattaacctcatacagggcatccagaaagatggtgttgctttgcttggtcgatgaataaaccttgtctaatttgtaagtcacggtcatagtaactgagttctacttcggtgaatttctttgt

SEQ ID NO: 2405 - DNA, 857 bp, Sesamum indicum
tttctatcaagttaaaaaacaactcttgaacaactttaccatcatttgcaacttcattctcctcaccaaagccctccatcttctcaaactggctcccacacctcggatcagattttgacaagcaatccatggcagctatttacagtctctacatcatcaataaatcaggtggcctcattttctataaggattatgggtcggcgggaagaatggacaccaacgatagtttgagactggcgagcctgtggcactcgatgcacgccatctctcagcagctctcccctgtttcgggctgctctggaatcgagctacttcaggctgatactttcgatcttcactgtttccagtccctcactggtacgaaattctttgtggtctgtgagcctggaactctgcatatggagaatctcttgaaacatatttatgagttatacactgactatgttttgaagaacccgttctatgagatggagatgccaattcggtgcgagttgtttgacataaatttggcacaagcagtacaaaaggatcgggtcgccttactgggaagatgacctgcttaacctgtacctgagcatgagagaccttttctatcctttgttttgcactgaattggttttcatttgtttttaaagcttgtttagttagtgttccattctcttgatttctgaaacaatgatagaaggttagacaacctgcgcaaggattctccattgtgtatgtgtggagttagaaaactggggcttctgcccatggccctcaacgatgagccatgactataaaatcaatgttgttttccttaaatagagttaccattccaaattttctgaatttcattttagattgaaatatgcggg

SEQ ID NO: 2406 - DNA, 696 bp, Tabernaemontana elegans
agggagggagtgagagaagtcatcagaattgaagctctcagtttggagcaaattacttatcgtattctgtaaatggcagcgatctacagcttgtacatcatcaataaatcagggggtctaatcttctacaaggactatggatcagcgggacgaatggataccaatgatagtttgagattggccagtctttggcattcaatgcacgccatctcacagcaactttcccctgttcccaattgttctgggattgaacttctccaagctgatactttcgatcttcattgcttccagtccctcacagggaccaagttttttgtcgtctgtgaacctggtatacagcatatggagggtctcttgaagcatatctatgagttgtatactgattatgtcctgaagaaccctttctacgaaatggagatgccaattaggtgcgagctgtttgacatcaacctggctcaggcagtgcaaaaggatcgtgttgccttgttggggagataagctccttttttttgccgcttaatgtatcctgggtggtaataccatgagcaaagggagcttaatacatttcaactctggtttctattgtcagggtaatcatcatgtaatatagaggacaaagaatttaatcaggcagagtacatcctttaggggaccttgagttttctggactgcatgcattgaaaattcttataccaa

SEQ ID NO: 2407 - DNA, 938 bp, Citrullus lanatus
tcgtaattacatctatctgccattggcgactccatccagtctcaagctcccaaaactcactcactggcttaagatcggcgactggattttacgccttccaatctacgttcttccccacaccgattatacccattcacaaccatattcattctcatttccttcataatacttcagaactttgatagatctaaagacgatggcagcaatttacagcctctacatcatcaacaaatctggtggtttgatcttctacaaggattatgggtctgctggacgaatggacacaaatgatagtttgagagtggcgagtttatggcattcgatgcatgccatttcccagcagctgtcgcctatagccggttgttcgggtattgaacttcttgaagccgatacattcgacctccattgcttccagtcacttactgggacaaagttttttgttgtgtgtgagcccggagcacagcacatggagggtcttctgaagtacatttatgagttatacacagattttgtcttgaagaatccattctatgagatggagatgcctatacggtgtgagctctttgacatcaacttagcgcaggcagtgcaaaaagatcgtgttgctttgcttggccgatgagcttaggacatccttgattttgtcagtattgaccatccacaattcaagaatgaaaggcctatgatattattgtgcaaaattcttgataatttgccgtccttaatgctaaatgtactccattcctagtgaatcgtgtgagatttggtggaaatagaatgtttcttttcagtgttgttcaccagaaactcaaggttaattttatacccaaatttttgtcaattgcatacagatctggatccagttaaatgacagagcaacgtcatgttataagcttttggggcctggtgaactaagcagccgaagtatttacatttta

SEQ ID NO: 2408 - DNA, 573 bp, Amorphophallus konjac
ctgctctctgttctctgtgaactcatactcacaaacacacgttcttttctgtgcgctaaggcgaggggaatggcggctggcccggcctccaacgccgccatctacagcctcttcatcatcaacaagtctggcgggttgatcttctacaaggattacgggtcggcagggcggatggacaccaacgacagcctgcgtctggcgagcctctggcactcgatgcacgccatctcccagcagctgtccccccacgccggctgcaccggcgtcgagctcctccaggctgacacctttgatctccactgcttccagtccctcaccggaaccaaatttttttgtgtctgcgagcctggaaggcaacacatggaagctcttttgaaggtcatctatgaactctacactgattatgtcctgaagaacccctttctatgagatggaaatgccaattcggtgtgaactgttcgacctcaacctctctcaagcaatccagaaggaccgggttgccttgatgggaatatggaaaattgggaactgctaattgtatcatacaatggactccagaagacttcacatcac

SEQ ID NO: 2409 - DNA, 768 bp, Allium cepa
aaagaagcggtgtcttccgaaataattactcgtgccctttatatttcttcccgatttcatctaaataccaaacccggatattcataagcaacttcagatttcagaataatggcggcaatctacagtctctttatcatcaacaaatctggcggcctcatcttctacaaagattatggttcgacagggagaatggacacaaatgatagtttgagactggcaagtttgtggcactcgatgcatgcgatttctcagcagctgtctcctgttgttggatgtaatgggatcgagctgctacaggctgacaattttgatttgcattgtttcaatcacttacaggaacaaaattctttgtagtgtgtgagcctggaacgccacaaatggaaaacttgctgaagcttatttacgagctgtatacagattatgtgctgaagaatcctttctacgagatggaaatgcctattcggtgcgaactctttgatctccacctctctcaggcaatccagaaagaccgagtttcactcttaggccggtagataacttgcatgcttctttgaattattggatgacttttttccccttgcactgcttgtaataaatctgtataatactcaagtctatattagaattgtattgactatatataagaatgctttggagcaattcttgtttttccccacctaggcatcacgtgcactaatttagtggtttaaatgtcctaatattgatcatgacattaatacaatgtgcactgaattatttttccttttc

SEQ ID NO: 2410 - DNA, 731 bp, Papaver somniferum
gtccctaattttatttcaacagatttctctgaatcggagaacatctttaccatcaaatggctgctgcaatatacagtctttttattattaacaaatccgggggtctcattttctacaaggattatggatcagcaggaagaatggatacaaatgatagtttgagattagcaagtttatggcattcaatgcatgcaatctcacaacaactatcaccagttttaggttgtcaagggattgaacttcttgaagctgatacttttgatcttcattgttttcaatcacttacaggaacgaagttctttgtcgtatgtgaaccagggacacaacacatggacgctctactaaaaatcatttatgaactgtacacagactatgttttgtaaaacctttttacgagatggagatgccaattaggtgtgaactcttcgatattaacctcatacaagccatccagaaagatcgtgttgctttgcttggtcgatgaataaaccttgtctaatttgcaagtcacggtcatagtaactgagttgtacttcggtgaaatttgtttgtttataaatttacagagttggatatatgaaagtttgtctgaacaatttttcaaattcgaacttctgtcaggaatttaaaacaccacccatcaattttctttgaatttcagatttgatgcttctgtatatttgttttttctctttgttaaatattcttgtgtgcagattcttaatttatgt

SEQ ID NO: 2411 - DNA, 743 bp, Tripterygium wilfordii
agcatttgtcgtcggacatccgcgtgagagagaggtcgccgatctggaagaccgaggtcttggatggccgtcgttttctaggaaatttcagagaaaggaaattttgagatggcagcaatttatagtctttacatcatcaacaaatcaggtggtttgatattctacaaggattatggttctgcgggacggatggacacaaatgatagtttaagagtggctagtttatggcactcaatgcatgccatctctcagcagctatcaccaactgtgggctgttcgggcattgaactgcttgaggctgatacatttgatcttcattgcttccaatccctcacagggacaaagttctttgttgtctgtgaacccggaacaccacacatggagagtctgttgaaagtcatctatgaattgtatacggattatgtcttgaagaatcccttttatgagatggagatgcctataagatgcgagctatttgacatccacctgacacaggcaatacacgaaggactcgtgttgccttgctggggcgataaatttactgactctgaatattgttgctgaatgttagtcttgtggcctgagaaatgtaactttaatttgtgcatttcaattgaagaatttggatactcgactctttgcgaggtttcctttttattatgttttgatgcatgaagattatgggtgaattgaagggcattggatggaaattattcagcaaagcttgattactcttttaggtg

SEQ ID NO: 2412 - DNA, 495 bp, Utricularia gibba
ctcaggcggcgatctacagtctctacatcatcaataaatcggggggactcatattctacaaggattacgggtcggctgggaggatggatacgaatgacagtctgagactggcgagcttgtggcactcgatgcacgcgatctctcagcagctctcccctgtttctgggtgctccggaatcgagcttcttcaggctgatacttttgacctccattgtttccagtctcttaccggtacgaagttcttgtggtatgcgagcccggtagccttcacatggagagcctgttgaagcagatatacgagctgtacacggactacgttctgaagaatcctttctacgagatggagatgcccatccgctgcgagctgtttgatgtaaacttggcacaggctgtccaaaaggatcgtgttgctttgttaggaagatgagaacaagcatgtaccataggaatgagcacttctccagattctcaaaagttaaaaaccttggagtttat

SEQ ID NO: 2413 - DNA, 894 bp, Ricinus communis
attatttcttctccccagtgaaagaaagaagcgggagggtaggtacgttgtgcatcgatctggttaggttttggcgttcaaattgatctcgtcgtttgggattttccgatggcagcaatttacagtctttacataatcaacaaatcaggtggtttgattttctacaaggattacggatctggtggaaggatggatacaaatgacagcttaagagtagctagtttatggcattcgatgcatgccatttctcagcagctatcaccggttgttggttgttctgggattgaactccttcaagctgatacttttgacctccattgtttccagtctcttaccgggacaaagttcttcgtggtttgtgaacctggaacgcctcacatggaggctctgttgaaagtcatttatgaactgtatacagattatgttttaaagaaccccttctacgaaatggagatgcctatacgatgtgaactctttgacatcaacgttacacagatcatacagaaggatcgtgttgctttgttgggtcgatgaacgacatgctgtttttcttcttcttattttctctattttttttttttagtttcatctgggaattttctgagggatctttcgtcttgtggaacattgttttgttatatttactggtatagcaggcctgtgattgttaatggctgtgtgcttctactgggtttatctttgctgtcatgattgatctggaaacgctggaatacgtttgtttcagcttggttcctgctgagtctctggttaccatctttgagttttagggttgggatatccatgagtgccttaggtcaacgaagaggaaaaaaaatgcagttggacagctttttatcgactttagtttgtgcaataatacgaatgtcattgccg

SEQ ID NO: 2414 - DNA, 776 bp, Petroselinum crispum
tgtagccagcagaggtacaattcaataaagtttcagtgccaaaataagcaattaagccccttgttctggctattccccctgggcgattcttcttcagttctacctcactttttagtttcgaaatgcctgcgatttacagtctttacattatcaataaatccggtggtctcatctactacaaggattatggctctgcgggacgtatggatacaaatgacagcttgagattagctagtctgtggcactccatgcatgcaatttctcagcagttgtcaccagttgcaggatgcacagggattgaacttctcgaggcggatacttttgatcttcattgttttcagtctcttactgggacgaagttctttgttgttgctgagcctggaatgcaaaatatggagagtctgttaaagtatatctatgaactatacacagactatgttctcaaaaatcctttttatgaaatggagatgcctattaggtgtgagctttttgatattaatttgtcacaggcagttcagaaggaccgtgttgcgttgcttggacgatgaacacattaccctcttccctgaaaacactagtttgacttcgtaggtgcatgattattgtattatgtatatttctctggggacaacattgtcttgtttgtccgcatctccatatcactcgctttggaccttcccgaatgctagatgctgcaataatttttcaatttaagagtttaatgaggaatatacctgagttattttgactagtagtctagagagattgaatttatc

SEQ ID NO: 2415 - DNA, 2931 bp, Ricinus communis
tcctccaagatagcagagatcaccagaagaggtcaaaacagtgtcatgaaaagcagacctttctaacacacgaaccatatgaggctccaccatgtgcttccctcccaatattttcaatattgtagtttttcctagcgccattggatccaacaagaaggcatcggtcacctgagttgagagtgagattgaaatcatcaatcaaaggcttcgacccaggcggcggatgtccgtcgattcctggatacgtgaatttcagacctttggtctctattgttgcctgtttacactccacaactgccatctcttttttttttctttttcaacagagaaaagcagagaagctttgaatttgtattgcttcctcacctacacacctgcttcaatttaactataataaaaaaagtgaatgctcctacgtggcaagttcaaagaccgcattaagcaaatgttgcaacacgtggcataatggttgccgtcaactatgagagacatatatcctacagtacacagggtgaaggtgaattcgagtgcagaggattatttcttctccccagtgaaagaaagaagcgggagggtaggtacgttgtgcatcgatctggttaggttttggcgttcaaattgatctcgtcgtttgggattttccgatggcagcaatttacagtctttacataatcaacaaatcaggtggtttgattttctacaaggattacggatctggtggaaggatggatacaaatgacagcttaagagtagctagtttatggcattcgatgcatgccatttctcagcagctatcaccggttgttggttgttctgggattgaactccttcaagctgatacttttgacctccattgtttccagtctcttaccgggacaaagttcttcgtggtttgtgaacctggaacgcctcacatggaggctctgttgaaagtcatttatgaactgtatacagattatgttttaaagaaccccttctacgaaatggagatgcctatacgatgtgaactctttgacatcaacgttacacagatcatacagaaggatcgtgttgctttgttgggtcgatgaacgacatgctgtttttcttcttcttattttctctattttttttttttagtttcatctgggaattttctgagggatctttcgtcttgtggaacattgttttgttatatttactggtatagcaggcctgtgattgttaatggctgtgtgcttctactgggtttatctttgctgtcatgattgatctggaaacgctggaatacgtttgtttcagcttggttcctgctgagtctctggttaccatctttgagttttagggttgggatatccatgagtgccttaggtcaacgaagaggaaaaaaaatgcagttggacagctttttatcgactttagtttgtgcaataatacgaatgtcattgccgaatgtttcattgctcacttgaacatttgactgtgtcagttagctcaaattaagttgcagcattgctgaactatcaaccatttggtcctatcaggaaaaacaattttatacttgagagcctggcttcaccagtctctgcttggaaggacattgtgtacacaataaaatccgaaagccacagatgatcattggaaaaggttaaatgtaagatattgaaatgagttttaaaaaataaatgcaacttcctaggaaaataaaaattattaactgaagcatcaaaagaactttcagtttccaaatattgaaagaaagtaatagcacggtaacacttcatgcggcaaaggaggggagccgtacatccaatctctgctagcattattacatcaattctacaagaaaagaaaaagaataaagaaagagagaaaatatactcaattatacactcgcgtgaaaacccttggcatttctgtggctgtttacaattacagaatattgcagcaacatccagataaaaatatgtgctgtcattctgacagcaaccagaaaaaacatccaaaacgaaggcttaaatacaacatggaaactgcaaaccaaaaactgtacacaaataaacacatgattttgtagcacatatcacgcgcaaactcctaaaatgcttccacatccccattccaggactccattatattcatgttaaaaaatcttactcctgcctatgcaaaaagtggggatcgagatggccggggataagaggttcgtccatcattggtgtccccatgagcccttgtattgctctcttttttgttagattcttgaagctgctctaatgcctggaccacttcatccatgcttggcctgaattttggttctacatctaagcattgaactgtaaggctggccaccttctgagctcgactaagagagtattggccttcaatacgcgtatccagaacatggagaactctgcgtttgtttgtaaggtaaggttttgcccactccactagattgtgttgcccagttggccgattcttgtctatagctcgtcggccagataacatttctagaagtacaactccaaagctgtatacatcgctcttcgcagtcaaatgaccttttcaatatcaaaacacaattaattataagaacaaaatgaaaaacaacattaattaccagagcaaattgaacatatattagttatcacgatgattatgtaatctagaagtacaactcccatgggttgcatttcaatatgttaaacatttcaaatattccatggcatggggaggattattaacagaaaacataatgtttgaattgccttctttttgcatagatttcaatgaaagtccttaaagtttggcagttctcattcacaattatctctattaatggaacctttcactcactctctcaccctcgcttgcttgaacatgcacatgcccccacatgcacacagtgtcacaaggattagggatctttacaacacttctgatggccaaata

SEQ ID NO: 2416 - DNA, 764 bp, Gossypium hirsutum
gttttagggtttttgtaatttgtattttcctttgtacaatggctgcgatttacagtctctatataatcaataaatcggggggtttaatcttctataaggattatggatcaaagggacgcatggatacgaatgatagcttgagagtagctagtttatggcattcgatgcacgcgatctcacagcaactatcgcctatcaatggttgttcgggaattgagctacttgaagctgatacatttgatctccattgttttcaatcccttactgggacgaagttctttgtggtctgcgaaactggaacacagcacatggaggctctcttgaaagtcatctatgagctctacacggattatgtcttgaagaaccccttctatgagatggagatgcctatacgttgtgaactctttgacatcaacctgacacaggcaatacaaaaggatcgtgttgcgctgttgggacgatgaaactgtccttaaactggtaccaaatcaaattcccacctcttatatttgtacattttcgatgcccgactgctttctagtttgaatcagctatgttaatgttatgtctattagacccctgttctcaattcatgaatgctgtgtgatttacagcattgtacaacttagaaaatgtctcgtgctttgatcaaagtgataggaaaatgcatcatcataacattatagtttaagtctccatctttgttgcatgaaaagcaatcttcaataggagagcaatccttcacctatggatcttgattaaaa

SEQ ID NO: 2417 - DNA, 872 bp, Gossypium raimondii
tcccagatcaaaaacagaaaatagctactatttaatttccaattaacaagttttagggttttgaatttgattttccttttacaatggctgcgatttacagtctctatataatcaataaatcggggggtttaatcttctataaggattatggatcaaagggacgcatggatacgaatgatagcttgagagtagctagtttatggcattcgatgcacgcgatctcacagcaactatcgcctatcaatggttgttcgggaattgagctacttgaagctgatacatttgatctccattgttttcaatcccttactgggacgaagttctttgtggtctgcgaaactggaacacagcacatggaggctctcttgaaagtcatctatgagctctacacggattatgtcttgaagaaccccttctatgagatggagatgcctatacgttgtgaactctttgacatcaacctgacacaggcaatacaaaaggatcgtgttgcgctgttgggacgatgaaactgtccttgaactggtaccaaatcaaattcccacctcctatatttgtacattttcgatgcccgtctgctttctagtttgaatcagcaatgttaatgttatgtctattagacccctgctctcaattcatgaatgctgtgtgatttacagcattgttcaactttgaaaatgtctcgtgttttgatcaaagtggtaggaaaatgcatcatcataacattatagtttaagcctccatctttgttgcatgaaaagcaatcttcaataggaaagcaacccttcacctatagttcttgattaaggacttcatctttttagaaatattaatgccctctcttattgcaatataatgtacttcaagttgtg

SEQ ID NO: 2418 - DNA, 728 bp, Glycyrrhiza uralensis
gaccgtgcgttgagttttcttctgctttacggtgctattggccgccgccgccgccgccgctagagtcgccgtcgacgtatcgatccccgtgtcctcccactgagtcgctcttcctttctatctttaaatcgtggcctgtgacccgaaattgaacgttggcatcaccactgttcgcagattcacgagctcatcagttcgcagaatcccaagcattttgggtcgccattgttcgcagaaatcgcaagcttcctttgaacatcttcagattctcgcaaaggcttttggaatggccgcgatttacagtctttacatcatcaataagtctggtggattgatctactataaggattatgggtctgccggacgaatggataccaatgatagcttacgggtggctagcttatggcattcaatgcatgccatctctcagcagttgtcacctgtttcaggctgttcaggaattgaactactccaagctgacacatttgatcttcattgcttccaatcactgacagggacaaagttttttgtggtctgtgagcctggaactcaacaaatggaaagtctattgaaattcatatatgaattgtacacggattatgttctgaagaaccctttctatgagatggagatgcctatacgatgtgagctctttgatatcaacctaactcaagcagtacaaaaggatcgtgttgcattgttgggccgataaatcgctatcgatctgg

SEQ ID NO: 2419 - DNA, 752 bp, Mimulus guttatus
aatcagtgtaaacttaagggaccaaaacagtaatttcccgaaacaaaaatgaagcttgagatctgaagagaagaggttgttttcaacaatcaacaatcaacaatcaatttgtgttcacattcttctcaaaaatcttcgctgaaatcaccacctcactcaacaatggcagcgatttacagcctctacataatcaacaaatcaggtggcctcatttactacaaggattatggttcggcgggaagaatggatacgaacgatacgttgagattagcgagcctctggcactcgatgcacgccatctctcagcagctttcccccgtcaatggctgctctggaattgagctccttcaggctgatcatttcgatcttcactgtttccaatctctcactggcacgaaattctttgtggtgtcggagcctggaagcgttcacatggagagtctgttgaaaaatatatacgagctgtacaccgattatgttttaaagaaccctttctacgagatggagatgcctatccgttgcgagcttttcgacattaatttggcacaaaccgtgcaaaaggaccgcgttgccttattgggaagataacttttgccgtattactttgtttttaaaacctttgttccaaattggtgtttttgttatacacaagtatggttctctagtataccgaattactgattttcattatgacagactgattatattgaatgccaaatattcacttcttagtttaactttattttttgaaa

SEQ ID NO: 2420 - DNA, 908 bp, Nicotiana benthamiana
gtacaaaaatatttttgcttccttcttttgggacttctcccttatcaacccgattcatcgctgatcgggaggagctctcacatcgatcaccgaagccatcttttcagatcaactcgccacgagagggcaacaaagaaaggggtttaatccaaaatggcagctatttacagcctttacatcatcaataaatcaggagggcttattttctacaaggattatggttctgctggaagaatggacacaaatgatagtttgaggttggctagtctttggcattctatgcacgctatctctcagcagttgtccccagttaatggctgcgccggtattgaactccttcaagctgataactttgacctccattgcttccaatctcttactggaacaaaattttttgtggtttgtgaacctggaagtctgcatatggaatctctgttgaagtatgtctacgaattatacactgattacgtcttgaagaatcctttctatgaaatggaaatgccaatacggtgtgagctcttcgacattaatttgtcacaggcagttcagaaagatcgtgttgccttactggggagatgagcttctcaagcacatgctgcaaattgttggttagactaaaatctggtaaattctgctggataggttgcactaggacatatgcaatgtgtgtttctttgttgttttgggataatggccttgtaagatacattttgaaagcagcaatcccaagtaggatttgttatgcaaggttgatgctctttagcgtcgtttacacgctctgcttgatctctcatagaaatggtaatgggacagatatggcaagcagcaggtgttgccttacatgggcaagaagacactgaacatgttaacattaaacgactaccaagaaggcattgagcatattaata

SEQ ID NO: 2421 - DNA, 1190 bp, Elaeis guineensis
gtctggagactttcctctctgtctctcaatattttcggatcaagaaaaaaaatatatatataccatcaaattctcttgaaaagaagacgaaatttcgatctcgtcttcgcaatggcggcaatctacagcctctttatcataaacaaatccggcgggctcatattctacaaggattatggatcggcggggcggatggacacgaatgatagcttgaggttggcgagtttgtggcactcgatgcatgcgatctcgcagcagctgtcgcccaccgtgggatgcaacgggatcgagcttctccaggctgacaccttctacctccactgcttccaatctctcactggtacaaaattttttgttgtttgtgagcctggcatacaacacatggaaggtttgctgaaagtcatctatgaattatacacggattatgttttgaagaaccctttctatgaaatggagatgccaatccgctgcgaactttttaatctgaacctttctcaagcaatccagaaagaccgtgtttcactgttcgggcgatgaaaaaagaatgtctgactatatcgtttagatattagtttcccccacttttttcaattgaatttgtgaatgtggacagttgtattgtcagtccatcttgaatgaatctaagcatttcttgtttggcaagaaaggtgcattcaaatttttgaaatgttcaaggtctggattgagatatttttattcccattatatccagcttatacttttgaactggggcatatgtcccttcatatgcttctttccgcataaaatatgtacacatgtgcctgagcaaatctacaagagcacttggacctttatgatttgtttccacctgtcattcaaaaaggaagcttcaacagtgtaatcacaaaagttccaacaataagtttaccatttatgatataatacaacataagtagagctttacttataatataagtaaccacttgaaagctcatttggcctgagtatcacccattgagttgttttccaaggtctttcagcaaaaattgcagagtagaacctatatttgttgtcatgcaggtgtacgggcatgccttgagcaagtttgataaatcattgtgtgaggttagataaagttggtcccatcaaggatttaacccttctgccatcaggctgtgccacaaattttacgatttgtgaagaagcaa

SEQ ID NO: 2422 - DNA, 823 bp, Arachis hypogaea
acattcagaatctgaatttcagatctcacttcacttgtttgagaaacaaaaacacaacattgaattacaccctaacatttgctacgatcggaacaaagaacgagtagccatccgccgccaccgatctgcgccgcttgcaccatggtcaccgcactgagttaggagagacacttcactctcactagggttcagtcagtgggtttcgcaatctcattccgccaaactattttgttttttcttttcctttggaaatggcagcagcaatttacagtctttatatcatcaacaagtccggcgggttgatctactataaggattatgggtctgccggacgaatggataccaatgacagtttgagggtggcaagtttatggcattcaatgcatgcaatctctcagcaattgtcacctgtttcgggttgttcaggaattgaacttctccaagcagacacatttgatcttcattgctatcaatcactgacagggacgaagttttttgtggtctgtgagcctggaactcaacacatggaaagtttattgaaatatatctatgaattgtacactgattatgttttgaagaatcctttctatgagatggagatgcccattcgctgcgaactctttgacatcaacctaacacaggcagtgcaaaaggaccgtgttgcatttttggggcgctgagtttgatttgatttgatcctattttcttgtccttttatattctgatgtgtacataatctaacaagtttcaaactttcaattcaattgcttgaggtacttcattcttctacaatgactagcatctgtatttggttgttttcagc

SEQ ID NO: 2423 - DNA, 964 bp, Populus trichocarpa
cagaaactccggtggaatggagcgtgagtgaagtaaggaattatgaggaataatcgttgaaaattaatcaacaaaaataataatagtaaataaatgtaaggattgagtagtgaataatacggcagcgtttgaaggagtggtatgcggcccgaaagaaagaagcgaagggagagaagggaattgaaatcacgcagaattaagtggcagtcttcccccttctcagagccaaaccatcagcgaacaaaccctcactgaaaatcaaatttcactttgatccgaagaagaagaaattctctctcactctcagatctgattactcagaaaggcttgtgtgaatccgaaaaagcccttgggaatggcagcaatttacagcctttacatcatcaacaaatcaggtggtttgatcttctacaaggattatggatcttctggacggatggatacaaatgatagcttacgagtagctagtttatggcattcaatgcatgccatctctcagcagctatcaccaactgttggctgtttaggcattgaactcctcgaagctgatacctttgatcttcattgcttccaatcactcactggaacaaagttctttgtggtgtgtgaacctggaacacagcacatggaaggcctcttgaaagtcatatatgaattgtacacggattatgtcctaaagaacccgttttatgagatggagatgcctatacgatgcgagctctttgacatcaacctgtctcaggcaatacagaaggatcgtgttgctttattggggcgatgaactttcctgaattttgcttcaataacttttgttatttttcattttcatttgtgcatttgccatgagatctttcaattttcttttatgctcttcttctccttagtggctgtttgtggttgcgttcaacttgcttttcatgaaaattttatttttttttaaattttttttttagtgtttttggat

SEQ ID NO: 2424 - DNA, 872 bp, Nicotiana tabacum
gtacaaaaatatttttgcttccttcttttgggacttctcccttttcaacccgattcatcgctgatcaggaggagctctcacatcgatcaccgaagccatcttttcagatcaactcgccacgagaggccaagaaagaaaggggtttaatctaaatggcagctatttacagcctttacatcatcaataaatctggagggcttattttctacacggattatggttctgctggcagaatggacacaaatgatagtttgagattggctagtctttggcattctatgcacgctatctctcagcagttgtccccagttaatggttgcgccggtatcgaactccttcaagctgataactttgacctccattgcttccaatctcttaccggaacaaaattttttgtggtttgcgaacctggaagtctgcatatggaatctctgttgaagtatatctacgaattatacactgattacgtcttgaagaatcctttctatgaaatggaaatgccaatacggtgtgagctcttcgacataaatttgtcacaggcagttcagaaagatcgtgttgccttactcgggagatgagcttctcaagctcatatgccgcaaactgttggttgccctataatccgccaaattctgctggaccggttccacttggaacatggaatgtgtgtttctttgttgtttcgggataatggccttgtaatatacattttgagaacagcaagcccatataggatttgttatgcaaggttgtcatggctgatgccctttagtgtcgtttacacgccctgcctgatctctcatagaaatggtaatcggacagatctggcacccagcacgtgttgccttaaaaagcaccacgaccttgaacat

SEQ ID NO: 2425 - DNA, 508 bp, Utricularia gibba
cggcgatctacagtctctacatcatcaataaatcggggggacttatattctacaaggattacgggtcggctggaaggatggatacgaatgacagtctgagactggcgagcttgtggcactcgatgcacgcgatctctcagcagctctcccctgtttctgggtgctccggaatcgaacttcttcaggctgatacttttgacctccattgtttccagtctctcacgggtacgaagttctttgtggtgtgcgagcccggtagccttcacatggagagcctgttgaagcagatatacgagctgtacacggactacgttctgaagaaccctttctacgagatggagatgcccatccgctgtgagctgtttgatgtaaacttggcacaggctgtccaaaaggatcgcgttgctttgttaggaaggtgagaacaagcatgtaccatgcgaatgaacactgctccagattctcaaaaagttaaaaaccttggagtttattgcacaaacaacgaaag

SEQ ID NO: 2426 - DNA, 560 bp, Amaranthus tuberculatus
catcaatttctgctttgggtgttttcaaataaacaatttcgtaaattagggttcatcttttaagttaattgaatcggaaaatggcagcaatttatagcctttacatcatcaacaaatctggaggtctaattttctacaaggattatggatctgctggtagaatggacacaaacgatacattgagattagcaagtttatggcattctatgcacgccatttctcagcagctttctcctatttctggatgttctgggatcgaacttcttgaagctgataattttgatcttcattgctttcagtctctcactggaaccaagtttttcgtggtatgtgaacctggaacacatcatatggagcatctttaaaatatatttacgagttgtacacagattatgtattgaaaaatcctttctatgaaatggagatgcctattcgctgtgagctcttcgacattaaccttgcgcaagctgtgcaaaaggatcgtgttgctttgttgggtcgataatctatcaaacgccatggttgaaccttaatttcttcttgtttttgaattttcatta

SEQ ID NO: 2427 - DNA, 676 bp, Amaranthus tuberculatus
ttagggttcatcttactagttaattgagtctgaaaatggcggcaatttatagcctttacatcatcaacaaatctggaggtctcattttctacaaggattatggatcggctgggagaatggacacaaatgatacattgagattagcaagtttatggcattctatgcacgccatttctcaacaactttctcctatttctggatgttctgggatcgaacttcttgaagccgataattttgatcttcattgctttcagtctctcactggaaccaagttttttgtggtatgtgagcctggaacgcaacatatggagcatcttttgaaatatatttatgagttgtactcagattatgtattgaaaaatcctttctacgaaatggagatgcctattcgctgtgagctcttcgacattaaccttgcgcaagcagttcagaaggatcgtgttgctttgttgggtcgatgatttatcaaacgcaatggttggccttactttcttaaacttccattatctgaaatttaattgcagtgctgaatgctgaaaaaatacatgtgaaattatacagtgttttaaaatttcacaatgatattatagttcttcacatggtttcttcatttaattttgtgaagagttcatcagcttgtggggggctgtggcaagcaacgcctaagttgtagaag

SEQ ID NO: 2428 - DNA, 730 bp, Acacia harpophylla
tctcctaaaatccgattctggaaagggattttagaatggctgcaatctacagcctttacatcatcaataagtctggtggattgatctattacaaggattatggttctgctggaagaatggataccaatgacagtttaagagtggcaagtttatggcattcaatgcatgccatctctcaacaattatcaccagtttcaggttgttcagggattgaacttctgcaagctgatacattcgatcttcattgcttccagtcacttactgggacaaaattttttgtggtctgtgagcctggaacccaacacatggaaagtttactgaaattcatatatgagctttacactgattatgtcctgaagaacccattctatgaggtggagatgcctatacgttgtgagctcttcgatatcaacttatcacaggcagtacagaaggatcgggttgcattgttgggacgataaactgccttccctgttctgagaattgtcatttaacagcttgtacaacgggctgtcctgttctatttgaagattaggtggttgcattttatcagacaaattcccaggagagttcgtattctgtgacttcgcttattttctggagttaaagatatgcaagttgcccacattctatagagaatatattgcagttgatttgactgatttctgatggcggtatttaaactaagaatgttagatcaactttgtctataggctgtgctctgttgcat

SEQ ID NO: 2429 - DNA, 710 bp, Aquilegia formosa
tcattcaaaatacatatatgactgctgcgatttacagtctttttatcatcaataaatctggtggtcttattttctacaaggattatggatcagctggacgaatggatacgaatgacagtttgagattggcgagtttatggcattcgatgcacgcaatctctcaacagttatctcccattgtggcttgttctggaattgaattacttcaagctgacacattcgatctccattgcttccaatcactgacaggtactaagttctttgtggtctgtgagcctggcgcacaacatatggaaagtcttctgaaattgatctatgaactatatacagattatgtcttgaaaaatcctttttatgagatggagatgccaatccggtgcgaactctttgatctgaatctttcacaggctacccaaaagaatcatgttgcattgctggggagatgagaactccctggacttgtacatgcagaagctgcccattaaactccatatcatatgcacctcgcaagacatgcaggatttgtgtctagctcaaatgcagccacagttttatcacgtgccttgaatcttgatgatgtttttattttttttatgcatatcagagaatgccacaattatgttttttaccaggatacacagttagcaattttagggttgaggattttgatttttctatggttatgtactggtatcatttaatctaccaag

SEQ ID NO: 2430 - DNA, 782 bp, Ocimum basilicum
agacgtgtgctcttccgtctggcttctgctaaaagtccagcaaatccactgaataatttaccggcgaggctcaccggcgattaggaggttcacgcggcggcgttgctgcgaatttctgtgctgcgctaccgccgtcgtacgcaaattgagctcataaacatcagatcggagaaactgatacaaatccatggcggcgatttacagtctctacatcatcaataaatcgggcggtctcattttctacaaggactatggctcagcggggagaatggatacgaatgacagtttgaggttagcgagtctgtggcactcgatgcacgcgatctcgcaacagctctctccgatttctggctgctctggaatcgagcttcttcaggctgatacttttgatctcaactgttttcaatctctcactggtactaaattctttgtggtttgtgagcctggaactctgcacatggagaatcttttgaagcatatatacgagctatacacggattacgtcttgaagaaccctttctatgagatggagatgccaatcagatgtgagttgtttgacataaatttggcacaggcggtacagaaggatcgagtcgctatgttgggaagatgagttacgagataacctgataccggtgcgataaacctatctcgtccttgtttcttagtaagttttcgagcttggttggtgctctatttagaaacaatgatagaaggattctgtgaacttggatttctgttaacaatgatgccatgaccgagattgattgtttgataactca

SEQ ID NO: 2431 - DNA, 1081 bp, Vigna unguiculata
gacagagaaacggcgtcgtgtcgtgtggttcgggggcgtattgacgaggcaaacggagtcgccggcagaggatttggtagaacgaacgaaagaaaaaggtttcgtttttcactcattcttcttcccaaatcgaaatctaacaactttttcactccaatctttcgaatcccttttgaagttccttcgctgatccctctctctgctcgcgctaacctcgtactctctctctcagattctggaaaagttttcggaatggcagcaatttacagtctttacatcatcaataagtctggtggactgatctattacaaggattatgggtctgctggacgaatggataccaatgacagcttgcgagtggcaagtttatggcactcaatgcatgctatctctcagcagttatcacctgtattaggctgtttaggaattgaacttctccaagcagatacgtttgatcttcattgctttcagtcgctgacagggactaagttttttgtggtgtgtgagcctggagctcaacacatggaaaatttactgaaatttgtctatgaattgtacacggactacgttttgaagaatccgttctatgagatggagatgcctatacgttgtgagctctttgatatcaacctaacacaggcagttcaaaaggatcgtgttgcatttttgggccgataaatttatatcttaccgttttcacatttttatattttgattgagtacataatctaaatattctcattcaattgcttgtaacgtatcgtattactgctagcctttgttgcttttcaggcacaaagcaacaactatgatgtctgagataagataagttttctgacatccgagattcatcattttcgagcattgctttagtatgggtagttgttggaaattgcctttgcctacacattattaccttggctgtggtttcaggtttgtaatgtgtgtggaatttattttcccttggcgttgggttcttacgtcgttggttattgctgtaatgggtcaatagtcagttgcaatgttgcatattcctcagctggttacaaaatttcaatcagtttactgttctcaatgatcc

SEQ ID NO: 2432 - DNA, 854 bp, Cucumis sativus
ccagtctcaagctccccgaaactccgccttaagatcggcgttcactgaactggattttgcgccttccaatctacgttcttacccacacttaatccctatccacacccatatttatttttattctcatttccttcataattcttcaaattttggatagatctaaagacgatggcagcgatttacagcctctacatcatcaataaatctggtggtttgatcttctacaaggattatgggtctgctggacgaatggatacgaatgacagtttgagagtggcgagtttgtggcattctatgcatgccatttcccagcagctttcgcctatagctggttgttcgggtgttgaacttcttgaagctgacactttcgatctccattgcttccagtcactcactgggacaaagttttttgttgtgtgtgaacctgggactcagcacatggagagtcttctgaagtacatttatgaactatacacagattttgtattgaagaatccattctacgagatggagatgcctatacggtgcgagctctttgacatcaacctagcgcaggcagtgcaaaaagatcgtgttgctttgcttggccgatgagcttaggatatccttcattttgtcagtattaaattcaagaaagaaaggctcatgatatcattgtgcagaatacttgataatttaccatccttaatgctaaatgtactccgttcctagtgattcatgtgagatttggtggaaatagaatgtttcttttcagtgttgttcatcaggaagtcggggttagttttatgcccattttttgtcatgtatacagatgtggatccagttaaatgacagagcaatgttataagcttttg

SEQ ID NO: 2433 - DNA, 883 bp, Taraxacum officinale
taatctttgagactttgaacgaggtttgaactttggggtagccttcgcttacgcatcaacaaaactcggccatcgcacactacgtaccaccgtcacaacagccacaggcaccagtcaccaaggcaccaacccgccaacccgacccgtcaacccgagcacgacccaattatcagccccgactctcctacgaaacaagcatctgcccgttctcagtgcttgtctctgaaatctgaactccgagcctggatctgtagaattttgatccaatctgctaacaacaaataatggctgcaatttacagtctttacatcatcaacaaatcagggggtctcatcttttacaaggattatgggttagcgggcagaatggatacgaacgatagcttgcgattggcaagtttgtggcattcgatgcacgctatctctcagcaattgtccccaatttccggatgctcgggtatcgaactcctcgaagccgacacatttgatcttcactgctttcagtctctcacagggacaaagtttttcgtggtatcagagcctggaacacagaacatggagaatttattgaaacatatttacgaattatacacagattatgtgttgaagaatccgttttatgaaatggagatgccaattcggtgtgagctttttgatatcaatttggcacaagcaatacaaaaggaccgtgttgcttatctcggccgataagaggaatattatgaaaccaaactcgttttttttttaattccggtttctgttttaatttcgggtttatttgaatttaaatgagaatatatggtatgtgatattattgatttccaaatgtattcgacaatatagtaagtaaccaacagaagcttttcacttcaaaaaaaaaaaaa

SEQ ID NO: 2434 - DNA, 839 bp, Eucalyptus grandis
cgctcggtctctaccacggtaagagcagagcgaaagaagaaaggaagaaagcgaagccgaatcggagaaccccctcgcctcgctccgaagctcgcggcgagatcctccgaccgccgccgtcaccgtcctccgatggccgccgtgtacagcctcttcatcatcaacaaatccggcggcttgatcttctacaaggattacggatcttcggggaggatggacacgaacgacagcctgagggtggcgagcctgtggcactcgatgcacgccatctcccagcagctgtccccgactgtcggctgctccgggatcgagctcctcgaggccgacacgttcgatctccactgcttccagtccctcactgggacaaaattttttgtggtctgtgagcccgggactcagcatatggaggctctgttaaaagtcatctatgagctgtacacagactatgttttgaagaatcccttttatgagatggagatgccaattcggtgtgagctctttgatctcaacctgtcacaggcagtgcagaaagatcgtgtggcattgctgggaagatagtgtgcttaattttttcctttcttgactgaaaggtagcgagcttagttcataactgatctcattcgccttgaatgaaatttttccgaagcattgtggttagcttgatgagaagcatgcgttctgctcagcaagaaatctttctaactgattacctcggcgagtatgagtaatgattttcctttgttgagagactcgagacaaggccaagtgtgagccattgtaaattgttggcttctttgaaaagcttacattttttttaattgaagtttttgtccctgtga

SEQ ID NO: 2435 - DNA, 768 bp, Heritiera littoralis
gggtcaaatgattttggaaactaaaaaacaacttcgcagttcccaaatcgaaaccgaaagcaaagcagttatttccaacttccaattccaagcaacaagtgttagggttttgaattagattcacttgacgatggctgcgatttacagtctttacataatcaataaatcgggaggtttgatcttctataaggattatggatcaaagggacgcatggatacgaatgatagcttgagagtggctagtttatggcattcaatgcacgcgatctcgcagcagctatcgcctaccactggttgttcgggaattgagctacttgaagctgatacttttgatctccattgttttcaatcccttactgggacgaagttctttgtggtctgcgaacctgggacacagaacatggaggctctcttgaaaatcatctatcagctctacacagattatgtattgaagaaccccttctacgagatggagatgcccatacggtgcgaactttttgacatcaacctgacgcaggcaatacagaaggatcgtgttgcgctgttgggtcgatgaactgtcttggaaccttctcttatcttcaattgtacaatttcaatagaagattactctcaagtttgtatcagctttgttttgatagcgttaggcaagggacttgaattgcaaaatttcagtttatatctccattctgcacctcggaatgaaacgaggataggtgtttgagttccataccagcacattggctcacatcaatcagtgaatcaact

SEQ ID NO: 2436 - DNA, 853 bp, Lupinus angustifolius
agatttcagctagagagggcagtagtcattaccgtaaaacaaggcatagtgagtgacttcatcacattcagatcttgcttcacttttttatctgttcttaatcgccattcgcaaattgaattcaacaattttatatttctcagtttctgattccattattcattttctagcataacttttggaatggcagcaatttacagtctttacatcatcaataagtcaggtggattgatctactataaggattatgggtcttctggacgaatggataccaatgacagcttgcgtgtggcaagtttatggcattcaatgcatgccatctctcagcagttatcacccgtttcaggttgtacaggaattgaacttctccaagcggacacattcgatcttcattgctttcaatcgctgacagggaccaagttttttgtggtctgtgaacctggaacacaacacatggaaagtttattgaagtttagctatgaattgtacaccgactatgttttgaagaatccgttctatgagatggagatgcctatacgttgtgagctcttcgatatcaacctagcacaggcagtgcagaaggatcgtgttgcatttttaggccgataaatttatctgaccaaatttcgcatttcatttcaacattatgatgtgtacataatctaaaatttgtcacccaattgcttgtaaggtaatattctcttttactatgcctagcctcagtatttgctttttatgaacaaattttccaatgtttgagaaatgacaaagttcttcagaattctgctgtctaagattcaaaatttcctagttatgcttttcctatagttctagtcagaaatagcctgtgcct

SEQ ID NO: 2437 - DNA, 952 bp, Medicago truncatula
atgtcgggagactcgctgactagatccaaatttaattttaattggataaaaaactatcatttctcacgctggttcgtggcggagacctttatcccagagaaatcaacaccgtcaccgatctccactgtggcggcgagcacgaccagcgcacaatcaagtccattcagcagcgccgctttcgcccactccttgagattcttgcaaaggcttttggtaatggcagcggtttacagtctttacatcatcaataagtctggtggattgatctactataaggattatgggtcttctggacgaatggacaccaatgatagcttacgggtggctagcttatggcattcaatgcatgccatctctcagcagttgtcacctgtttctggttgcacaggaattgaattactccaagctgacacatttgatcttcattgcttccagtcactgacagggacgaagtttttcgtggtctgtgaacctggaactcaacaaatggaaagtttactgaaattcgtatatgaattgtacacggattatgttttgaagaaccccttctatgagatggagatgcctatacgatgtgagctctttgatatcaacttagctcaggcagtgcagaaggaccgtgttgcattgctgggtcgataaactgccatggatctggcaagtgttgtttttaaaaaattgttatggtggtgctgctttcttataatgcttataatacaaaattttaggatgccaatatatgcttttcatcatttcctactattttttttttccgtacaaatgaggaatgatgtctatgtagatcactattatcttggccataactttctaatctgtacaaaattaaacatacatctagcaggtaacatgtaatttcgtacttggatatttaggtatccaaattgataaattgacttgaaggcgcttaatgaaaatataagcaacatttgga

SEQ ID NO: 2438 - DNA, 725 bp, Citrus sinensis
aataaagaaaaaattacaaagaccttttgactctcttcttcttgttcttcttgcttccaagttaatagattcagaaaaaaagcgttttccgatggcagcaatttatagcctttacatcatcaacaaatccggcggcttgattttctataaggattatggatctgctgggcgaatggatacgaatgacagcttgagagtggcgagtttatggcattcgatgcacgcgatctctcaacagttatcgccaaccacaggctgttctggcatcgaactccttgaagctgacacttttgatctccattgcttccaatctctcactgggacaaagttctttgtagtgtgtgaacctgggactcagcacatggaatctctattgaaagttatctatgaattgtacacggattatgtattgaagaatcccttttatgagatggagatgcctatacgatgtgaactatttgacatcaatctatcacaggcagtacagaaggatcgtgttgccatgttggggcgataaactcctctgaaacatacatcatactaaattgtatttgttatgctatcttgatttgtttctttgcattcgtgcagtagaagcttaattggttgtagtttgtgtacgaacatttgactgatctttgacaaaatctggtgtttggtcatcgatgcagaaatcatgtaagatgttagatatttttgtttttgtttccaccagatgatccatg

SEQ ID NO: 2439 - DNA, 1301 bp, Cajanus cajan
gggatagcatcacaagtcatccaccgttagatttattcattttcaagtgaagggttgacggttgacatcaccctctgtagttgctgcattctcggtggttcaagttgctgtttccaggcctcaatcgattctggaaaagtttttggaatggcagcaatttacagtctttacatcatcaacaagtctggtggattgatatattataaggattatgggtctgctggacgaatggataccaatgacagcttgcgtgtggcaagtttatggcattcaatgcatgctatctctcagcagttatcacctgtttcaggttgtttaggaattgaacttctccaagcagatacatttgatcttcattgctttcaatcgctgacaggcacaaaattttttgtggtctgtgagcctggagcacaacacatggaaaatttattgaaatttgtctatgaattgtacacggactatgttttgaagaatccgttctatgagatggagatgcctatacgctgtgagctctttgatatcaacctaacacaggcagtacaaaaggatcgtgttgcttttttgggccgatgaatttatatctgacatcacatttctattctgatcagcacataatctaacatttgtcattcgattacactacttgtaagggagagtctcttctactgctcctagcctttttgatttgctcttttgaacaaatcaagatttacaatgtcttagaaaaacaagttttccgacataagatttatcattttccaggaatgcttttcatatggtagtagttaaaaattgcctgtgtgctacatagattaccttggcgtatggtttgttttgcagatgtaatttatttttacatgatggtagaattactcgaggaatggactagtgttcttgcatgattggatttggtgtatcagctcaatagtcaggtgcaatgttgcatgttccttagctggttacatattccaatgagtttactgtcctcaacgatccaaatctggtgtagtacacataaacatcacctaaaatatgcttagttttcattctttgatagtaatcggttacacttcatgggcacactttttgattgtgtcatcactatttagtgtttattgaagtgagatgataaggtgttctgctccaagtatcatcaccaaatccgatatgcagtgatctatatgcataagtttactgggtttagttgctgagggaacaaatttagacatagactagatgttaaagttcgaaagtttggtcattttacaaataattaggtttaaggcttagtaattaactat

SEQ ID NO: 2440 - DNA, 911 bp, Solanum tuberosum
ctcttttctacaaaattgttttgctctctcttcgttttttttcccttcttcttccctacagactacccgattttgcatctgaattcagataaagaaagagaaggattcaatataaatggcagctatttacagcctttacatcatcaataaatcaggagggcttatcttctgcaaggattatggttctgctggaaaaatggacacaaatgatagtttgagattggctagtctgtggcattctatgcacgctatctctcagcaattgtccccggttaatggctgtgctggtatcgaactccttcaagctgatacgtttgatctccattgcttccaatctcttaccggaacaaaattctttgtggtctgtgagcctggagctctgcatatggagtccctcttgaagtatatctatgaattatacactgattacgtcttgaagaaccctttctatgaaatggaaatgccaattcggtgtgagctctttgacataaatttatcacaggcagttcagaaagatcgcgttgctttgttagggagatgagcttctcaagttcatatgccataagttgttgactgatctataatttggcaagtttcgttgacaggttcggttatgcatctggaatgtgatttttctttgttgtttcgagataatggcttgtaagacaaattttgagaaccaccccaaataacattttttgtgcacaatcaccaacttatcatggctccatatttctatggtaggcctagaggtgaatttcatcttacctgaatatcctagtatctctatagttggttctactgttgaaactcattagctggctgctgctgtggtacagtagtttaaactcaaaaggaaagaagattgaaagacaccatgagtatgtataatttccattttgtgctgttca

SEQ ID NO: 2441 - DNA, 902 bp, Silene vulgaris
attggtattccgattgccatctgaacgtacatttcacaattgatttctcctcccctcacagaaaccctagaaaatttagggtttcgaggagatcgattgagttactccattgatttactcatttcaaaggaatggcggcgatttattgtctgtacataatcaacaaatccggaggtctcatcttctacaaggattatggatcagctggtagaatggataccaatgatacattgagattagcgagtttatggcattcgatgcacgccatttcgcagcagttatccccggtttccggttgcaatggtattgaactccttgaagcagataattttgatctccattgcttccagtcccttactggaacaaagtttttcgtggtttgtgagcctggcacacagcatatggagaatcttctgaagtttatctatgagctctatactgattatgtgttgaagaaccctttttatgaaatggagatgcctatacggtgtgagcttttcgacatcaacctttcacaagcagtacagaaggatcgtgttgcattgctgggacgttgattaatagtattgctctatttccttcatctctgtagattactcgttgaaagttactctccttttcagtttccattacacttttgcaatgtgctgccatttttagttgggtcctatttctcattacctgtgagggaataatactttgtggtgagtctaccttgtgatgtgcaagcaattcaggaacaaccgacgtaggttccattgtttactgttcaaatatctttttgggtgtataccatccggtttagagccgggtaggaccataagggtggtaaatcccttccattgtaacatccctgcattcccgttttaacaccctttacctgttgtaaggttttcatcatt

SEQ ID NO: 2442 - DNA, 796 bp, Solanum phureja
ctcttttctacaaaattgttttgctctcttcgttttttccccttcttcttccctacagactacccgattttgcatctgaattcagatcaagaaagagaaggattcaatataaatggcagctatttacagcctttacatcatcaataaatcaggagggcttatcttctgcaaggattatggttctgctggaaaaatggacacaaatgatagtttgagattggctagtctgtggcattctatgcacgctatctctcagcagttgtccccagttaatggctgtgctggtatcgaactccttcaagctgatacatttgatctccattgcttccaatctcttactggaacaaaattctttgtggtctgtgagcctggagctctgcatatggagtccctcttgaagtatatctatgaattatacactgattacgtcttgaagaaccctttctatgaaatggaaatgccaattcggtgtgagctctttgacataaatttatcacaggcagttcagaaagatcgtgttgctttgttagggagatgagcttctcaagttcatatgccataagttgttgactgatctataatttggcaagtttcgttgacaggttcggttatgcatctggaatgtgatttttctttgttgtttcgagataatggcttgtaagataaattttgagaaccaccccaaataacattttttgtgcacaatcaccaacttgtcatggctccatatttctatggtaggcctagaggtgaatttcatcttacctgaatatcctattatctctatagttggttc

SEQ ID NO: 2443 - DNA, 640 bp, Vinca minor
gtttaagaataaaatttggttgaaatggcggcgatcaacagcttatacataataaacaaatcaggaggtttgatatattataaagattatggaacagctggaagaatggacacaaatgatagtctgagattagccagtctttggcattcgatgcacgccatctctcaacaactctctcctattcccaattgtactggaattgaacttctccaagctgacactttcgatctccattgcttccaatccctcacagggaccaagtttttcgttgtatgtgaacccggtacacagcatatggaggttctcctgaagcatacatatgagttatatactgattatgtcctgaagaaccctttttatgaaatggagatgccaattaggtgcgagctattcgacatcaacctggctcagtcagtgcagaaggatcgcgttgccttgttggctagatgagcgcctttttgccgcttatcctaccttggagcaagggagtacattttaactctggtttttatttaaggtaatcatgatgtaagatatacaggacgaacaatttgttcagacaaactacacatgtttaggaggccttggaaacaatggattccattgagtttacctaatttcaggttcttgtcttctttag

SEQ ID NO: 2444 - DNA, 597 bp, Bupleurum chinense
agtagttagtttcgtgggttaaggatcacaagtagatcacgaaatgcctgcaatttacagtctttacatcatcaataaatctggtggtctcatctactacaaggattatggctctgcggggcgtatggatacgaatgacagcttgagattagctagtttgtggcactctatgcatgcaatttctcagcagttatcgcctgtggcggggtgttcagggattgagctgcttgaggcagatactttcgatcttcattgtttccagtctcttactgggacaaagttttttgtagttgctgagcccgggacacaaaacatggaaagtttgctaaagcatatctacgaactatacacagactatgttctcaaaatcctttttatgaaatggagatgcctattaggtgtgagctttttgatatcaacctgtcacaggcagtacagaaagaccgtgttgcattgcttgggcgatgagcgttgaacacattatactacttccttgtaagattaatatgactatgttggtgcatgcatattgttctgtacggactatatatgatattgtctgtctacatctccagattttagtaaatgttacattta

SEQ ID NO: 2445 - DNA, 1037 bp, Solanum lycopersicum
attgatttaagaaagtttgttttcctaattatttcataaagcggggatagctcagttgggagagcgtcagactgaagatctgaaggtcacgtgttcgatccacgttcaccgcatatattttaaattttttattaatatccttttctttcccaaactcttctctacaaaattgttttgctctcttttccttttgtccatcctcttccgtacagagcttggactaccccattttgcatctgaattcagatcaacaaacagaaggattcaatataaatggcagctatttacagcctttacatcatcaataaatcaggagggcttatcttctgcaaggattatggttcggctggaaaaatggacacaaatgatagtttgagattggctagtctgtggcattctatgcacgctatctctcagcagttgtccccagttaatggttgtgctggtatcgaactccttcaagctgatacgtttgatctacattgcttccaatctcttaccggaacaaaattctttgtggtctgtgagcctggaactcttcatatggagtccctcttgaagtatatctatgaattatacactgattacgtcttgaagaaccctttctatgaaatggaaatgccaatccggtgtgagctctttgacataaatttgtcacaggccgttcagaaagatcgcgttgctttgttggggagatgagctagaaaaaaattcatatgacaattttgttgacaggttcggttatgcatctggaatgtgatttttttctttgttgtttcaagataatggcttgtaagataaattttgagaatcccaaataacatttttcgcggacaattaccaactcggcatgtctccatatttacatggtaagcctagaggtgaattttaccttacctgaatattctagtatgtctatagttggttctacttttgaagctcttagctgctgctatagcactataaagtttaaaatcattaaggaaagtaaattgaaagacagcatgaatatatataatttccatagagtgctgttc

SEQ ID NO: 2446 - DNA, 1856 bp, Amborella trichopoda
tacggggttgagaaaaaaattaggattttaagctataagaataatatatattataataaattatctagaccatctattttaccttaaaataagtagagcaatgatccaatacaacggttgtatcataatataatgcaacgatacttctagaaatccatatttgtggtatttgtatgacctcaaattttacacatactttcttcatctcaataatcaatccccctaaaaaagttcaatttaaaccttagatgtggtcaaattgagtcccccttcaaaaacgaattcagaccattaattttatgaatttcaagatcttagcttttataaacttaaaattattatttttttctttttaacattgttcatctaatgataataaaaccatccaaaaaattggaaatgaaaaaatccttctaagacttagatctaagtatctcaccaaaatgactagcctatgttaattgggctaaaaaaaactctttagattgtgttttcaattttttatctttttgtgattgttcattagaatgaaagaatatatatttcaaaatttggatcaaacaaatggtcataagattgttttttaaagttattgtatcatattactatacaatggttgaaatcattgcccaaataagtattcataaatccataagggaccatctattttaccttaaaaataagtattcataaatccataggatatgtactattatttgagttcaaatttgatcgtcgatgttaaaatttgatttaaatggagattttccaaaaagtgctttctagacgaggatttaatcatgattcctttttaagtaaccccataggcattttgaccctttttatgatattcctaaacgcatacttcctctgagccgtctatggaagatggacggtacggatccagtcttgaaagcggtgttttcatttgagcttaaatcatgtcttttaagcagctgatatcacagtgaaaagaaagtatgatttgagtgatttggggcacatctggtttgaacttgatttgggtaaagaagatggctgctatctatagtctcttcataataaacaaatctggcggacttatattttataaggattatggatcagcagggcgcatggacacaaatgatagcttgcgtttagcgagcttatggcactctatgcatgcgatttcacaacagttatctcctactattggttgtacaggaattgaactacttgaggcggatacatttgacctccattgctttcagtcacttacagggaccaagttctttgtagtctgtgagcctggtatacagcacatggaagctctcctcaaacacatctatgagctttacactgattatgttcttaaaaacccattttacgaaatggagatgccgattcgttgtgagctttttgagctgaatctctctcaggcaattcgaaaagataggatcggattggtgggtcgttgaaaatggaggaccaaaatagatcaaagtggtgcatgcctcatgaagagtaagaggctaagagcttacattctcagttattttctttgattgaagccagtttgccttcatgatagttttaactccaggctgcataccagagcagatcaattttttttagtaagaaattgctattattccttgttgtaaagctactgcaaatcagttttacaaacttttcaatgctatgtggtaggttggtgggtgggtggtcaagttgacagggagattaactgttcgtcttgcaacctgttaatctgtgccatccatcatgaataatggatggttgatgtcccatggtctacgatatagcatacactgctataatataaatgagtgttccagatgctgattgctttt

SEQ ID NO: 2447 - DNA, 1121 bp, Phaseolus vulgaris
cccataacccgtaacccgtaatacctcactctctctgaaactgaaaacaagaaggcaaaacactaaacacaactcacccacagcaacgaatcgcctcctccctcaagctcgcggcgcggcggcgaccggttaccggaaaccggcaacatactcactcacgagcaacgaatctcatctccaatctcccctccctccgctgcaagctgatctgacctcctccctcaagttcgcgtcggcgaccgcaacggcggggcaaggagcctcactctgacgacgtcgatactcctctccttctctctgttaggttttctgccctcacgattctggaaaaaattttggaatggctgcaatttacagtctttacatcatcaataagtctggtggtttgatctattataaggattatgggtctgctggacgaatggataccaatgacagcttgcgggtggcaagtttatggcactcaatgcatgcaatctctcagcagttatcacctgtatcaggctgtttaggaattgaacttctccaagcagatacgtttgatcttcattgctttcagtcgctgacagggacaaagttttttgtggtatgtgagccgggagctcaacacatggaaaatttactgaaatttgtttatgaattgtacacggactacgttttgaagaatccgttctatgagatggagatgcctatacgttgtgagcttttcgatatcaacctaacacaggcagtccaaaaggatcgtgttgtatttttgggccgataaatttatatcttaccgttttcacatttttatattttggatgagtacataatctaaatattgccattcaattgctttgaaagtatcgtatgactgctagcctttgttgctttttacgcacaaagcaagaattacaatgtctgagacaagacaagttttctgacatccgatattcattttcgagcaatgctttacatatggggactagttagaaattgcctctggctatacattattaccttggctgtggtttaaggtttgtaatgtgaattgggttcttacatgattggttattggtgtaacgggtcaatagtcagttgcaatgtttcatgttcctcagttagttacaagattgtaa

SEQ ID NO: 2448 - DNA, 760 bp, Theobroma cacao
aaatcgaagcaagaaatagagcagttattcatttccaagcaacaatttttagggttttcaatttgattcccttgacaatggcggcgatttacagtctttacataatcaacaaatcgggaggtttgatcttctataaggattatggatcaaagggacgcatggatacgaatgatagcttgagagtggctagtttatggcattcgatgcacgccatctcacagcagctatcgcctaccactggttgttcgggaattgagcttcttgaagctgatacatttgatctccattgctttcaatcccttactggaacaaaattctttgtggtctgtgaacctggtacacagcacatggaggctctcttgaaagccatatatgagctctacacagattatgttttgaagaaccccttctatgagatggagatgcctattcggtgtgaactctttgacatcaacctgacacaggcaatacagaaggatcgtgttgtgctgttgggaagatgaaccgttctggaacctgtatctcacaaaattttcaccttatcttttcttaatttgtacatttataaacggaagattgttgtcaagtttatatcagctatgttaacgctgtattaatcaaactctggtgttcggttcatcaatgctggactcatttacagcattggatgattagagaagttgtctttctcaattaacagttagaaacttgatttgctcggatgttctcaattaatgaaaaatcatgttacaggcctgct

SEQ ID NO: 2449 - DNA, 937 bp, Manihot esculenta
aaaaaaaaaaagaaaaaaacattcttacaaccaatatcttcactgctacccataaggaactctgaaaaggttatactaaccagcgccattcgatccaacgagaaggcaccgatcaccggacttgagagtgagagagaaatcatctatcagaggcttcgacccaggcggtgggtgcccgtcgattcctggatatgtgaatctcaggccgtttatctctattgttggttcttgatgatccacgacgcccatcttcctctctctacaaaagatatggagaattccgagagaagtgtctggaaatggcagccatttacagcttatacattatcaacaaatcaggtggtttgatcttctacaaggattatggatctgctggacggatggatacaaatgatagcttacgagtagctagtttatggcattcaatgcatgccatttctcagcagctatcaccaactgttggttgttcaggcattgaactccttgaagcagatacatttgaactttattgtttccaatcccttaccgggacaaagttctttgtggtctgtgaacctgggacaccacacgtggagggtctcttgacagtcatatatgaattgtacacagattatgttttaaagaaccccttctatgaaatggaaatgcccatacgatgcgaactctttgacatcaacctaacacaggtgatacaaaaggatcgtgttgctttgctagggcgataaatcacatgaattttgtcccaaaacttgttgttttgttttcttcatttgtgtatttaccatggttgaagaatcgaattctgaaatacatttggttaagctatgctcgcatacttaagatgtatggaagtacttaactgtttagctccacatagaatttgaatcatacagtgcctgtggaacagtgaaaaatctccacatagaatagattgact

SEQ ID NO: 2450 - DNA, 708 bp, Gossypium hirsutum
tagagtaattcatttccaagcaataagttttagggttttgagttctgttctcttgacaatggctgcgatttacagtctttacataatcaacaaatcaggaggtttgatattttataaggattatggatccaaggggcggatggatacgaatgatagcttgagagtggctagtctatggcattcgatgcacgctatctcacagcagctatcgcctaccactggttgttctggaattgagctacttgaagctgatacatttgatctccattgttttcaatctcttaccgggacgaagttctttgtagtttgcgaacctgggacacagcacatggaggctctcttgaaagttgtttatgagctctacacagattatgttttgaagaaccccttctatgagatggagatgcctatacgatgcgaactctttgacatcaacctgacacaggcagtacagaaggatcgtgttgcgcttttggggcgataagctgtcctggaacctttatcttaccaaaatgtcaccatctcttatcttcatcagtacacttttgatggaagattgctatcaagtttgtatcaacctgtgtattgggatatcatcatgctcctttgtttagctcataagtgctgaatcatttacaacatatgatgatttctggagttgtttctcccaattaacatttataaaattaatgaaaaaatccttttaga

SEQ ID NO: 2451 - DNA, 695 bp, Solanum melongena
cggagaagaagtggaggttcctttcggacgacttctccattttggactagccgattttgcatctattcagatcaagaaggagaaggattcaatataaatggcagctatttacagcctttacatcatcaataaatcaggagggcttatcttctgtaaggattatggttctgctggaaaaatggacacaaatgatagtttgagattggctagtctctggcattctatgcacgctatctctcaacagttgtccccagttaatggttgtgctggcatcgaactccttcaagctgatacatttgatctccattgcttccaatctcttaccggaacaaaattttttgtggtctgtgaacctggaagtctgcacatggagtccctcttgaagtacatctacgaattatacactgattacgtcttgaagaatcctttctatgaaatggaaatgccgattcggtgtgagctctttgacataaatttatcacaggcagttcagaaagatcgtgttgccttattggggagatgaacttctcaagttcatatgccataggttgatctggaatgtcgtttttctttgtttcgggatataatggcatgtaagataaattctgagaactacccaaaaagcatctttcgtccacgactaccaacttgtcatggcttagttttaatgttgttgagttgcaaactctgctcgt

SEQ ID NO: 2452 - DNA, 864 bp, Euonymus alatus
atcttccgtacgaagatccaagcatttgtcgtcggagatccgcgtgagatagaagtccccgatctggaagactggggtggtggatggccgtcgttttctaggaaatttgagagaaaggaagttttgagatggcagcaatttatagtctttacatcatcaataaatcaggtggtttgatattttacaaggactatggttctgcgggacggatggacacaaacgataccttaagagtggctagtttatggcactcaatgcatgccatctctcagcagctatcaccaacagtgggctgttcaggcattgaactgcttgaggctgatacatttgatcttcattgcttccaatcccttacagggacaaagttctttgtagtctgtgaacccggaatacctcacatggagagtctgttgaaagtcatctatgaattgtatacagattatgtcttgaagaatcccttttatgagatggagatgcctataagatgtgagctatttgaaatccacctgacacaggctgtacagaaggatcgtgttgccttgctgggacgataaattttctgggactctgagtcttgtggcctgaaaaatgcaactttcatttttgtatttcaatagaagaatttggatactcgactcttctctgtgaggtttcctttttatcatgtgttgatgcatgaagatattgatgaattgcagagcattggatgggaaattattctgcaaagctggattacaaaaactgtgtctgagctgtgtgatgctttgcacaggaatgattgtcaataggtgtgttgcaatttgatgtgcaccgggattgacagacaatttacctacattttactagttcatatattttttcttc

SEQ ID NO: 2453 - DNA, 603 bp, Fagopyrum esculentum
tagaatcgatcgacaaaggagaggaaattcgtccatcaatggcggcaatttacagtctgtatataatcaacaagtccggtggtctcatcttctacaaggactatggatcagctggtaggatggacacaaatgatagcttgagacttgcgagtttatggcattcgatgcatgccatctctcagcagctatcccccgtcactggctgcactgggatcgaactcctcgaagctgataccttcgatcttcactgtttccaatctcttactgggacaaaattctttgtggtttgtgagcctggaacacagcatatggataatctgttgaaacacatctatgagttgtacacagattatgtgttgaagaatcctttctatgaaatggagatgccgataagatgtgagctctttgacattaatctggcaactgcagtgcagaaggatcgtgttccattgctagggcgttgatctaaatgaactttcttaaacaaaatcatgtacttttctgccattttcctatacatttctgttgagaaagacttattaggttacagacttgtattcataaattgattctgagatccaaatctaagctttagattgaagt

SEQ ID NO: 2454 - DNA, 573 bp, Flaveria ramosissima
gagtccctggtaaagtgtggtacccaataagcatcgacgatttctcgtttgcagtcgaagtaagaaactcgatctgtcttctgcaatcaaggaatggcagccatttatagcctttacatcatcaacaaatcagggggtctcattttctacaaggattatgggttacaaggaagaatggatacgaatgatagcttgagattggctagtttgtggcattcgatgcacgccatctctcagcaattgtccccaattccgggatgctctggtatcgaacttctcgaagccgacacatttgatctccattgctttcaatctcttactggaacaaagtttttcgtggtatctgagcctggaacacaaaacatggagaatttgttgaagcatatatatgaactatatacggattatgttttgaagaatccgttttatgagatggagatgccaatacggtgtgagctgtttgatatcaacttggcacaagcaatacaaaaagatcgtgtttcatatctagggcgatgaaacaaaggttttgcggaaacactatatctacccgactgctttcatttgggttac

SEQ ID NO: 2455 - DNA, 650 bp, Flaveria ramosissima
gtgtggtacccaataagcatcgacgatttctcgtttgcagtcgaagtaagaaactcgatctgtcttctgcaatcaaggaatggcagccatttatagcctttacatcatcaacaaatcagggggtctcattttctacaaggattacgggttacaaggaagaatggatacgaacgatagcttgagattggctagtttgtggcattcgatgcacgccatctctcagcaattgtcccctattccgggatgctctggtatcgaacttctcgaagccgacacatttgatctccattgctttcaatctcttactggaacaaagtttttcgtggtatctgagcctggaacacaaaacatggagaatttgttgaagcatatatatgaactatatacggattatgttttgaagaatccgttttatgagatggagatgccaatacggtgtgaactgtttgatatcaacttggcacaagcaatacaaaaagaccgtgtttcatatctagggcgatgaaacaaaggttttgcagacacaccgtatatctacccgactgctttcatttggattacttgagcagttgaattaaggattttctgttaagtgatcttattactttgcaaatgtttgacatatcgtttgaaatttgctgaatatgttt

SEQ ID NO: 2456 - DNA, 1504 bp, Gossypium raimondii
atcataatatagtacaaacaagctcttgggatcaagcatatcgactctcactttttttctcatccattttttattttctttttgccttctctatgtgtaaatatatatatatatatatatgctgacataagtatggaaaatcatctcgaagcataatttctaacactctaaatcacttttagtgtgcaagaattttgaagcatttgaacctattccgccttcctcgatccataaccaaaaacaagtaggaagaaagccgaaacgatgtggtgggaagctgatcttcgcaacgctcgaacaatgtgtgattcgattggagtagaactcggcaatcatcgaaacaaatcgtagtttcccctatcacacacatcgactttctccgttcacgtaatattattaaccaaccaattaagcagagctattggatccaagggaataccgatctgaagcccaaaatgggatgaccctcgattccaggatacatcctcagaatgttgttagtttccactcaccgccatttctctgattctgactcactcacttctccctctccctaccaaaaaatttttgaattttttctactttttattgtttgtttccttccaaaacggaccagcttttccttaaatttacgaaagcatccatgtgcccgtacgtggcactatgagctaagcttgatgtaatttaacttttcaagtgaggtctaaaacgtcaattggatatttaagaagaaaaagaaaagaaatgacttcccagttcccagtcccacagaatcagagtaattcatttccaagcgataagttttagggttttgagttctattctcttgacaatggctgcgatttacagtctttacataatcaacaaatcaggaggtttgatattttataaggattatggatccaaggggcgcatggatacgaatgatagcttgagagtggctagtctatggcattcgatgcacgctatctcacagcagctatcgcctaccactggttgttctggaattgagctacttgaagctgatacatttgatctccattgttttcaatctcttaccgggacaaagttctttgtagtttgcgaacctgggacacagcacatggaggctctcttgaaagttgtttatgagctctacacagattatgttttgaagaaccccttctatgagatggagatgcctatacgatgcgaactctttgacatcaacctgacacaggcagtacagaaggatcgtgttgcgcttttggggcgataagctgtcctggaacctttatcttaccaaaatgtcaccatctcttatcttcatccgtacacttttgatggaagattgctatcaagtttgtatcaacctgtgtattgggatatcatcaagctcctttgtttagctcataagtgctgaatcatttacaacatatgatgatttctggagttgtttttcccaattaacatttataaaattaatgaaaaaatccttttagaggcatgctccccaactatttgt

SEQ ID NO: 2457 - DNA, 949 bp, Cucumis melo
tcgtaattacatttgatccgccactagcaaccagtctcgctcccccgaaactctccccttaagatcggcgttcactgaaactggattttgcgctttccaatctacgttcttccccacacttaatccctattcacaaccatatttatactcatttccttcataattcttcaaaatttgggtagatcgaaagacgatggcagcaatttacagcctctacatcatcaacaaatctggtggtttgatcttctacaaggattatgggtctgctggacggatggatacgaacgatagtttgagagtggcgagtttgtggcattctatgcatgccatttcccagcagctttcgcctatagctggttgttcgggtgttgaacttcttgaagctgacactttcgatctccattgcttccagtcactcactgggacaaagttttttgttgtgtgtgagcctgggactcagcacatggagagtcttctgaagtacatttatgaactatacacagattttgtcttgaagaatccattctatgagatggagatgcctatacggtgcgagctctttgacatcaacctagcgcaggcagtgcaaaaagaacgtgttgctttgcttggccgatgagcttaggatatccttcattttgtcagtattaaattcaagaaaaggaggctcatgatattattgtgcaaaatacttgataatttaccatccttaatgctaaatgtactccgttcctagtgaatcacgtgagatttggtggaaaaagaatgtttcttttcattgttcatcaggaagtcagggttaattttatacccattttttgtcaattgtatacagatgtggatccagttaaatgacagagcaatgttataagcttttgggatatggttaatttaagcagccaaagtatttacattttaaaaaaaaaaaactagagacgcacagggagta

SEQ ID NO: 2458 - DNA, 974 bp, Prunus mume
tctgaatctgggctaaaggtttgatttcctctgtttgatcaaataggcatcttcttcttcgttcttctattttgttcatatatttctattggattccgaaataccccttggaaatggcagcaatttacagcctatacatcatcaacaaatcaggtggattgatcttctacaaggattatgggtcttcgggacggatggacactaatgatagcttgagggttgcaagcttgtggcactctatgcacgccatttctcagcagctgtcgccgatatcgggttgtttcggcatcgagctcctccaagctgacactttcgatcttcattgcttccaatcactcactgggacaaagttctttgttgtctgtgagcctgggacacagcacatggaaggtctcttgaaacatatctatgaattgtacacagattatgtcttgaagaaccccttctatgagatggagatgcctatacgatgtgagctctttgatatcaacctgacacaggcaatacagaaggatcgtgttgccttgttagcccgatgatctgcctcaggagtcactcttgtctcttatgtagttgttgcttgttctattttctccagatgtacatcttttgatgaacattatcttccattcgtgtgactcaggagatagtttttgtacggttagttcgacttcagtgttcattctatgagcattctgattcaaggatggttccatgttttatgtgaataatttgaagttttaatatgttttacatcaatgtctgctgcatgctagatgttaattaaacttggtgccgttgagttcatgtactgaaattaaagccatgggaatgacaatcctcatttgcctgtttcgaccgtctaacggattcccgccacttggcaatgactgttcacagctgccttcagctctgggtgtcagtctccgacggcctcgtcacatgctatgagagcattttttaacgttgggtca

SEQ ID NO: 2459 - DNA, 782 bp, Prunus persica
atgagatttggctcgagaaggattcgaacctgcatcttcgcgctaaacatcagacaagcatcttcttcttcgttcttcttttttgttcatatatttctattggattccgaaatacccctcttggaaatggcagcaatttacagcctatacatcatcaacaaatcaggtggattgatcttctacaaggattatgggtcttcgggacggatggacactaatgatagcttgagggttgcaagcttgtggcactctatgcacgccatttctcagcagctgtcgccgatatcgggttgtttcggcatcgagctcctccaagctgacactttcgatcttcattgcttccaatcactcactgggacaaagttctttgttgtctgtgagcctgggacacagcacatggaaggtctcttgaaacatatctatgaattgtacacagattatgtcttaaagaaccccttctatgagatggagatgcctatacgatgtgagctctttgatatcaacctgacacaggcaatacagaaggatcgtgttgccttgttagcccgatgatctgcctcaggagtcactcttgtctcttatgtagttgttgcttgatctattttctctagatgtacatcttttgatcaacattatcttccatttgtgtgactcaggagatagtttttgtatggttagttcgacttcagtgttcattctatgagcattctgattcaaggatggttccatgttttatgtgaataatttgaagttttaatatgttttacatcaatgtctgctgc

SEQ ID NO: 2460 - DNA, 661 bp, Sarracenia psittacina
tccctcaagcgcagagcagaactagatcaaaggaactcgatcagtccttcagctcgacacgaaagggaaaaaatggccgccatttacagtctgtacatcattaacaaatctggtggcctcatcttctacaaggattacggctctgcgggacggatggatacaaatgatagcttgagattggccagtttatggcattcgatgcacgctatctctcagcagctatcgccggttcctggatgttctggaatcgaacttcttgaagccgacacttttgatctccattgcttccagtctcttactgggacaaaattctttgtggtcagtgaaccaggaacgcagcatatggatggcctcttgaaacatatctatgaactgtacacggattatgttcttaagaacccattctatgaaatggagatgccaatccgatgcgagttatttgatataaacctggcacaggcagttcagaaggagcgtgttgccttgttgggacgatgaaacttcccttaaagctggtatttgacttccatttttttacattgtaacagtacaatcttatcttcctagtttattttattaagttctcgtggatttgtgaaactttgttgggattgaatccatatgtacacagatttttatgatattatgacaactaggggaa

SEQ ID NO: 2461 - DNA, 778 bp, Euphorbia esula
cgacagcaacgggttttttcttccgatttgttttgatttcgagaaggtttatcagctatggcctcaatttgtagcctttacatcatcaacaagtctggaggtctgatcttttacaaggattatggtactcatggaaggatggatacaaatgacagtttaagagtggctagtttatggcattccatgcatgctatctcccagcagctatctccaactcttggttgttcaggcattgaactcctagaagctgacacttttgacctccattgctttcagtcccttactggaacaaagttctttgtagtctgcgaaccaggaactccaaatatggagagcctcttgagagtcatatatgaactgtacacagattatgtcttgaagaatcccttttacgaaatggaaatgcctatacgatgcgagctctttgacatgaatctaacacaaacaattcagaaagatcgtgttgctttgttgggtagatgaaccacttgaggggctggaattgttcttttcatcaaagcattttccatgaacattgctgcttgtataaccttcttttgatgtactccactgttttcaatctttatgcaattgaaaagtgtctgctctgctcttagctagttaccttttcttctatgattgagcatttggatcgcaagcatacgtttattttgatggttcattgtagagtccgtgctcacggttcatgcttgtcaaaattcgaattcatcaatatgtgaaattaaaccttaatagtagaaagcaatggaaccatgag

SEQ ID NO: 2462 - DNA, 870 bp, Fragaria vesca
attccggccgttttcgagaacatattcttaacctaaaagacaccaagctggaaacccgccgatatgcgtctggatacgtattcgtaaataaggtggatactcggggtaaataattacttttgggccctcgggaagagggacgtgggtttcgggtcgggtatagaacctgtatctgtaaatacaatcttgctagtcttcttcttcatcatccgtccactcatttagattcagaaacagccttcggaaaatggcagcgatttacagcctctacatcatcaacaaatcaggcggcttgatcttctacaaggactatggatcgacgggacgaatggacacgaatgacagcttgagggttgcgagcttgtggcactcaatgcacgccatttctcagcaattgtctccggttcccggttgcgcaggcatcgagcttcttcaagctgatacctttgatcttcactgcttccagtcacttactggaacaaagttctttgttgtcagtgagcctggtacacagcacatggaaggtctcttgaaacacatctatgagctgtacactgattatgtcttgaagaaccccttctatgagatggagatgcctatccggtgcgagctctttgatattaacctgacacaggcaatacaaaaggatcgtgttgccttgttagcccgatgatctgcgtcgtgacatgtatcttatgtttttgttgcttgatctatatttctttagatgtaaatcttctgaacaatcgtgaatacaacacataagatatgtgttgttgtgttgttcgactttagctgactacaacttcaatgttcagtacagggtttgtgaagtatatcttcttttgaattgacgttcattgttttctg

SEQ ID NO: 2463 - DNA, 726 bp, Tripterygium wilfordii
tccccgatctcggagaccggggtcgtggatggccgtcgtttctaggaaattttagtggaagttttgagatggcagcaatttatagtctttacatcatcaacaaatcaggcggtttgatattctacaaggactatggttcagccggacgtatggatacaaacgatagtttaagagtggcgagtttatggcactcaatgcatgccatctctcagcagcggtcaccaacagtgggctgttcgggcattgaactgcttgaggctgatacatttgatcttcattgcttccagccgcttacagggacaaagttctttgtagtctgtgaacctggaacaccacacatggagagtcttttgaaagttatctatgaattgtatacggattatgttctgaagaatcccttttatgagatggagatgcccataagatgtgacctatttgacatccacctgacgcaggcaatacaaaaggatcgcgttgccttgttgggtcgataaatttcctgggactccgaatctcgttgctgattagtcttgtggcctgattaatgtgactttcatttctgcatgtcaatagaagatggtgatacgttaccctttgcaaggtttccttttaatcatatgtcgatgcattaaagtttatggatgaattaaagagcattggtgggaaattattcagcaaagcttgattacccttttaggtgaactactttgtgcctgagctgtttga

SEQ ID NO: 2464 - DNA, 689 bp, Allium cepa
attttcggagtaatcgcttcagtctgcagtctctttatcattaataaatccggcggtctcatcttctacaaagattatggttcgacagggagaatggatacgaatgatagcttgagattggcaagtttgtggcattcgatgcatgcgatttctcaacagctgtctcctgttgttggatgtaatgggatcgagctactacaggctgacaattttgatttgcactgttttcaatcgcttacaggaacaaaattctttgtagtatgcgagcctggaaccccacaaatggaaaacctgctgaagcttatttacgagctgtatacagattacgtactgaagaatcctttctacgagatggaaatgcctattcggtgcgaactctttgacctcaacctctctcaggctattcagaaagatcgagttccactcttaggacggtagataactagcctactttatggaattatcgggtgagttcctcccctccattgctggtaataaatttgtatgataagtccgtcgtgcttagcattgtattgactatatatctgagaaggttttggagcaattcctgttttccctacataggcatggcacgcatcaattttgtgctttaaatggtctaataaaccttggaagatcgtgagatagatacagtgtgcgctcgtatgtcattgttctctttctgtttt

SEQ ID NO: 2465 - DNA, 1804 bp, Cirsium arvense
aaacgtgaagataatgagcagggggaacgataatagcagcaaactgaactccgtcttctacgcaacctcctaccatccgattcaggccggtagcatcgacggcaccgacattcttcctcacgataacgccgtctacagagctcttctttgttcttccgccggtctctatgatccgttcggagatccgaatgtcatcggtgaagatccttattgcacagttttcgtcggccacctctctcaattcactaccgaagatactcttcgcaaggctatgagcaactatggcacggtgaagaacttgcgattggtcaggcatattgttactggtgcctctcaaggttatgcttttgttgaatttgaaagtgaacgagagatgcgacgagcatatgagaaggcacaccattcagttatcgatgattccgaaattattgttgattacaaccggcagcaactaatgccagggtggattccaagaagattgggaggtggtcttgggggtaagaaagaatcagggcagcttcggtttggaggacgagaaagacctttccgggcgccattgcgtccaattccattggatgatctgaaacggcttggaatcccgcctcccccggaaggaaactacatgtctcgatttgaggttccatccccaccccgaaggaaggcggattatgcagatagggaagacagacgtaacagaagacgtgagcgaagatctagcagccgggatcgcttacacgacccaaggagatctgtggataacgacgatggctccaggaagagccacagtagaaattattctgaaaggtctagccgtgatcggtatgatgaaagagaagacgataccaggaaaagatacaaagattctcacagacgtgaccgaacatccaccagtcacgaccatcaatctgatacaagacgttctagcgacagggaacaacggtctcgcaagcgccacaaacacgagtgagatttctttgaaattaaagcacttatggttatatgtatttaactcgagttaagccctaaacattataacaatgaatatttaagatttaaatccttcgattggcttagattccccgtaacagattaaaatcgattagtatgagtttatcaaaaaagaactttagcatagaacaggcaacaataaaattacaatcatttatattccaaaagttctggcacttgtattggttgctaacatgtctgtctaattcacttggaaagtaataacaccacttaacgaatattcatcgatacaaaccgaaattaaaagttttcaatgggttcgtttgcattgattcatcggccaagatacgcaacacggtccttctgtatcgcctgtgacaagttgatatcgaagagctcacaccgaattggcatttccatctcataaaacggattcttcaaaacataatccgtgtagagttcataaatatgtttcaacagatgctccatgtgctgcgttccaggctcggataccacaaaaaacttcgtcccggtaagtgactgaaagcaatggagatcaaatgtgtcagcttcgaggagttcgataccggtgcatccagaaataggggacaattgcatagagatggcatgcatcgagtgccacaaacttgccaatctcaaactatcgttcgtatccattcttcctgctaacccgtaatccttgtagaagatgagaccccctgatttgttaatgatgtaaagactgtaaattgcggccattgttgtagcagattctgcaaaactccaagtagttcagaacttcagagatgcatgcggcaagaacctgtagattcgg

SEQ ID NO: 2466 - DNA, 641 bp, Sarracenia psittacina
gcagagcagaactagatcaaggaactcgatcagtccttcagctcgacacgaagggaaaaataggccgccatttacagtctgtacatcattacaaatctggtggcctcatcttctacaaggattacggctctgcgggacggatggatacaaatgatagcttgagattggccagtttatggcattcgatgcacgctatctctcagcagctatcgccggttcctggatgttctggaatcgaacttcttgaagccgacacttttgatctccattgcttccagtctcttactgggacaaaattctttgtggtcagtgagccaggaacgcagcatatggatggcctcttgaaacatatctatgaactgtacacggattatgttcttaagaacccattctatgaaatggagatgccaatccgatgcgagttatttgatataaacctggcacaggcagttcagaaggagcgtgttgccttgttgggacgatgaaacttctcttaaagctggtatttgacttccatttttgtacatcgtaacagtacaatcttatcttcctagtttattttattaacttctcgtggatttgtgaaactttgttgggattgaatccatatgttttattatagctgaagcatgtgtacacag

SEQ ID NO: 2467 - DNA, 780 bp, Castanea mollissima
attccgaaattgccctttgaaatggcagctatttacagcctctacatcattaacaaatcaggtggtttgatcttctacaaggattatgggtctgctggacggatggacacaaatgatagcttgagggtagcgagtttatggcactcaatgcacgcaatctctcagcaattatcgccggttgcaggttgttcgggcattgagcttcttgaagctgatacatttgatctccattgcttccaatcacttactgggacaaagttctttgtggtctgtgagcccgggacacagcacatggaagctctcttgaaagtcatctacgaattgtatacagattatgtcttgaagaatcccttctatgagatggagatgcccatacggtgtgagctttttgatatcaacctttcgctgacagtacagaaggagcgtgttgccttgttgggccgatgatctgcactggaacttggatctgatttgatcttttttgatctgttaccttcgcgtgtacattttcagagcaatcttatcttcgaatttgtagaagatgctttatatgtgatttatgtcacactctgatgttagtttttgaaaatctttgaacaagtgaggtatgagatattcaacaatggagaggaattctttgtactggagtatgcaaaaatcatcttgttaaaatttattaaacttgtagactctgtatgtgtcatggccttctcggttaggttattgactgtgcaatgtaagtcaaactcaaaccttttcacattaatgttttgctgaaat

SEQ ID NO: 2468 - DNA, 529 bp, Castanea mollissima
attcccaaattgccctttgaaatggcagcaatttacagcctctacatcatcaacaaatcaggtggcttgattttctacaaggattatgggtctgctggaaggatggacacaaatgatagcttgcgggttgcgagtttatggcactcgatgcacgcaatctctcagcagttatcgccagttgcaggttgttcgggcattgagcttctcgaagccgatacgtttgatctccattgcttccaatcactcactgggacaaagttctttgtggtctgtgagcctgggacacagcagatggaagctctcttgaaagtcatctatgaattgtacacagattatgtgttgaagaatcccttctatgagatagagatgcctatacggtgtgagctttttgatttcaacctttcacagacagtacagaaggattgtgtcgccttgctgggccgatgatattctctgcaacttggatctgatttgattttcttttgatctgttacctttgaatgtatattttcagagcaatcttatcttc

SEQ ID NO: 2469 - DNA, 792 bp, Chrysanthemum coronarium
tttacccttttaatatcttggtcttcttttaccattttcacctattttaattcaatttcagatcacttccatagattctcaatatacttaattcatcacttcaatttttatcacagtattaatttgaaggaaaaatggctgcaatatacagtctatacatcatcaacaaatcaggtggtctcatcttctacaaggattatgggttacaaggaagaatggatactaatgatactttgcgattggcgagtttatggcattcgatgcacgccatttcgcagcagttgtctccggtttcgggctgtacgggtatcgagttgcttgaagctgatacctttgatcttcattgctttcagtctcttactgggacaaagttttttgtggtttctgagcctggaacacaacacatggagaatctgctgaagcatatctatgaactatacacagattatgttttgaagaatccattttatgaaatggagatgccaatccggtgtgagctatttgatatcaacttggcacaggctatacaaaaggaccgtgttgcatatctcgggagatgaacacaagcttttaccagtagaccaatttcttcaacttctgtttacagtcaatgacgtaatattcaagcacttgatatgaagaatgttccgtaagtgaactattaccttataaatgtattagcaaataattgttggatcaagttatgttacacaaatgacattagtattatatgacctttctccgcttatcttatttagtaattgtgttattgaatctatgtgcttttaagtt

SEQ ID NO: 2470 - DNA, 831 bp, Chrysanthemum coronarium
tttacccttttaatatcttggtcttcttttaccattttcacctattttaattcaatttcagatcacttctatagattctcaatatccttaattcatcacttcaatatttattacagtattaatttgaaggaaaaatggcagcaatatacagtctatacatcatcaacaaatcaggtggtctcatcttctacaaggattatgggttacaaggaagaatggacacaaatgatactttgcgattggcgagtttatggcattcgatgcacgccatttcgcagcaattgtctccggtttcagggtgtacgggtatcgagttgcttgaagcggatacgtttgatctccattgctttcagtctcttactgggacaaagtttttcgtcgtttctgagcctggtacacaacatatggagaatctgttgaagcatatctatgaactatacacggattatgtcttaaagaatccattttatgagatggaaatgccaatccggtgtgagctctttgatatcaacttggcacaggcaatacaaaaggaccgtgttgcatatcttgggagatgaacacaagcagacaaatctttatatctccaccttctgtttacagtctaaacttactattcgagcacctaatttgaagaatgttccgtgagtggtgttatttccttaaaagtgtactagcaggtaattgttgaatcatgtattttttaagcaaataacttgagtattacacaatggaatttgcccaaccctttcacttctaaaatgtttccattgccctcaagcatgttgtatgtcttcatggtaccgaataaagaaccttccattagttcat

SEQ ID NO: 2471 - DNA, 659 bp, Cichorium intybus
ggttacgaacaagaaaaagtttttgggttctttgtgattgattgctcagaagtctgaactaccgaacctggatctgtgaagttttactcaatccgctacaacaaagaatggctgcaatttacagtctttatatcatcaacaaatcagggggtctcatcttctacaaggattatgggctagcgggcagaatggatacgaacgatagcttgagattggcaagtttgtggcattcaatgcacgccatctctcagcaattgtccccaatttccggatgctccggtatcgaactcctcgaagccgacacatttgatcttcattgctttcagtctcttactggtacaaagttttttgtggtatctgagcctggaacgcatcacatggacaatctgttgaaacatatttatgaattatacacagattatgtgttgaagaatccgttttatgaaatggagatgccaattcggtgtgagctctttgatatcaatttagcacaagcaatacaaaaggaccgtgttgcttatcttggtcgatgaaaaatgacacattatgcgaacaaacttgtattttcagtttggatttatttgatttgaaatgagaattttttcggtatgtgatgttttattactttactagtgtattagacaaaatggtaaccaaca

SEQ ID NO: 2472 - DNA, 832 bp, Centaurea maculosa
aatcggccagatgtgacgactatagtatttggtatataattccaataaaactctgaatcgttcatatgattcagaaccattcctttttccaggttgctctgatctcttttcttctcaccaccatcgatctgatctctcctattaatcataggttcttgctgcatgcatctctgaagttctgaactacttggagttttgcagaatctgctacaacaatggccgcaatttacagtctttacatcattaacaaatcagggggtctcatcttctacaaggattacgggttagcaggaagaatggatacaaacgatagtttgagattggcaagtttgtggcactcgatgcatgccatctctatgcaattgtcccctatttctggatgcaccggtatcgaactcctcgaagctgacacatttgatctccattgctttcagtcacttaccgggacgaagttttttgtggtatcggagcctggaacgcagcacatggagcatctgctgaaacatatttatgaactctacacggattatgttttgaagaatccgttttacgagatggaaatgccaattcggtgtgagctcttcgatatcaacttgtcacaggcgatacaaaaggaccgtgttgcgtatcttggccgatgaatcaatgcaaagaacccattgaaaatttaattcggtttgtatcgatgaatattcgttaagtggtgttattactttccaagtgaattagacagacatgttagcaaccaatacaagtgccagaacttttggaatataaatgattgtaattttattgttgcctgttctatgctaaattcttttctcaaaaagaa

SEQ ID NO: 2473 - DNA, 758 bp, Centaurea maculosa
agcgtcctttttccagattgctctgatctcttttcttctcaccaccatcgctctgatctctcctattaatcataggttcttgctgcatgcatctctgaagttctgaactacttggagttttgcagaatctgctacaacaatggccgcaatttacagtctttacatcattaacaaatcagggggtctcatcttctacaaggattacgggttagcaggaagaatggatacgaacgatagtttgagattggcaagtttgtggcactcgatgcatgccatctctatgcaactgtcccctatttctggatgcaccggtatcgaactcctcgaagctgacacattcgatctccattgctttcagtcacttaccgggacgaaatttttcgtggtatccgagcctgggacgcagcacatggagcatctgttgaaacatatctatgaactatacactgattatgttttgaagaatccgttttatgagatggaaatgccaattcggtgtgagctcttcgatatcaacttgtcacaggcgatacagaaggaccgtgttgcgtatcttggccgatgaatcaatgcaaacgaacccattgaaaactattaatttcggttaagtggtgttattactttccaagtgaattagacagacatgttagcaaccaatacaagaacttttggattatatatgattgtaattttattgttgcctgttctatgctaaattcttttctacaaaaaagaaaaaagtaaccgactgcgactct

SEQ ID NO: 2474 - DNA, 699 bp, Centaurea maculosa
tctgatctcttttcttctcaccaccatcgatctgatctctcctattaatcgcagcaactgccatacaatcccttagttgtatccaagttttgaactacttggagttttgcagaatctgctacatcaatggccgcaatttacagtctttacatcattaacaaatcagggggtctcatcttctacaaggattacgggttagcaggaagaatggatacaaacgatagtttgagattggcaagtttgtggcactcgatgcatgccatctctatgcaattgtcccctatttctggatgcaccggtatcgaactcctcgaagctgacacatttgatctccattgctttcagtcacttaccgggacgaagttttttgtggtatcggagcctggaacgcagcacatggagcatctgctgaaacatatttatgaactatacacggattatgttttgaagaatccgttttacgagatggaaatgccgattcggtgtgagctcttcgatatcaacttgtcacaggcgattcaaaaggaccgcgttgcatatcttggccgatgaatcaatgcaaacgaccattgaaaactttaattcggtttgtatcgatgaatattcgttaagtggtgttattactctccaagtgaattagacagacatgttagcaaccaatacaagtgccagactttagaatataaatgattgtaattt

SEQ ID NO: 2475 - DNA, 638 bp, Cirsium arvense
gctacccatatgattcagaactcagatgcgtccttttttccaggttgctctgatctctttactcctcactactgttgctctgatctctcctattaatcgcagcaattgccaaacaaccccagttgcgtctgcctcaacaggttcttccacttgtgtctcttaagttctgaactacttggagttttatacaatctgctacaacaatggctgcaatttacagtctttacatcattaacaaatcagggggtctcatcttctacaaggattatgggttagcaggaagaatggatacgaatgatagtttgagattggcaagtttgtggcattcgatgcacgccatctctcagcaattgtcccctatttctggatgcactggtatcgaactccttgaagctgacacatttgatctccattgctttcaatctcttactgggacgaagttttttgtggtatctgaacctggaacgcaacacatggagaatctgttgaaatatatatatgaacaatacacagattatgttttgaagaatccgttttatgagatggaaatgccgattcgttgtgagctctttgatatcaacttgtcacaggcaatacaaaaggaccgtgttgcgtatcttggccgatgaatcaaacac

SEQ ID NO: 2476 - DNA, 725 bp, Citrus clementina
aataaagaaaaaattacaaagaccttttgactctcttcttcttgttcttcttgcttccaagttaatagattcagaaaaaaagcgttttccgatggcagcaatttatagcctttacatcatcaacaaatccggcggcttgattttctataaggattatggatctgctgggcgaatggatacgaatgacagcttgagagtggcgagtttatggcattcgatgcacgtgatctctcaacagttatcgccaaccacaggctgttctggcatcgaactccttgaagctgacacttttgatctccattgcttccaatctctcactgggacaaagttctttgtagtgtgtgaacctgggactcagcacatggaatctctattgaaagatatctatgaattgtacacggattatgtattgaagaatcccttttatgagatggagatgcctatacgatgtgaactatttgacatcaatctatcacaggcagtacagaaggatcgtgttgccatgttggggcgataaactcctctgaaacatacatcatactaaattgtatttgttatgctatcttgatttgtttctttgcattcgtgcagtagaagcttaattggttgtagtttgtgtacgaacatttgactgatctttgacaaaatctggtgtttggtcatcgatgcagaaatcatgtaagatgttagatatttttgtttttgtttccaccagatgatccatg

SEQ ID NO: 2477 - DNA, 832 bp, Gossypium hirsutum
ccttccaaaacggaccagcttttccttaaatttacgaaagcatccatgtgcccgtacgtggcactatgagctaagcttgatgtaatataacttttcaagtgaggtctaaaacgtcaattggatatttaagaagaaaaagaaaagaaatgacttcccaattcccagtcccacagaatcagagtaattcatttccaagcgataagttttagggttttgagttctattctcttgacaatggctgcgatttacagtctttacataatcaacaaatcaggaggtttgatattttataaggattatggatccaaggggcgcatggatacgaatgatagcttgagagtggctagtctatggcattcgatgcacgctatctcacagcagctatcgcctaccactggttgttctggaattgagctacttgaagctgatacatttgatctccattgttttcaatctcttaccgggacaaagttctttgtagtttgcgaacctgggacacagcacatggaggctctcttgaaagttgtttatgagctctacacagattatgttttgaagaaccccttctatgagatggagatgcctatacgatgcgaactctttgacatcaacctgacacaggcagtacagaaggatcgtgttgtgcttttggggcgataagctgtcctggaacctttatcttaccaaaatgtcaccatctcttatcttcatccgtacacttttgatggaagattgctatcaagtttgtatcaacctgtgtattgggatatcatcaagctcctttgtttagctcataagtgctgaatcatttacaacatataatgatttctgg

SEQ ID NO: 2478 - DNA, 785 bp, Cucurbita pepo
cccactcgcttaagttgggcgctcattgaaactgggtctggattttgcgcctttgaatctacgctcttcaccacacccacaatcgcattcattccatttctttcgttaagacttcagaagtttcaacccggaaagatctgaagaggatggcagcaatttacagcctctacatcatcaacaaatctggtggcttgatcttctacaaggattatgggtctgctggacgaatggacacaaacgatagcttaagagtggcgagtttatggcattcgatgcatgccatttcccagcagctttcgcctatttccggttgttcgggtactgaactccttgaagccgacacattcgacctccattgcttccagtcacttactggaacaaagttttttgttgtgtgtgagcccgggacagtgcacatggagggtcttctgaagtacatttatgagttatacacagattatgtcttgaagaatccattctatgagatggagatgcctattcggtgtgagctctttgatatcaacctcgtgcaggcagtgcaaaaggatcgtgttgctttgcttggccgatgaactttgaatatccttcattttgccagaattaaccatccataattcaagacaggctcatgatattgttgtccaaatacttgataatttgcctgctaaaatgtactccatgtactccatgtactccatggtccttttcagtgttcaccggataatcatggttcattttatagccaattttttgtcaatgaaatacagaactgaatccaggctttg

SEQ ID NO: 2479 - DNA, 859 bp, Euonymus alatus
ttacccgttcattttcttagcagaccaagaaacagcccggttaaaagctatcttccgtacgaagattcaagcatttgtcgtcggacatccgcgtgagagagaagtccccgatctggaagaccggggtcgtggatggccgtcgttttctaggaaatttcagagaaaggaagttttgagatggcagcaatttatagtctttacatcatcaacaaatcaggtggtttgatattttacaaggactatggttctgcgggacggatggacacaaacgataccttaagagtggctagtttatggcactcaatgcatgccatctctcagcagctatcaccaacagtgggctgttcaggcattgaactgcttgaggctgatacgtttgatcttcattgcttccaatcccttacagggacaaagttctttgtagtctgtgaacccggaacacctcacatggagagtctgttgaaagttatctatgaattgtatacggattatgtcttgaagaatcccttttatgagatggagatgcctataagatgcgagctatttgaaatccacctgacacaggcagtacagaaggatcgtgttgcctcgctgggacgataaatttcctgggactctgagtcttgttgcctgaaaaatgtaactttaatttgtgcatttcaatagaagaacttagatactcgactctctgtgaggtttccttttcatcatgtgttgattcatgaagattattgatgaattgcagagcattggatgggaaattattctgcaaagcttgattacaaaaactttttgtctgagctgtgtgatgctttgcacaggaatgattgtcaataggtgtgttgcaatttgatgtgca

SEQ ID NO: 2480 - DNA, 1029 bp, Panax ginseng
agtcttctaagcggtatagtacctgtttggctcagtttcaggtctcaactcacaatccaaaaccagattcaacggattgatcaacaaaatgccagcaatttgcagcctctacatcatcaacaaatccggtggcctcatctactacaaggattatggatctgcgggacgtatggatacgaatgacagcttgagattggctagtttatggcattcgatgcacgcaatttctcagcaattatcgccggtcaatggttgtacggggatcgagcttcttgaggctgatactttcgatcttcattgctttcaatctcttactgggacaaagttttttgtaatctctgagcctggaacacagcacatggagggtcttttgaaacatatatatgagctctacacggattatgttttaaagaatcctttctatgaaatggagatgccaattcggtgtgagctctttgatatcaacttgtcacaggcagtacagaaggaccgggttgccttgctgggacgatgaaggtactaccctgattgccggaaatatcagtatgacatttttgcttgatctgttatttgtatatttcagagggactaccaattcattaagttagataatcaactcagctctactttgtgctaaaaagctgtagaatgttaattttagtgatactgagaaaactaatacttggcaagccgcttcttttagtgataattcaaggctttttcggaaacggatgttagcggataagtgcagttctctataccattttggtggattaatttgggaaagcatcttaattggaaagaaaaaaaaaaaaaaacaaaaaaaaaaaaaaaaaaaaaaaaaacaaaaaaaaaaaaacaaaaaaaaaaaaacaaaaaaaaaaaacaaaaaaaaaaacaaaaaaaaacaaaaaaaagaaaaaacgaaaagaaaagaacgaaagaaagaacaacgaagaagaagaagaacagacacacagacacacacacacacacacacacacacacacacacacacacacacacaca

SEQ ID NO: 2481 - DNA, 906 bp, Gnetum gnemon
atacactgtgaattcgtaaattcccacagaagacgacattgctcttccatattcgacccataggttcagcgacttgaagttgttgcaaagaattgtttttgtcagtgattgaagtagactgtccaacaattcattgcattgcagattcggtgtgaccaatggctagcatttataatttgtttatcatcaataaatctggaggactcattttttacaaggactatggatcagctggaagaatggatacaaatgacagtttaagacttgctagtctgtggcattcaatgcatgccatttcacagcaattatcacctgtacttgggtgcactggcattgaacttcttgaagcagatacctttgatcttcattgttttcagtcattaacaggaacaaaatttttcgtggttacagagccaggtacccaaggcatggaatatctgttgaagacaatttatgagctctataccgactatgttctgaaaaatccattttatgagatggagatgccgattcggtgtgagctgtttgatcttaatttagcacaagctattcggaaagataagattccttttcttggacgttaattaagtatatctgaattcaagcatgtcttcgagtgttttgttagtgatgcataatgaaattttgttcttttcaaaaggttgcattgcatatgaatattttagtaaaacattgtgatgaacattacaagaacgtagcttgtaactgtacttttgtatactattatgatgaatgttccattgaagttggagttaggaagcaattgttagctgtaccgatcatgaaggatgtgtaaattattttttcttgactctaaaatgtttcatttttcttgtgaacatattgaatgaagtattaatgtttctcgttagttcaactagagat

SEQ ID NO: 2482 - DNA, 667 bp, Guizotia abyssinica
aatactgcggggagttcgggcattatgtgccgggggtgtgtgtgcgtcccgaggaacgggatctacattctttgtatgcgcacagaagataagacggtcgtttctccgctcatggataagaagatcggcttctgcaaccaaagggatctgtgaaatttcacccaatcaatggcggcaatttatagcctttatatcatcaacaaatcagggggtctcatattctacaaggattatgggctacaaggaagaatggacacgaatgatagcttgcgattggccagtttgtggcattcaatgcacgccatctcgcagcaattgtccccaattcccggatgcgctggtattgaacttcttgaagcggacacatttgatctccattgctttcaatctcttactgggacaaagttttttgcggtatctgagcctggaacacaaaatatggagaatctgttgaaacatatttacgaactatacacggattatgttttaaagaacccgttttatgagatggagatgccgatacgttgtgagctctttgatatcaacctggcacaatcaatacaaaaagaccgagtttcatatctcggtcgatgaaacttgcaaaactcgtgtgttgtttgggtttatttgagcaggtgaattaaagaatgtttgttaagtgatgcta

SEQ ID NO: 2483 - DNA, 809 bp, Lactuca sativa
agtaaattaacaactacatcttgcaacacagagcacggcaattctctcggttattcgaacaagaaatttgatcaatacgctcttggacccgaattttgtatgctctacaaaaagcgagtctcctactgagcctgaacctggatctgtgaagttttactcaatctgctacagcaaagtatggctgcaatttatagtctttacatcatcaacaaatcaggaggtctcatcttctacaaggattatgggttagcaggcagaatggataccaatgatagcttgagattagcaagtttgtggcactcgatgcacgccatctcccagcaattgtccccaatttccggatgctccggtatcgaactcctggaagcggacacatttgatcttcattgctttcagtctcttaccgggacaaagttttttgtggtatctgagcctggaacgcatcacatggataatttgttgaaacatatttatgaattatacacagattatgtgttgaagaatccattttatgaaatggagatgccaattcggtgtgagctctttgatatcaatctagcacaagcaatacaaaaggatcgtgttgcgtatcttggccgatgaagagatgaatcttattatgcaaacaatcctatcttttttctttttttttttctccaaattctaattttaatttcgggtttatttgattgatattgttaaattccaagtttatttgatgaaatagtagccaactgaagcttttggcttttgggatatatgctcatatcatatgtttcttatatgttatacatttgtttctttcctcg

SEQ ID NO: 2484 - DNA, 569 bp, Lotus japonicus
gatagtcttctcttctcagattctggaatggcagcagtttacagtctttacatcatcaataagtctggtggattgatatactataaggattatgggtctggaagaatggataccaatgacaccttgagggtggccagtttgtggcactcgatgcatgctatctctcagcagttatcgcctgtttcaggttgctttggaattgagcttctccaagcggacacgtttgatcttcattgctttcaatcactgacagggactaagttctttgtggtctctgagcctggagcacaatacatggaaagtttattgaaatttatctatgaattgtacacggactatgtcttgaagaatcctttctatgagatggagatgcctatacgttgtgagctatttgatattaacctgacacaggcagtgcaaaaggatcgtgttgcgttattgggacgataaacttatctgaccaaatcttgttgtgcaaaacttgtcactaatgcctagcatctgtaattgcttttttacagacaaattaagattgacccaaatgtctgagaaaagacatgttcctaaca

SEQ ID NO: 2485 - DNA, 1043 bp, Tropaeolum majus
accacatacaacaattgatcgcactttcttcaattcagttattcgcgttgtgcatcacgggcgccgatctgtgtctcgcggaagttgttttcaggtttctgtcaaatctattccaccaggcacttagaaggtttaatagtactggccagcaaaaaacgagtggaataaacaggggtttgactgattttatattagttatcaaatgattcgaagaaagaataactgaagaacaacggaacaaattttgtattgagacttcctgcagtgttcttctgttgtattaaggttcttgtgtacttggagcacaatatcttcttataactgagctggaaaacccagacaatggcagcaatttacagcctttatatcatcaacaagtcaggtggtttgatcttttataaggattatggttctagaggccgaatggacacaaatgatagtttgcgggtggctagtttgtggcattcaatgcatgctatctcacagcagttatcacctaccactggctgttcaggaattgaactcctcgaagcggacacctttgatctccattgcttccaatcactgactggaacaaagttctttgtggtctgtgaacccgggacgcagctgatggaaaatctcttgaaaataatatatgaactgtacacagattatgtattgaagaatccattttatgaaatggagatgcctatacggtgcgagttatttgacatcaaccttacacaggcaatacagaaggagcgggtggccatgttgggacgataaaattccttcactcgaaacttgtagttaatctgtttgttttatttttggtttttgtatttctatgacatcaacgtcttcttctgggtctgttttttttttcccgtaaaccgatcggttcgatgtaggattgtgaatgcaattgtgaaactctttgtattagattcagatgttttattacggggagaaaaatacgagcctaagaaaatgatgatccaattatgcgaaattagcaatattagcctaacatataaaaaatatatacgtgctgattaaat

SEQ ID NO: 2486 - DNA, 668 bp, Quercus alba
atctatctcaaaagtttatcagattccgaaattgccctttggaatggcagctatttacagcctctacatcattaacaaatcaggtggtttgatcttctacaaggattatgggtctgctggacggatggacacaaacgatagcttgagggtagcgagtttatggcactcgatgcacgcaatctctcagcagttatcgccagttgcaggttgttcaggcattgagcttcttgaagctgatacatttgatctccattgcttccaatcactcactgggacaaagttctttgtggtctgcgagcctgggacacagcacatggaagctctcttgaaagtcatctatgaattgtatacagattatgtcttgaagaatcccttctatgagatggagatgcccatacggtgtgagctttttgatatcaacctttcactgacagtacagaaggagcgtgttgccttgttgggccgatgatctgcactggaacttggatctgatttgatcttttttgatctgttaccttcgcatgtatcttatcttctaatttgtagaagatactttatatgtgatttatgttacactctgatgttagtttttgaaaatcactaaacaagtgaggtatgaggtattcaacaatggagaggaattctttgtactggggtatgcaaaaatc

SEQ ID NO: 2487 - DNA, 660 bp, Quercus alba
atcatcgatcttcttgatttatctttctcaacagtttatcatattcgcaaattgccctttgaaatggcagcaatttacagcctctacatcatcaacaaatcaggtggcttgattttctacaaggattatgggtctgctggaaggatggacacaaatgatagcttgcgggttgcgagtttatggcactcgatgcacgcaatctctcagcagttatcgccagttgcaggttgttcgggcattgagcttctcgaagccgatacatttgatctccattgcttccaatcactcactgggacaaagttctttgtggtctgtgagcctgggacacagcagatggaagctctcttgaaagtcatctatgaattgtacacagattatgtgttgaagaatcccttctatgagatagagatgcctatacggtgtgagctttttgatttcaacctttcgcagacagtacagaaggattgtgtcgccttgctgggccgatgatattctctgcaacttggatctgattttattttcttttgatctgttacctttgaatgtatcttatcttctagtttgtgtaagataactatatatttgatttgtgtcacactctgatgtttatttatgcaaattactaagcatttgcgggatgacatattcaataatggagag

SEQ ID NO: 2488 - DNA, 736 bp, Primula obconica
gcttgcatatacatacacatatatacatacacatatattatatatatacctacttaattaacagctccaaaatcagcaccagctgatcattttaattagggcttttaattcgtataaaaacaaatggccgcaatatacagtctctacatcatcaataaatctgggggcttaatcttctacaaggattatggatcagcagggcggatggatacaaacgatagcttgagaatggccagtttatggcactcgatgcacgctatttctcagcagctgtctcccgtcctaggatgttccgggatcgagcttctagaagcagattcgtttgacctgcattgcttccaatcactcactgggacaaaattctttgtggtctccgaaccgggaacactacatatggatggccttctgaaacacatctatgaactatacactgattatgttttgaaaaacccgttttatgaaatggagatgcccattcggtgcgagctctttgatatcaacttggcacaggctgttcagaaagatcgtgtcgccttgttgggtcgatgatacttctcttaaaaccatatatgtagcattttaaggtttaattatgccctctagttgattttggcaagttcttcagatactgtttgtgtttttcgatcgatgatctcgatttatggtgttttctgtagtttttcttacatttattgatggaacttgatattgatgagaaaatttctttgagtaaatg

SEQ ID NO: 2489 - DNA, 1072 bp, Chenopodium quinoa
atcaaaatgaaacgaaaagaggatcatcactctcttaacaactcacggtgctgggtatagagatcaaagttgtaagttcttagtttctaacagcaactttgaaagcttgacctccacattaatttccttgtaatttcatcatttcgctccttatttcaaacatctccaattctcaactaaaccccagaaaaattagggttgaattgagatctcggcaattagggttcttctctgaattttccggatcaattggaattcataaatggcggccatttatagcctatacataatcaacaaatctggaggtctcatttactacaaggattatggatcagctggtagaatggatacaaatgatacattgagattagcgagtttatggcattcaatgcacgcaatttctcagcaattatcgcctgtttcgggttgttttggggttgaacttcttgaagccgatacctttgatcttcattgcttccaatctctcactggaacaaagttctttgtggtatgtgaacccggaacacaacatatggagcttctcttgaagtacgtttatgagctatacacagattatgtgctaaagaatcctttttatgaaatggagatgcctatacgctgtgagctctttgacatcaaccttactcaagctgtgcagaaggatcgtgttgctttgctaggccgatgattgatcttaatcactcaagacaaaactaccagttttgtaaatttgctcctattcaacttttctctcattacgtttcatgatattacagtctgctgcgcgtttttagtttgtcttgctgatgagtagttgtaagaggatgccctctttctggaatcaggctgtctggtatgttaactgcagatacatgggggtatcagagtataatgaatttgtctttgcagtaattgggtatattggaactttggaaggattgtgttatcattctaaatgacctataaacgatttgtatctcggttagtataagggctttttattttatttactacggagtagtatttatttatttttggccatcataaaacgttattataaaattaagacaag

SEQ ID NO: 2490 - DNA, 754 bp, Carthamus tinctorius
cataggcgggggcgtcctttttccggttgctctgatctcttttcttctcaccaccatcgctctgatctctcctattaatcgcaggttcttgccgcatgcatctctgaagttctgaactacttggagttttgcagaatctgctacaacaatggccgcaatttacagtctttacatcattaacaaatcagggggtctcatcttctacaaggattacgggttagcaggaagaatggatacgaacgatagtttgagattggcaagtttgtggcattcgatgcacgccatctctcagcaattgtcccctatttctggatgctccggtatcgaactcctcgaagctgacacatttgatctccattgctttcagtctcttaccgggacgaagttttttgtggtatcggagcctggaacgcagcacatggagcatctgttgaaacatatctatgaactatacacggattatgttttgaagaatccgttttatgagatggaaatgccaattcggtgtgagctctttgatatcaacttgtcacaggcgatacaaaaggaccgtgttgcgtatctcggcagatgaatcaacgcatacgaacccatcaagaacttttaatttcggtttgtatcaaagaatgttccgtaagtggtgtcattactttccaagtgaattagacagacatataccaacacaagtaccagacctttataagtgattgtaattttgttgttgcctattctaagcaaaattcttttcccaaaa

SEQ ID NO: 2491 - DNA, 857 bp, Glycine max
ctcatactctcatttttctttctctgctctctggtcataaatcgtgtcgtgatttcccccattctagagtgtgagtgagcaccctgcttcgattggcctctgcctcttcctttgtttgaatggttttcgttgcaaattctggataagtttttggaatggcagcaatttgcagtctttacatcatcaataagtctggtggattgatatactataaggattatgggtctgctggacgaatggataccaatgacagcttgcgggtggcaagtttatggcactcaatgcatgctatctctcagcagttatcacctgtttcaggttgtttaggaattgaacttcttcaagctgatacttttgatcttcattgctttcaatcactgacaggaacaaaaatctttgtggtgtgtgagcctggagcacaatacatggaaagtttattgaaatttgtctatgaattgtacacggactacgttttgaagaatccgttctatgagatggagatgcctatacgttgtgagctcttcgatatcaacctaacacaggcagtacaaaaggatcgtgttgcatttttgggccgataaatttatatatgactcttctaatttctatattctgatgagtacatataatctgaaaattgtcattcaatttcttgtaagggacgagtttcttttactactcctagcctttgtattttatcaagatttacaatgtctaagacaagtttccagacatacgagattctgcatttcgagcaatgtttttcatatggtagtagttagaaattgcttgtgtatatgcctacatagttaccttggcgtatggtttgtactgcggatgtaatttattttcacatg

SEQ ID NO: 2492 - DNA, 689 bp, Allium cepa
attttcggagtaatcgcttcagtctgcagtctctttatcattaataaatccggcggtctcatcttctacaaagattatggttcgacagggagaatggatacgaatgatagcttgagattggcaagtttgtggcattcgatgcatgcgatttctcaacagctgtctcctgttgttggatgtaatgggatcgagctactacaggctgacaattttgatttgcactgttttcaatcgcttacaggaacaaaattctttgtagtatgcgagcctggaaccccacaaatggaaaacctgctgaagcttatttacgagctgtatacagattatgtattgaagaatcctttctatgagatggaaatgcctattcggtgcgaactctttgacctcaacctctctcaggctattcagaaagatcgacttccactcttaggacggtagataactagcctactttatggaattatcgggtgagttcctcccctccattgctggtaataaatttgtatggtaagtccgtcgtgcttagcgttgtattgactatatatctgagaaggttttggagcaattcctgttttccctacataggcatggcacgcatcaattttgtgctttaaatggtctaataaaccttggaagatcgtgagatagatacagtgtgcgctcgtatgtcattgttctctttctgtttt

SEQ ID NO: 2493 - DNA, 922 bp, Vaccinium corymbosum
agtgcaaaaatctcagtccctttcgactccgagacaaaaacgaaaatggcagctatttacagcctctacatcatcaacaaatccggtggcctcatcttctacaaggattacggatctgctggacgcatggacacgaacgatagcttgagattggccagtttatggcattcgatgcacgctatttcccagcagctatccccggtttctggatgctcaggaatcgaactgctcgagccgatactttcgatctccattgctttcagtctcttactggactaaattttttgtggtctctgagccgggaacgcagcatatggacggcctcttgaaacacatctatgaactgtacacggactatgttttaaagaatcccttctatgaaatggagatgccaatccgatgtgagctctttgatataaatctggcccaggcagttttgaaggatcgtgttgccttgttggggcgatgaaatttcccttggaatcggttcccggttatggattcactcgaggcagcccccgatgaagaggcaatgaccagtgaacgaagaaatagtagatggcaagtgtttatttaagccctagagagtggaaatagttagataccatggaggaagtacagcaactggactgaaagcatgaatccattgcagctcgattgtggaagttgtatcaccattcagaatcttattttgactctgtgtttggtaaattccttcactttcccatttagttccgagatgaatgctccagttttctgtgtttcaccgtccatatgattgtgtgctatatgacatgaaacttagcatgattgtgtgctatattgtttttcgcattttatgtactctaatacgggaggcaaataaaacgcggccttaataggtcattgggcgcgttttgttattgttaattacaatattatt

SEQ ID NO: 2494 - DNA, 689 bp, Flaveria ramosissima
cccaacaagcatcgacgatttatcgtttgcagtcgaactaagaaactcgatctgtcttctgcaaacaaggaatggcagccatttatagcctttacatcatcaacaaatcagggggtctcattttctacaaggattatgggttacaaggaagatggatacgaacgatagcttgagattggctagtttgtggcattcgatgcacgccatctctcagcaattgtccccaattccgggatgctctggtatcgaacttctcgaagccgacacatttgatctccattgctttcaatctcttactggaactaagttttcgtggtatctgagcctggaacacaaaatatggagaatctgttgaagcatatatatgaactatacacggattatgttttgaagaatccgttttatgagatggagatgccaatacggtgtgaactgtttgatatcaacttggcacaagcaatacaaaaagatcgtgtttcatatctagggcgatgaaacaaaggttttgcagacacaccgtatttatctacccggctgctttcatttggattacgtgagcagttgaattaagaattgtctgttaagtgatcttattactttgcaaatatattagacatatcgtttgaaatgtgctgaatatgtttcttgtatgatcagttcctcaccattgatgttctaaaaaaaatatt

SEQ ID NO: 2495 - DNA, 2567 bp, Panax ginseng
gatttccccaaattgcagtgaatctcccctctctcttcttcgctgatcgcggcggtgaagtgggtttttagggtttaacctaaaagatggcgccgccgggaactgtcgccggtggtggtggtcggcaacaacaagagcaacaacaaccgggatttggtaagtcaatacaggggataataaggattgctatattttggtactttgcctccaaattcttctccccaaagaagccttccactggttctgagccctcacttcagatctccaatctcttccccaaagccgagcccctggatatgtggctttatctttccgaatatgaaaagttaaatgatttcggtagcgaaggtgtacttgtttggcatgagacgaatataccttatgcagtttggggatccgagagtaccaggtctctctcaatgaagtattatccatctgaggctttgaagcacaatgggagtctttatgctcatgttttctttgcacgatctggctatcctccagatcccaaggatcccgagtaccagccgaatgctgccttcggaaggacacaccctgttgtgacatacttgccaaaatctagagcagacaaaaagaggagtctgttagcaaattccgatggcagcagtgaagctgtgcctgaggtggttgaagactctcaagttgattccaaggatgtcggtccagtggaatggatttcatactggaaaccaaatatcaccatcaatttggttgatgattttacaagatactcctacaatgctattccaccaaatattgccccttacttgaatgtcgaacctggtacacagggctactatccaaccattttcttcaatgagttttggttacttagagataagttaataccaatcaatgagactgtgaccgagttaccattactgctagaagtgggtcccataagcatgacaaagtggcaattattcctgcagattgatcagtcgtttcagattcaccgtagttatggcagcatgcttgaaggcgaggctgacgaactcaagagagtattcttggaaggaaatccctacatactgatgattaccatggttgtctcattacttcattctgtattcgactttttggcattcaagaatgatattcagttttggaacaaaaacaagtctatggaaggactctctgcgaagtccgtaattgtgaacttcttttgtcagctgatcgtattcctgtacctacttgacaatgatacttcatggatgatacttgcaagttctggggttggttgctgcattgaattctggaaaattgggaaagccatgcacatcgaggttgatagatctggaaatatacctaggttaaggttccgtgaccatgaatcatatgctggaaacaagacaaaggagtatgatgatcttgcgatgaagtatttgtcatatgtgctctttcttcttgttgctggctcttctgcttattctctcaagtatgaacgtcataagagttggtactcttggatcctctcatctcttacaagctgtgtctacatgtttggttttattatgatgtgccctcaattgttcatcaactataagctgaagtcagttgcccatctaccttggaggcagatgacatacaagtttcttaatacaattattgatgatctctttgcctttgtgatcaaaatgccactactacatcgactttctgtcttccgtgatgatgttatatttctgatctatatttatcagaggtgggtctatccagttgacaagaaacgagtaaatgaatttggttttggtggtgaggacgcagatcaggcttctggctctgggagcacagatgtgacaactgtgaacgaagaggagaagaaaactaaatgagctggttttctttgaataatttgaaattttacagccctacgatcttgtaaaattcagtcagagatttgatttgttttagtgttttttttcctgatcgaatttagtacgacgacagtaaaaacacttctttacaaatgttatgatgatcgctttcttttcactcgaagaacttgtataggcatatttttgtctccattaatttacagcctttacatcatcaacaaatccggtggcctcattttctacaaggattatggctctgcgggacgtatggatacaaatgacagcttgagattggctagtttgtggcattcgatgcatgcaatttctcagcaattatcacctatcactggatgtttggggatcgaacttctcgaggccgatacttttgatctccattgctttcaatctcttactgggacaaagtttttcgtagtttctgagccaggaacacaacatatggagggtctgttgaagcatatatatgaactctacacagattatgttttgaaaaatcctttctatgaaatggagatgccaattcggtgtgagctcttcgacatcaacttgtcacaggcagtacagaaggaccgagttgccttgctgggacgatagaacaaactatcctgtgtttcggaaaacataaatgacatgatctgttgttttgtatatttaagagggatattcaagttctgtagtttgtcaagaagc

SEQ ID NO: 2496 - DNA, 728 bp, Humulus lupulus
gctaatgcagtgaccagtggttcataattctctgcaagttttgcctctgaataaaatttgtgtcctagagaaggggaagggctttggaaatggcagcaatctacagtctctacattattaacaaatcaggaggtttaattttctataaggattatggatcggcaggacgtatggacaccaatgatagcttgagggtggcaagtttatggcattcgatgcatgctatctcgcagcagttgtctccggtttcgggttgctttggaattgagcttctccaagctgacacctttgatctccattgcttccaatcactaacggggacaaattctttgtggtctcagagcctgggacacaacacatggaagatctcttgaaaagcatctatgaattatacacggattatgtcctaaagaatcccttttatgagatggagatgcccataaggtgcgagctttttgatataaatctaacacaggcagttcaaaaggatcgtgtttccttgttgggcagatgaactagtatttagttaagcttatatgatctgaggtcatatgtacatctttaagcaatctcatgtactctttgaaattgatgtttttgagtcacactcacactggcttttccaacatgagtaactgagatattgtttagttgggaactcgtgttttcttccttgagatcttcataaggatttcaccttagctttatactatatgcccattccttga

SEQ ID NO: 2497 - DNA, 709 bp, Daucus carota
tttacaacttcgaatccagaagacgagcaattaacagttagaagccgtgattcaccctgctctggccattcccagctcagcgattcttcttcaggtttaattaattaattaattagttcgggggttgaaagttgcgtttacctcgccaaatgcctgcggtttacagtctttacatcatcaataaatctggcggtctcatctaccacaaggactatggctctgcgggacgtatggatacaaatgacagcttgagattagctagtctgtggcactccatgcatgcaatttctcagcagttatcgccagttgcaggatgcactgggattgaacttctcgaggcagatacgtttgatctccattgtttccaatctctaacagggacaaagtttttcgtggttgctgcgcctggaacgcaaaatatggagagcctattaaagcatatctacgaactatacactgactatgttttgaaaaatcctttttatgaaatggagatgcctattaggtgcgagctctttgatatcaacttgacacaggcaattcaaaatgaccgttttgcattgcttggacgataagtgccatgctcttttctaaagactaatttgggtatctagtgcataagtatggtatatttctgtgggacaaaacattctgttgtttgtaggcatctctgtatcccttttcttttgaccttataccgaatgcagga

SEQ ID NO: 2498 - DNA, 814 bp, Cichorium intybus
aactataagatgaaatctgtaacaaaatcatttcacgattccgattcataatcttaggttacgaacaagaaaaagtttttgggttttttgtgattgctcagacgtctgaactaccgaacctggatctgtgaagttttactcaatcggctacaacgaatggctgcaatttacagtctttatatcatcaacaaatcagggggtctcatcttctacaaggattatgggttagcgggcagaatggatacgaacgatagcttgagattggcaagtttgtggcattcaatgcacgccatctctcagcaattgtccccaatttcgggatgctccggtatcgaactcctcgaagccgacacatttgatcttcactgctttcagtctcttactggtacaaagtttttcgtggtatctgagcctggaacacatcacatggacaatctattgaaacatatctatgaattatacacagattatgtgttgaagaatcctttttatgaaatggagatgccaattcggtgtgagctctttgatataaatttagcacaagcaacacaaaaggaccgtgttgcttatcttggtcgatgagataacggattatgcgaataaacttgtaattttttttaatcaatttgtattttcggtttggatttatttgatttgaaacgaggatttttttcggtatgtgatgttttattgctttactagtgtattagacaaaatggtaaccaacagaactatatgaaatgtgtattttagtctttttacagcttttttactattaaagcccgtaaacttactttccgggtatgtttatgtg

SEQ ID NO: 2499 - DNA, 708 bp, Malus domestica
cctcttcttcgtcttcttctttctgtatacttgttttggattccgaaatagcccttggaaatggcagcaatttacagtctctacatcatcaacaaatcaggcggcttgatctactacaaggattacgggtcggcgggaaggatggacactaacgataccttgagggttgcgagcttgtggcactcgatgcacgccatttctcagcagctgtcgccggtatcgggctgtttcggaatcgaactcctccaagctgacactttcgatcttaattgcttccaatcactcactgggacaaaattctttgttgtctctgagcctgggacacagcacatggaaggtctcttgaaacatatctatgagctgtacacggattatgtcttgaagaatcccttctacgagatggagatgcctatacgatgcgagctctttgataccaacttaacacaggcagtacagaaggatcgtgttgcattgttggcccgataatttgcttttgaatttgttcttgtgtggctgttggcccgatgatctgcctgagaacttgtatggtatctgtagtttacaatcaatgtgttttgtacggtttgagctcacctcgactttggtgtgcgtaatcaatcagatataagcatcgactaattcaactttcaatcccaaatgtctacgtattcatttccagttaagaatacaacggcagttatgtgtttc

SEQ ID NO: 2500 - DNA, 754 bp, Artemisia annua
ccattttcacctattttatttcaatttcagatcacttctatacattctcaatacccttaattcatcgcttcatttttctatcaatctgaagaaaaaatggcagcaatatacagtctatacatcatcaacaaatcaggtggtctcatcttctacaaggattatgggttacaaggaagaatggacacaaatgatactttgcgattggcgagtttatggcattcgatgcacgccatttcgcagcaattgtctccggtttcggggtgtaccggtatcgagttgcttgaagcggatacgtttgatctccattgctttcaatctcttactgggacaaagtttttcgtggtttctgagcctggtacacaacatatggataatctgttgaagcatatctatgaactatacacagattatgtcttaaagaatccattttatgagatggaaatgccaatccggtgtgagctctttgatatcaacttggcacaggcaatacaaaaggaccgtgttgcatatcttgggagatgaatacaagtagacaaatctttatatctccaccttctgtttacagtctaaacttactattcgaaatttgaagaatgttccttgagtggtgttattaccttaaaagtgtactagcagataattgttgaatcaagtatttttttaagcaaataacttgagtatcattcggcctctccacatatattgttgagtaattgtattaatgacacaatggaatttgcccaatagagacacg

SEQ ID NO: 2501 - DNA, 1295 bp, Cannabis sativa
taataaataaattccacaagattttttttcctttttctcttcttttctttctcgattattcctcttctcaagcccaaggcatcgccgtcgacaatgtggtcgtcgtccttgtgatgccgagttggaggtagcttttgcttgcgaggttggtgttccgtactttagggttaacggcatcggcgacgaaggtgaataagccgagttttgtgttgtcgactacggggacgggggatgattgtgtacctggattagattccagatctaagttttcaagtgacccctggttcgtaattctctgtaaaatttgtttcctagtgaaggggaagggctttggaaatggcagcaatctacagtctctatattattaacaaatcaggaggtttaattttctataaggattatggctcggcaggccgtatggacaccaatgatagcttgagagtggcaagtttatggcattcgatgcatgctatctcgcagcagttgtctccagttttgggttgttttggaattgagcttctccaagctgacacatttgatctccattgcttccaatcactaacggggacaaaattctttgtggtctcagagcctgggacacagcacatggaagatctcttgaaaagcatctatgagctatacacagattatgtcttgaagaatcccttttatgagatggagatgcctataaggtgcgagcttttcgatatgaatctaacgcaggcagttcaaaaggatcgtgtttccttgtttggcagatgaactggtatttagctaagcttatatgatctgagttatttccttttttatatgtacatctttgagcaatctcatatactctttgaaaacaatgttttgaatggcattggcttttctaacatgagtaactgagatattgtttagttgggaactcatgtttcttccttgagatcttcataaggatttcaccttagctatatactctatatgcctattcttgccttgttgaaacttgaaaccaaaatgaattcaattctattttgagagagagggagaggtgggaagagggcaaattagtcaaattagtggagatgcccactattcttgtggaagatttgaaggcaaccaaaactatgaagaaacaagctaaaattcttcaatcttcctaatatgcaaattttggtaaaatgcaggtgtaaagcaatgtgatgactagtccactagggattcgacttgtataatccttttcccaaaaattttatgagttaattttctaattaattaacatattcttattgccaattaatttcaaaaat

SEQ ID NO: 2502 - DNA, 815 bp, Cynara scolymus
cgcgggctttaacatgttaccctgcccatatgattcagaagcgtcctttttcgaggaaactctatctctttaacctcgctactgtcgctctgatctcttctgttaatcgcaggttcttgccccttgcgtctctgaagttctgtactacttggagttttgcacaaggatggccgcaatttacagtctttatatcattaacaaatcagggggtctcatcttctacaaggattatgggttagcaggaagaatggataccaacgatagtttgagattggcaagtttgtggcactcgatgcacgccatctctcagcaattgtcccctatttctggctgctccggtatcgaactccttgaagctgacacatttgatctccattgctttcaatctcttaccgggacgaagttttttgtggtatccgaacccggaacacagcacatggagcatctgttgaaacatatttatgaactatacacagattatgttttgaagaatccattttatgagatggaaatgccaattcggtgtgagctctttgatatccacttgtcgcaggcaatacagaaggaccgcgttgcgtatcttggccgatgaatcaatgcaaacaaaccccattaaaacctttttactttcagtttgaaccgaagaatgtccggtaagtggtgttattactttccaagtgaattagacagacatcttagcaaccaacacaagtagcagaccttttcggatataaatgattcctgttctaagcaaaatccttttcttaacccgggtacgggtacgggtacgggtacgggtacaggtacaggtacag

SEQ ID NO: 2503 - DNA, 858 bp, Echinacea purpurea
cggccgggggattaacaaccaactaatgagaccccctctcattgaaacccctttgtaaattatcacatcacgccaaccaattctctagcggttgcatctgtgaagtgacaacaaaccagctggatctgtaaacgatggcggcaatttacagcctttacatcatcaacaaatcagggggtctcatcttctacaaggattatggattgcaagggagaatggatacgaatgacagtttgagattggcgagtttgtggcattcgatgcacgctatctctcagcaattgtctccgattcagggatgctctggtatcgagcttcttgaagcggatacatttgatctccattgctttcaatctcttactgggacaaagtttttcgtggtatccgagcccggaacacaaaatatggagaatctgttgaaacatatttatgaactatacacagattatgttctaaagaatccgttttatgagatggagatgccaatacggtgtgagctctttgatatcaacttggcacaagcagtacaaaaagaccgtgtttcatatcttgggcgatgagcaagcaaaccagcattgatgtatctgacccgttcggatttatttgagcacctgaattaaatgtatgttttttaagtgatgttttgaatttccaagatatctttcgaataaacatgtgtttctttggcaaaattgatccttagtttaaaaaaggtgcgactgagaagacgataagtgtacctgaggtgcggtaaatttatgtagatttgcaaatgggcagatattgttgtacgtatagtttttggaattttactcaactcgtacttctaaattacaccaaattaatcataatctaccc

SEQ ID NO: 2504 - DNA, 752 bp, Echinacea purpurea
gtaatcaatggcggcaatttacagcctttacatcatcaacaaatcagggggtctcatcttctacaaggattatggattgcaagggagaatggatacgaatgacagtttgagattggcgagtttgtggcattcgatgcacgctatctctcagcaattgtctccgattcagggttgctctggtatcgagcttcttgaagccgatacatttgatctccattgctttcaatctcttactgggacaaagtttttcgtggtatccgagcccggaacacaaaatatggagaatctgttgaaacatatttatgaactatacacagattatgttctaaagaatccgttttatgagatggagatgccaatacggtgtgagctctttgatatcaacttggcacaagcagtacaaaaagaccgtgtttcatatcttgggcgatgagcaagcgaaccagtatttatgtatctgacccgtccggatttatgtgagcacctgaattaaatgaatgttttttaagtgatgttttgaatttccaagatatctttcgaataaacatgtgtttctttggcaaaatggatccttagtttaaaaatgtgcgactgagaagacgataagcgtgcctgagctgcggtaaatttatgtagttttgcaaatgggcagatattgttgtacgtatagtttttggaattttactcaactcgtacttctaaattacaccaaattaatcataatctaccctatacaatgaatggaaccctgc

SEQ ID NO: 2505 - DNA, 528 bp, Echinacea purpurea
ctagtgcttgcatctgtgaagtagtgacaacaacccagctggatctgtaaacgatggcggcaatttacagcctttacatcatcaacaaatcagggggtctcatcttctacaaggattatggattgcaagggagaatggatacgaatgacagtttgagattggcgagtttgtggcattcgatgcacgctatctctcagcaattgtctccgattcagggttgctccggtatcgagcttcttgaagctgatacttttgatctccattgctttcagtctcttactgggacaaagtttttcgtggtatccgagcccggaacacaaaatatggagaatctgttgaaacatatttatgaactatacacagattatgttctaaagaatccgttttatgagatggagatgccaatacggtgtgagctctttgatatcaacttggcacaagcagtacaaaaagaccgtgtttcatatcttgggcgatgagcaagcaaaccagtatttatgtatctgacccgtccggatatatgtgagc

SEQ ID NO: 2506 - DNA, 847 bp, Eschscholzia californica
acccaaatcatgttgtagagatcaaccgagagaccgaagctacccaaatcgagttggtaaagagagaaaagggtttaatcttctacccaaatcaagttgtaaagatcaacccagagtttatttagaaaaaaagacaagaacagcaggggaagggggtaaatcaaaggtacactcactacttaagtcatattccttcaagaatcagaaatccaagttaagaaatggctgcaatttacagtctttttatcattaacaaatccgggggtctcattttctacaaggattatggatctacaggtcgaattgatacgaacgacagtttgagattagcgagtttgtggcattcgatgcacgccatctcgcaacaattatcacctgtattaggttgttcaggcattgaactccttgaagctgatacctttgatctccattgcttccaatcactaacaggaacaaagttctttgtagtgtccgagcccggaacacaacacatggaggatcttttgaaagtcatttatgaactttatacagattatgtcctaaaaaatcccttctaccagagagagatgccgattcgatgtgaatcattcgattttaatctcttacaggccattcagaaggatcgagttgcgttgcttggccgttgaaaccaataacttagcggtcgactgattttttctaaatttagtaatccatttgcttataactcttgtcgagttgatgtttataatctagagggtggagctaaaacgtttcaaaccattgttatgagatttctgttaattttgacttaatcatgaacttgagaactgaatattgtttgagagatacaggcctattaacgacg

SEQ ID NO: 2507 - DNA, 695 bp, Fagopyrum esculentum
cggacgtagttcctcgaaggaacgactaggtaggtctacgaacgacgagacggtagggggggcgagaagtctatcgatcaggacaatagatcgacaaaggtgaagaaattcgtccatcaatggcggcagtttacagtctgtatataatcaacaagtccggtggtctcatcttctacaaggactatggatcagctggtaggatggacacaaatgatagcttgagacttgcgagtttgtggcactcgatgcatgccatctctcagcagctatccccagtcaccggctgcactgggatcgaactcctcgaagccgataccttcgatcttcactgtttccagtctctcactggaacaaaattctttgtggtttgtgagcctggaacacagcatatggataatctgttgaaacacatctatgagttgtacacagactatgtgttgaagaatccgttctatgaaatggagatgccgataagatgtgagctctttgacattaatctggcaactgcagtgcagaaggatcgtcttccattgctagggcgttgatctaaatgaactttcttaaacaaaatcatgtacttttctctatagattgctgttgagaaaaactgattaggttacagacttgtattcataaattgtttctcatctgaatctaagctttagattgaagtgactaacatttggacggtttct

SEQ ID NO: 2508 - DNA, 746 bp, Linum usitatissimum
cgatctcgtttcactttcagttcaaagatttccaagagagctcagacgcttccattcgaaaatggctgccatttacagcctctacatcatcaacaaatccggtggcttgatcttctacaaggattatggatcttctggtagaatggacacgaacgacagcttgcgagtggctagtttgtggcactcgatgcacgccatttctcagcagttatccccaattgttggctgtacgggcattgagctccttgaagccgataattttgacctccattgcttccaatcccttacagggacgaagttctttgttgtgtctgagccaggaacgctgtacatggagaatctgttgaagtacatctacgagcagtatacggattacgtgttgaaaaaccctttctatgagatggagatgcctatcagatgtgagctcttcgacatcaatatgtctcaggctatacagaaggatcttgttgctctgttgggtcgatgaatgttctggaattgcaatcaatgtcttgatttgatgtttggtaatggagattttggattgccagcaaaattatgcagaaagaacagaaatattttgttcttcctgtcttcagtgccttttcttcgctgtaaacatgcgttactctcactttcgagattggctgttatgtagctccaagttttttagggtttgagattttgatcgcagtacatcggttgatgttttgttcaaacgggtacgaaaactactgatgttctcg

SEQ ID NO: 2509 - DNA, 753 bp, Panax ginseng
taagcagtggtatcaacgcagagtacatggggagagaacctcttctctctcaaaacattcctcctaccagcttaatcagagggaagacagcagtgatcaggctcgatctcagatctcaactcagcccaacaccagactgataacaaataacttgcggtttttgtcaggttaccataacaactacaccgagaaatgccagtaatttacagcctctacatcatcaacaaatccggtggcctcattttctacaaggattatggctctgcgggacgtatggatacaaatgacagcttgagattggctagtttgtggcattcgatgcatgcaatttctcagcaattatcacctatcactggatgtttggggatcgaacttctcgaggccgatacttttgatctccattgctttcaatctcttactgggacaaagtttttcgtagtttctgagccaggaacacaacatatggagggtctgttgaagcatatatatgaactctacacagattatgttttgaaaaatcctttctatgaaatggagatgccaattcggtgtgagctcttcgacatcaacttgtcacaggcagtacagaaggaccgagttgccttgctgggacgatagaacaaactatcctgtgtttaggaaaacataaatgacatgatctgttgttttgtatatttaagagggataatcaagttctgtagtttgtgaagcagtatatttttgaacctaaacaatttcagttttaattttttt

SEQ ID NO: 2510 - DNA, 793 bp, Liriodendron tulipifera
gaagttgaacactgacaaaacccccctaggatttctggagaacagatccaacgcaaaaacctctctcattttttttctcccgaaattccttttatacccttcccttcccgagatctattccccatcatctgattcttcacatctcctttaatggctgcgatctacagtctcttcatcatcaacaaatctggcggtctgatcttctacaaggattacggatcggcgggacgaatggatacgaacgacagcctgcggttggcgagcttatggcattcgatgcatgctatttctcagcagctgtctccgaccgttggatgctcgggtgtcgaactcctcgaggcggatacattcgatctcaattgctttcagacgctgacagggaccaagttctttgtagtctgtgaacctggcgcacagcacatggacagtcttctgaaactcatctatgaactttacaccgactatgtcttgaaaaatcctttctacgaaatggaaatgccaattcggtgcgagcttttcgacctcaaccttatgcaggcagtccaaaaggatcgtgtccttttgatgggaagatgaacaacggctgatgataccgatgactgaattgacaccacctacattttttggtgatcatcatgcatcttgggtcatcgtcattgacgctagggctgtgaaacaaatggctcagtcatctgcatcaaagaaagataaaatagctgtaagtattgcaaatttaagtatgtttctttaataaatgaagttgcattcaactcctaatggcgcaaaggaattt

SEQ ID NO: 2511 - DNA, 926 bp, Lotus japonicus
gggagtcatttaaccggccggttcaatatctctctttggaaggagcaacatcgagctacagttatcaaagcttgaaagtgaaaggaagatcgggagtggatcttgtgtgagctttattcgatcgaattctggtaaaggcttttggaatggcagctatttacagtctttacatcatcaacaagtctggtggattgatctactataaggattatggatctgctggacgaatggataccaatgatacgttacgggtggctagtttatggcattccatgcatgccatctctcagcagttatcacctgtttcaggttgtgcaggaattgagctactccaagctgacacatttgatctccattgcttccaatcactgacagggacaaagttttttgtggtctctgagcctggaactcaacaaatggaaagtttattgaaattcgtatatgaattatacacggattatgttttgaagaaccccttctatgagatggagatgcctattcgttgtgagctcttcgatatcaacctaactcaagcagtacaaaaagatcgtgttgcattgttggcccgatgaaccccttctaggtttttgttcaaaaatattctgcactctcctaaatttgttattcaatgtcttgtatggggtgctactctcttttactagacaagttaatgtccaacgaccaataggtgaaattcattatttgctcccatcccttttctggtacaaatgcagtgccagtgtgtgtctatgtagatcactactatcttaccatttggtgattggttcaggggtatgtggattcaccaaaggtggtacaaggatttaggtttgagtgttgtgtataaaaaaatgttggaaaagttagtttcaccgcattgtggcacgatgtggatatttccaaatttatgtctttgaagtgtatga

SEQ ID NO: 2512 - DNA, 1564 bp, Lupinus angustifolius
agagggttccacacaaatttctcatcgtcaaacaaggcacagttaagtgtcttcatcacattcagatctctcgcaaaaacgcatcacattcataggttacttcactttttatctcctctcaatcttccttagcaatttcacttcaacaattatatatatatttttagatttgttcggtcaccgattccatcattcattaactttttttagatttgttagaaatctagaatcaattttaagactttagatcaattgcactgttctcatatttaaattgaagtacatgcctttaactaatttagacttggttagtttttcttgtatgaaatgatctatctacctgataaagttaacacattagttcagacttcagagtctgagcataaaggtaattccttgattcttccccaaaagaaatgcaacataagggaagggaatgtgcaacatgatcgatgtatctctctaattattttttgtataataaatgatattcataaattgtggttcttattgggttatgtgatacttgttggttgtcatggtattagggttatctatttgaattttatattttaggatattgataaaaagggctgctcagtccatgaggctcccacatagtggggtatggggtggtagatgtatgtaattttagttttatcatcggaagagactgtttccagaatttgaactcatgacttctaggccacaatgcaaacaacctttatgttgcgccaaaactcaccctctatattttaggatattgatggattataaatattttatactcatgtttatcttaattgatgttcacctatgctattacttggttgttaattctactctaaatcatgagcttgtgctgttgtggtaattattaaatttgaaagttcccttgttaaactccatcatcatctttatttcagattctagcataacttggaatggcagcaatatgtagtctttacatcatcaataagtctggtgggttgatctactataaggattatggatcttctggtagaatggataccaatgacagcttgcgggtggctagtttatggcactcaatgcatgccatctctcagcagttatcacctgtttcgggttgtgcaggaattgaacttctccaagctgacacatttgatcttcattgctttcaatcactaacagggacaaagttttttgtggtctgtgagcctggaacacaacacatggaaactttattgaagtttgtctatgaattgtacacggactatgttttgaagaatcctttctatgagatggagatgcctatacgttgtgagctctttgatataaacctaacacaggcagtacagaaggatcgcgttgcatttttaggccgataaatttatctgatcaaattttgtttttcatttctacattctgatgtgtacataatctaaaaattgtcgcacaattgcttgtaaggtacaattctcttttactatgcctaccctcagtatttgctttttacaaacaaattttgcagtgtttgacaaatgacaaattcttcagaattccactgtctaagattcctcat

SEQ ID NO: 2513 - DNA, 802 bp, Tropaeolum majus
cagcaaaaaagagtggaataaacaggggttggactgattttatattagttgtcaaatgattcgaagaaagaataactgaagaacaacggaacaaattttgtattgagacttctgctcttctgttgtattaaggtggagcacaatatcatcttataactgagctggaaaacccagacaatggcagcaatttacagcctttacatcatcaacaagtcaggtggtttgattttctataaggattatggttctagaggccgaatggacacaaatgatagtttgcgggtggctagtttgtggcattcaatgcatgctatctcacagcagttatcacctaccactggctgttcaggaattgaactcctcgaagcggacacctttgatctccattgcttccaatcactgactggaacgaagttctttgtggtctgtgaacccggaacgcagctgatggaaaatcttttgaaaataatatatgaacgatacacagattatgtattgaagaatccattttatgaaatggagatgcctatacggtgcgagttatttgacatcaaccttacacaagcaatacagaaggaacgtgtcgccatgttgggacgataaaattccttcactcgaaacttgtagttaatctgtttgttttatttttggtttatgtatttctatgacatcaacatcttcttatgggtctgttttttttcttcataaaccgaccggttcgatgtaggattgtgaatgcgattgtgaaactctttgtattagattcagatgttttattacagggagaaaaatacgagcctac

SEQ ID NO: 2514 - DNA, 1135 bp, Carica papaya
accagtgtagtcggtgcaaggggagaggggacgggtttgtggattttttgggagtgaacgaaggatcagagaaagcgttcagattggaaaaaaagtaaggaatttcggatttgagtggggtgaatcaagagcacacggagaagcaattccggaatcctaaaggcaatcatagtatagggagctccggtttgttgggtagatctgttgtttaaaagctgatttgtgggaaattgagagagctttttgtagaggtttctggaaccaagtggagaggaaaatcataggcgagttgagggggaagcgggctcggcttctattaggaacgattgatagaatttgtggagagctcttgagaatggcagcaatctacagtctctatattatcaataaatcaggtggcttgatcttctacaaggattatggatcggagggacgtatggacacaaataatagcttgcgagtggctagtttgtggcattcaatgcatgcaatctctcagcagttatcaccagtcactggttgttcaggaattgaactcttggaagcagacaaatttgatctccactgcttccaatctcttactggaacaaaattctttgtcatctgtgagcctggggcacagcacatggagaatctcctaaaatttatctatgaattgtacacagactatgtgttgaagaatcccttttatgaaatggagatgcccattcggtgtgagctatttgatgtcaatctcacacaggcaatacaaaaagatcgtgtagccttgttgagtcgatgaaaatgcattggaacatgcaacattgaatttgttgtttgttttattgtctttgattttattttttcattacggtgagttatcttctgctgctttgcattgtctaatgcttcatatggatggaagctgaccttgccctggcacagacctggcagaaaatacccattgaggtctaggtcctttctgccttgcactatgattgtaacaaaattctgtcttgagctgtccaccaacaaggctactattgaaccaaaagaattgctgctgtttgtaagatgccttatatataggatatctaattgctaccttgttgggatgtttaatccatgatctatgttaaaaatttatgatgatcta

SEQ ID NO: 2515 - DNA, 1097 bp, Glycine max
agcaatggccatcttgtaggtgccatctgaaagctaccgacaccttctttctaacgcacgcacgcttgcacgtgtcgtccctttcctccgatctccctgaaaataccgcaaccctttgatctccgtttaattccctttgcatctgaaagaagaaactcacagtggcttacggtcatcgatttcatagatctattaagattatctggaatggcagcaatttacagtctttacatcatcaataaatctggtggattaatctattataaggattatgggtctgctggacgaatggataccaatgatagcttgcgggtggcgagtttatggcactcaatgcacgctatctctcagcagttatcacctgtttcaggttgtttaggaattgaacttctccaagcagatacatttgatcttcattgctttcaatcactgactgggacaaaattttttgcggtctcggagcctggagcacaacacatggaaagtttattgaaatttgtctatgaattgtacacggactacgttttgaagaatccgttctatgagatggagatgcctatacgttgtgagctcttcgatatcaacctaacacaggcagtacaaaaggatcgtgtcacatttttgggccgataaattgatatctgaccgttttcacatttctctattctgattagtacataatataaagattgtctttcatatgcttgtaagggattgtgttacagctcatagcctttgtatttgctttttacacacaaatgaagatttactatgtctgaggaatgacaagttttctggcatccgagcaatgcttttcatatggtggtagttagaaattgcctgtatgcctgcatagatcaccttggtgtatggtttgaggacagtgatgtttgggttcttgcatgatattcaatttggtgtacctggtaatagttagttgcaatgttccatgtaactcttactcagctgattactggaaattccaatcagtttactgttctcaacgatccaaatctggtataataccgccgacacaaaaataatcacttagcatctgcttattttagtgttttgtaaagtgagatgataaggtgttc

SEQ ID NO: 2516 - DNA, 1106 bp, Glycine max
gattgttttgaagaaggttgttttcaaaaattttaaatggtgatcggagtcaataccaaataccaatagcaacgggtgcctcatgtaatcttcggtgtcatccaaaagctaccaaccaacattccttctttctcacgcacgcacaggcacgctcgcacgtgttgtcctctgatctccctgaaaaaccgcaacactaactcaaactattgatctccgtttaattccttttgaatctgaaagaagaaacagacggtggcttacggtcatcaattgcagagatctattaagattctggaatggcagcaatttacagtctttacatcatcaataaatctggtggattaatctattataaggattatgggtcagctggacgaatggataccaatgacagcttgcgggtggcaagtttatggcactcaatgcatgctatctctcagcagttatcacctgtttcaggttgtttaggaattgaacttctccaagcagatacatttgatcttcattgctttcaatcactgacagggacaaaattttttgtggtctctgagcctggagcacaacacatggagagtttattgaaatttgtctatgaattgtacaccgactacgttttgaagaatccgttctatgagatggagatgcctatacgttgtgagctctttgatatcaacctaacacaggcagtacaaaaggatcatgtcacatttttgggccgataaattgatatctgaccgttttcacatttctctattctgatcagtacataatctaaaaattgtcattcaattgcttgtaagagatcgtgttacagctcctagcctttgtatttgctttttacaaacaaatcaagaattactatatctgagaaaagacaacttttccggcatccgttacaagcaatgcttttcatatggtagtagttggaaatagcctgtatgcctgcatagattgattaccttggcgtatgtatggtttgaggattataatgtggatgtaattattttcccttggcgttgggttcttgcatgattgaatttggtgtactgggtcaataaatctggtataataccacacacacacacacacactaaaatcacttataa

SEQ ID NO: 2517 - DNA, 649 bp, Zinnia violacea
gcaagaaagcatggcggcaatttacagcctttacgtcatcaacaaatctggaggtctcattttctacaaggattatggtttacaaggaagaatggatacgaatgatagtttgagattggcaagtttatggcattcgatgcacgcaatctctcagcaattgtcccccattccgggatgctctggtattgaattactcgaagcggatacgtttgatctccattgctttcagtctcttactgggacaaagtttttcgtggtatcggagcccggaacacaaaatatggagaatctgttgaaacatatctatgaactatacacagattatgttctaaaaaatccgttctatgagatggagatgccaatacgatgtgagctctttgatatcaatctggcacaagcagtacaaaaggatcgtgttgcatatcttgggctgtgaaacaaagctttttcaaacaaatccgtatctatgtatccgcccctttcgggttgcttatctgagcctgttgaatcgatgaatgttgttttattactttccaaaatttcttcatagtattacttgtgagacgagttaaaattcaaactttctaagtgaaggtgtgcagtcttcatgacgacttaactgactgatgctgccattggcatactaatt

SEQ ID NO: 2518 - DNA, 738 bp, Nicotiana benthamiana
tttacagcctttacatcatcaataaatcaggagggcttattttctacaaggattatggttctgctggaagaatggacacaaatgatagtttgaggttggctagtctttggcattctatgcacgctatctctcagcagttgtccccattgtccccagttaatggctgcgccggtattgaactccttcaagctgataactttgacctccattgcttccaatctcttactggaacaaaattttttgtggtctgtgaacctggaagtctgcatatggaatctctgttgaagtatatctacgaattatacactgactacgccttgaagaatcctttctatgaaatggaaatgccaatacggtgtgagctttttgacataaatttgtcacaggcagttcagaaagatcgtgttgccttactggggagatgagcttcttgaactcatatgccgcaaattgttggttggtctattatctggtaaattttgctggacaggttgcattaggacatatgcaatgtgtgtttctttgttgtttcgggataatggccttgtaagatacattttgacaacagcaaccccaaataggatttgttatgcaaggttgtcattgctgatgttctgtagtgtcgttgaattacacgctctgcctgatctctcaagaaatggtaatgggacagatattgcaagcagcaggtgttgccttaaaaaattcacgacattgaccatattaacattaaacgac

SEQ ID NO: 2519 - DNA, 668 bp, Cucurbita pepo
cggggaagagcttccgaaactccccccactggcttatgatcggcgatcgttgaaactggattttgcgcctttgaatctacactgacaatcgctttcattccatttctttcataggacttcagaaatttcaacccggaaagatctgaagaggatggcagcaatttacagcctctacatcatcaacaaatctggtggcttaatcttctacaaggattatggatctgctggacgaatggacacaaacgatagtttgagagtggcgagtttatggcattcgatgcatgccatttcccagcagctttcgcctatttctggttgttcgggtactgaactccttgaagccgacacattcgatctccattgcttccagtcacttactggaacaaagttttttgttgtgtgtgagcctgggacactgcacatggagggtcttctgaagtacatttatgagttatacacagattatgtcttgaagaatccattctatgagatggagatgcctattcggtgtgagctctttgatatcaacctagtgcaggcgtgcaaaggttcgtgttgctttgcttggtcgatgagctttcgattatccttcatttgccagtataccatccacaattcaagaaagaaggctcatgatattgtgtccaaatacttgataatttgcctgc

SEQ ID NO: 2520 - DNA, 728 bp, Panax ginseng
aagcagtggtatcaacgcagagtacatggggagagaacctcttctctctcaaaacattcctcctaccagcttaatcagagggaagacatcagtgatcaggctcgatctcagatctcaactcagtccaacaccagactgataacaaataacttgcggtttttctcaggttaccataacaactacaccgagaaatgccagtaatttacagcctctacatcatcaacaaatccggtggcgtcattttctacaaggattatggctctgcgggacgtatggatacaaatgacagcttgagattggctagtttgtggcattcgatgcatgcaatttctcagcaattatcacctatcactggatgtttggggatcgaacttctcgaggccgatacttttgatctccattgctttcaatctcttactgggacaaagttttttcgtagtttctgagccaggaacacaacatatggagggtctgttgaagcatatatatgaactctacacagattatgttttgaaaaatcctttctatgaaatggagatgccaattcggtgtgagctcttcgacatcaacttgtcacaggcagtacagaaggaccgagttgccttgctgggacgatagaacaaactatcctgtgtttcggaaaacataaatgacatgatctgttgttttgtatatttaagagggatattcaagttctgtagtttgtcaagcagtaaatttttgaaacc

SEQ ID NO: 2521 - DNA, 2135 bp, Trifolium pratense
ttccttttcaataaccactttgcaacagatttaggttttagtttcttatagtagatttatgcactatacatttcaatctcatagagtttctaattccaagtgtttaaattaactctgaaacgataactatcattatcaatatagtttaatttgaacactagttaggttttgttcttgaatcttgagttgttaatgttaacattgttaaggttgtaaaattgtacctaaatgatttttgaatcctagagagtgtttaggttgtaaaattggctaaaaggagtcaggtggtggcaacagtgttcaatcctcatgctctgataaatagctgggtgtgtgctgtcttggttatttgtgtgtatcagtcaaggggcaaacaatttaaggttgtttgggagaacttatcctgtctctcagattctctctcgtctcaacctcgttctcaccaccagctcttctcttgcatctcacctcgctctgccgctcaccatcaccgattcgcttcgagttcgataacagccgccagactcttcattcttgatttgttttatgtgaggttattgatttctgaggttgattgattgtgagattctagcaaaggcttttggaatggcagcgatttatagtctttacatcatcaacaagtctggtggattgatctactacaaggattatgggtcagctggacgaatggataccaatgataccttacgggtggctagcttatggcattcaatgcatgccatctctcagcagctatcacctgtgtcaggttgttcaggaattgaactactacaagctgatacatttgatcttcattgcttccaatcactaacagggacgaagtttttcgcagtatgtgagcctggcactcaacaaatagaaagtttattgaaatacatatatgaattgtatactgattatgttttgaagaaccccttctatgagatagagatgcctattcgatgtgagctctttgatatcaacctaactcagtcagtacaaaaggatcgtgttgcactgttgggtcaataaatcgctgccctaggccaagtgttgttgatgactgtcttgtaagagatgctactctgttttattgtacctgtactatgtattttttacagaaaaactttttatgattcaaattcaaatatatgatattcttcatttcctaccatgtttttcccatacaaattatctgtatcactacctatttggtcatattttttaaccatatgcaatttgttatcgatgtgatgataatggtacatattaggtgaatataagtagtttggcagtcagttagttagatacaagtttatagttagatggttagattgttgttcaatatggtgaattaatttagtaaaagtagtttgttagtcagttagtaattgaaccccaaagcttattaggattgtgaattaagttccagacatccttagcaagaagagaaaaattggtggcagacttccctgatttctaagagtaactgtttaccaatttacccattggctagacttgctacccgaataaactctcacacttctgtcaatctgaccacaaacagttgtttgtttacactgcatagaatgaactgctacagaagtaatgatcattaactctatcaagaatgtagggaaaatcatgctttttaacctgggcagacaacaaagtaaatcccaaacacttaccatgtttataagtatgatggaattcgacaatagaaacatatcgagcaaccttagcattggctaaatttgaggagggcggaaacctggatttaggcaggttcacattgaaagttgaaaccagaaaagctagacaaaagtgttggagaatttccttgacaagttttgctcgagaagctttactctgagtgccaatttgcagaaggcatctacttgaaagccagtgctagatgttctttgatcaaaccttgatccatggcataataggtatgctagtcttttggggagaatagtcttaacttaattctgtcattaattatatgcatatcttatacatctcttcattcacatataaggttttcaaaggaattgtagggggcaaaggtgattgtgtgggttaaatggtatgtgtcatgctagtcaaaaagaaaagggtgtctttgacgc

SEQ ID NO: 2522 - DNA, 620 bp, Cephalotaxus harringtonia
atttccagcctgctcaaatttaaaccgatcatatacggtctaaaaccccaaaaacaggctacaaatcgtcaatttccagggttgtgtggagttaatttgcttgcttcgatttccctgcaggttggggaacaaaaagtatggccagcatttacaatctttttatcataaataaatctggcggtctcattttctacaaggactatggatcagctgggcgaatggacacaaatgatagcttgaggcttgcgagtttgtggcattctatgcacgcaatatcacaacaattgtcccctactataggctgtatgggtattgagctacttgaggcagatacctttgatcttcattgcttccaatcattgacgggaacaaagttttttgtggtcgccgagccaggagcccagggcatggagctacttctaaaatcaatatatgaactgtacacagattatgtcctaaaaaatcctttttatgaattggaaatgccaatcagatgcgagcttttcgaacttaatttagcacaagctatccgtaaggataaacctgtatttggtggccggtaattgattcatgtgtggtaatcgttaccttgcaaaggttctatagaaggcaaaggccaa

SEQ ID NO: 2523 - DNA, 764 bp, Raphanus sativus
ggggtttggatgttttgaatgaaagaatatgtcaaatattcttgttacgtttatccttatcgtatattcctctgtttctatattccctccttgtcttgaggatctacaactgtaactagtttatattggatcctccatgtacgtttgtgataaggtgagtaaatacaagctttcattgaataattttagcagacatggcagcgatttacagtctttacataatcaacaaatctggtggtttgattttctacaaggactgtggaacaaagggaaggatggatacgaatgatagcttgagggtagccagtttatggcactcaatgcacgccatttctcagcagctttctcctgttaatggctgttctggcatcgaccttctccaagctgatacctttgatctccattgcttccagtctctcccaggaacaaagttctttgtggtttgtgaacctggaactccccacatggagagcctcctcagatacatttatgaactctacactgactttgtcctcaagaatcctttctatgagattgagatgcctattcgttgcgagcttttcgacatcaacctttctcaagctgttcagtctgaccgcgttgctctcttaggacgatgacccccactagattgattctctcacttctttgccttttgtatgtgaacattgcaacaaaacccatcatttttttttgtcttgtttcattcttttcccttacatttgctcaggaaagttgggcaaaaattaaaagaccctttgttt

SEQ ID NO: 2524 - DNA, 662 bp, Helianthus annuus
gtttcgtgaaacaacatcatttgctgtcgttgatccgagaccttcgaatatctgtttgtataacttcttcttcttgctagcgaacagcactcaaatcagggatctgtggaattatggcagcaatttacagcctctacatcatcaacaaatcagggggtctcatcttctacaaggattatggattacaaggaaggatggatacgaatgatagcttgagattggccagtttgtggcattcaatgcacgcaatctctcagcaactctcccccattcagggctgctctggtatcgaacttcttgaagccgatacatttgatctccattgctttcagtctcttactgggacaaagtttttcgtggtatctgagccggggacacaaaatatggagaatctgttgaagcatatttatgaactctacacggattatgttctgaagaatccgttctatgagatggagatgccaatacggtgtgagctttttgatatcaacttggcacaagcggtacaaaaggagcgtgtttcatatcttgggcgatgaaataaatgttttacaaacaaacacgtacccgtttgagcagttgaattgaaagaatgtttgtctgttaagtgatgttattactttcccagatatcttttgaatatgtttcctacataaacatgt

SEQ ID NO: 2525 - DNA, 936 bp, Helianthus annuus
acgttttaagtttgtctttagagatagaaatatataccagccagccaaggatacaactgtttgttcaatttcttacattagggttttgtggattctattagcagctactagggagttgtttagatctacattttgatattgtttctaatcgttcttgttaattacagtaatataaacaaaactcgtttcaattgaaaaactaaaagttataataaaaagaaaatattgaaaacttaggaattgagaaagagaagaagcaactatcggcaagtggatctatggcagcaatttacagcctgtacatcatcaacaaatcagggggtctcatcttctacaaggattatggattgcaaggaagaatggacacgaatgatagcttgagattggccagtttgtggcattcaatgcacgcaatctctcagcaactctcccccattcagggatgctctggtatcgaacttcttgaagcggatacatttgatctccattgctttcagtctcttactgggacaaagtttttcgtggtatctgagccgggcacacaaaatatggagaatctgttgaaacatatttatgaactctacacggattatgttctgaagaatccgttctatgagatggagatgccaatacggtgtgagctttttgatatcaacttggcacaagcagtacaaaaggagcgtgtttcatatcttgggcgatgaaacaaatgttttacaaacaaacccgtacccgtttgagcagttgtttgtttgttaagtgatgttattactttcccagatatcttttgaatatgtttcctaaataaacatgtgtttctttggcaaagtggatccttccttccttagtttggaaaggtgtgtgagcgcaacgggaggttgtacgtataagtggtatgtacatagaggttacatccaaataactcgcttcttgtgt

SEQ ID NO: 2526 - DNA, 886 bp, Helianthus annuus
aatttaagagtttgttgtggatgatttttgtgaatataaagcaaatcgttgatgttaatttttattatctagactctccgactctatgattagttttgtccccaattgagtcatgtttgagtgcttttatagtgataataaaaagaaaatattgaaaacataggaattgagaaagagaagaagcaactatcggcaagtggatctatggcagcaatttacagcctgtacatcatcaacaaatcagggggtctcatcttctacaaggattatggattgcaaggaagaatggacacgaatgatagcttgagattggccagtttgtggcattcaatgcacgcaatctctcagcaactctcccccattcagggatgctctggtatcgaacttcttgaagcggatacatttgatctccattgctttcagtctcttactgggacaaagtttttcgtggtatctgagccgggcacacaaaatatggagaatctgttgaaacatatttatgaactctacacggattatgttctgaagaatccgttctatgagatggagatgccaatacggtgtgagctttttgatatcaacttggcacaagcagtacaaaaggagcgtgtttcatatcttgggcgatgaaacaaatgttttacaaacaaacccttacccgtttgagcagttgaattgaaagaatgtttgtttgttaagtgatgttattactttcccagagatatcttttgaatatgtttcctaaattaacatgtgtttctttggcaaagtggatccttccttccttagtttagaaaggtgtgtgagcgcaacgggaggttgtacgtataggtggtacgtacatagaggttacatccaaataacttgcttcttgtgtatgtcgaac

SEQ ID NO: 2527 - DNA, 679 bp, Valeriana officinalis
gacacgatggcagcaatttacagtctctacatcattaacaaatcaggtggcctaatcttctacaaggattatggcacgaaggggcgaatggatacaaatgatagtttgcgactagcgagtttatggcattcaatgcacgccatctctcaacagttatcaccggtaattggatgtatgggaatcgaacttcttgaagctgatacgtttgatctacattgttttcaatctcttaccgggacaaaaatatttgtggtatcagagccaggaacacaatacatggagagtcttttgaaacaaatatatgaactttatactgattatgttctaaagaatcccttttatgaaatggagatgcctattcgctgcgaactttttgacataaatctcaaccaagctatacaaaaggaccgtgtttccctgctcggacgatgaaaatactaaactgcccttgtcgtgctttcaacttgatcgatggcactgcggtatctgtactttcctgtttttaagtcgccttaataaattgtttgttttgatctcttaatgctgaatttgcttaggcttgcaatgttttcacacatgttttgataaaacaaaattgaaatactttgaaatatgttcacatattttctattcatacttgaaactatagaacaattgcatataaaagtacacgaagctg

SEQ ID NO: 2528 - DNA, 2440 bp, Setaria italica
aatattcttcagcccatggccgattatcctttctgcgcgttagccatcttttttttcgccggcccatctcccatctcaccatgtggataacgtacgttacaagccgctgcctgccacgtagcacacctcgcagcctctgctccctactccacgcgctctcctgcctgtctcccgcgtcctctgctgccttcgacttcgacaaccccgtgggatgagatccccctcctcgccatggccgcgtccctcctgccccccgccgccaccctcgccaagaagtaccccaccctcctccacccgtccggcgccaggccacacgcccagaggctgatcttcaggtgcggcgcgaccagcgacgccgcggacgatggctgggcatccttcgtggacgagctcaagagctcgctgcaggacccgtccgacacggtggccagcgacgccgccggcgcgggcgccgcgccggacgaccttgtgaccgcgctgccactggacgcctccgccgacccggccggtgtcggggacacgaccaatgccatcgccggcgcggcgaacgagctcatgggcgtggacgcgtccggtgcggctgccagcagcgactccatcccggacgggctcctgagcgtgctgcacctggacgcgtcgaaccctgcggtgcgcgcggcgggcggcgcgctgtcccgcctggacgcgctcacggcggggctgtcggacgcgcagcggtgggcgctgctcgggttcctgggcgtgacatggctatacctgacggcgcggccgggggtgttgagcggcgccgtggacacgtacgtgctggcgccgctgcagctggcgctggacagcgtgctgggccggcggagcctgaagatgagcgacttcgtggtcggcgagcgcatcggagagggctcgttcggggtggtgtacgccggcgccgttgtgccgaagaacggcgccgtcgtggaggagcggtcaggcagggcccggacgagcctccagaacgacgacaggtacaaggagaaggtcatcctcaagaagatcaaggttggcacggtgggggcgaaggagtgcggcgactacgaggagtggtttaactaccgcatggccagggcggcgccggagtcgtgcgccgacttcctcgggagcttcgtcgccgacaagaccaagtcggagttcatcaagggcggcaagtggctcgtatggaagtttgagggagaccggacgctggcggactacctgggcgaccgggcgttcccgtccaacctggagcagctcatgttcgggcgcgcgctgcgtgggcttggcacgctggagcgcgacgcgctggtggtgaagcaagtgatgcgacagctggtcacgtcgctgaagcgcatccatggcacgggcatcgtgcaccgcgacatcaagccctccaacctcgtcgtcacccggcgcgggcaggtgaagctcatagacttcggcgccgccaccgacctccgcatcggcaagaactacgtccccgaccgcgccctgctcgacccggactactgcccgcccgagctctacgtcctccccgaggagacgcccgagcccccgccggagcccatcgccgccatcctctcccccatcctctggcagctgaacaacccggacctgttcgacatgtactcggcggggatcgtgctgatgcagatggccataccgacgctgcggacgcagtcggggctcaagaacttcaacgccgagctcaggtccgccggctacgacctcaacaggtggcggcagagcacgcggcggaggcccgacctgcagatcctggacctcgactccgggcgaggctgggacctcgccaccaagctcatctcggagaggggcgccaacggcgggggcaggctctccgccgccgcggcgctacggcacccatattttctcctgggtggagatcaggccgcggccgtgctgtccaagctctcgctcatcaaatagcatccgtccatggctcatggctgggtacgtacaggctctatacacattggatcattggaatcctctgatcggttcgtcggtgtacattacgcattgttgagtccttggcatacggtgttcagcaatgtcattggcattttttgctgtgtaaccactcatgggactatgggagggatcaagagggaggcatctggtgactggtgttacaattttctgttctgtatgggattgcttgaacaatgtggtgcagagtttcagacactagctaactttacattatactggacagaaatcctacttccgctggtcagttcctccaaactacgcagatgcagactcccagagagctcgtcgactggttgcgaaattctgagctgttcccgtttcagccgatcaggtgtttggtcatgctcgtcctgatgctatcctgacagacgaaatggtcacctaacatttctcctggcagtatggatcgaacttcttctgg

SEQ ID NO: 2529 - DNA, 2280 bp, Setaria italica
ctgctccctactccacgcgctctcctgcctgtctcccgcgtcctctgctgccttcgacttcgacaaccccgtgggatgagatccccctcctcgccatggccgcgtccctcctgccccccgccgccaccctcgccaagaagtaccccaccctcctccacccgtccggcgccaggccacacgcccagaggctgatcttcaggtgcggcgcgaccagcgacgccgcggacgatggctgggcatccttcgtggacgagctcaagagctcgctgcaggacccgtccgacacggtggccagcgacgccgccggcgcgggcgccgcgccggacgaccttgtgaccgcgctgccactggacgcctccgccgacccggccggtgtcggggacacgaccaatgccatcgccggcgcggcgaacgagctcatgggcgtggacgcgtccggtgcggctgccagcagcgactccatcccggacgggctcctgagcgtgctgcacctggacgcgtcgaaccctgcggtgcgcgcggcgggcggcgcgctgtcccgcctggacgcgctcacggcggggctgtcggacgcgcagcggtgggcgctgctcgggttcctgggcgtgacatggctatacctgacggcgcggccgggggtgttgagcggcgccgtggacacgtacgtgctggcgccgctgcagctggcgctggacagcgtgctgggccggcggagcctgaagatgagcgacttcgtggtcggcgagcgcatcggagagggctcgttcggggtggtgtacgccggcgccgttgtgccgaagaacggcgccgtcgtggaggagcggtcaggcagggcccggacgagcctccagaacgacgacaggtacaaggagaaggtcatcctcaagaagatcaaggttggcacggtgggggcgaaggagtgcggcgactacgaggagtggtttaactaccgcatggccagggcggcgccggagtcgtgcgccgacttcctcgggagcttcgtcgccgacaagaccaagtcggagttcatcaagggcggcaagtggctcgtatggaagtttgagggagaccggacgctggcggactacctgggcgaccgggcgttcccgtccaacctggagcagctcatgttcgggcgcgcgctgcgtgggcttggcacgctggagcgcgacgcgctggtggtgaagcaagtgatgcgacagctggtcacgtcgctgaagcgcatccatggcacgggcatcgtgcaccgcgacatcaagccctccaacctcgtcgtcacccggcgcgggcaggtgaagctcatagacttcggcgccgccaccgacctccgcatcggcaagaactacgtccccgaccgcgccctgctcgacccggactactgcccgcccgagctctacgtcctccccgaggagacgcccgagcccccgccggagcccatcgccgccatcctctcccccatcctctggcagctgaacaacccggacctgttcgacatgtactcggcggggatcgtgctgatgcagatggccataccgacgctgcggacgcagtcggggctcaagaacttcaacgccgagctcaggtccgccggctacgacctcaacaggtggcggcagagcacgcggcggaggcccgacctgcagatcctggacctcgactccgggcgaggctgggacctcgccaccaagctcatctcggagaggggcgccaacggcgggggcaggctctccgccgccgcggcgctacggcacccatattttctcctgggtggagatcaggccgcggccgtgctgtccaagctctcgctcatcaaatagcatccgtccatggctcatggctgggtacgtacaggctctatacacattggatcattggaatcctctgatcggttcgtcggtgtacattacgcattgttgagtccttggcatacggtgttcagcaatgtcattggcattttttgctgtgtaaccactcatgggactatgggagggatcaagagggaggcatctggtgactggtgttacaattttctgttctgtatgggattgcttgaacaatgtggtgcagagtttcagacactagctaactttacattatactggacagaaatcctacttccgctggtcagttcctccaaactacgcagatgcagactcccagagagctcgtcgactggttgcgaaattctgagctgttcccgtttcagccgatcaggtgtttggtcatgctcgtcctgatgctatcctgacagacgaaatggtcacctaacatttctcctgg

SEQ ID NO: 2530 - DNA, 3220 bp, Panicum virgatum
cggcaagtcgtctatgctgctttctgcgctctccatcggcgctttcttgccccttttccctcttctcgccggaggcattccgtcgaacaggcggcgggcgtctgtgctgcgggacaagaaaccatattgtcggataacgacggaaagggcggaggtaatcagatgaggatatgtaaaagtaaaacggcgctcggccgctcgccggtgaccagctcacctcgcgtcccgtagcctgggtcctggggtgagatcgacgcagaagcagcaggggcggcggccgatcggagtcggaggagagaagaggtcctctctttattgttccgtcaacatgctttcaggcccaatatcctccagtccagggcccattatgttctctgcgttacccatctttattttttccggcccatctcctcccattcggataacaaacgttacaagccgctgcctgccacgtagcacacctcgcagcctctgctccctactccacacgccgccccgtctcccccgcgtcctcggctgccttcgacaacccatgggatgagagctccctcctcgccatggccgcctccctcctgcccccggccaccctcgccaagcagtaccccaccctcctccacccgttcgccgccaagctacacgcccagaggctgatcttcaggtgcggcgcgaccaccgacggcacggactacagctgggcgtcctttctggacgagctcaagagctcgctgcaggtgggcccgaccgacacggtgggcagcgacgccggcgcgggcgccacgccggacgacctcgtgacctcgctgccactggacgcctccgccgccccggccgtcggagacgcgaccaatgccgccgccggcgcggcgaacgagctcctgggcgtggacgcgtccggcgcggcggccagcagcgacgcgggcgcgggcgccatcccggacgggctcctgagcgcgctgcacctggacgcgtccaacccggcggtgcgcgcggcgggcggcgcgctgtcccgcctggacgcgctcacggcggggctgtcggacgcgcagcggtgggcgctgctggggttcctgggcgtgacgtggctgtacctgacggcgcggccgggggtgctgagcggcgccgtggacgcctacgtgctggcgccgctgcagctggcgctggacagcgcgctgggccggcggagcctcaagatgagcgacttcgtggtcggcgagcgcatcggggagggctcgttcggggtggtgttcttcggcgccgtcgtgccgaagaacggcgccgtggtggaggagcggtcgggcagggccaggacgagcctccagaacgacgacaggtacaaggagaaggtcatcctcaagaagatcaaggtgggcacggtgggggccaaggagtgcggcgactacgaggagtggttcaactaccgcgtggccagggcggcgccggagacgtgcgccgacttcctcgggagcttcgtcgccgacaagaccaagtcggagttcgtcaggggcggcaagtggctcgtctggaagtttgagggggaccggacgttggcgaactacctgaacgaccgtgggttcccgtccaacctggagcagctcatgttcgggcgcgcgctgcgtgggctgggcacgctggagcgcgatgcgctggtggtgaagcaggtgatgcggcagctggtcacgtcgctgaagcgcatccacggcacgggcatcgtgcaccgcgacatcaagccctccaatctcgtcgtcacccggcgcgggcaggtgaagctcatcgacttcggcgccgccaccgacctccgcatcggcaagaactacgtccccgaccgcgccctgctcgaccccgactactgcccgcccgagctctacgtgctccccgaggagacgcccgagcccccgccggagcccatcgccgccatcctctccccgatcctctggcagctcaacaacccggacctgttcgacatgtactcggcggggatagtgctgatgcagatggccataccgacgctgcggacgcagtcggggctcaagaacttcaacagcgagctcaggtccgccggctacgacctcaacaagtggcggcagagcacgcgccggaggcccgacctgcagatcctggacctagacgccggccgaggctgggacctcgccaccaagctcatctcgcagaggggcgccaacggcgggggcaggctctccgccgccgcggcgctgaggcacccatattttctcctgggtggagatcaggccgcggccgtgctgtccaagctctcgctcagcaaatagcacccatccgtggatcatggctgggaacgaacgtacaggctcgcgctatacagattgggtgattggaatcctctgatcgtttcatcgttgagtccttggcatacagtgatcagcaatggcattggcatttttttttgctggatgaccactcatgggagggatcaagagggaggcatgtggtcgtaagtggcgttacaatttttgttctgtatgaattgcttgaacaatgtggtgcagagtttcagacactagctaactttacattatactagacagaaatcctacttccgctggtcagttcctcgaaactatgaagatcccagagaggtcatcgactggttgccaaatattctgagctgttcccgtttcagccgatcaggtgtttggccatgctcgttctgatgctatgctgacagacttaatggtcatcggtcatttctcctggcagtatggatcgaacttcctctggagatcttcctggttgcccccgaccagcttgtcgatctccttcttgtctctcatgaagatgaacgttggagttgctcgtacgtcaaattgggtgaccagttcctggagaacatgtactttttaaggtggcatttaaaaaaatgaagaaagaaatcaataggcaaaattccgagtattctcgtgtaccggcagttcgtctacatcaatggacaagaaaacaagatcagaatgcttcaaagagagctcggcgaataatggagcagcattcctgcacggtccgcaccaagtcgcgctgaattttaccacaacctgcacacacatggacatgtcaacatacgtagttaacctggtgaaaacctgaagggatcgtgaaatggagagccaaatgcactgcgaacgcctcgtatttttgcaatcggggcatactcgctgtgccctaatgacacaatgaaggaggacctagtaat

SEQ ID NO: 2531 - DNA, 2300 bp, Panicum virgatum
ggctgttccagtccaggcccattatgttctctgggttcgccatctttattttcgccggcccatctcctcccatctggataacaaacgttacaagccgctgcctgccacgtagcacacctcgcagcctctgctccagcctccagtgctccctactccacacgccgcccgctctctcccccgcgtcctcggctgccttcggcaacccatgggatgagagctccctcctcgccatggccgcctccctcctgcccccgcccacccttgccaagaagtaccccaccctcctccacccgtccggcgccaagccccacgcccagaggctgatcttcaggtgcgccgcgaccaccgacggcgcggacgatagctgggcgtcctttctggacgagctcaagagctcgctgcaggtgggcccgcccgacacggtggccagcgacgccggcgcgggcgccgccacgccggacgacctcgttaccgcgctgccactggacccctccgccgccggcccaaccatcggggacacgaccaatgccgccgtcggcgcggcgagcgagctcctgggcgcggacgcgtccggcgcggcagccagcagcaacgcgggcgcggccacgggcgccatcccggacgggctcctgagcgcgctgcacctggacgcgtccagcccggcggcgcgcgcggcgggcggcgcgctgtcccgcctggaggcgctcacggcggggctgtcggacgcgcagcggtgggcgctgctggggttcctgggcgcgacgtggctgtacctgacggcgcggccgggggtgctgagcggcgcggtggacgcctacgtgctggcgccgctgcagctggcgctggacagcgcgctgggccggcggagcctcaagatgagcgacttcgtggtcggcgagcgcatcggggagggctccttcggggtggtgttcttcggcgccgtcgtgccgaggaacggcgccgccgtggaggagcggtcgggcagggccaggacaagcctccagaacgacgacaggtacaaggagaaggtcatcctcaagaagatcaaggtgggcacggtgggcgccaaggagtgcggcgactacgaggagtggttcaactaccgcgtggccagggcggcgccggagacgtgcgccgacttcctcgggagcttcgtcgccgacaagaccaagtcggagttcgtcaagggcggcaagtggctcgtctggaagtttgagggggaccggacgttgggcaactacctgaacgaccggggtttcccgtccaacctggagcagctcatgttcgggcgcgcgctgcgtgggctgggcacgctggagcgcgacgccctggtggtgaagcaggtgatgcggcagctggtgacgtcgctgaagcgcatccacggcacgggcatcgtgcaccgcgacatcaagccctccaacctcgtcgtcacccggcgcgggcaggtgaagctcatcgacttcggcgccgccaccgacctccgcatcggcaagaactacgtccccgaccgcgccctgctcgacccggactactgcccgcccgagctctacgtcctccccgaggagacgccccaacccccgccggagcccatcgccgccatcctctcccccatcctctggcagctcaacagcccggacctgttcgacatgtactcagcggggatagtgctgatgcagatggccataccgacgctgcggacacagtcggggctcaagaacttcaacagcgagctcaggtccgccggctacgacctcaacaagtggcggcagagcacgcgccggaggcccgacctgcggatcctggaccaggacgccgggcgaggctgggacctcgccaccaagctcatctcgcagaggggcgccaacggcgggggcaggctctccgccgccgcggcgctgaggcacccatattttctcctgggcggagatcaggccgcggccgtgctgtccaagctctcgctcagcaagtagcatccatccgtggctcatggctgggaacgtacagggcaggctcgctttatacagattgggtaattggaatcctctggttggttcatcgctggacacagcgcgtcgtcgagtccttggcgatggcatacagtgaccaccagccattgtattggcattttttgctgcatgaccactcatgggaggaatcaagagggagaggcatctggtcgcgttacaattttttgttctgtatggaattgcttgaacaatgtggtgcagagtttcagacactagctaactttacattatactagtcagaaatcctacttccgctggttagttcctcgaaac

SEQ ID NO: 2532 - DNA, 2790 bp, Triticum aestivum
gtttcctcgcgccgcttcctcccgcccgccgcggcgcaccacgccgcagctgaatctttcgcctccgcggcgtcgtccctctgagcctcccgtcagcaccagtccgttcctctgcaccccaactgcaatccaatccaatccaatcttccgcctttcggcgtttctgcttcttgggactcgggatctcgtcgggggaggcggcggcggatttgagatttggggcacatggcgtggcggcgcgtcctctcccaggctgcaaggaaccaatcagcatatgcaatctataatgagttggcagcctcctctcctctgaggtcacttagaagtgacatcagtgcaggtggcgcactcaggaacttacatgagaggtatcattcgagctattttggtggcctttcacgcagcatgcgagacctgggctcccagagtgaagcttctatgataaaagagatatacagaagtgacccagagcgtgtgataaaaatatttgaaagccagcctttgttgcattcgaatccttcagcactctctgagtatgtaaaagctcttgtgaaggtcgacaggctggatgatagcaccttgctaaaaacattgcaaagaggtcttgctgcttcagaaaggtcagaaggaagccttggtagcgtgccggcattaaagagtgctggtcaagtgacaaaagatggaattattggcactgcgaatgcgcctattcacatggttacagcagaaacaggtcaatttaaggatcagctttggcgcaccttccgaagcattgcactgactttccttctaatttcgggcatcggagctctcattgaggatagaggaatcagcaaaggccttggcctaaacgaagaggttcaaccaagcatggaatctagtacgaaatttagtgatgtaaaaggtgttgatgaagccaaagctgaactcgaggaaatagttcactaccttcgagatccaaagcgttttacacgtcttgggggaaaactgccaaaaggtgttctgcttgttggtcctcctggcactggcaagaccatgttagcgagggctattgctggggaagccagcgtcccttttttctcgtgcagcggtagtgagtttgaggagatgtttgtaggcgtgggagctagaagagtgagggatctttttgctgcagcaaaaaacgatcgccttgtatcatattcattgatgaaattgatgcaattggtgggagtagaaatccgaaggatcagcagtatatgaagatgaccttgaatcagttgcttgttgagctggatggctttaagcagaatgaggggataattgtcatcgctgcaactaacttcccagagtcattagataaagcattagtcagacctgggcgctttgatcgtcatattgttgttcccaatccagatgttgagggcagacgtcagatcttagagatccacatgtcaaaggtcttaaagggtgatgatgtggatttgatgatcattgccaggggaacaccaggattttcaggtgctgaccttgctaacttggtgaatgtggctgctcttagagctgccatggatggcgcaaaatccgttagcatgaatgatctggagtatgccaaggaccggatcatgatgggtagtgagcgcaagtcagcagttatctctgatgagtgcaggaagctgacagcataccatgaaggagggcatgcccttgttgccatgcacacggatggtgcacatcctgtccacaaagctaccatcgtgcccagggggatggcccttgggatggtggctcagctccctgacaaagatgagactagcgtgtcaaggaaacagatgctagcaagattggatgtgtgcatgggagggcgggtggcagaggagcttatatttggggatagcgaggtgacatccggtgcttcatccgactttgagcaagcaactttgatggcaagagcaatggttactcagtatggtatgagcaagcaggtgggtcttgtttcatacaactatgaagaggacggaaagactatgagctcagaaacgaggcttctaattgaggaggaggtgaagaatttcttggagaaagcatacaacaatgcaaaggctatcctcaccaaacacaacaaggagctccatgctctagccaatgcacttcttgagcatgagaccatgagcggaacccaaataaagaacttgttggcccaagtagataacaaacagccgcaggggcatgctgttgaagccccacagaagacgccagcttcacccccatctccagccgcagcggccgcagccgtggccgcggcggcagcacaacaagcggcagcgcaagccaagggagttgctggtatcgggtcttagcatccatgggtctgcgttgtgtatattaattcaccaaattagcaggttgttccgtcaaactgtcagctgatgagtatcccccaggaagaatacgctacactgctgcatcaaacacgaggacacatcgatgttgcttggggtgtgaatagagaaagaaacacatggaggaaaattcacacatagtagcaggcacatgttagctagtgtttgagttgagttctctggttgtgctgttgacaacttcacatctcaataattgttatcgttaaaatctgccttgtatttgtatggtatatacgtttggtcgtgaaagttgccaataatattttgctcatcagccgcaacgctgaaattgagatcccatgcatacacacattatgaaggaaggccttgtgagaagctaaaatgactagtttcagatcaaatccaccatgtcttggaactcttgcat

SEQ ID NO: 2533 - DNA, 2804 bp, Triticum aestivum
ggcgcctcgtgacgtgggctgtttcctcgcgccgcttcctccagcccgccgcgccgcaccacgccgcagctgaatcattcgcccccgcggcgtcttccctctgagcctcccgttagcaccagtccgttcctctgcaccccaactgcaatccaatccaatccaatccttccgcctttcggcgtttctgcttgcctgggacttgggatctcgtcgggggaggcggcggcggatttgagatttggggcacatggcgtggcggcgcgtcctctcccaggctgcaaggaaccaatcagcatatgcaatctataatgagttggcagcctcctctcctctgaggtcacttagaagtgacatcagtgcaggtggcgcactcagaaaattacatgagaggtatcattcgagctattttggtggcctttcacgcagcatgcgagacctgggctcccagagtgaaggttctatgctaaaagagatatacaggagtgacccagagcgtgtgataaaaatatttgaaagccagcctttgttgcattcgaatccttcagcactctctgagtatgtaaaagctcttgtaaaggtcgataggctggatgatagcaccttgctaaaaacattgcaaagaggtcttgctgcttcagaaaggtcagaaggaagccttggtagcgtgccggcattaaagagtgctggtcaagtgacaaaagatggaattattggcactgcgaatgcgcctattcacatggttacagcagaaacaggtcaatttaaggatcagctttggcgcacattccgaagcattgcactgactttccttttaatttcgggcatcggggctctcattgaggatagaggaatcagcaaaggccttggtctaaacgaagaggttcaaccaagcatggaatctagtacgaaatttagtgatgtaaaaggtgttgatgaagccaaagctgaactcgaggaaatagttcactaccttcgagatccaaagcgttttacacgtcttgggggaaaactgccaaaaggtgttctgcttgttggtcctcctggcactggcaagaccatgttagcgagggctattgctggggaagccagcgtcccttttttctcgtgcagcggtagtgagtttgaggagatgtttgtaggcgtgggagctagaagagtgagggatctttttgctgcagcaaaaaaacgatcgccttgtatcatattcattgatgaaattgatgcaattggtgggagtagaaatccaaaggatcagcagtatatgaagatgaccttgaatcagttgcttgttgagctggatggctttaagcagaatgaggggataattgtcattgctgcaactaacttcccagagtcattagataaagcactagtcagacctgggcgttttgaccgtcatattgttgttcccaatccagatgttgagggcagacgtcagatcttagaggtccacatgtcaaaggtcttaaagggtgatgatgtggatttgatgatcattgctaggggaacaccaggattttcaggtgctgaccttgctaacttggtgaatgtggctgctcttagagctgccatggatggcgcaaaatccgttagcatgaatgatctggagtatgccaaggaccggatcatgatgggtagtgagcgcaagtcagcagttatctctgatgagtgcaggaagctgacagcataccatgaaggagggcatgcccttgttgccatgcacacggatggtgcacatcctgtccacaaagctaccatcgtgcccagggggatggcccttgggatggtggctcagctccctgacaaagatgagactagcgtgtcaaggaaacagatgctagcaagattggatgtgtgcatgggaggacgggtggcagaggagcttatatttggggatagcgaggtgacatccggtgcttcatccgactttgagcaagcgactttgatggcaagagcaatggttactcagtatggtatgagcaagcaggtgggtcttgtttcatacaactatgaagaggacggaaagactatgagctcagaaacgaggcttctaattgaggaggaggtgaagaatttcttggagaaagcatacaacaatgcaaaggctatcctcaccaaacacaacaaggagctccatgctctagccaatgcacttcttgagcatgagaccatgagcggaacccaaataaagaacttgttggcccaagtagataacaaacagccgcaggggcatgctgttgaagccccacagaagacgccagcttcacccccatctccagccgccgcggcggctgctgctgccgcggcggcggcacaacaagcggcagcgcaggccaagggagttgtcggtatcgggtcttagcatccacaggtttgcattcaccaaattagcaggttgttctgccaaaccgtcagctgatgagtatcccccaggaagaatatgctacactgctgcatcaaacacgaggacacatcgatgttgcttggggtgtggatagagaaagaaacacatggaggaaaattcacacatagtagcaggcacatgtagctagtgtttgaagtgacttctctagttgtgctgttgacaacttcacatctgaataattgttatcgttaaaatctgccttgtatttgtgcgatgcacgtgtttggtcatgaaagttgccaataataatattttgctcatcagccgcaacgctgagattgagatcccatgcatacacacgttatgaaggaaggccttgtgagcagctaaaatggccaaagtttcagatcaaatctaccatgtcttggaactcttgcat

SEQ ID NO: 2534 - DNA, 2751 bp, Triticum aestivum
gggctgtttcctcgcgccgcttcctcccgcccgccgcggcgcaccacgccgcagctgaatctttcgcctccgcggcgtcgtccctctgagcctcccgttagcaccagtccgttcctctgcaccccaactgcaatccaatccaatccaatcttccgcctttgggcgtttctgcttccctgggactcgggatctcgtcgggggaggcggcggcggatttgagatttggggcacatggcgtggcggcgcgtcctctctcaggctgcaaggaaccaatcagcatatgcaatctataatgagttggcagcctcctctcctctgacgtcacttagaagtgacatcagtgcaggtggcacactcaggaacttacatgagaggtatcattcgagctattttggtggcctttcacgcagcatgcgagacctgggctcccagagtgaagcttctatgctaaaagagatatacagaagtgacccagagcgtgtgataaaaatatttgaaagccagcctttgttgcattcgaatccttcagcactctctgagtatgtaaaagctcttgtgaaggtcgacaggctggatgatagcaccttgctaaaaacattgcaaagaggtcttgctgcttcagaaaggtcagaaggaagccttggtagcgtgccggcattaaagagtgctggtcaagtgacaaaagatggaattattggcactgcgaatgcgcctattcacatggttacagcagaaacaggtcaatttaaggatcagctttggcgcaccttccgaagcattgcactgactttccttttaatttcgggcatcggggctctcattgaggatagaggaatcagcaaaggccttggcctaaacgaagaggttcaaccaagcatggaatctagtacgaaatttagtgatgtaaaaggtgttgatgaagccaaagccgaactcgaggaaatagttcactaccttcgagatccaaagcgttttacacgtcttgggggaaaactgccaaaaggtgttctgcttgttggtcctcctggcactggcaagaccatgttagcgagggctattgctggggaagccagcgtcccttttttctcgtgcagcggtagtgagtttgaggagatgtttgtaggcgtgggagctagaagagtgagggatctttttgctgcagcaaaaagacgatcgccttgtatcatattcattgatgaaattgatgcaattggtgggagtagaaatccaaaggatcagcagtatatgaagatgaccttgaatcagttgcttgttgagctggatggctttaagcagaatgaggggataattgtcatcgctgcaactaacttcccagagtcattagataaagcactagtcagacctgggcgctttgatcgtcatattgttgttcccaatccagatgttgagggcagacgtcagatcttagaggtccacatgtcaaaggtcttaaagggtgatgatgtggatttgatgatcattgccaggggaacaccaggattttcaggtgctgatcttgctaacttggtgaatgtggctgctcttagagctgccatggatggcgcaaaatccgttagcatgaatgatctggagtatgccaaggaccggatcatgatgggtagtgagcgcaagtcagcagttatctctgatgagtgcaggaagctgacagcataccatgaaggagggcatgcccttgttgccatgcacacggatggtgcacatcctgtccacaaagctaccatcgtgcccagggggatggcccttgggatggtggctcagctccctgacaaagatgagactagcgtgtcaaggaaacagatgctagcaagattggatgtgtgcatgggagggcgggtggcagaggagcttatatttggggatagcgaggtgacatccggtgcttcatcggactttgagcaagcaactttgatggcaagagcaatggttactcagtatggtatgagcaagcaggtgggtcttgtttcatacaactatgaagaggacggaaagactatgagctcagaaacgaggcttctaattgaggaggaggtgaagaatttcttggagaaagcatacaacaatgcaaaggctatcctcaccaaacacaacaaggagctccatgctctagccaatgcacttcttgagcatgaaaccatgagcggaacccaaataaagaacttgttggcccaagtagataacaaacagccgcaggggcatgctgttgaagccccacagaagacgccagcttcacccccatctccagcggcagcggctgcggccgcagccgcggcggcagcacaacaagcggcagcgcaagccaagggagttgctggtatcgggtcttagcatccataggtctgcattgtgtatattaattcaccaaattagcaggttgttccgtcaaactgtcagctgatgagtatcccccaggaagaatacgctacactgctgcatcaaacacgaggacacatcgatgttgcttggggtgtgaatagagaaagaaacacatggaggaaaattcacacatggtagcaggcacatgttagctagtgtttgagttgagtttgctgttgacaacttcacatctcaataattgttatcgttaaaatctgccattgtatttgtacggtatacgtttggtcatgaaagttgccaataatattctgctcatcagccgtaacgctgagattgagatccaaaaagaaaagtaccgaatgacgactctgcgtgatacactgctggccgctcgtc

SEQ ID NO: 2535 - DNA, 2739 bp, Secale cereale
gagaagaaaaattcgacgactcgtctcgtctcccttgcgcctcgtgacgtgggctgtttcctcgcgccgcttccttccgcccgccgcggcgcaccacgccgcagctgaatctttcgcctccgcggcgtcgaccctcttagcctcccgttagcagcagtccgttcctctgcaccccaactgctatccaatccttccgcctttcggcgtttctgcttgcttgggactcgggatctcgtcgggggaggcggcggcggatttgagatctggggcacatggcgtggcggcgcgtcctctcccaggctgcaaggaaccaatcagcatatgcaatctataatgagttggcagccttctctcctctgaggtcacttagaagtgacatcagtgcaggtggcacactcaggaacttacatgagaggtatcattcgagctattttggtggcctttcacgcagcatgcgagacctgggctcccagagtgaagcttctatgctaaaagagatatacagaagtgacccagagcgtgtgataaaaatatttgaaagccagcctttgttgcattcgaattcttcagcactctctgagtatgtaaaagctcttgtaaaggtcgataggctggatgatagcaccttgctaaaaacattgcaaagaggtcttgctgcttcagaaaggtcagaaggaagccttggtagcgtgcccgcattaaagagtgctggtcaagtgacaaaagatggaattattggcactgcgaatgcgcctattcacatggttacagcagaaacaggtcaatttaaggatcagctttggcgcaccttccgaagcattgcactgactttccttttaatttcgggcatcggggctctcattgaggatagaggaatcagcaaaggccttggtctaaacgaagaggttcaaccaagcatggaatctagtacaaaatttagtgatgtaaaaggtgttgatgaagccaaagctgaactcgaggaaatagttcactaccttcgagatccaaagcgttttacacgtcttggggggaaactgccaaaaggtgttctgcttgttggtcctcctggcactggcaagaccatgttagcgagggctattgctggggaagccagcgtcccctttttctcttgcagcggtagcgagtttgaggagatgtttgtaggcgtgggagctagaagagtgagggatctttttgctgcagcaaaaaaacggtcgccttgtatcatattcattgatgaaattgatgcaattggtgggagtagaaatccaaaggatcagcagtatatgaagatgaccttgaatcagttgcttgttgagctggatggctttaagcagaatgaggggataattgtcatcgctgcaactaacttccccgagtcattagataaagcactagtcagacctgggcgatttgatcgtcatattgttgttcccaatcctgatgttgagggcagacgtcagatcttagaggcccacatgtcaaaggtcttaaaggatgatgatgtggatttgatgatcattgccaggggaacaccaggattttcaggtgctgaccttgctaacttggtgaacgtggctgctcttagggctgccatggatggcgcaaaatccgttagcatgaatgatctggagtatgccaaggaccggatcatgatgggtagtgaacgcaagtcagcagttatctctgatgagtgcaggaagctgacagcataccatgaaggagggcatgcccttgttgccatgcacacggatggtgcgcatcctgtccacaaagctaccatcgtgcccagggggatggcccttgggatggtggctcagctccctgacaaagatgagactagcgtgtcaaggaaacagatgctagcaagattggatgtgtgcatgggagggcgggtggcagaggagcttatatttggggatagcgaggtgacatccggtgcttcatccgactttgagcaagcaactttgatggcaagagcaatggttactcagtatggtatgagcaagcaggtgggtcttgtttcgtacaactatgaagaggacggaaagactatgagctcagagacgaggcttctaattgaggaggaggtgaagaatttcttggagaaagcatacaacaatgcaaagactatcctcaccaaacacaacaaggagctccatgctctagccaatgcacttcttgagcatgagaccatgagcggaacccaaataaagaacttgttggcccaagtaaataacatagagccgcaggggcatgctgttgaagccccacagaagacgccagcttcacccccatctccagccgcggccgccgcagctgcggccgcggcggcagcacaacaagccgcagcgcaagccaagggagttgctggtatcgggtcttagcttccacaggtttgcattgtgtatattaattcaccaaattagcaggttgttccgtcaaactgtcagctggtgagtatccccctggaagaatatgctacgctgctgcatcaaacactaggacacatcgatgttgcttggggtgtgaatagtagagaaagaaacacatggagttaaattcacacatagtagcaggcacatgttagctagtgtttgagttgagttctctggttgtgctgttgacaacttgacatctcaataattgttatcgttaaaatctgccgtgtatttgtacgatacacgttcggtcatgaaagttaccaataatattttgctcatcagctgcaatgctgag

SEQ ID NO: 2536 - DNA, 2559 bp, Lolium multiflorum
atctcgtcgggagaggaggcggcggcggcggattggagattcgggcccatggcgtggcggcgcgtcctctccctggctgcacggaaccgatcagcatatgcaatttataatcagtccgcagcttcttcccctctgaggtcaattggaagtgacatctttgcaggtggcgcacgcaggaacttacatgataggtttcattcaagctattttggtggcctttcacgcagcatgcgagatctgggctcccaaagtgaagcttctctgctaaaagagatatacagaagtgacccagagcgtgtgatacaaatatttgaaagccagcctttactgcattcgaattcttcagcactttcagaatacgtaaaagctcttgttaaggttgataggctggatgatagcaccttgctaaaaacattgcaaagaggtcttgctgcttcagaaagggcagaaggaagccttggtagcgtgccagcatcaaagagcgctggtcaagtgacaaaagatggaattattggcactgcgaatgcgcctattcacatggttacagcagaaacaggtcaatttaaggaccaactttggcgcaccttccgaagtattgcactaactttcctattaatttcgggcatcggtgctctcattgaggatagaggaatcagcaaaggccttggtctaaatgaagaggttcaaccaagcatggaatctagtacgaaatttagtgatgtaaaaggtgttgatgaagccaaagctgaacttgaggaaatagttcactacctccgagatccaaagcgttttacacgtctaggtggaaaactgccaaaaggtgtcctgcttgttggccctcctggcactggcaagaccatgttagcaagggctattgctggtgaagccagtgttccttttttctcatgcagtggtagtgagtttgaggagatgtttgtaggtgtaggagctagaagagtgagggatctttttgctgcagccaaaaaacgatcgccttgtatcatattcatggatgaaattgatgcaattggtgggagtagaaatccaaaggaccagcagtatatgaagatgaccttgaatcagttacttgtcgagctggatggctttaagcagaatgaggggataattgtcatcgctgcaactaacttccccgagtcattagataaagcactagtcagacctgggcgctttgaccgtcatattgttgttcctaatccagatgttgagggcagacgtcaaattttagaggtccacatgacaaaggtcttaaagggtgatgatgtggatttgatgaccattgccaggggaacaccaggcttttcaggtgctgaccttgctaacctggtgaatgtggctgctcttagggctgccatggatggagcgaaatctgttacaatgactgatctggagtatgccaaggaccggatcatgatgggtagtgagcgcaagtcggcagtgatctcggatgagagcaggaagctgacagcgtaccatgagggagggcatgcccttgttgccatccacaccgatggtgctcaccctgtccacaaagctaccattgtgcccagggggatggcccttgggatggtggctcaactccctgacaaagatgagactagcgtgtcaaggaaacaaatgctagcaagcttggatgtctgtatgggagggcgggtggcagaggagcttatatttggggagagcgaggtgacatctggtgcttcatctgacttcgagcaagcaacttcgatggcaagagcaatggttactcaatatggtatgagcaagcaggtcggtcttgtttcgtacaactatgaagatgatggaaagactatgagctcagaaacgaggcttctaattgaggaggaggtgaagaatttcttggagagggcatacaacaatgcaaagactatcctgacgaaacacaacaaggagctgcatactctagccaatgcacttcttgagcacgagacgctcagcggagcccagataaagaacttattagcccaggcagataacaaacagccgcaggagcatggtgttgaagccccacagaagacaccagcttcacccccatcaccagctgccgcagctgcagctgcggctgcagcggcagcacaaaaagccgcagcgcaagccacgggtgttgctggtatcggatcttagcacatgggacatccacaggtttgcgttgtgtatagttacgaaactagcaggtttttccatcaaatcatcagctgatgagcatcatgaagaatatgatgctacgctgctgcatcaacacgagggcacattgattgtttgtacgaatgctattgatgttcctctggtgaatagggcacacatggaagaaaattcacacattgtagcaggcacatgtagctagtgtttgagtatgagctttgttctcgcatgccgtctgtagttttcaactctacatctcaataattgttaccgttcagacctgccttgtatttgtaggaataaggcatgctctattctgaagtctgagacgcatttggtagctgcgaagtctgcttctctggccctcttatgctcaat

SEQ ID NO: 2537 - DNA, 2778 bp, Brachypodium distachyon
ctcgccgcggcgcacctcgccgccgccgaatcctccccctccgcgttcctgccgtagttccgggtcctccgttcccaccggtccgtaaatttgcacccccagccccaccaaggcccaaactccaatccaaatccaatccttccgtgagcctgcctgcttgggactcgggatctcgtcgggagaggaggcggaggattgaggatttgggcccatggcgtggcggcgcgtcctatcccaggctgcaaggaatcagtcagcatacgcaatctataatgaactggcagccccctcccctcttaggtcacttagaagtaacatcagtgcaggtggcacactcaggaacttacatgagaggtattattcaagctattttggtagcctttcacgcagcgcacgagacctgggctcgccaagtgaagcttctctgttaaaagagatatacagaagtgacccagagcgtgtcatacagatatttgaaggccagccttcattgcattctaatccttcagcactctctgagtatgtaaaagctctcgtaaaggtcgataggctggatgaaagcatcttgctaaaaacattgcaaagaggtgttgctgcttcagaaagggcggaaggaagccttagtagcgtgccagcattaaagagtgctggtcaagtgacaaaagatgggattattggcaccgcgaatgcgcctattcacatggttacagcagaaacaggtcaatttaaggaacagctttggcgtaccttccgaagcattgcactaactttccttttaatttcgggcatcggggctctcatcgaggatagaggaatcagcaaaggcctcggtctaaatgaagaggttcaaccaagcatggaatctagtacgaaatttagtgatgtaaaaggtgttgatgaagccaaagctgaacttgaggaaatagttcactaccttcgagatccgaagcgttttacacgtcttggaggaaaactgccaaaaggtgtactgcttgttggccctcctggcactgggaagaccatgttagcaagggctattgctggggaagcaagtgttccttttttctcatgcagtggtagtgagtttgaggagatgtttgtaggtgttggagctagaagagtgagggatctttttgctgcagcaaaaaaacgatcgccttgtatcatattcatggatgaaattgatgctattggtgggagtagaaatccaaaggatcaacagtatatgaagatgacattgaatcagttgcttgttgagctggatggctttaaacagaatgaggggataattgtcattgctgcaactaacttccccgagtcattagataaagcacttgtcagacctgggcgctttgaccgtcatattgttgttcctaatccagatgttgagggtcgacgacaaatcttggagtctcacatgtcaaaggtcttgaagagtgaggatgtggatttaatgatcattgccagggggacaccaggattttcaggtgctgaccttgctaacttggtgaatgtggctgctcttaaggccgccatggatggggccaaatctgttacaatgaatgatctggagtatgccaaggaccggatcatgatgggtagcgagcgcaagtcagcagttatctctgatgagtgcaggaaactgacagcataccacgagggagggcatgcgcttgttgctatgcacaccgatggtgctcaccctgtccacaaagctaccatcgtgcccagggggatgtcccttgggatggtggctcaactccctgaaaaagacgagactagtgtgtcacggaaacagatgcttgcaagattggatgtctgtatgggaggacgggtggcagaggagattatatttggggatagtgaggtgacatctggtgcttcatctgatttccagcaagcaacttcgatggcaagagcaatggttactaaatatggtatgagcaagcaggttggtcttgtttcatacaactatgaagacgatggaaagactatgagctcagaaacaaggcttctaattgaggaggaggtgaagagtttcttggagaaggcatacaataatgcaaagactatcctcacaaaacacaacaaggagctccatgttcttgccaatgcgcttcttgagcacgagaccctcagcggtgcccaaataaagaaaatactggcccaggtaaataacaaacagccacaggagcatgctattgaagctccacagaagacacaaacttcaccctcatctccagctgcagcagctgctgctgccgctgcagcggcagcacaacaagcggcagcgaaagcccagggagtcgctggtatcggttcttagcacatgggacgcccactggtttgcattgtgtatattcaccaaattagcaggttgtttccatcaattgacagctgatgaggatcatgaagaatatgcaatgctgttgcatcaatatgaacgtcatattgaccgtatgtaagttagtattgatgttcctcgggggacgaaaagaaaacacatggaagaaaatctgcacattgtagcaagtgcatgtagcaaaaatgcttgaaaatgagttctgtactcacatgccgaacgagttgtgttgtttacaactttacatggtaataattttgacttttaaagtctgccttgtattttgtatgagtaacaataaagcgtgctctgctctgcattctgatacgcatttgactcttgatgctcatcatgtttgtatctgcatgaatcatgcaaaccaccataaatttacctccaggtggttcttatgtttt

SEQ ID NO: 2538 - DNA, 3429 bp, Brachypodium distachyon
gtaccgtaagagctctcgaagcagggaagaaaaggaaaaaaaatctgaacacctatttgtcttcccttgcgctccctgcgccgcgtgagtgcgtgacgtggtccgttttctctcgccgcttcctcctgctcgccgcggcgcacctcgccgccgccgaatcctccccctccgcgttcctgccgtagttccgggtcctccgttcccaccggtccgtaaatttgcacccccagccccaccaaggcccaaactccaatccaaatccaatccttccgtgagcctgcctgcttgggactcgggatctcgtcgggagaggaggcggaggattgaggatttgggaccatggcgtggcggcgcgtcctatcccaggctgcaaggaatcagtcagcatacgcaatctataatgaactggcagccccctcccctcttaggtcacttagaagtaacatcagtgcaggtggcacactcaggaacttacatgagaggtattattcaagctattttggtagcctttcacgcagcgcacgagacctgggctcgccaagtgaagcttctctgttaaaagagatatacagaagtgacccagagcgtgtcatacagatatttgaaggccagccttcattgcattctaatccttcagcactctctgagtatgtaaaagctctcgtaaaggtcgataggctggatgaaagcatcttgctaaaaacattgcaaagaggtgttgctgcttcagaaagggcggaaggaagccttagtagcgtgccagcattaaagagtgctggtcaagtgacaaaagatgggattattggcaccgcgaatgcgcctattcacatggttacagcagaaacaggtcaatttaaggaacagctttggcgtaccttccgaagcattgcactaactttccttttaatttcgggcatcggggctctcatcgaggatagaggaatcagcaaaggcctcggtctaaatgaagaggttcaaccaagcatggaatctagtacgaaatttagtgatgtaaaaggtgttgatgaagccaaagctgaacttgaggaaatagttcactaccttcgagatccgaagcgttttacacgtcttggaggaaaactgccaaaaggtgtactgcttgttggccctcctggcactgggaagaccatgttagcaagggctattgctggggaagcaagtgttccttttttctcatgcagtggtagtgagtttgaggagatgtttgtaggtgttggagctagaagagtgagggatctttttgctgcagcaaaaaaacgatcgccttgtatcatattcatggatgaaattgatgctattggtgggagtagaaatccaaaggatcaacagtatatgaagatgacattgaatcagttgcttgttgagctggatggctttaaacagaatgaggggataattgtcattgctgcaactaacttccccgagtcattagataaagcacttgtcagacctgggcgctttgaccgtcatattgttgttcctaatccagatgttgagggtcgacgacaaatcttggagtctcacatgtcaaaggtcttgaagagtgaggatgtggatttaatgatcattgccagggggacaccaggattttcaggtgctgaccttgctaacttggtgaatgtggctgctcttaaggccgccatggatggggccaaatctgttacaatgaatgatctggagtatgccaaggaccggatcatgatgggtagcgagcgcaagtcagcagttatctctgatgagtgcaggaaactgacagcataccacgagggagggcatgcgcttgttgctatgcacaccgatggtgctcaccctgtccacaaagctaccatcgtgcccagggggatgtcccttgggatggtggctcaactccctgaaaaagacgagactagtgtgtcacggaaacagatgcttgcaagattggatgtctgtatgggaggacgggtggcagaggagattatatttggggatagtgaggtgacatctggtgcttcatctgatttccagcaagcaacttcgatggcaagagcaatggttactaaatatggtatgagcaagcaggttggtcttgtttcatacaactatgaagacgatggaaagactatgagctcagaaacaaggcttctaattgaggaggaggtgaagagtttcttggagaaggcatacaataatgcaaagactatcctcacaaaacacaacaaggagctccatgttcttgccaatgcgcttcttgagcacgagaccctcagcggtgcccaaataaagaaaatactggcccaggtaaataacaaacagccacaggagcatgctattgaagctccacagaagacacaaacttcaccctcatctccagctgcagcagctgctgctgccgctgcagcggcagcacaacaagcggcagcgaaagcccagggagtcgctggtatcggttcttagcacatgggacgcccactggtttgcattgtgtatattcaccaaattagcaggttgtttccatcaattgacagctgatgaggatcatgaagaatatgcaatgctgttgcatcaatatgaacgtcatattgaccgtatgtaagttagtattgatgttcctcgggggacgaaaagaaaacacatggaagaaaatctgcacattgtagcaagtgcatgtagcaaaaatgcttgaaaatgagttctgtactcacatgccgaacgagttgtgttgtttacaactttacatggtaataattttgacttttaaagtctgccttgtattttgtatgagtaacaataaagcgtgctctgctctgcattctgatacgcatttgactctgatgctcatcatgtttgtatctgcatgaatcatgcaaaccaccataaatttacctccaggtggttcttatgttttgttggtcaactgcattgctgagatatgccacatggtcctgctgctttacaggcctcgccgtcaatcagattagattatgaaagcaaacattacagaagatacttactcgtttcagagcagatgcaccgtatcctggaacgcttttgcatacaggactgcggcaggccaagcagcaccacgatgccgccgctgtatatgcaaaattgtgaaccatattactaagtttgtcaaaatttgaatgtatttagacatgacttagtgtatagatgcattcaaatttaatcaaagttgagacattttttgttggacggaagaagtatctaactcaatatatatacttcctccgtccaacaaaagatgtctcaaatttattaaaatttagatgtatctagacataacttagtgtatggatgcattcaaatttagtcaaagttgagacatactttgttggacggaagaagggaaaatctaagctttgcctatcgcaagataatctggtagcttcgttttctttttcctcccca

SEQ ID NO: 2539 - DNA, 2845 bp, Setaria italica
gaaaaaaagaaaaaaaaatcggagctccccctcgtgtcctcttcctctccttcacttcttccttccaacctcccctgctcgcgcgtgacctgggccgccgccgcctccatccaaccctcccgctgccgcttcaaccgcgccgccaccgccgccgcctaatcttgccttcgcctccgcgcggctcggagcctcgttcccgtgggaatcgtccgtccgccccgaccgcccaatccccccaaacctccgcccgcgtgggcgcttcttcctcgggatctcgtcggtccgggcggcgcagggctagggattcgggcccatggcgtggcggcgcgtcctgacccagatcgcaaagcatcgacccacaaaagcaatctacaatgagctagttgcttcctcccctttaggcactcttagaaccgaagtcactgcaggtgccagaattagaaacttacaagagaggaatcagtcaagctatattggtagccttgcacgccgtgtgcgggacctagatgcaccaagcgaaacttctctgcttaaagagatttacagaagtgacccagagcgtgtcatacaaatatttgaaagtcaaccttcgctccattccaatcctgcagcactttcggagtatgtgaaagctcttgtaagggttgataggctggatgagagcaccttgcttaaaacattacagagaggtgttgctgcttcaacaaggggggaagaaagctttggcagcattccagcattaattggtgctggtcaagcgacaaaagatggagttcttggcactgcaaatgcacctattcacatggttacagcagaaacaggtcaatttaaagatcagctttggcgtaccttccgaagcattgcactaactttccttcttatttcgggcatcggggctctcatcgaggatagaggaatcagcaaaggccttggtctgaatgaagaggtccaaccaagcatagagtctaatacgaagttcagtgatgtaaagggtgttgatgaagccaaatctgaacttgaggaaatagttcattatcttcgagatcccaagcgcttcacacgtcttggtggaaaacttccgaaaggtgtcttgcttgttggccctcccggcactggcaaaaccatgctagcaagggctattgctggtgaagctggtgttcctttcttctcatgcagcggaagtgagtttgaggagatgtttgtgggagttggagctcgaagagtgcgcgacctttttgctgcagcaaaaaagcgatctccttgtataatattcattgatgaaattgatgcaattggtgggagcaggaatcctaaggatcaacaatatatgaagatgaccttgaatcagttgcttgtcgagttagatggctttaagcagaacgaggggataattgtcattgctgcaaccaacttccctgaatcactagataaggccctagtcagacctgggcgttttgaccgtcatattgttgttcccaacccagatgttgagggccggcggcaaattctagattcccacatgtcaaaggtcttgaagggtgatgacgtggacttgatgatcattgccaggggaacaccgggattctctggtgctgaccttgctaacttggtaaatgttgctgctctcaaggctgccatggatggtgcaaaagctgtcacaatgaatgatcttgaatatgcaaaggaccgaatcatgatgggtagtgagcgcaagtcagcagttatttctgatgaatgcagaaagttgacggcatatcatgaaggagggcatgcccttgttgccatccacacagacggagctcaccctgtccacaaagctaccatagtacccagggggatggccctaggaatggtggcccaactccctgaaaaagatgagactagtgtgtcaaggaaacagatgctggcaaacttggatgtctgcatgggagggcgtgtggcagaggagcttatatttggagatactgaagtgacatctggtgcgtcatctgacttccagcaagcaactgcaacggcaagagctatggttactaaatatggcatgagcaagcaagtcggccttgtctcttacaactacgaagatgatggaaagagcatgagctcagaaacaagacttttgattgagcaggaggtgaagaatttcttggagaatgcatacaataatgcaaagactattcttacgaaacacaataaggagctccatgctctagccaacgcacttcttgaacatgagaccctcactggagcccagataaagaacatattggcccaggtaaataacaagcagcaacaggagcatgctattgaagcaccacagaagaccccagccgcaccagcttcccctgcatcaccagctgcatcagctgctgcggcagcagctgcagctgctgcagctgcacagcaggcggcagccaaagccaagggggtggctggtatcggatcttagtgcatggagcacccaccagtttgcattgtgtatatttcaccaaactagtaagatgttccagcaattgacgatcaagaggatcatcaggatatgctaaactgctgcagcaatagaaaatactgattgtgtgtaagctactgttcatgtgcctcgagggcaaaacaagactttacacattgtagtaggcacatttagctggtgctcgaatcagttttgtacccacatccaaaatgatttctgttgtttagaacctaataattgttagcctttgatccgcctgccttatgtacctacagagcataaattgtaacacattctgaataaggtatcctgtgtgcttgaatacaaatgtggtaactggtagctgatgagtcaatttctcagcttctctgatgctca

SEQ ID NO: 2540 - DNA, 2836 bp, Setaria italica
gaaaaaaaaatcggagctccccctcgtgtcctcttcctctccttcacttcttccttccaacctcccctgctcgcgcgtgacctgggccgccgccgcctccatccaaccctcccgctgccgcttcaaccgcgccgccaccgccgccgcctaatcttgccttcgcctccgcgcggctcggagcctcgttcccgtgggaatcgtccgtccgccccgaccgcccaatccccccaaacctccgcccgcgtgggcgcttcttcctcgggatctcgtcggtccgggcggcgcagggctagggattcgggcccatggcgtggcggcgcgtcctgacccagatcgcaaagcatcgacccacaaaagcaatatacaatgagctagttgcttcctcccctttaggcactcttagaaccgaagtcactgcaggtgccagaattagaaacttacaagagaggaatcagtcaagctatattggtagccttgcacgccgtgtgcgggacctagatgcaccaagcgaaacttctctgcttaaagagatttacagaagtgacccagagcgtgtcatacaaatatttgaaagtcaaccttcgctccattccaatcctgcagcactttcggagtatgtgaaagctcttgtaagggttgataggctggatgagagcaccttgcttaaaacattacagagaggtgttgctgcttcaacaaggggggaagaaagctttggcagcattccagcattaattggtgctggtcaagcgacaaaagatggagttcttggcactgcaaatgcacctattcacatggttacagcagaaacaggtcaatttaaagatcagctttggcgtaccttccgaagcattgcactaactttccttcttatttcgggcatcggggctctcatcgaggatagaggaatcagcaaaggccttggtctgaatgaagaggtccaaccaagcatagagtctaatacgaagttcagtgatgtaaagggtgttgatgaagccaaatctgaacttgaggaaatagttcattatcttcgagatcccaagcgcttcacacgtcttggtggaaaacttccgaaaggtgtcttgcttgttggccctcccggcactggcaaaaccatgctagcaagggctattgctggtgaagctggtgttcctttcttctcatgcagcggaagtgagtttgaggagatgtttgtgggagttggagctcgaagagtgcgcgacctttttgctgcagcaaaaaagcgatctccttgtataatattcattgatgaaattgatgcaattggtgggagcaggaatcctaaggatcaacaatatatgaagatgaccttgaatcagttgcttgtcgagttagatggctttaagcagaacgaggggataattgtcattgctgcaaccaacttccctgaatcactagataaggccctagtcagacctgggcgttttgaccgtcatattgttgttcccaacccagatgttgagggccggcggcaaattctagattcccacatgtcaaaggtcttgaagggtgatgacgtggacttgatgatcattgccaggggaacaccgggattctctggtgctgaccttgctaacttggtaaatgttgctgctctcaaggctgccatggatggtgcaaaagctgtcacaatgaatgatcttgaatatgcaaaggaccgaatcatgatgggtagtgagcgcaagtcagcagttatttctgatgaatgcagaaagttgacggcatatcatgaaggagggcatgcccttgttgccatccacacagacggagctcaccctgtccacaaagctaccatagtacccagggggatggccctaggaatggtggcccaactccctgaaaaagatgagactagtgtgtcaaggaaacagatgctggcaaacttggatgtctgcatgggagggcgtgtggcagaggagcttatatttggagatactgaagtgacatctggtgcgtcatctgacttccagcaagcaactgcaacggcaagagctatggttactaaatatggcatgagcaagcaagtcggccttgtctcttacaactacgaagatgatggaaagagcatgagctcagaaacaagacttttgattgagcaggaggtgaagaatttcttggagaatgcatacaataatgcaaagactattcttacgaaacacaataaggagctccatgctctagccaacgcacttcttgaacatgagaccctcactggagcccagataaagaacatattggcccaggtaaataacaagcagcaacaggagcatgctattgaagcaccacagaagaccccagccgcaccagcttcccctgcatcaccagctgcatcagctgctgcggcagcagctgcagctgctgcagctgcacagcaggcggcagccaaagccaagggggtggctggtatcggatcttagtgcatggagcacccaccagtttgcattgtgtatatttcaccaaactagtaagatgttccagcaattgacgatcaagaggatcatcaggatatgctaaactgctgcagcaatagaaaatactgattgtgtgtaagctactgttcatgtgcctcgagggcaaaacaagactttacacattgtagtaggcacatttagctggtgctcgaatcagttttgtacccacatccaaaatgatttctgttgtttagaacctaataattgttagcctttgatccgcctgccttatgtacctacagagcataaattgtaacacattctgaataaggtatcctgtgtgcttgaatacaaatgtggtaactggtagctgatgagtcaatttctcagcttctctgatgctc

SEQ ID NO: 2541 - DNA, 2947 bp, Oryza sativa
attattattattattttcgggcaagaaaatcaccgagaactcctctctccggtcggtgtccccctgcgccgcgtgaccgtcaactgacgtggcccatccctcctctcttccccccacctcgccgccggcgaattcctcgcctccgccgcgaccgagcccccgccgctcttggggcttcgctcgcttctccagcgcaaccctcccccccctcccccgccgccgccctcacacagggttctcttgcgggttggggatctcatcgcggcggcggcggcggactaataagggattccggccgatggcgtggcggcgcgtcctttcgcaggtcgcaaggaaccgatccgcatatgcaatctgcaatgaaataatagcctccaacccatcgaggattcttagaggtgacaccatagcaggtggaacacttagaaacttacatgagaggtatcagtcaagctatgttggtagctttgcacgcaggatgcgacagatggactcaccaagtgaagcctctctgctgaaagaaatatataggagtgatccagaacgtgtcatacagatatttgaaagccaaccttcattgcattccaatccttcagcacttgctgagtatgtaaaagctcttgtcagggttgataggttggaggatagcaccttgctgaaaacattgcagagaggaattgctgcttcagcaagggaggaagaaaaccttggtagtgtttcagaaaatcttggtagtgtttcagcagttagaagtgccggtcaagtgacaaaagatggaattcttggcactgcaaatgcacccattcacatggttacagcagaaacaggtcaatttaaggaacagctttggcgtacctttcgaagtatagcgctaacattcctcctgatttctggcattggagctcttattgaggatagaggaataagcaaaggccttggtctaaatgaagaggttcaaccaagcatggaatctaatacgaaattcagtgatgtaaagggtgtcgatgaagccaaagctgaacttgaggaaatagttcactacctccgagatcccaagcgttttacacgtcttggtggaaaactgccaaaaggtgtcttgctggttggtcctcctggcactggaaagaccatgttagcaagggctattgctggggaagctggtgttcctttcttctcatgcagtggtagtgaatttgaggagatgtttgtaggcgtaggagctagaagagtcagggacctttttgctgcagctaaaaaacgttctccctgtatcatattcatggatgaaattgatgcgatcggtgggagtagaaatccaaaggatcaacagtatatgaagatgacgttgaaccagttgcttgtcgagctggatggctttaagcagaatgaggggataattgttattgctgcaaccaactttcctgagtccctagataaagcactagtgagacctgggcgctttgaccggcatattgttgttccaaatccagatgttgaaggccggcggcaaatcctagagtcccatatgtcaaaggtcttgaagagtgatgatgtggatttgatgatcattgccaggggaacacctggattctcaggtgcagaccttgctaacttggttaatgtggctgctcttaaagctgccatggatggggcaaaagccgttacaatgaatgatcttgagtatgccaaggaccggatcatgatgggcagtgagcgcaagtcagcagttatttctgatgaatcccggaaattgacggcgtaccatgagggagggcacgcccttgttgccatccacactgaaggtgctcaccctgttcacaaagctaccatagttcccaggggaatggcccttggaatggtggcccaactcccggataaagatgagacaagcgtgtcacggaaacagatgctggcaaggctggatgtgtgcatgggagggcgggtggcggaggagcttatttttggggatagcgaggtgacatctggcgcttcatctgattttcagcaagcaactgcagtggcaagagcaatggtaaccaaatatggtatgagcaagcagcttggctttgtttcttacaattatgaggatgatggaaagagcatgagcaccgaaacgagactcctgattgagaaggaggtcaagtgtttcgtggagaatgcttacaacaatgcaaagaatattctcatcaaacacaacaaggagctccatgctctagccaatgcgctgcttgagcacgagacgctcaccggtgcccaaataaagaacatattggcccaagtaaacaacaagcagcagcaggagcatgctattgaagctccacagaagacaccagctgtaccatcatctccagctgcatcagctgcagcggcagcggcagctgcagcagccgcagcacagcaagctgcagcgaaagcgaagggtgaaatcgccggtatcggatcttagcagtcaccaaatgatgttggatcgattgacagctcttgaggatcacgaagagtttgctaatgctgctgcagtcatcaatagaacatattgattgtgtgtaagctgttatttcgtttcatgttcctcaagtgtgtggtaagaaaacataagagaaatcataacattgtagaaggcacatttagactgtgcttgatatgtgaatttttgtatcacatggccacacacacggaaatactgtttacatcctaataattttcagctaccttagacgttggatggttatacctaacagagaacctgttgtatttgtctagaatggtagctccagagtccatttctttagccctgtgatgctcccttgttgtactgtatgttctgcaagttgacaaaagaagtttttctgtatctttgctgaattgccgtgtaatgacaaacagtaatgttggggccagatactcgccaattgcaggtattctgtcatcaatcagttttttattcctg

SEQ ID NO: 2542 - DNA, 2819 bp, Sorghum bicolor
cgtcttcctctccttcacttctcctgccctgtccaccctcgactgcctgcgcgtgacctcagcccccgccgcctacatccgctcatctccgcgcccgcctcaaccgcgccgccaccgaccacctctaatcccgcctcaccctccgtgcggttcccgaggctcgtttcctttgggggtcgtccgtctgccccgaccgcgtcggcgcttcttcttcttcgggatctcgctgggccgagcggcgcagggctagggattcgggcccatggcgtggcggcgcgtcctcacccagattgcaaggcatcgaccaacaaaagcaatctacaatgaactagttgcttcctcccctttgggcactcttcgaagtgacatcactgcaggtgccagaattaaaaatttacaagagaggaaccagtcaagttacattggtagccttgcacgccgggtgcgagatctagaatcaccaagcgaaacttctctacttaaagagatttacagaagtgacccagagcgtgtcatacaaatatttgaaagccaaccttctttacattctaatccagcagcactttcagagtatgtgaaagctcttgtaagggttgataggctggacgagagtgccttgcttaaaacactgcagagaggtgctgcttcctcgacaaggggggaagaaagctttggtagcattccagcattaattggtgctggtcaagtgacaaaagatggagctcttggcactgcaaatgcacctattcacatggtcacagcagaaacaggacaatttaaggatcagctttggcgtaccttccgaagcattgcactaactttccttcttatttcgggcatcggtgctctcattgaggatagaggaatcagcaaaggacttggtctgaatgaagaggttcaaccaagcatggagtctactacaaaattcagtgatgtaaagggtgttgatgaagcaaaatctgaacttgaagaaatagttcattatcttcgagatcccaagcgcttcacacgtcttggtggaaaacttccgaaaggtgtcttgcttgttggccctcctggcactgggaaaaccatgctagctagggctattgctggtgaagctggtgttcctttcttctcttgcagtggaagcgagtttgaggagatgtttgtgggagttggagctcggagagtgcgagacctttttgctgcagcaaaaaagcgatctccttgcatcatatttattgacgaaatagatgcaattggtgggagccggaatcctaaggatcaacagtatatgaagatgaccttgaaccagctgcttgttgagttggatggctttaagcagaatgaggggataattgtcattgctgcaaccaactttcctgagtcactagataaagccctagtcagacctgggcgttttgaccgtcatattgttgttcccaacccagatgttgaagggcgacgtcaaattctagaatcccatatgtcaaagatcttgaaaagtgatgatgtggacttaatgatcattgctagaggaacaccgggattctctggtgcagaccttgctaacttggtaaatgttgctgctcttaaggctgccatggatggtgcaaaagctgtcacaatgaatgatcttgagtatgcaaaggaccgaatcatgatgggtagtgagcggaagtcggcagttatctctgacgaatgcaggaagttgacagcataccatgagggagggcatgcccttgttgctatccacactgaaggagctcaccccgtccacaaggctaccatcgtacccaggggcatggctctaggaatggtggcccaactccctgacaaagaccagactagtgtgtcaaggaaacagatgctagcaaaattggatgtatgcatgggaggccgtgtggcagaagagcttatatttggggatactgaggtgacatctggtgcatcctcagacttccagcaagcaactgcaatggcaagagcaatggttactaaatatggcatgagcaagcaggtcggccttgtctcttataactatgaggacgatggaaagagcctgagctcagaaactagacttgtgattgagcaggaggtgaagaatttcttggagaatgcatataataatgcgaagaccattcttacaaaacacaataaagagctacatgctctagccaacgcacttcttgagcatgagaccctcacaggagcccagataacgaacatattggcccaggtacataacaaacagcaacaggagcatactatcgaagcaccgcagaagaccccagccgcaccagcttcccccgcatcaccagctgcatcagctgctgcagcagcagctgcagccgccgccgcagcacagcaggcggcagccaaagctaagggggtggctggtatgggatcttagcacatggaccactccaccagattgcattgtgtatatttcatcaaacaagcaaagctgttccagcaattgacagtcgacgagggtcattggtagtatgctaaagtgctgcagcaatagaacatactgattgcgtggaagttactgttcatgtgccttcagtgcaaagcagaaacaaaaactttacacattgtagtaggcacatttagctggtgcttgaatcagttttgtacccacatcgaaaacaatttatgttgtttacaccccaaaaattgttagattttgatctgcctgcctcttgtaccttaacagagcataaattgtaacacattctgaataagtgtcctgtgtgcttaatacaatgtggtagctgacgagtcgattcatcagcccctctgatgctcatttgttgtatgttacttcctcc

SEQ ID NO: 2543 - DNA, 2800 bp, Saccharum officinarum
tgcttgtgcgtgagctgagcccccgccgcctacatccgctcatccccgcgcccgcctcaaccgcgccgccaccgaccacctctaatccggcctcccccgccgcgcggttccgaggctcgtttccgttgggatcgtccgtccgccccgaccgcgtgggcgcttcttcttcgggatctcgctgggccgagcggcgcagggctagggattcgggcccatggcgtggcggcgcgtcctcacccagattgctaggcatcgaccaacaaaagcaatctataatgaactagttgcttcctcccctttgggcgctcttcgaagtgacatcactgcaggtgccagaattagaaatttacaagagaggaaccagtcaagttacattggtagccttgcacgccgggtgcgagacctagaatcaccaagtgaaacttctctgcttaaagagatctacagaagtgacccagagcgtgtcatacaaatatttgaaagccaaccttcattacattctaatcctgcagcactttcagagtatgtaaaagctcttgtaagggttgataggctggacgagagtgccttgcttaaaacactgcagagaggtgttgcttcctcgacaaggggggaagaaagctttagtagcattccagcattaattggtgctggtcaagtgacaaaagatggggctcttggcactgcaaatgcacctattcacatggtcacagcagaaacaggtcaatttaaggatcagctttggcgtaccttcagaagcattgcactaactttccttcttatatcgggcatcggtgctctcatcgaggatagaggaatcagcaaaggccttggtctgaatgaagaggttcaaccaagcatggagtctagtacaaaattcagtgatgtaaagggtgttgatgaagcaaaatctgaacttgaagaaatagttcattatcttcgagatcccaagcgcttcacacgtcttggtggaaaacttccgaaaggtgtcttgcttgttggccctcctggcactgggaaaaccatgctagctagggctattgctggtgaaactggtgttcctttcttctcttgcagtggaagcgagtttgaggagatgtttgtgggagttggagctcggagagtgcgagaactttttgctgcagcaaaaaagcgatctccttgcatagtatttattgatgaaatagatgcaattggtgggagccggaatcctaaggatcaacagtatatgaagatgaccttgaaccagctgcttgtcgagttggatggctttaagcagaacgaggggataattgtcattgctgcaaccaactttcctgagtcactagataaagccctagtcagacctgggcgttttgaccgtcatattgttgttcccaacccagatgttgaaggtcgacgtcaaattctagaatcccatatgtcaaagatcttgaaaagtgatgatgtggacttaatgatcattgctagaggaacaccaggattctctggtgcagaccttgctaacttggtaaatgttgctgctcttaaggctgccatggatggtgcaaaagctgtcacaatgaatgatcttgagtatgcaaaggaccgaatcatgatgggtagtgagcggaagtcggcagttatctctgacgaatgcaggaagttgacagcataccatgagggagggcatgcccttgttgctatccacacagaaggagctcaccctgtccacaaggctaccatcgtacccagggggatggctctaggaatggtggcccaactccctgacaaagaccagactagtgtgtcaaggaaacagatgctagcaaaattggatgtctgcatgggaggccgtgtggcagaagagcttatatttggggatactgaggtgacatctggtgcgtcctcagacttccagcaagcaactgcaatggcaagagcaatggttactaaatatggcatgagcaagcaggtcggccttgtctcttataactacgaggacgatggaaagagcctgagctcagaaactagacttgtgattgagcaggaggtgaagaatttcttagagaatgcatataataatgcgaagaccattcttacaaaacacaataaagagctacatgctctagccaacgcacttcttgagcatgagactctcacaggagcccagataacgaacatattggcccaggtacataacaaacagcaacaggagcatactatcgaagcaccacagaagaccccagccgcaccagcttcccccgcatcaccagctgcatcagctgctgcagcagcagctgcagccgccgcggcagcacagcaggcggcagccaaagctaagggggtggctggaatgggatcttagcacatggaccaccccaccagattgcattgtgtatatttcaccaaacaagcaaagctgttccagcaattgacggttgacgagggtcatcggtagtatgctaaactgctgcagcaatagaacatactgattgcatggaagttactgttcatgtgcctgcagtgcaaagcagaaacaaaaactttacgcattgtagtaggcacatttagctggtgcttgaatcagttttgtacccacatcaaaaacaatttctgttgtttacaccccaaaaattgttagattttgatctgcctgccttctgtaccctaacagagcataaattgtaacacattctgaataagatgccctgtgtgcttgaatacaatgtggtaactgccgagtcgattcatcagcccctctgatgctcgtttgtggatggtatgtcttatcaaactaatatgagatcccctttttccc

SEQ ID NO: 2544 - DNA, 2602 bp, Zea mays
atatacatgttgatgtatgtatacatatgaatgttagttgctttagctgatccaggtttgtgtgtgttttgtgttgtcctcacccagattgcaaggcatcgaccagcaaaagcaatctacaatgaactagttgcttcctcccctttgggtgttcttcgaagtgacatcacttcaggtgccaggattagacatttacaagagaggaaccagtcaagttacattggtagccttgcacgccgggtccgagacttagaatcaccaagcggaacttctctgcttaaagagatttacagaagtgacccagagcgtgtcatacaaatatttgaaagccaaccttcattacattctaatcctgcagcactttcggagtatgtaaaagctcttgtaagggttgataggctggatgaaagtgccttgcttaaaacactgcagagaggtgttgcttcctcgacaaggggcgaagaaagctttagtagcattccagcattaattggtgctggtcaagtaacaaaagatggagctcttggcactgcaaatgcacctattcacatggtcacagcagaaacaggtcaatttaaggatcagctttggcgtaccttccgaagcattgcactaactttccttcttatctcgggcattggtgctctcatcgaagatagaggaatcagcaaaggccttggtctgaatgaggaggttcaaccaagcattgagtctaaaacaaaattcagtgatgtaaagggtgttgatgaagcaaaatctgaacttgaagaaatagttcattatcttcgagatcccatgcgcttcacatgtcttggtggaaaacttcctaaaggtgtcttgcttgtgggccctcctggcactgggaaaaccatgctagctagggctattgctggtgaagctggtgttcctttcttctcttgcagtggaagcgagtttgaggagatgtttgtgggagttggagctcggagagtgcgggacctttttgctgctgcaaagaagcgatctccttgcataatatttattgatgaaatagacgcaattggtgggagtcggaatcctaaggatcaacagtatatgaagatgaccttgaaccagctgctcgttgagttggatggctttaagcagaatgaggggataattgtcattgctgcaacgaactttcctgagtcgctagataaagccctagtcagacctgggcgttttgaccgtcatattgttgttcccaacccagatgttgaaggtcgacgccaaattctagaatcccatatgtcaaagatcttgaaaggtgatgatgtggacttaatgatcattgctagaggaacaccgggattctctggtgcagaccttgctaacttggtaaatgttgctgctcttaaggctgccatggatggtgcaaaagctgtcacaatggatgatcttgagtatgcaaaggaccgaatcatgatgggtagtgagcggaagtcggcagttatctctgacgaatgcaggaagctgacagcataccatgagggagggcatgcccttgttgcaatccacacagaaggagctcaccctgtccacaaggctaccatcgtacctagggggatggccctaggaatggtggcccaactccccgacaaagaccagacaagtgtgtcaaggaaacagatgctagcaaaactggatgtctgcatgggaggccgtgtggcagaagagcttatctttggggatactgaggtgacatccggtgcgtcgtcagatttccagcaagcgaccgcaatggcgagagcaatggttactaagtatggcatgagcaagcaggtcggccttgtctcttataactacgaggacgatggaaagagcatgagctcagaaacgagacttgcgatcgagcaggaggtgaagaacttcttggagaatgcatacagcaatgcgaagaccattcttacaaaacacaacaaagagctccatgctctagccaacgcacttcttgagcatgagaccctcacaggagcccagataaagaacatattagcccaggttcataacaaacagcaacatgagcatactatcgaagcaccacagaaggcctcagtcgcaccagcttcccccgcatcaccagctgcatcagctgctgcagcagcagcagccgccgccgcggcagcacagcaggcggcagccaaagctaagggggtggctggtatgggatcttagcacattagagcacccccactggtttgcattgtgtatatttcaccaaacaagcaaagctgttccagcaattaacgttcaacgagggtcctcggtagtatgctaaactgctgcagcaacagaacatactgattgtgtggaagctactgttcacgtgcctcgagtgcgaagcagaaacgaaaactttatgcattgtagtaggaggcacatttagctggtgattggatcagttttgtacccaaatcgaaaacaatttctgttgtttacaccccaagaattgttacatttcgatctgcctgccgccttcaccctaacagagcataaattgtaatacattctgaataagatgtcctgtgtgcttgaatacaatgtggcagctgccgaatcgattcgtcagccccttcgatgctca

SEQ ID NO: 2545 - DNA, 2668 bp, Zea mays
gtcttcctctccttcacttttcctgtacgccctcgaagcttcgactgcttgcccatgacctaagccgctgccgcctacaccctcacatcccgcgccctcctctatcgcgccgccaccgaccacccccaaatcctgcttccccaccgctcgcttccgaggctcgcttccgttgggatcgtccgtcctcccagaccgcgtgggcgcttcttcttcggaatctccgtgggccgagtggcgctgggctagggattcgggcccatggcgtggcggcgcgtcctcacccagattgcaaggcatcgaccaacaaaagcaatctacaatgaactagttgcttcctcccctttgggcgcttttcaaagtgacatcactgcaggtgccagaattaaaaatttgcaagagaggaaccagtcaagttacatcggtagccttgcacgccgggtgcgagacctagaatcaccaagccaaacctctcttcttaaagagatttacagaagtgacccggagcgtgtcatacaaatatttgaaagccatccttcattacattctaatcccgcagcactttcggagtatgtaaaagctcttgtaagggttgataggctggacgagagtgccttgcttaaaacactgcagagaggtgttgtttccttgacaaggggggaagaaagctttagtagcattccagctttaattggtgctggtcaactgacaaaggatggagctcttggcactgcaaatgcacctattcacatggtcacagcagagacaggtcaatttaaggatcagctttggcgtaccttccgaagcattgcactaactttccttcttatttcgggcatcggtgctctcatcgaggatagaggaatcagcaaaggtcttggtctgaatgaagaggttcaaccaagcatagagtctactacaaaattcagtgatgtaaagggtgttgatgaagcaaaatctgaacttgaagaaatagttcattatcttcgagatcccaagcgcttcacacgtcttggtggaaaacttccgaaaggagtcttgcttgttggtcctcctggcactgggaaaaccatgctagctagggctattgctggtgaagctggtgttcctttcttctcttgcagtggaagcgagtttgaggaaatgtttgtgggtgttggagctcggagagtgcgagacctttttgctgcagcaaaaaaacgatctccttgcataatatttattgatgaaatagatgcaattggtgggagccggaatcctaaggatcaacagtatatgaagatgaccttgaaccagctgcttgtcgagttggatggttttaagcagaaccaggggataattgtcattgctgcaaccaactttcctgagtcactagataaagccctaatcagacctgggcgttttgaccgccatattgttgttcccaacccagatgttgaaggtcgacgtcaaatcctagaatcccatatgtcaaagatcttgaaaggtgatgatgtggacttaatgatcattgccagaggaacacccggattctccggtgcagaccttgctaacttggtaaatgttgctgcacttaaggctgccatggatggcgcaaaatctgtcacaatgaatgatcttgagtatgcaaaggaccgaatcatgatgggtagtgagcggaagtcggcagttatctctgatgaatgcaggaagctgacagcataccatgagggtgggcatgcccttgttgccatccacacagaaggagctcaccctgtccacaaggctaccatcgtacccaggggggtggccctaggaatggtggcccaactccctgacaaagaccagactagtgtgtcaaggaaacagatgctagcgaaactggatgtctgcatgggaggccgcgtggcagaagagcttatatttggggatactgaggtgacctccggtgcgtcgtcagacttccagcaagcaactgcaatggcaagagcgatggttaccaagtatggcatgagcaagcatgttggccttgtctcttataactacgaggacgatggaaagagcgtgagctcagaaaccaggcttgtgattgagcaggaggtgaagaatttcctagagaacgcgtataataatgcgaagaccatccttacgaaacacaataaagagctacatgctctggccaacgcacttcttgagcacgagaccctcacaggagcccagataacgaacatattggcccaggtacgtaacaaacagcaacaagaacatactgtcgaagcaccacagagggccccagcttccccggcagcacagcaggcggcagccaaagctaagggagtggctggtatgggatcttagcacatggagcgccccaccggatgtatatttaaccaaacaagcaaagctgttccagcgattgacagttgatgaaggtcatcggatgtattgtatgctaaactgctgcagcaatagaacacactgattgcgtggaagttactcttccatgtgcctcgagtgcaaagcagagacaaaaaaactgtacgtgttgtagacttgtagctggtgcttgaatcagttttgtacccacatcgaaaacaattcctgttgtttacaccccgaaaaattgttagatttcgatctggctgccttgtgtaccctaacagagcgtaaattgtaacacatcctgaataag

SEQ ID NO: 2546 - DNA, 2476 bp, Panicum virgatum
aaatgtctttctgcttcttgtttgatatttgttttattgtttgttgcccatcacaggtgcaagaattagaaacttacaagagaggaatcagtcaagctatattggtagccttgcacgccgtgtgcgagacctagactcaccaagcgaaacttctctgcttaaagaaatttacagaagtgacccagaacgtgtcatacaaatatttgaaagtcaaccttcactgcattccaatccagcagcactttcggagtatgtaaaagctctcgtaagggttgataggttggatgagagcaccttgcttaaaacattgcagagaggtgttgctgcttctacaagaggggaagaaagctttagtagcattccagcattagttggtgctggccaagcgacaaaagatggagtttttggcactgcaaatgcacctattcatatggttacagcagaaacaggtcaatttaaagatcagctttggcgtaccttccgaagcattgcactaactttccttcttatttcgggcattggggctctcatcgaggatagaggaatcagcaaaggccttggtctgaatgaagaggttcaaccaagcatggagtctaatacaaagttcagtgatgtaaagggtgttgatgaagcaaaatctgaacttgaggaaatagttcattacctccgagatcccaagcgcttcacgcgtcttggtggaaaacttccaaaaggtgtcttgcttgttggccctcctggcacagggaaaaccatgctagcgagggctattgctggtgaagctggtgtacctttcttttcttgcagtggaagtgagtttgaggagatgtttgtgggagttggagctcgaagagtgcgcgacctttttgctgcagcaaaaaagcgttctccttgtataatattcattgatgaaattgatgcaattggtgggagcaggaatccaaaggatcaacagtatatgaagatgaccttgaatcagttgcttgttgagttggatggctttaagcagaatgaggggataattgtcatcgctgcaaccaacttccctgagtcactagataaagccctagtcagacctgggcgttttgaccgtcatattgttgttcccaatccggatgttgagggtcggcggcaaattctggagtcccatatgtcaaaggtcttgaagagtgatgatgtggacttgatgatcattgctaggggaacgccgggattctctggtgctgaccttgctaacttggtaaatgttgctgctcttaaggctgccatggatggtgcaaaagctgtcacaatgactgatcttgagtatgcaaaggaccgaatcatgatgggtagtgagcgaaagtcagcagttatttctgatgaatgcaggaagttgacggcataccatgagggagggcatgctcttgttgccatccacacagaaggtgctcaccctgtccacaaagctaccatagtacccagggggatggccctaggaatggtgtcccagctacctgaaaaagatgagactagtgtgtcaaggaaacagatgctggcaaatttggatgtctgcatgggtggacgtgtcgcggaggagctgatatttggggatattgaagtgacatctggtgcgtcatctgatttccagcaagcaactgcgacagcaagagcaatggttactaaatatggcatgagcaagcaggttggccttgtctcttacaactacgaagatgatggaaagagcttgagttcagaaacaagacttttaattgagcaggaggtgaagaatttcttggagaatgcatacaataatgcaaagactattctcacgaaacacaataaggagctccatgctctagctaacgcacttctagagcatgagactctcacaggagcccagataaagaacatattagcccaggtaaataacaagcagcaacaggagcatgccattgaagcaccacagaagaaccctgccgctccagcttcccctgcatcaccagctgcatcagccgcagcagccgctgctgcagctgctgcagccgcacagcaggcggcagccaaagccaagggggtagctggtatcggatcttagcgcatcgagcacccaccatttgcattgtgtatatttcaccaacctagcaagctgttcctgcacttgacggtcaagaggatcatcaggagtatcctaaactgcagcagcaatagaacatactgatgatgtgtaagctactgtttatgtgccttgagcgcagaacaaaagaggaaaactctacacgttgtagtaggcacatttagctggtgcttgaatcagttttgtacccacatcgaaaacgatttctgttgtttagaccccaataattgatgcctttgatctgcctgccttatgtacctaacagaggatcataaattgcaacacattctgaataaggatgtcatgtgtgctctaccatccggtagctgatgaatgacgagtcaatttcgcaactcctttgat

SEQ ID NO: 2547 - DNA, 2663 bp, Oryza sativa
taattgacaaacgtaaaattggcagatagttaaatccccttcccccctccccctcccccgccgccgccctcacacaggggtcttagttttccttgtgggtttgggatctcatcgcggcggcggcggcgggattccggccgatggcgtggaggcgcgtcctttcgcagcttgcgaggagtcgaccagcatccacaatctacaatgaactgataacctccagaccttcgtggctgcttagaggtgacgtcaacggtggtggcacacttaaaaacttaaatgagaggtatcagtcaagctttgttggtagcttagcacgcagggtgcaaaacctcgacgttccaagtgaagcctctctgctgaaagaaatatataaaagtgacccagaacgtgtcatacaaatatttgaaagccagccatggttgcactccaatcgtttagcactttcagagtatgttaaagctcttgtcaaggttgataggctggatgatagcaccttgcttaaaacactacggagaggtatggctgtttcaggaggagagggagaaagagttggtagctcttctgcattaaagagtgctggacaagcgacaaaagatggaattcttggcactgcaaacgcacccattcacatggtgacatcagaaacaggccattttaaggatcagatttggcgtacctttcgaagccttgcactaactttccttgtaatttcgggcattggggctcttatagaggatagaggaataagcaaaggtcttggtctaagtcaagaagttcaaccaatcatggattctaaaacaaaattcagtgatgtaaagggtgttgatgaagccaaagctgaacttgaggaaatagttcactatcttcgagatcccaagcgttttactcatcttggtggaaaactgccaaaaggtgtcttgctggttggccctcctggcactgggaagaccatgttagcgagggctgttgctggggaagctggtgtccctttcttctcatgcagcggtagtgagtttgaggagatgtttgtaggtgtaggagctagaagagtcagggacctttttgctgcagctaaaaaacgttctccctgtatcatattcatggatgaaattgatgcaatcggtgggagcagaaatccaaaggatcaacagtacatgaggatgaccttgaaccagttgcttgtcgaactggatggctttaagcagaatgagggaataattgtcattgctgcgaccaactttcctcagtccctagataaagcactagtgagacctgggcgctttgaccggcatattgttgttccgaatcctgatgttgaaggccggcggcaaatcctagagtcccatatgttgaaggtcttgaagagtgatgatgtggatttgatgatcattgccaggggaacacctggattctcaggtgcagaccttgctaacttggttaatgtggctgctcttaaagctgccatggatggggcaaaagccgttacaatgaatgatcttgagtatgccaaggaccggatcatgatgggcagtgagcgcaagtcagcagttatttctgatgaatcccggaaattgacggcgtaccatgagggagggcacgcccttgttgccatccacactgaaggtgctcgccctgtccacaaagccaccatagtgcccaggggaaggacccttgggatggtgtcccaactcccagaaaaagatgagacaagcttctcacggaaacagatgctggcatggctggatgtctccatggcaggacgggtggcggaggagcttatttttggggatagcgaggtaacatccggtgcatcgtccgatttccagaacgcgaccaaaatggcaagagcaatggttacgaaatatggcatgagcaagcagcttggctttgtctcttacaattatgaggatgatggaaagagcatgagcacagaaacaaggcttctgattgagcaggaggtgaagagcctgctggagaatgcctacaacaatgcaaagaccatcctcacaaaacacagcaaggagcaccatgttctagcccaagcacttcttgagcacgagactctcaccggagcccagataaagaagatcttggcccaggcaaatagcacacagcagcagcaggagcatgctgttgaagctccacggaagacgccagctgcgccgtcgtctccagctgcgtcggcggccgcagcggcggcggcgacggcggccgccgcagcaaaacaagctgcggcgaaagccaagggtgttgctggtattggatcttgagcgcgtggaacatccaccgattggcagcataggagtacaatctaagtagcagctaaggtaggagatttgagcaaaatgtgtagtgttcacctgctcttctgcgcaagaaatgtcttttggtacgttctcaccaggtcagagctgttttgttgctggagaccttcccttccaggctccagcgaggggcctatctagtgttgatatattgtagtaataatttgatagctaaccgtagtccatgtcctttgtttatttatctttatttaagaaactgacgactattaaaaatagaggggacataggaccaatattcaggaaatattattaaggttcaggcaattatattggactagtctagggtcgcacgtataattcgagttaaattatcggttg

SEQ ID NO: 2548 - DNA, 2628 bp, Secale cereale
ctccgatcacccggcgcggcgggcggggcgcaccccatcccatcccatcccatcccccccatggcctggcggctcgccctctccaaggctggaaggcggtcgtcgagtgtgatctacaatgagctagcgagtacaagtgctttcaggacacctgcaaatggcaccggtggtgttcttaaggcgctgcaagagaggtaccgatcgagctacgtcggtagcttcgcgcgcaggctacgagacttcgacacgccaagtgaagcttcccttctcaaagagatctacagaagcaacccagaaagagtcgtccagatcttcgagagccagccttccttacataacaactcttcggctctctcccagtacgtgaaggctcttgtcgctctcgacaggctggatgaaagcccactgcttaagacattgcagagaggaattgccaattcagcaagggaggaagaagggtttagtggcatcccagcttttcaaagtgttggccgtacgacgaaagatggggctcttggtactgctggtgcaccaattcacatggttgcatcagagactggccaattcaaggagcagctttggcgtaccttccgaagcattgcactcactttcctagtaatctctggcatcggggctctgattgaagatagaggaattagtaaaggccttggattgcatgaagaggttcagccaagcttggattcgagcacaaaattcagtgatgtcaagggggttgatgaagctaaagctgaacttgaggaaatagttcactacctacgagatcccaagcgtttcacacgccttggtggcaagcttccaaaaggcgttttgcttgtcggcccacccgggacagggaaaaccatgctggcaagggccatcgctggggaagctggtgttcctttcttctcctgcagtggcagtgagtttgaggagatgtttgtgggtgtcggggcgagaagagtgagggatctcttcagtgcagcaaagaagagatctccttgtataattttcattgatgaaattgatgccatcggtgggagcagaaacccaaaagatcaacagtatatgaagatgaccttgaaccagttgcttgttgagctggatggctttaagcagaatgatgggataattgtaattgcagcaacaaacttcccccagtcactggataaagcccttgttaggcctgggaggtttgaccgtcatatcgtggttcctaatccagatgttgagggccgacggcagattctggagactcatatgtcaaaggtgttaaaagcagacgatgtggatctgatgaccattgccaggggaacacctggattctcaggtgcagaccttgcaaacctggtgaacgtggctgctctcaaggctgccatggatggagcgaaatctgtttcaatgaccgacctcgagtttgccaaggacaggatcatgatgggcagcgagcgcaaatcagcagtgatatccgacgaaagcaggaagatgactgcataccatgagggagggcatgcgctggtcgcgatacacacggctggtgcccaccctgtccacaaggccaccattgttccgaggggaatggctctgggcatggtcacgcagctgccagagaaggaccagaccagcgtgtctaggaagcagatgctggcaaggctggacgtctgcatgggagggcgggtggccgaggagcttattttcggggagagcgaggtgacgtccggcgcgtcgtccgaccttagccaagcgacccggctggccaaggccatggtgaccaagtacggcatgagcaagcgcgtgggcctcgtggcctacaactatgacgacgacggcaagaccatgagcacgcagacgcggggcctggtggagcaggaggtgaaggagctgctggagacggcctacaacaacgccaagacgatcctcacgacccataacaaggagctgcacgcgctggccaacgccctcatcgagcgcgagaccctcaccggcgcccagatcaagaacctgctgtcgcaggtggacagcagcagcgacagccagcagcagcctcaggccgccgaggttccgcagcaaacacccgctgccccagcctcaccccagtctccagcagcagcggctgcagcggccgccgcagctgcagcgcagcaagcggcggctcaagccaagggagtcgcgggcatcgggtcctagccacccacaccaggcaacaaaagaacatcaatccagcaaagtgccattaattagcatccgttttttttatggacaagagggcaaattcttagctgccgctgaagagagcatctgtactctagtaatttagctagttgggagtacaatttatatgtgttcttggctgttggtatgatgcagccagcctgaagaagaagaaggtccattcatggcaggggatcctctgagtcatgtcaaggagattttttaatctctgcatcagttagacctcttatcatttgatcgttgcggcgcattgtgtgtcgcagtcttggataagttgtaacgcgtcggttatactccggtttagacggcccgccttgttgtttccgtggcaacttttctttttcgatgttaaaagctcaccaggaatggcattgtggatcatggcctgctatgtactct

SEQ ID NO: 2549 - DNA, 2682 bp, Triticum aestivum
ccctcaccggctccgatcacccggcgggtgggctcgcggcggggcgcaccccatcccctcccccccatggcctggcggctcgccctctccaaggctggaaggcggtcgtcgagtgtggtctacaatgagctagtgagtacaagtgctttcaggacacctgcaaatggcaccggcggagttctcaaggcgctgcaagagaggtaccgatcaagctacgtcggtagcttcgcgcgcaggctacgagactttgacacgccaagtgatgcctcccttcttaaagagatctacagaagtaacccagaaagggtcgtgcagatctttgagagccagccttccttacataacaactcttcggctctctcccagtatgtgaaggctcttgtcgctctcgacaggctggatgaaagcccgctgcttaagacattgcagagaggaattgtcaattcagcaagggaggaagaagggtttagtggcatcccagcatttcaaagtgttggccgtacgacgaaagatggggctcttggtactgctggtgcaccaattcacatggttgcatcagagactggccaattcaaggagcagctttggcgtaccttccgaagcattgcactcactttcctagtaatctccggcatcggggctctgattgaagatagaggaattagtaaaggccttggattgcatgaagaggttcagccaagcttggattcgagcacaaaattcagtgatgtcaagggggttgatgaagctaaagctgaactcgaggaaatagttcactacctacgagatcccaagcgtttcacacgccttggtggcaagcttccaaaaggtgttctacttgtcggcccacccgggacagggaaaaccatgttggcaagggctatcgctggggaagctggcgttcctttcttctcctgcagcggcagtgagtttgaggagatgtttgtgggtgtcggggcaagaagagtgagggatctattcagtgcagcaaagaaacgatctccatgtataattttcattgatgaaattgatgcaattggtgggagcagaaacccaaaagatcaacagtatatgaagatgaccttgaaccagttacttgttgagctggatggctttaagcagaatgatgggatcattgtaattgcagcaacaaacttcccccagtcactagataaagccctcgttaggcctgggcgttttgaccgtcatatcgtggttcctaacccagatgttgagggccgacggcagatcctggagactcatatgtcaaaggtgttaaaagcagacgatgtggatttgatgaccattgccaggggaacgcctggattctcaggtgcagaccttgcaaacctggtgaacgtggctgctctcaaggctgccatggatggagcgaaatccgtttcaatgaccgacctcgagtttgccaaggacaggatcatgatgggcagcgagcgcaaatcagcagtgatatccgacgaaagcaggaagatgactgcataccatgagggagggcatgcgctggtcgcgatacacacggccggtgcccaccccgtccacaaggccaccattgttccgaggggaatggctctgggcatggtcacgcagctgccagagaaggaccagaccagcgtgtctaggaagcagatgctggcaaggctggacgtctgcatgggagggcgggtggccgaggagcttatatttggggagagtgaggtaacgtcgggcgcgtcgtccgacctaagccaagcgacccggctggccaaggccatggtgaccaagtatggcatgagcaagcgcgtgggccttgtggcctacaactatgacgacgatgggaagaccatgagcacgcagacgcggggtctggtggagcaggaggtgaaggagctgctggagacggcctacaacaatgccaagacgatcctcacgacccacaacaaggagctgcacgcgctcgccaacgccctcatcgagcgcgagaccctcactggcgcccagatcaagaaccttctgtcgcaggtaaacagcagcagtgacactcagcagccccaggccgctgaggttccacagcaaacacccgctgccccagcctcaccccagtctccagcagcagcggctgcggccgccgcagcagctgcagcacagcaagcagcggctcaagccaaaggagtcgcaggcatcgggtcctagcctcaccgggcaacaagagaacatcaacccaacaaagtgccattaattagcatgctgtttttttatggacaacagggcaaattcttagctgccgctgaagagagcatctgtactctgtagtaatttagctagtcgggagtacaatttatatgtgttcttggctgttggtatgatgcagcctgaagaagaagaagatccattcatggcaggggatccgctgagtcatgtcaaggagattttgtactctgcattaattagacctcttatcatttgatcgtcgtgacgtatcatatgtcgcaatcttggataagttataacgcgccggttatactccagtttagacggcctgccttgttgttgctgtggcaacttttttcgatgttaaaagctcaccaggaatgacatggcattgtaagatcatcgcctggtactctgttgtttcctttctatatatctgcaggagattgattcttgatgcaattgcatcaggttctt

SEQ ID NO: 2550 - DNA, 2666 bp, Triticum aestivum
acccggcaggcggcgcggcggggcgcaccccatcccctcccccccatggcctggcggctcgccctctccaaggctggaaggcggtcgtcgagtgtggtctacaatgagctagtgagtacaagtgctttcaggacacctgcaaatggcaccgggggagttcttaagacgctgcaagagaggtaccgatcaagctacgtcggtagcttcgcgcgcaggctacgagactttgacacgccaagtgaagcctcccttctcaaagagatctacagaagtaacccagaaagggtcgtgcagatcttcgagagccagccttccttacataacaactcttcggctctctctcagtatgtgaaggctcttgttgcccttgacaggctggatgaaagcccgctgcttaagacattgcaaagaggaattgttaattcagcaagggaggaagaagggcttagtggcatcccagcatttcaaagtgttggtcgtacaacaaaagatggggctcttggtactgctggtgcaccgattcacatggttgcatcagagacaggccaattcaaggagcagctttggcgtaccttccggagcattgcactcactttcctagtaatctccggcatcggggctctgattgaagatagaggaattagtaaaggccttgggttgcatgaagaggttcagccaagcttggattcgagcacaaaattcagtgatgtcaagggggttgatgaagctaaagctgaacttgaggaaatagttcactacctacgagatcccaagcgtttcacacgccttggtggcaagcttccaaaaggtgttttacttgttggcccacccggaacaggtaaaaccatgttggcaagggccatcgctggggaagctggtgttcctttcttctcctgcagtggcagtgagtttgaggagatgtttgtgggtgtcggggcgagaagagtgagggatctcttcagtgcagcaaagaagagatctccttgtataattttcattgatgaaattgatgccatcggtgggagcagaaacccaaaagatcaacagtatatgaagatgaccttgaaccagttgcttgttgagctggatggctttaagcagaatgatgggataattgtaattgcagcaacaaacttcccccagtcactggataaagcccttgttaggcctgggcggtttgatcgtcatatcgtggttcctaacccagatgttgagggccgacgccagatcctggagactcatatgtcaaaggtgttaaaagcggacgatgtggatctgatgaccattgccaggggaacacctggattctcaggtgcagaccttgcaaacctggtgaacgtggctgctctcaaggctgccatggatggagcgaaatctgtttcaatgaccgacctcgagtttgccaaggacaggatcatgatgggcagcgagcgcaaatcagcagtgatatccgacgaaagcaggaagatgactgcataccatgagggagggcatgcgctggtcgcgatacacacggccggtgcccaccctgtccacaaggccaccattgttccgaggggaatgtctttgggcatggtcacgcagctgccagagaaggaccagaccagcgtgtctaggaagcagatgctggcaaggctggacgtctgcatgggagggcgggtggccgaggagcttatattcggggagagcgaggtgacgtccggcgcgtcgtccgacctcagccaggcgacccggctggccaaggccatggtgaccaagtacggcatgagcaagcgcgtgggcctcgtggcctacaactacgacgacgacggcaagaccatgagcacgcagacgcggggcctggtggagcaggaggtgaaggagctgctggagacggcctacaacaacgccaagacgatcctcacgacccacaacaaggagctgcacgtgctcgccaacgccctcatcgagcgcgagaccctcaccggcgcccagatcaagaaccttctgtcgcaggtgaacagcagcggtgacacccagcagccccaggccgctgaggttccacagcaaacacccgctgccccagcctcgccccagtctccagcagcagcggctgcggccgccgcagcagctgcagcacagcaagcggcggctcaagccaagggagtcgcgggcatcgggtcctagccacaccgggcaacaagagaacatcgtcaatccagcaaagtgccattaattagcatgccgttttttttatggacaacagggcaaattcttagctgccgctgaagagagcgtctgtactctgtagtaatttagctagttgggagtacaatttatatgtgttcctggctgttggtatgatgcagcctgaagaagaagaagatccattcatggcaggggatctgctgagtcatgccaaggagattttgtaatctctgcattcattagacctcttatcatttgatcgttgcgatacattgtatgtcgcaatcttggataagttgtaacgcgtcggttatactccggtttagaccgcctgccttgttgctgtggcaacttttttcgatgtttaaaagctcaccaggaatggcattgtggatcatggcctggtaagtactccgttgtttccttcctatatccgcatggagattgattcttgacgcaattgcatcaggtccttgctg

SEQ ID NO: 2551 - DNA, 2477 bp, Ananas comosus
gagagagagagggcgatcgatcgaacgatctagagaaggattagggtttcctttgaggggttactatggcgtggaggcgtctcctcacgaaggttgtgaagaatcaattggaacatccatacattcatgggttaggtggtcaccctcgtctttctacactcactgctggagctagtgggagtaagagacttcgaaacttatctgaaagatatcagtcaagttatgttggtggtttttctcgcaaactacgggatgtggatggatcaaatgaagtttcattgcttaaagagctttacagaagtgatccagaaagagttatacgaatatttgaaagtcaaccctcgttacatgcaaatccttcggcactagctgagtatgttaaagctctagtcaaagttgacaggctagacgaaagttcattgcttaaaacattgcaaagaggcatagctagttcgccacgggaagaagatagtcttaacagtattccagctttgaagaatgtgggtcaaataacaaaggatggagttcttggtactgcaagtgccccaattcacatggtgacggctgaaactagtaactttaaggagcaattgtggcgtactttccgctcgatagcacttacttttcttctaatatcgggtgttggggcactcatcgaggatagaggaattagcaaaggacttggactgcatgaagaggttcagccaagcatagattctggtacgaaatttactgatgttaagggagttgatgaggccaaagctgaacttgaggaaattgttcattatcttcgtgatcctaagcgcttcactcgccttggtgggaagctccccaaaggtgtcttgcttgtgggcccgccaggcacgggaaagactatgttagctagggctattgcaggtgaagccggtgtgcccttcttctcgtgcagtggcagcgagtttgaggagatgttcgtgggtgttggagccaggagggtccgtgacctctttgctgcggcaaagaagcgatctccctgcataattttcattgatgagatcgatgcaattggtgggagccgcaatcctaaagaccagcagtacatgaagatgacgctgaatcagttgcttgttgagctggatggttttaagcagaacgagggtattattgtaattgcagcgaccaacttccctgaatcgctggacaaagctcttgtccggcctggacgtttcgatcgccatattgttgtgcctaacccagatgttgagggccgacggcagattttggattcccacatgtccaaggtcttgaaggcggacgatgtagatttaatgattatcgcgagaggaacaccaggtttctccggcgcggaccttgccaacctagtaaacgttgcagccctcaaggcggcgatggatggtgcgaaggcagtgagcatggctgacctcgagtacgccaaggaccgaatcatgatgggcagtgagcgcaaatctgcagtgatctctgaggagaaccggaaactaactgcataccacgagggcgggcatgccctcgtggccatccacaccgacggggccctcccggtacacaaagccactatcgtcccccgaggtatgtcccttggcatggttgcccaactaccggaaaaggacgagactagcatttcgaggaagcagatgctcgccaggctggatgtctgcatggggggcgggttgctgaggagctcatctatggggagaacgaggtgacctcaggggcatcgtcagatctccagcaagcgacatcgctggcacgggccatggttactaaatatggtatgagcaagaatgtgggtgttgtgactcacaattacgacgataacggaaagagcatgagcaccgagacgaggctgcttattgagaaggaagtgaaggattttctcgagagggcatacaacaacgcgaagaccattttgacaacgcacaacaaggagctccatgccctggctaatgctcttctggagcacgagacactatcgggagcgcagatcaaggcattgttggcccagttaaacagtagtaacaacagtaaccagcagcaagtgcaggtggtggaagccccacaaagtactccaactgtgccgacaacacctgctggagccgcttccgctgcagccgcagctgctgctgcggccgctcaagcagcggcggcgaaagccaaaggagttgcccagcccgtggtgggatcttagcgagcagcagacgagctattgagccatggatatgtatagaaagtctttgctgggctaaccggatcaaacaagaagatgaaaactgaaaattgagcataatgtattttgtatgtttagatgttcaatttatgatgtttcccaaagcatgtggagggaccctaggggttagagactttcatggcagttgtattaactggcacttaaacgaagcgagtaattctgtttttgtaattttttaacctcgcataattataatattataataaagaga

SEQ ID NO: 2552 - DNA, 2922 bp, Musa acuminata
tgggtcgctcagctctaatattagcatcgttgttaccatccgggtgagacctcgtgatttggggccgaacccccgccgccgctgcgtcctcggtctctccgacatcgctttcccggccgtcgcgcggaccctctccttgattggatctcgcccacaccggacatggcttggaggcgcctcctcacgaagcttcgaaaacaacagtttctagggcatccacaattatttggtagcggccaatttcatcatgttgggcacaaggttgaaggtggcttgggcagcaaacttggaaacctccatgggaggttccagtcaagctatgttggcacttttgctcgcagagtgagggatacagatgtgtcaaatgatgttacactgcttaaagagctctacagaagtgatccggaaagggttattagactatttgaaagtcagccttcattgcattccaacccttcggcacttgctgagtatgttaaagcattggtgaaagttgataggctggaacaaagtacattgttaaaaactttacaaagaggtattgctaactcggcaagggaagaggatagcattgacagcattagcagtattccagcattaaagaatgttggccagtcgacaaaggatgggattcttgggacagcaagtgctccgatccacatggtgacagcagaaaccagtaattttaaggagcaactatggcgtacatttcggactattgcagtttcatttcttgtcttatctggtgttggagcactcattgaggatagaggtcttagtaaaggccttggtctacatgaggaggtccagccaagcatggattctagtaccaagtttagtgatgtaaaaggtgttgatgaggccaaagctgagcttgaggaaattgtccattaccttcgcgatcctaagcgtttcactcgccttggcgggaagcttcccaaaggtgtattgctagttgggcctcctggtacagggaagacaatgctagcaagggctatagcaggagaagctggtgtccctttcttctcatgcagtggcagtgagtttgaagaaatgtttgttggtgttggagctaggagggtcagggatctttttactgcaggaaagaaaaggtccccatgtattatattcattgatgagattgatgcaataggtgggagccgaaatccaaaggatcaacagtacatgaaaatgacgttgaatcagctacttgttgaactggatggttttaagcagaatgaggggattattgtcattgcagcaaccaactttcccgaatcattagacaaagcacttgtgaggcctggacgttttgaccgacatattgttgttcctaacccagatgttgagggtcgaaggcagattttggaatcacacatgtcaaaggtcttgaaggcagatgatgtcgatctgatgatcatcgccaggggcacaccagggttctcaggtgcagaccttgcaaatttggtcaatgttgcagctcttaaggctgctatggatggtgcaaaagctgtgacgatggctgatctggagtatgcaaaggacaagatcatgatgggcagtgagcggaaatcggcagtgatctctgatgaatccaggaagttgacagcttaccatgaaggtggccatgctcttgttgccatccacactgatggtgcccttccagttcacaaggctactatcgtgcctcgggggatgtctcttggcatggtcgcacagttgcctgataaggatgagacaagtatctctaagaagcaaatgctggcaaggcttgatgtctgcatgggtggccgagtagctgaagagctaatatttggggagaatgaagtgacttctggtgcttcttcggatttgcagcaagcgacttccgttgcaagagcaatggtcacaaagtatggtatgagcaagcaggttggtcttgtttcccacaactacgatgataatggtaagagcatgagcaccgaaacaaggttacttatagaggaggaggtgaagggatttttggaaagggcttaccataatgcaaaaactattttgataaccaacaacaaagagctgcatgcccttgccaatgcacttcttgagcatgaaaccttatccggtgtgcagatcaagaacttgcttgctcaagtaaatagtcagcagcagcaacctcagcttgtggcagctccgcatgtgagtaccccaccagtaccaacggcgcctccctcagccgctgcagctgctgcagccgcagctgcagccgcagcccaagcagcagccaaggctaaaggagttgctcagcctgccgttggatcctagtctccgaaaagctactctaacatttgggcatgtaaagtaactttatcctgcacgttctgaaatctcaaagcacaagcacaagcatgctgatctcaggataggttagaagttacaaagtcaaccaacattgcaatgtatgtatttttatcctccctgagttttcaaagacacaagggtagaaatttgtagaaccaatgtgggtcttcagaatatgttttgaagttttcagttggcggcactaatcactatactgctaataatgacatctgtaactttccaaaacttgagctttggacaattttaactattgattattgtccaggtgtgtcctttgatgctattacagagtatccattacatcagtgtctatcaaatatttatttattttgttcttttagtcattactgtttggtatttaaatttttttggatgatattgggtggtgtatgtgggtatcagttgttggatagagatttaaatctctttttttttcacttgataaccatcctttatttacaaatctttcttttttcttttacttgattacctaaatattacaaatcgagttctgcagtaaatcttccgcatcagaaaagattcaacttttagggtctgtctttt

SEQ ID NO: 2553 - DNA, 2981 bp, Cocos nucifera
gctaatcttgacctaagccgatggacgatcaaatccctcgcaaggattaatgcaggagggaagaaagtagtgcatacgttcgtacggatgggttagagagtgtatctcggcgacggatggtagtcgtacgtgctaatgagggtgagaatgtagaatcgctttgctgctgtatgctcaccgtcgattggttacccctaccggtaccgacaaggttgatggggcccgcatgaaacgtgaccggatgtaatttgggtccttctagatgttccccaataagaccaccggtctttcgacgctgcgcccggtgaggaaacggtataaccacaactccgataaatctctcgcgcgctttccttgcgggtagcagccgaccacgtcctcctcctcctctccgacgtctacccacgtagaaatactttgtttccttttaggttttatttataaattgcaaatagagggagatcaagagagggaagaaggaaggttttgttgaaggaattatggcgttgaggcacctcctcacgaagattgcaaaacagcaattggagcctccatttttatatcaattaagtggtcgatcctgtcttgcttcacacttggttgaaggttgtggaggaagcaggctcagaaattttcaccaaaggtttcagtcaagctatgttggtagttttgctcgcagagcacgggatgcagatggaaccaatgatgttgcactgcttaaagaactttacagaagtgatccggaaagagttattagactatttgaaagtcagccttcactgcattctaacccttcagcacttgcggagtatgttaaagcattagttcaagttgataggctggatgaaagctccttgctcaagacattgcaaagagggattgttaattcagcaagggagggagagagtatcagcagcatcccggcattgaggaatgtaggccagacgaccaaggaaggaattcttggaactgcaaacgcccctattcacatggtgacagcagaaactggtcaatttaaagagcagttgtggcgtacattccgcacaattgcccttacctttcttttgatatctggtgttggagcactcattgaggataggggaattagtaaagggttgggtctacatgaggaggtgcagccaagcatggattctagtacaaaatttaatgatgtaaagggtgttgacgaggctaaagctgaactagaggaaattgttcattatcttcgtgatccaaagcgtttcacccgtcttggtggcaagcttcccaaaggtgtcttgctggttggcccacctgggacagggaagaccatgttagcaagggctattgctggtgaagctggtgttcctttcttttcatgcagtggaagtgaatttgaggagatgtttgttggtgtgggagctaggagggtgagggatctttttgctgctgcaaagaaacgatccccctgcataattttcatagatgagattgatgcaataggtgggagccgcaacccaaaggaccaacagtacatgaagatgaccctgaatcagttgcttgttgagctggatggctttaagcagaatgaagggattattgtcatcgctgcaaccaactttcctgaatcattggacaaagcccttgtgagacccggacgctttgaccgtcacattgctgttcctaatccagatgtagagggccgaaggcagatcatggaatcccacatgtcaaaggtgttgaaggcagatgatgtagatctaatgatcattgcaaggggaacgcctgggttctcaggcgctgacctcgcaaacttggttaacattgccgcccttaaggctgctatggatggggccaaagctgtgagcatgtctgatctggagtatgccaaggacaggatcatgatgggcagcgaacgcaaatcagcagtgatttctgatgaatcgaggaggctgacagcttaccatgagggcggtcatgctcttgtggccgtccacaccgacggcgccctcccggtccataaggccaccatcgttccgagggggatgtcgctcggcatggtcgcccaattgccggaaaaggatgagaccagcatctctcggaagcaaatgcttgcaaggctggacgtttgcatgggcggacgggtggctgaagaactaatattcggggagaacgaggtgacctctggtgcttcctcggatctcgaacaagccacttatctagcaagagccatggttacaaaatatggtatgagcaagcaggtgggtcttgtcgcacacgactatgatgacaatggtaagagcatgagcaccgagacaaggctgcttattgaggaggaggtgaagaacttcctggaacgggcatataataatgcgaaaactatcttgacgactcacggtaaagagctgcatgccctcgccaatgctcttctcgagcacgagacactttctggggctcagatcaagaagttgcttgcccaggtgaacacccagcagcagcagcaagttgtgactgccccacagacaaccacccctgctgtgccaacggcgcctccctccgctgcatccgctgcagccgcagcagccgccgctgctgcggcccaagcggcggcgaaggccaaaggagttgcacagcccgtagtgggatcttagcagcaagaaggtaatcggtaggatcaaccatgtatagtaatctcaattgcaggttcctatagcatccgaagcatgaataggtggtggaaggactttcagaagaagaataagaagaagactcccaccgccggtaaaatgaagtcagctgcctgttgcaaatctcaactccatgtacgtaggcatctgtttgtttcttccctgccttgcaggagaacaagaagtagaaacttgaaggttttgaatgacaacattgagacaggcttctctttttaacttttcatacaaataatgttattgcaatctcttttgaaccaaacggtgggacttaaaccaatcgctttttgatggggc

SEQ ID NO: 2554 - DNA, 2739 bp, Cocos nucifera
agttcggataaatctgcgtcaaactgtggtttcggggtagcggccgacctcctcctccactccgacgtttcccctctgcatcatcgcggagatacttctatcccttttcacgttttatttatagacatatagagagatcaagggagggagggaagaaggaaaattttgttcaaggaattatggctctgaggcgactcctcaccaagattgcaaaacagaaattggagcattcatacttatatcaattaagcggtcgatctcgtcctgcttcatacttcgtcgaaggtagtggaggaaacagactcagaaattttcaccaaaggtttcagtcaagctatgttggtagttttgctcgcagagcacgggatgcagatggaaccaatgatgttgcactgcttaaagaactttacagaagtgatccggaaagagttattagactatttgaaagtcagccttcactgcattctaacccttcagcacttgcggagtatgttaaagcattagttcaagttgataggctggatgaaagctccttgctcaagacattgcaaagagggattgttaattcagcaagggagggagagagtatcagcagcatcccggcattgaggaatgtaggccagacgaccaaggaaggaattcttggaactgcaaacgcccctattcacatggtgacagcagaaactggtcaatttaaagagcagttgtggcgtacattccgcacaattgcccttacctttcttttgatatctggtgttggagcactcattgaggataggggaattagtaaagggttgggtctacatgaggaggtgcagccaagcatggattctagtacaaaatttaatgatgtaaagggtgttgacgaggctaaagctgaactagaggaaattgttcattatcttcgtgatccaaagcgtttcacccgtcttggtggcaagcttcccaaaggtgtcttgctggttggcccacctgggacagggaagaccatgttagcaagggctattgctggtgaagctggtgttcctttcttttcatgcagtggcagtgaatttgaggagatgtttgttggtgtgggagctaggagggtgagggatctttttgctgctgcaaagaaacgatccccctgcataattttcatagatgagattgatgcaataggtgggagccgcaacccaaaggaccaacagtacatgaagatgaccctgaatcagttgcttgttgagctggatggctttaagcagaatgaagggattattgtcatcgctgcaaccaactttcctgaatcattggacaaagcccttgtgagacccggacgctttgaccgtcacattgctgttcctaatccagatgtagagggccgaaggcagatcatggaatcccacatgtcaaaggtgttgaaggcagatgatgtagatctaatgatcattgcaaggggaacgcctgggttctcaggcgctgacctcgcaaacttggttaacattgccgcccttaaggctgctatggatggggccaaagctgtgagcatgtctgatctggagtatgccaaggacaggatcatgatgggcagcgaacgcaaatcagcagtgatttctgatgaatcgaggaggctgacagcttaccatgagggcggtcatgctcttgtggccgtccacaccgacggcgccctcccggtccataaggccaccatcgttccgagggggatgtcgctcggcatggtcgcccaattgccggaaaaggatgagaccagcatctctcggaagcaaatgcttgcaaggctggacgtttgcatgggcggacgggtggctgaagaactaatattcggggagaacgaggtgacctctggtgcttcctcggatctcgaacaagccacttatctagcaagagccatggttacaaaatatggtatgagcaagcaggtgggtcttgtcgcacacgactatgatgacaatggtaagagcatgagcaccgagacaaggctgcttattgaggaggaggtgaagaacttcctggaacgggcatataataatgcgaaaactatcttgacgactcacggtaaagagctgcatgccctcgccaatgctcttctcgagcacgagacactttctggggctcagatcaagaagttgcttgcccaggtgaacacccagcagcagcagcaagttgtgactgccccacagacaaccacccctgctgtgccaacggcgcctccctccgctgcatccgctgcagccgcagcagccgccgctgctgcggcccaagcggcggcgaaggccaaaggagttgcacagcccgtagtgggatcttagcagcaagaaggtaatcggtaggatcaaccatgtatagtaatctcaattgcaggttcctatagcatccgaagcatgaataggtggtggaaggactttcagaagaagaataagaagaagaagataaagggtaaaatgaagtcagctgcctgttgcaaatctcaactccatgtacgtaggcatctgtttgtttcttccctgccttgcaggagaacaagaagtagaaacttgaaggttttgaatgacaacattgagacaggcttctctttttaacttttcatacaaataatgttattgcaatctcttttgaaccaaacggtgggacttaaaccaatcgctttttgatggggtaaattcagacctgtgaagaagtgtggattgcttttattgtgcgtgcggtgctcgaaaagccgagctccgagtagatctggca

SEQ ID NO: 2555 - DNA, 3302 bp, Cocos nucifera
gagggaagaaggaaaattttgttcaaggaattatggctctgaggcgactcctcaccaagattgcaaaacagaaattggagcattcatacttatatcaattaagcggtcgatctcgtcctgcttcatacttcgtcgaaggtagtggaggaagcagactcagaaattttcaccaaaggtttcagtcaagctatgttggtagttttgctcgcagagaatgggacgcagatggacccaatgatgttgcacttcttaaagagctttacagaagtgatccagaaagagttattagactatttgaaagtcagccttcgctgcattccaacccttcagcacttgcagagtatgttaaggcattagttaaagttgataggctggatgaaagttcattgctcaagacattgcaaagaggcattgctaaatcagcaagggaggaagagagtatcagtagcatcccagcatcgaggaatgtgggccagatgaccaaggaaggaattcttggaactgcaagtgctcctattcacatggtgacagctgaaactggtcattttaaagagcagttgtggcgtacatttcgcactattgccctaacctttcttttgatatcgggtgttggagcactcattgaggatagaggaattagtaaagggcttggcctacatgaggaggtgcagccgagcatggattctagtacaaaatttaatgatgtaaagggcgttgatgaggctaaagctgaactagaggaaattgttcattaccttcgtgatccaaagcgtttcacccgccttggtggcaagctccccaaaggtgtattgcttgttggcccacctgggacagggaagaccatgttagcaagggctattgctggagaagctggcgttcctttcttttcatgcagtggaagtgaatttgaggagatgtttgttggtgtgggagctaggagggtgagggatctttttgctgcagcaaagaaacgatccccctgcataattttcatagatgagattgatgcaataggtgggagccgcaacccaaaggaccaacagtacatgaagatgaccctgaatcagttgcttgttgagctggatggctttaagcagaatgaagggattattgtcatcgctgcaaccaactttcctgaatcattggacaaagcccttgtgagacccggacgctttgaccgtcacattgctgttcctaatccagatgtagagggccgaaggcagatcatggaatcccacatgtcaaaggtgttgaaggcagatgatgtagatctaatgatcattgcaaggggaacgcctgggttctcaggcgctgacctcgcaaacttggttaacattgccgcccttaaggctgctatggatggggccaaagctgtgagcatgtctgatctggagtatgccaaggacaggatcatgatgggcagcgaacgcaaatcagcagtgatttctgatgaatcgaggaggctgacagcttaccatgagggcggtcatgctcttgtggccgtccacaccgacggcgccctcccggtccataaggccaccatcgttccgagggggatgtcgctcggcatggtcgcccaattgccggaaaaggatgagaccagcatctctcggaagcaaatgcttgcaaggctggacgtttgcatgggcggacgggtggctgaagaactaatattcggggagaacgaggtgacctctggtgcttcctcggatctcgaacaagccacttatctagcaagagccatggttacaaaatatggtatgagcaagcaggtgggtcttgtcgcacacgactatgatgacaatggtaagagcatgagcaccgagacaaggctgcttattgaggaggaggtgaagaacttcctggaacgggcatataataatgcgaaaactatcttgacgactcacggtaaagagctgcatgccctcgccaatgctcttctcgagcacgagacactttctggggctcagatcaagaagttgcttgcccaggtgaacacccagcagcagcagcaagttgtgactgccccacagacaaccacccctgctgtgccaacggcgcctccctccgctgcatccgctgcagccgcagcagccgccgctgctgcggcccaagcggcggcgaaggccaaaggagttgcacagcccgtagtgggatcttagcagcaagaaggtaatcggtaggatcaaccatgtatagtaatctcaattgcaggttcctatagcatccgaagcatgaataggtggtggaaggactttcagaagaataagaagaagaagataaagggtaaaatgaagtcagctgcctgttgcaaatctcaactccatgtacgtaggcatctgtttgtttcttccctgccttgcaggagaacaagaagtagaaacttgaaggttttgaatgacaacattgagacaggcttctctttttaacttttcatacaaataatgttattgcaatctcttttgaaccaaacggtgggacttaaaccaatcgctttttgatggggtaaattcagacctgtgaagaagtgtggattgcttttattgtgcgtgcggtgctcgaaaagccgagctccgagtagatctggcatcatgatggtgtatttaactagtttgatcgtgctagctagacttccggacggtgagcattattatgatattgatgggtagacttgtggggagtgtgattctactgctagcgtgcactcttttgatggatcgtccgaattcttggccttcgcatgtgcggaaagtgcggtgaaagctgctgtgctatcatttgtccctctcattccatgtcctgtctgaagaggcattaagtggtgattctgtaggtgaacggcttatcgtactaaagaaaaggatggaacagattaaagtagagaaaagcatgtcgaaaatttggcgcctgtaacgtgtgatcttgattccaagcgattcccggtttccacacggtgcggtggtcgtttattatgtctcctctcggccgtgcggcatcgaaggatcgagaagtcattatttataggacaccgtggtcggtgcaccagactagtccttggtagaatgccgaggcctgaggacaaaaacaagatgtgacttaaataacagtgacctggacccctctcctaggccagaggcaagggtaggatatcgctagaacttcgaacggatgccagagatggagagggaatgtaaggtttttgaagtaataggaaaagagatggcagaaacagaaaataaagcgatcgctttgtaaagaagacagctaaatctttttcatttgtcttcaaccttttatatccc

SEQ ID NO: 2556 - DNA, 2884 bp, Musa acuminata
aaactctggtcgagacctcgtgtacttgatttggggctgacccgcgtcgtcgctgcttcctcctcctcctccaccgccggcgtcccggcacgtctttccgacccgcgtcccggtttctcggctgactccatctcgccctaatcggacatggcttggaggcgcgtcctcacgagggtacgatctgttccatttcggttgcccagattcttgtcttttcttttttttgtaactttttgcatgttctcacttcttgcaggtaacagacttggaaacttccacgaaagatttcagtcaagctatgttggtagttttgctcgcagagcacgggatacagatgggccaaatgatgttatgcttcttaaagagctctacagaagtgatccagaaagagttattagactctttgaaagtcagccttcactgcactcaaacccttcagcacttgctgagtatgtcaaagctttagtgaaagttgatagactggaccaaagtacgttgtttaaaactttacaaagaggtgtttctaactcggcaatggaggagagcattaacagcattagcagtgttccagcattaaagaatgttggccaatcaacaaaagatgggattcttgggactgcaagtgctcccatccacatggtgacagcagagaccagtaattttaaagagcaattatggcgtacatttcgtactattgcagtttcatttcttgtaatatctggtgttggtgcacttattgaggataggggacttagtaaaggccttggtctacatgaggaggtgcagccaagcatggattctagtacaaaatttagtgatgtaaaaggcgttgatgaggccaaagctgagttagaggaaattgtccattaccttcgtgatcccaagcgtttcacccgccttggtgggaagcttccaaaaggtgtgttgcttgttggtccccctggcacagggaagacaatgttagcaagggctattgcaggagaagctagtgtccccttcttctcatgcagtggcagtgagtttgaagagatgtttgttggtgtcggagctaggagggtcagggacctttttactgcagcaaagaaaaggtccccttgtattatattcattgatgagattgatgcaataggtgggagccgtaatccgaaggatcaacagtacatgaaaatgacattgaatcagttgcttgttgaactggatggttttaagcagaatgaggggattattgtcattgcagcaaccaactttccggaatcattggacaaagcacttgtgaggcctggacgttttgatcgtcatattgttgttcctaatccagatgttgagggtcgaaggcagattttggaatcccacatgtcaaaggtcttgaaggcggatgatgtggatttaatgatcattgcccggggcacgccagggttctcaggtgcagaccttgcaaatttggttaatgttgctgccctcaaggctgccatggatggggcaaaagctgtgacaatggctgatctggagtatgcaaaggacaagatcatgatgggcagtgagcggaaatcggcggtgatttctgatgaatccaggaggttgacagcttaccacgaaggtggccatgctcttgttgccatccacactgatggtgcccttccagtccacaaggcgactattgtgccgcgggggatgtccctcggcatggttgcacagttgcctgataaggatgagacaagcatctctaagaaacaaatgctagcaaggcttgatgtctgcatgggtggccgggtagctgaagagctaatatttggggagagcgaagtgacttctggtgcttcatccgacctgcagcaggcaacttccgttgcaagagcaatggtcacaaagtatggtatgagcaaacaggttggtcttgtttcacacaactacgatgataatggtaagagcatgagcaccgaaacaaggctacttatagagaaggagatgaaggattttctggaaagggcttacaacaatgcaaaaactattttgacaactcacaataaagagctacacgcccttgccaatgcgcttcttgagcatgaaaccctatctggtgcgcagatcaagaacttgcttgctcaggtgaacagtcagcagcagcaacctcaagtggtggtagctccacaggtgaataccccagcagtgccaccgacgcctccctcagcagctgcaaccgctgctgctgctgcagcagccgctgcagcccaggcagcggctaaggccaagggagttgctcagcctgcggttggaacttaagacggcgaagagctgcttttagattcggtgatgtatagcataagctgcagcttctggcatctaaaatcacaaatgctggttgcagaaaaagacaaagttcaaaatcaacttccattgtgacacagcaatgcatgtatgtgagcatctatttaattttccatgaattgcaaaggaagacaatgttggaaattttgttgaactaatgtgggtttttagcaggatgaattggggttttgaattgacatcaatcactatagtgctaataatgatgcctatacttttcggaacctgagttttggcggttcaacaaagatgaacgtccagatctgtgctttcagccttctgccaacattctattcagtattgtggtgaatatgagataaaagttcagcttttctaattgtgctgcatggacttctttaattctgaccgagatttgtggaaggaacaactttgtcccgctgtatctcgaatcaccatccataaataaaaggttggattaggtgtcgaaactttttaagatttgagcaagatgagttaccgagataacatttgtagctacttttacgatcaaataaatgataatgttatagttacttttaca

SEQ ID NO: 2557 - DNA, 2944 bp, Setaria italica
aaaccgcccccttggtccttggactcactccgatcactcgccccccgcccgcctccgctcgtcgtcctccatcgcggcgcctccccgggatctcctcgccgctcaccacttcctccgtccccgatggcatggcggctctccatatccaaggttgcaaggcatcggtcagcaaatgccatctgcagtcagctacaggcttcctttcctttcagggcacccagaagcgataccggcgcaggcagcacgcttagaaatttgcacgagaggtaccactcaagctatgccagtagctttccacgctggatacgagactttgactcacggagtgaagcttctctgcttaaagagatttatagaagcgatccagaaagagttgtacaaatctttgaaaggcacccttcattgcattccaactcttcagctctttctgagtatataaaagctcttgtcagtcttgacaggctggaggatagccccctgcttaaaacaatgcagagaggattagctagttcagcaacagagggagaaagacgtactggtcttgctgcatttgcgagtgttggtagacagactaaagatggagctcttggtaccgcgaatgcacctattcacatggttaccgcagaaactggtcaatttaaggagcaactttggaaaaccttccgaagtattgcacttactttcattgtaatctctggcattggagctctcattgaagacaaaggaattagtaaaggccttggtttgaacgaagaggttcagccgagcacgaattcgaccactaagttcagtgatgtcaagggagttgacgaggctaaagctgaacttgaggaaattgttcactacctacgagatcccaagcgttttacacgccttggtggaaagcttcctaaaggtgttttgctggtagggccacctggaacgggaaaaaccatgttggcgagggctatagctggggaagctggtgttcctttcttctcatgcagtggtagtgaattcgaggagatgtttgtgggtgttggggctcgaagagtgagggacctgttcaatgcagctaagaagcgatctccatgtataattttcattgatgaaatcgacgcgattggtgggagcagaaatcccaaggatcaacagtatatgaagatgacattgaatcagctgcttgttgagctggatggctttaagcagaatgacgggataattgtaattgcagcaactaacttccctcagtcactagataaagcacttgtcaggcctgggcgctttgaccgtcatattgtggttcctaatccagatgttgagggccggcggcagatcctggaaactcatatgtcaaaggtcttaaaagcagatgatgtggatctgatgatcattgcaaggggaacacctggattctcaggtgcagaccttgcgaacttggtcaatgtagctgctctgaaggctgctatggatggggcaaaagctgtcacaatgcaggaccttgaatttgccaaggacaggatcatgatgggcagcgagcgcaaatcagcagtgatatctcaagagtgcaggaaaatgactgcgtatcatgagggtgggcatgcccttgttgctattcacacagatggtgctaaccctgttcacaaggctacaatagttccaaggggaatggctcttggcatggttacacagctgccagagaaggatcagcatagtgtttcgagaaagcagatgctggcaagattggatgtgtgcatgggaggaagggtggccgaggagcttatatttggggaaagcgaggtaacctctggtgcctcatctgacctaaggcaagcgactcggctggcaagagccatggtcacgaagtatggtatgagtgagcgggtgggtcttgtttcctacagtgatgacaatggtagtatgagtgcccaaacaagaggcatgattgatagggaggtgaaggatattctggagagggcatacaacaatgcaaagacgattttgacagagcatgataaggagcttcatgcgctagcaaacgcccttcttgagcatgaaacgctctctggagcccagataaagaaactattagcacaggtaaagaatagtgacaataagcagaagaaggttgctaaggtgccgaagaagacgcctgtggccccaccttccccccagtcaccggccgcagctgctgctgctgcagcagcggcggcagcacaagaagcagctgccaaagccaagggagttgcgggtacagcggctgcagcacaagaagctgcagtgaacgcggagggagttgcgggtattgggtcatagtggtactgagaggagagcacggctggcattttgtagactgaccaaatcagcaggttgtctggcataatgtgatgggtgattagcatgaggaaggcagcaaggattttagcatctgctgaaataagagagctgcattctagtcccaaacagtatatgctggtggtggtggtgctcggcagggcaacctgaagacaagttgccgatatcatttgtagcaggcagggacctggttgtagataacatgcgcgttggcatgcgggaccatcttgtcgagcgattcttttgtagtatcattctgtcgcgcaatgcattctgtgcaatgcaagctcatctttgcattgttctttgatactggtagctgctgctgctgctgtgacatcgataaatcccgccctgatcaggttatgtagcagtaatggaattggaatggtaatggtgtttgatcatggaatgtcgtggtgggactgcattgggtgctgtttgcttggtggttttctaacgtaatccgaccgcagtgagattggaaagccctcttcgtgattctcgctcgattccaatccacagggtgcattcttccacccaatcatgtgatttcccccttatttttgcaacgttattacgagcttgtgattttcatgtaagcaaccgc

SEQ ID NO: 2558 - DNA, 2938 bp, Setaria italica
accgcccccttggtccttggactcactccgatcactcgccccccgcccgcctccgctcgtcgtcctccatcgcggcgcctccccgggatctcctcgccgctcaccacttcctccgtccccgatggcatggcggctctccatatccaaggttgcaaggcatcggtcagcaaatgccatctgcagtcagctacaggcttcctttcctttcagggcacccagaagcgataccggcgcaggcagcacgcttagaaatttgcacgagaggtaccactcaagctatgccagtagctttccacgctggatacgagactttgactcacggagtgaagcttctctgcttaaagagatttatagaagcgatccagaaagagttgtacaaatctttgaaaggcacccttcattgcattccaactcttcagctctttctgagtatataaaagctcttgtcagtcttgacaggctggaggatagtcccctgcttaaaacaatgcagagaggattagctagttcagcaacagagggagaaagacgtactggtcttgctgcatttgcgagtgttggtagacagactaaagatggagctcttggtaccgcgaatgcacctattcacatggttaccgcagaaactggtcaatttaaggagcaactttggaaaaccttccgaagtattgcacttactttcattgtaatctctggcattggagctctcattgaagacaaaggaattagtaaaggccttggtttgaacgaagaggttcagccgagcacgaattcgaccactaagttcagtgatgtcaagggagttgacgaggctaaagctgaacttgaggaaattgttcactacctacgagatcccaagcgttttacacgccttggtggaaagcttcctaaaggtgttttgctggtagggccacctggaacgggaaaaaccatgttggcgagggctatagctggggaagctggtgttcctttcttctcatgcagtggtagtgaattcgaggagatgtttgtgggtgttggggctcgaagagtgagggacctgttcaatgcagctaagaagcgatctccatgtataattttcattgatgaaatcgacgcgattggtgggagcagaaatcccaaggatcaacagtatatgaagatgacattgaatcagctgcttgttgagctggatggctttaagcagaatgacgggataattgtaattgcagcaactaacttccctcagtcactagataaagcacttgtcaggcctgggcgctttgaccgtcatattgtggttcctaatccagatgttgagggccggcggcagatcctggaaactcatatgtcaaaggtcttaaaagcagatgatgtggatctgatgatcattgcaaggggaacacctggattctcaggtgcagaccttgcgaacttggtcaatgtagctgctctgaaggctgctatggatggggcaaaagctgtcacaatgcaggaccttgaatttgccaaggacaggatcatgatgggcagcgagcgcaaatcagcagtgatatctcaagagtgcaggaaaatgactgcgtatcatgagggtgggcatgcccttgttgctattcacacagatggtgctaaccctgttcacaaggctacaatagttccaaggggaatggctcttggcatggttacacagctgccagagaaggatcagcatagtgtttcgagaaagcagatgctggcaagattggatgtgtgcatgggaggaagggtggccgaggagcttatatttggggaaagcgaggtaacctctggtgcctcatctgacctaaggcaagcgactcggctggcaagagccatggtcacgaagtatggtatgagtgagcgggtgggtcttgtttcctacagtgatgacaatggtagtatgagtgcccaaacaagaggcatgattgatagggaggtgaaggatattctggagagggcatacaacaatgcaaagacgattttgacagaacatgataaggagcttcatgcgctagcaaacgcccttcttgagcatgaaacgctctctggagcccagataaagaaactattagcacaggtaaagaatagtgacaataagcagaagaaggttgctaaggtgccgaagaagacgcctgtggccccaccttccccccagtcaccggccgcagctgctgctgctgcagcagcggcggcagcacaagaagcagctgccaaagccaagggagttgcgggtacagcggctgcagcacaagaagctgcagtgaacgcggagggagttgcgggtattgggtcatagtggtactgagaggagagcacggctggcattttgtagactgaccaaatcagcaggttgtctggcataatgtgatgggtgattagcatgaggaaggcagcaaggattttagcatctgctgaaataagagagctgcattctagtcccaaacagtatatgctggtggtggtggtgctcggcagggcaacctgaagacaagttgccgatatcatttgtagcaggcagggacctggttgtagataacatgcgcgttggcatgcgggaccatcttgtcgagcgattcttttgtagtatcattctgtcgcgcaatgcattctgtgcaatgcaagctcatctttgcattgttctttgatactggtagctgctgctgctgctgtgacatcgataaatcccgccctgatcaggttatgtagcagtaatggaattggaatggtaatggtgtttgatcatggaatgtcgtggtgggactgcattgggtgctgtttgcttggtggttttctaacgtaatccgaccgcagtgagattggaaagccctcttcgtgattctcgctcgattccaatccacagggtgcattcttccacccaatcatgtgatttcccccttatttttgcaacgttattacgagcttgtgattttcatgtaagcaa

SEQ ID NO: 2559 - DNA, 947 bp, Triticum aestivum
ccaatccatcgagctctccaagtcgactcgcaccgtcccatcccacttcccacccacccacacacagcgagtaaccaacccgaggaaggaagaagccatggccgagctgctgttcgcccccgccgtggccggcctcgtccacctgccggaggtgctcgagcgcctcgccgccgcggacgccgaccaccgcgaccacgcccaccaccacaccgcccacgggcacgggcacggccacccccgcgcgcagatcgggggcgtgggcggcggcgcgcccgtggacatcgtggagacccccgccgagtacgccttcctgctcgacgtccccggcctctccaagtccgacatccaggtgactctggaggaggacaacgtgctggtgatgaagagcgccagcaacggcggcggcggcgccaacgggaaacggaagcgggaggaggaggaggcggactgccgctacatccggctggagcgccgcgcgtcgccgcggtcgttcgtgcgcaagttccggctgccggaggacgcggatgcgggcgccgtggccgcgcgctgcgagaacggcgtgctcaccgtcaccgtcaagaagcagccgccgccggagaagaagaccaagtccgtccaggtcgccatcgcctgatcgttcgggccttccttcagtcgcgcgaaccttcggtacctcgtcggcgtttgtcgtcagtgatcgttctagcagtagagtagtgtggcgagtctggtagatttgggtcttctcttgtggtctcatgctctgttcgtggtctggccggacattaggtgtgctagttgtggtcgtgttttgtgaatcatgctgtgaatgcaacgatggagcacgaattgtatcttcctcgcttgaccgaatgcagccgcgtgcctggattcatacgtttttcacgtaatcttagcggaaaatagaatgagaactttgtttcacg

SEQ ID NO: 2560 - DNA, 975 bp, Pseudoroegneria spicata
gagctctcgaagtcgactcgcaccgtcccatcccagttcccacccacacgcagcgaggaaccagtcgcggaggagaaaggagaagccatggctgagctgctgttcccccctgccgtggccggcctcgtccacctgccagaggtgctcgagcgcctcgccgccgcggacgctgaccaccgcgaccacgcccaccaccacgccgcgcacgggcacgggcacggccacccccgcgcgcaaattgggggcggaggtggcggcggcgcgcccgtggacatcgtggagacccccggcgagtacgccttcgtgctcgacgtccccggcctctccaagtccgacatccaggtgactctggaggaggacaacgtgctggtgatgaagagcgccagcaacggcggcggcggcgccaacgggaagcggaagcgggaggaggaggaaggggactgccgctacatcaggctggagcgccgcgcgtcgccgcggtcgttcgtgcgcaagttccgtctgcccgaggacgcggacgcgggcgccgtggccgcgcgctgcgagaacggcgtgctcaccgtcaccgtcaagaagcagccgccgccggagaagaagaccaagtccgtccaggtcgccatcgcctgatcgagcccttcagtcaagctaactttcggtacctcatcggcgtcatcacttatcgttctagcagtagagtactgtgcagagtatggtagatttgggtgttctcttgtggtctcatgctctgttcgtgatctggccggagattaggtgtgctggttgtggtcgtcttctgtgaatcttgctgttaatggaactatggagcacgaattgttagttgcctatctctgcatgtatcttacccgcttgatcgaaggcagtagcgtgtctggattcagtatcttttttttgaaacataagagtcctgctgcgtatgcctgcattcagtatcaggattcatacgtgtttcacata

SEQ ID NO: 2561 - DNA, 834 bp, Secale cereale
ctctcgaagtctgactcgctccgtcccatcccagtccccacccacccacagcgaggaaccaacccgaggaagaaagaagccatggccgagctgctgttcgcccctgccgtggctggcctcgcccacctgccggaggtgctcgagcgcctcgccgccgcggacgccgaccaccgcgaccacgcccaccaccaccatgccgcccacgggcacggccacggccacccgcgcgcgcagatcgggggcgtgggcggcggcgcgcccgtggacatcgtggagacccccggcgagtacgccttcgtgctcgacgtccccggcctctccaagtccgacatccaggtgactctggaggaggacaacgtgctggtgatgaagagcgccagcaacggcgggggcggcggcgcgaacgggaagcggaagcgggaggaggaggaggcggactgccgctacatccggctggagcgacgctcgtcgccgcggtcgttcgtgcgcaagttccggctgcccgaggacgcggacgcgggcgccgtggccgcgcgctgcgagaacggcgtgctcaccgtcaccgtcaagaagcagccgccgccggagaagaagaccaagtccgtccaggtcgccatcgcctgatcgttcgggccttcagccacgcgaactttcggtacctcgtcggcgtttgtcgtcagtgatcgttctagcagtagattagtgtggcaagtctggtagatttgggtgttctcctgtggtctcatgctctgttcgtcatctggccggagattaggtgtgctagttgtggtcgtcttttgtgaatcttgctgttaatggaactatggggcacga

SEQ ID NO: 2562 - DNA, 941 bp, Leymus cinereus x Leymus triticoides
catccccctctccaagtcgactcgcaccgtcccatcccacccacacccacacagcgaggaaccagtcgaggaggaagaacgagaaggaagccatggctgagctgctgttcgcccctgccgtggccggcctcgtccacctgccggaggtgctcgagcgcctcgccgccgcggacgccgaccaccgcgaccacgcccaccaccatgccgcccacgggcatgggcacggtcacccccgcgcgcaaattgggggcggaggcgtgggcggcggcgcgcccgtggacatcgtggagacccccggcgagtacgccttcgtgcttgacgtccccggcctctccaagtccgacatccaggtgactctggaggaggacaacgtgctggtgatgaagagcgccaacaacggcggcggcggcgccaacgggaagcggaagcgggaggaggaggaaggggactgccgctacatccggctggagcgccgcgcgtcgccgcggtcgttcgtgcgcaagttccgtctgccggaggacgcggacgcgggcgccgtggccgcgcgctgcgagaacggcgtgctcaccgtcaccgtcaagaagcagccgccgccggagaagaagaccaagtccgtccaggtcgccatcgcctgaatcttcttcagccacgcgctcgcttgcttgggaacaacgttcagtatcggcgtcatcagcagtgtagcagtagatcagtgtgtctagtctggtacctttgggagtttgggtgttcttttgtggtcgcatgctctgatcgtggcatggcccgagactaggtgtgcgatgtggttatcttctgtgtgttgccgtggaagaacgatggagcacgaattgttagttcagtgtacatacagaaccgtgcgttctatcaggatccatgcgtgtttcacgtaccgttagcggaaaatggaaatgtgcaactca

SEQ ID NO: 2563 - DNA, 993 bp, Secale cereale
gctcgagctctcgaagtctgactcgctccgtcccatcccagtccccacccacccacagcgaggaaccaacccgaggaagaaagaagccatggccgagctgctgttcgcccctgccagtgccgctggtcacgtgccggagtgctcgagcgccttgccgccgcggacgccgaccaccgcgaccacgcccaccaccaccacgccgcgcacgggcacggccacggccaccccgcgcgcagatcggggcgtgggcggcggcgcgcccgtcgacatcgtggagacccccggcgagtacgccttcgtgctcgacgtccccggcctctccaagtccgacatccaggtgactctggaggaggacaacgtgctggtgatgaagagcgcgagcaacggcgggggcggcggcgcgaacgggaagcggaagcgggaggaggaggaggcggactgccgctacatccggctagagcgccgcgcgtcgccgcggtcgttcgtgcgcaagttccggctgccggaggacgcggacgcgggcgccgtggccgcgcgctgcgagaacggcgtgctcaccgtcaccgtcaagaagcagccgccgccggagaagaagaccaagtccgtccaggtcgccatcgcctgatcgttcgagccttccttcagtcgcgccaactttcggtacctcgtcggcgtttgtcgtcagtgatcgttctagcagtagattagtgtggcgagtctggtagatttgggtgttctcctgtggtctcatgctctgttcgtcatctggccggagattaggtgtgctagttgtggtcgtcttttgtgaatcttgctgttaatggaactatggggcacgaattgttagctgccgtatcaacctctgcatgaatcttcccagcttgaccgaatgcagccgcgtgcctggattcagtatcaggattcgtacgtgtttcacctaatcttcactcgcggaagatagaatgaggactctgtttcgttcccttgagcaaa

SEQ ID NO: 2564 - DNA, 842 bp, Secale cereale
gctcgagctctcgaagtctgactcgctccgtcccatcccagtccccacccacccacagcgaggaaccaacccgaggaagaaagaagccatggccgagctgctgttcgcccctgccagtgccgctggcacgtgcggagtgctcgagcgccttgccgccgcggacgccgaccaccgcgaccacgcccaccaccaccacgccgcgcacgggcacggccacggccacccccgcgcgcagatcggggcgtgggcggcggcgcgccgtcgacatcgtggcgaccccggcgagtacgccttcgtgctcgacgtcccggcctctccaagtccgacatccaggtgactctggaggaggacaacgtgctggtgatgaagagcgcgaccaacggcaacggcggcggcggcgcgaacgggaagcgcaagcgggaggaggaggaggcggactgccgctacatccggctagagcgccgcgcgtcgccgcggtcgttcgtccgcaagttccggctgccggaggacgcggacgcgggcgccgtggccgcgcgctgcgagaacggcgtgctcaccgtcaccgtcaagaagcagccgccgcccgagaagaagaccaagtccgtcaaggtcgccatcgcctgatccttcgagccttccttcagtcgcgctaactttcggtacctcgtcggcgtttgtcgtcagtgatcgttctagcagtagattagtgtggcgagtctggtagatttgggtcttctcttgtggtctcatgctctgttcgtcatctggccggagattagttgtgggtggtcgtcttttgtgaatcttgctgttaatggaactatggagcacgaattgttagc

SEQ ID NO: 2565 - DNA, 1745 bp, Triticum aestivum
tctccggccatggcgaccatctccgcagctctctccgtctccctcctcccgcccgcggcccgccgcgccgtctccaccgccacctcctccccgccgcgcgtcaagagagccgcgcggttcaggtgctgcgcagaacctccttccccggaacagcaggagacctccgcgccttcgccccctccgccggaattgccttcgtccctgtggggcgtctccacaagcgcctggacggcgggcgtcgcggggctggggctcctggagaccggctacctcagctacctcaagctcacgggctccgaggccttctgccccgtcgccgggggaggctgcggcgacgtgctcgacagcgactactccgtcgtcttcgggatccctcttccattagttggtatggtgacatatggtgtggtgactgcactttctctgcaagaaaacggagaggagttactccctggactcgatgacttggatatccgcctaaccttgcttctgcttgctacttcactggcgactgcgagtgcttattttcttttcatcctgaacaccaaatttgtcgggacgtcttgcttatactgcctatcgtcagcatttatctccttcacattatttttcatcagactgaaggacattggcttggcacgtatccagaagtttgttggtcttcagttagctgtagctgtcattgttgctcttgctttaacaaactcatatagttcggctactactcagttaaagggtacaggtgatttcgtattagaaccatacaaaacagaggtaacatcagaatcaaccccttttgctatttcactggcaagacatctacattctataggtgctaagatgtatggagcattctggtgtactcactgcaatgaccaaaaacaattgtttggtcgtgaagctatggaaattctggattatgtggaatgcttccctaatggagccggtaaggggaagaaaatggccaacgaatgtgtggccactggtctggaaggttttccaacatgggtcatcaacgggaagctcctgagcggcgaccaggaactctcagtcctcgcagaagaatccggttttgtctccgagagccccgagcaatcctgaggcatggagctcgatgagcagaagcaccccgccgaatcgaagagcagaaaagagctctctagaggcaagaacctgaagcttgtggcagttaacagcaacaccacaaaaatttcatcccagatgaggtgcattccaatggtgcatatgtagattatactactaaatacaaccactaaccactgtaatactatgtaaaaaacaagacctatttgtcctctcatcgaatggcgcggaaggagagcatcgaacccggggcgaatgtactaggacctttttgtagagcctgtagtttgtgctgtaaaacctgtagtcctggaaaaccattgttttcgtagtacgtaatactttgcacttggacatttgcagtcctggggaaggacactgtgtgtgccctccgccctttgaaacgaagggtttctgctctctgggagcatatgtgaattcctgagctccacaacgtcgataattgagccattaatactttgttggtgaaactgaattttctgcctgatatgtgcagaaagtcagaaacacaaggaaatggtctaattcttgcagcaactgaagcaaagccgtctccgttccccaaaacatatggatatgcaaattcactcgtgtctggaaaaaatatgtgagcgtgtaaa

SEQ ID NO: 2566 - DNA, 1143 bp, Avena sativa
ccactcacctccgtctccgcccatggcgaccatctccgcagccctctccatctccttcctcccgcccgcaactcgcctcgccgtctccaccgtctcctccacgcgcgtcaagagagccgcgcagttcaggtgctgcgccgagcccccttccccggagcaggagagccccgcgcctctgcccactccaccggcgccgccttcgtctctctggggcgtctccacgagcacctggaccgcgggcgtggcggggctggggttactggagaccggctacctcagttacctcaagctcacgggctccgaggctttctgccccgtcggcggcggaggctgcggcgacgtgctcgacagcgactattcggtcgtcttcgggatccctcttccattagttggtatggtggcatatggtttggttgctgcactttctctgcaagaaaacggagaggacttactccctggacttgacgacttggatattcgcttaaccttgcttctgatggccacttcattggcgaccgcaagtgcttattttcttttcatcctgaacacgaagtttgttgggacgtcttgtgtgtactgcctatcgtcagcatttatctcattcacgttatttttcatcagaataaaggacattggcttggcacgtatccagaagtttgttggtcttcagttagctgtagctgtgattgttgctcttgctctaacaaactcctatagttcagctactactgaattaaagggcacagatgattttgtattagaaccatacaaagtagaggtaacaacagaatcaaccccttttgctatttcactggcaaaacatctacactctataggtgctaagatgtatggagcattctggtgttctcattgcaacgaccaaaaacaaatgtttggtcgtgaagctatggaaattctggattatgtcgaatgcttcccaaacggagccggtaagggaaagaaaatggccaatgaatgtgcagccactggtctagaaggttttccaacatgggtcatcaatggcaagcttctgagcggagacaaggagctatcagtccttgcagaggaatcgggttttgcctccgaggtccctgaacaatcctaatgccatgaagcacgtgcagaacgtaccctcaagctctc

SEQ ID NO: 2567 - DNA, 2776 bp, Brachypodium distachyon
tgagggctctgaggtcaggcgagctctcaccactcaccttccgtctccgtccatggcgaccatctccgcggctctctccatccccttcctcccgtctccgacacgcttcgccgtctccacgtacttctccccgcgcgtcaagagagcctcgcggttcaggtgctgcgcagagcctccttccccggagcaggagacccccgcccccacgcctccgatccctcctccaggggaacaccctgcgtcgccttcgtctctgtggggcgtttacacgagcacctggtccgcgggagtcgcggggctggggttcctggagacaagctacctcagttacctcaagctcacgggctccgaggccttctgccccgtcggcgggggaggctgcggcgacgtgctcgacagcgactattcggtcatcttcgggattcctcttccgttagttggtctggtggcatatggtcttgttgctgcactttctctgcaggagaacggaaaggagttacttccaggacttgatgacttggatattcgtttagttttgcttctgattgctacgtcattagcaactgcgagtgcatattttcttttcattctgagcaccaaatttgttggaacgtcttgcttatattgcctgtcgtcagcgttgatctccttcactttattttctatcagagtgaaggatttcggtttggcacggatccagaagtttgtgggtcttcagttagctgtagctgtcattgttgctcttgctttaacaaactcctatagttcagctactactcaattgaagggcacaggtgattttgtattagaaccatatgaaacagagataacaacagaatcaaccccttttgctatttcacttgcaagacatctacactctattggtgctaagatgtatggagcattctggtgttctcattgcaatgagcaaaaacaaatgtttggtcgtgaagctatggaaattctggattatgttgaatgtttccctaatggagctggtaagggaaagaaaatggctgccgaatgtgcagtcactggtctagaaggttttccaacatggttcatcaacggcaaggttctgagcggcgaccaggaactctcagttctggcagaagcatcaggttttgtctccaaggcccctgaacaatcataaggccatgaagcatgaagagaagtacctcgccgaatgtaagcaagaacctgaagctggtggatgttgacagcattgtcacaaaattgcagtttgagcttgagaaggttcctgccaatcttgcatagttcactaaatacaaccactgaccattgaatatgtaaaaactctacttgttctctcatgtgggcaaggaaagcagagacccccagagaaggagagtgttccgcatcccttttttgtagttctctatagtttatgctgtaaaatgtataattctggaagaaaacacggcttgccatctttttacataatgtagtaactttgcaccttgacatttgcagtacttcactacacaagtatagtgtatgtcctttacccttctacacaaagtttcaggcctgtttggatcacttgaattttacggatactttgttataaagtgcttgattctcctgccaaggtaccagggctgatctgctgcaccgatgtgaggaggagcgggtccgcatcgaccgcgatgcagggggggtgaaagtggcaggcgcgtatcgctgagtaggagtacgagcaggtcatgctcgtttgccaacaccaacaagaatgactccatcgtcgaggcatggtcggtggatgacccatcgccaagatgttcattgccatggatcagagcctgctctcctgctagatcgccacccggagcgccgcctcaacgtcgtgtacaagttgaaattctgtcatcctgctcgcgacaatatacaaactgaagcatacaaaattcctctttatccaaactggactgttcttatttcgtagagctataacctgttgaggtcgctccagttgggtgttcttgccaaattgttggagacagtagatttgtcagagctggggttgctgattgatttcttatgcaagttcactgatagcccgtagccaccgagcatgcaggtgctccattgattcttcaatcgtgttgcttcaaagatttttgacaccttgcaaggcagaattgcagaaacatgttacgcatatcagccttcgtttctgtatatcgggagagtaaagctgcgacagattcgatgagcaaatgacctactacctaaatcagcaacacttattatgaattggaggtagtattttttaatcattgtaagcagtttattattatttattcattaaagtaatagatatacgatatctttcggaataaaaatatataactagtttgggcttgacccattgtgaaaaaaaataccttttacaatctttcaaaaagaatcattaaatagaaccatagatttgtaaacaattttttagtatccattttaaaagaatcattaaaagtatgaccagttgtaaatccttcgtcttatctatgcgggagctgctaattggcggacatcggggggaggtggggaacgccatggtgttgcgaggtggggtgccgtcaggaggaagaaagaggggaggaggaagagagaggtccagcctcttagagagcaggtttcgtccgcgcagatctgaagcagcggtcatgtgcagaatagactttctgtatctattttcgtacatcatataacatttcacatttgcgcaatagatttgggcaagctttcatatcat

SEQ ID NO: 2568 - DNA, 1567 bp, Gossypium raimondii
tgtcactctctttgtgtctaatttgacttgccttccacttcaaatgagtaccgagtcttgctttctctcctaagtccttatctctccccaaatctctccctcccttctcttcaaattcacagttatgccatcctctcccaagttcttccacgcgcgcacttcgccgccggcaacgcctcacaccagatctactctcctcatcttcgcctccctcctcaccttcgccattgtctctttcctctttgccctctcttctttcctttcctccggtggatccggttaccgttgccggaactccgaccctagatccgtccgtgtcatttgggacaaaactggtcatggcaacaacggtctttccgctgctggtgatgatgatgggactaagaggcataaaataatgggcttcgttgggatccaaaccgggtttggctccactggtcggagacagtctttgagaaagacatggatgccttctgatcgtcaaggccttcaacgattggaagaagcaactggattagcttttaggtttgtaattggtagaacaaatgataaatcaaagatggcagagctgaaaaaagaagtagcagaatatgatgatttccttttgttagatattgaggaggagtacagtaagctcccgtacaaaacgttagcattttttaaagctgcgtatgcactctttgattcagagttttacgtcaaagctgatgatgatatatatttgaggccagatcggctatcacttttactagtaaaagaacgttctcactctcagacttaccttggttgcatgaaaaagggtccggtattcaccgatcctaagctaaaatggtatgagccattatcctttctcctaggcaaggagtactttcttcacgcctacggtccaatatatgctctttcagctgatgttgttgcaagtttggttgctctaagaaacgacagttttcggatgttcagtaatgaggatgtgaccattggtgcatggatgcttgcaatgaatgtcaaccatgaggataatcgagcattatgtgagccagagtgtacgcaatcatctgttgctgtctgggatatccccaaatgttcagggctatgcaatccggagacaaagatgttggaacttcatcagatagatgcctgctctaaaagtccaactttgccatcggacgatgattagcttaattggcaaaacacagattttattaacatggaaaggtgtcagaattgtttgttctggtaagttgatcttattgccctcagacatatctcaattaccctcgttcgatcatcgcaagccatttttgtcttccgccatcgttttgtctgtactatatcaacgttttttttcgctgacgatgcaagttaccaagagatttttacaataccattcttttgccaatacatttgatcaaaatgagggcttacttggttctactgtctatattgtaatatgtcctatgctacaaattagaatttgtgagagtgaaattaccccttttgatataaaaaaaattggtgtaatgatatatttagccgttaatgtttactcattttttactttgacctt

SEQ ID NO: 2569 - DNA, 2577 bp, Zea mays
cccaaagccgctcacggctcagtagctcacgccactcgggtgaccgcgacttcgagccgtgagagcggtgacactgcagtgtgcaagcgtccaatgccggcacagagatctggaatatgccaatcgccaccggggccgaccggccgagccgaagccctgggtgcggtgggcccgcggactgccatgagaggcacgggagcttcaaaaagaagccaacagcgggcgagaacggcaggcggaggcgacgtgtggacgtcaggcctcgcgccggatagcgtaccgactggcgagccagtgaaagaagaccccgtccccctccgcccacagactccacgcctaccccgcactcactgacagccccgccgcactccgtgtagagtccacatctcagtgaagcgaacccgtgggtttgtgtagctgagagctttttacgcgtcgctgcctttgtcttcccttcttccgctgatccgtctccatgcggctgccaagcgctgctggaaagtttaaaaacgcacggggagcttggagacttcacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcggaggaccaggcgctggaggctaggaactccaagacggtggtggcggtcatcctcggcggtggcgccgggaccaggctcttcccgcttaccagacgcagggccaagcccgcggtgccaattggcggcgcgtacaggctcatcgacgtgccgatgagcaactgcataaacagcgggatcaacaaggtctacatcctcacgcagttcaactcgcaatccctcaatcgccacctctccagagcctacgatttcagcaatggcgtggccatcggagacggattcgtcgaggttctagcagcaacccagaggcctggaacggaggggaaaaggtggtttcagggtactgctgatgcagttcggcagttcgactggcttttcgatgatgcaaaatctaaagacattgaagatgtgctgattctttctggtgaccatctctaccgtatggactacatggactttgttcagagtcatcggcaaagaggtgcaggcatcagcatctgttgtttgccaattgatggcagccgggcatctgattttggcctaatgaagatagacgacactggaagggtaatttcattcagtgagaaaccaaaaggagacgaattaaaggcaatgcaagttgacaccacagtgcttggcttatcaaaggaggaagcagaaaacaaaccttatatagcttcaatggggatctatatttttaagaaagacatactcctaaaccttctaagatggcgttttcccactgcaaatgattttggttctgaaataattcctgcttcagcaaaagaaatcgatgtaaaggcttatcttttcaatgattactgggaagatattggaactattaagtccttctttgaggcaaaccttgctcttgctgaacagcctccaaggttcagtttctacgatgctgacaaaccaatgtatacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgccgtggaaagaggagagctgcttgcagaaggaaaagttcctattgggattggagagaatacaacgattcaaaagtgtatcatagacaagaatgcgaggatagggaagaaagtggtaatctccaactctgaaggtgtagatgaagctgatagaacttccgaaggcttctacattcgatctggcatcactgtcgtactgaagaacgcgataattgctgatggattggtcatatgagctgaaaaggtctcacaggacgggtatttgccgcacaaaatatcaataggagttctttgttagttttacaataagatgctgtatagcagtcaacaggttattcttgtctatacaagatacctttgtctacaaatcttgtctcaccatgttgtattcgactcaaacaatgttgcagtcatggacattgtccgtttcaaattttcttccttgcacatttacacaaaccttttcaatttttatttcttgctaaacaataaaagctgttgttctaatcagtatgcaaccaagtttcaagtttcttgtgtcaaattcaatgtgcttgatcatgtatccacattataggttgcatgtttgaaactgcattaccaatgatttatagattttgaaagtagaggtagcttgcctg

SEQ ID NO: 2570 - DNA, 2256 bp, Brachypodium distachyon
acgggagctagcggcaaagcccggggccgacgtgtggacgttacgcctcgcgccggatagcgtggccacccgagccaaaacctctcgccactccatcctcagcccgcaccaccgctgacaatgccgaccccgccacctcccgggcctaccaatcagcgatgtattgctccgaatctcggggaagttagatttaaagcgtggcatcgccccctattccagcgtccccgtgcttctgctgagtagtggaaaagcttcgggggctcacgggggagcttaggattggacgcggccaccgcaccgttccgtgacattggcgaggggaggcgcggcgcgagaagcgaagcaaagcgcttagctcccgggttggaattcggcggccgcgcgatggacctgcgcgtcgctgcccccgcctccgcggccgcggccgcgcgccggggcgtgccgggcggcggagtcgtgcgcctccgtgcgctcgccgccggcgggcgccagcgccgactctcagtgcgggtctccgtcgcgaccaccgaggccgccaccgccgccgtcggcgcctcggaggatgcggacacggagacgaggaacgcgaggacggtggtggcggtcatcctcggcggcggcgccgggacgaggctcttcccgctcaccaagcgcagggccaagcccgcggtgccgataggcggcgcgtacaggctgatcgacgtgccgatgagcaactgcattaacagcgggattaacaaggtgtacgtcctcacccagttcaactcggcttccctcaaccggcacctctccagggcctacaatttcagcaatggcgttggcttcggagatggtttcgtcgaggttctagcagcgactcagaggcctggattggaggggaagaggtggtttcagggtaccgctgacgcggttcgacagtttgattggcttttcgatgatgccaaagctaaagacatagaggatgtgattattctttctggggatcacctataccgtatggactacatggactttgttcagtctcatcggcagagagatgcaggcatcagcatctgttgcttgcctattgatgacagccgggcatctgattttggtctaatgaagatagacgacacaggaagagttatatcatttagtgaaaaaccaaaaggagatgatttaaaggcaatgcaagttgacaccactgttctaggcttatcaaaggaggaagcagaagagaaaccatacatagcttcaatgggggtgtatatatttaagaaagagatacttctaaatctcttaagatggcgttttcccaccgcaaatgattttgggtctgaaataattcccgctgcagcaaaagagatcaatgtaaaggcatatcttttcaatgattactgggaagatattggaactattaagtccttcttcgaagcaaatcttgcccttgctgaacagcctccaagattcagcttctatgatgctagcaaaccaatgtatacatcacggagaaacctaccgccatctatgatcagcagtagcaagatcactgattcaatcatttcccacggatgtttcttggataactgcagggtagagcacagtgttgttggagtccgttctcgagttggctccaacgtgcacctcaaggatactgtaatgcttggtgctgatttctatgaaaccgatgtggaaagaagcgaccagctggcagaaggaaaggttccaattggaataggagagaacacgacgattcaaaactgtatcattgacaagaatgcgaggatagggaagaatgtgaccattgctaactctgagggtgtacaggaagcagacaggacatcagaaggcttccacatccgatctggcatcacagtcgtactgaagaactcggtaatcgcagatggattagtcatatgaactggagaaaaaggttcccaattcagcaagagaaatcaggcatgagcacgtgcggctggaacagaataatcggaggagtttgttctacttttccaataagatgtgtagcaattgtgagctgctccttgtgtatccatgaccattttggctcacaaatttatgtgtctcgccgtgatgttgtgaaacagtaacatcgttgtaaaacatgacacctatgctggaaaacttctacgtttcagcatttcaatatttttgcttgccggacaatgtgcattagaagcttttatgctagtaccttttttttacagctatgctttattgtgttttttacgggtatgatttatggtactccctctg

SEQ ID NO: 2571 - DNA, 2451 bp, Brachypodium distachyon
catttcgtggctggcgtgccatggcagccagcccccactcccacgaggccacgagacacggggcgagagcttcgatccaaaaacatccaaggaagagagcagccaacgggagctagcggcaaagcccggggccgacgtgtggacgttacgcctcgcgccggatagcgtggccacccgagccaaaacctctcgccactccatcctcagcccgcaccaccgctgacaatgccgaccccgccacctcccgggcctaccaatcagcgatgtattgctccgaatctcggggaagttagatttaaagcgtggcatcgccccctattccagcgtccccgtgcttctgctgagtagtggaaaagcttcgggggctcacgggggagcttaggattggacgcggccaccgcaccgttccgtgacattggcgaggggaggcgcggcgcgagaagcgaagcaaagcgcttagctcccgggttggaattcggcggccgcgcgatggacctgcgcgtcgctgcccccgcctccgcggccgcggccgcgcgccggggcgtgccgggcggcggagtcgtgcgcctccgtgcgctcgccgccggcgggcgccagcgccgactctcagtgcgggtctccgtcgcgaccaccgaggccgccaccgccgccgtcggcgcctcggaggatgcggacacggagacgaggaacgcgaggacggtggtggcggtcatcctcggcggcggcgccgggacgaggctcttcccgctcaccaagcgcagggccaagcccgcggtgccgataggcggcgcgtacaggctgatcgacgtgccgatgagcaactgcattaacagcgggattaacaaggtgtacgtcctcacccagttcaactcggcttccctcaaccggcacctctccagggcctacaatttcagcaatggcgttggcttcggagatggtttcgtcgaggttctagcagcgactcagaggcctggattggaggggaagaggtggtttcagggtaccgctgacgcggttcgacagtttgattggcttttcgatgatgccaaagctaaagacatagaggatgtgattattctttctggggatcacctataccgtatggactacatggactttgttcagtctcatcggcagagagatgcaggcatcagcatctgttgcttgcctattgatgacagccgggcatctgattttggtctaatgaagatagacgacacaggaagagttatatcatttagtgaaaaaccaaaaggagatgatttaaaggcaatgcaagttgacaccactgttctaggcttatcaaaggaggaagcagaagagaaaccatacatagcttcaatgggggtgtatatatttaagaaagagatacttctaaatctcttaagatggcgttttcccaccgcaaatgattttgggtctgaaataattcccgctgcagcaaaagagatcaatgtaaaggcatatcttttcaatgattactgggaagatattggaactattaagtccttcttcgaagcaaatcttgcccttgctgaacagcctccaagattcagcttctatgatgctagcaaaccaatgtatacatcacggagaaacctaccgccatctatgatcagcagtagcaagatcactgattcaatcatttcccacggatgtttcttggataactgcagggtagagcacagtgttgttggagtccgttctcgagttggctccaacgtgcacctcaaggatactgtaatgcttggtgctgatttctatgaaaccgatgtggaaagaagcgaccagctggcagaaggaaaggttccaattggaataggagagaacacgacgattcaaaactgtatcattgacaagaatgcgaggatagggaagaatgtgaccattgctaactctgagggtgtacaggaagcagacaggacatcagaaggcttccacatccgatctggcatcacagtcgtactgaagaactcggtaatcgcagatggattagtcatatgaactggagaaaaaggttcccaattcagcaagagaaatcaggcatgagcacgtgcggctggaacagaataatcggaggagtttgttctacttttccaataagatgtgtagcaattgtgagctgctccttgtgtatccatgaccattttggctcacaaatttatgtgtctcgccgtgatgttgtgaaacagtaacatcgttgtaaaacatgacacctatgctggaaaacttctacgtttcagcatttcaatatttttgcttgccggacaatgtgcattagaagcttttatgctagtaccttttttttacagctatgctttattgtgttttttacgggtatgatttatggtactccctctgttcctatctaaaacatgctctagttttgtcctctaaatttataaaaacatgtatattccatgacgaatttaataacattaatttgcagcc

SEQ ID NO: 2572 - DNA, 2085 bp, Oryza sativa
cacgctgcggccgccgcggttgtgtccctagtggaaagttgcacgagctcacgggggtcaggcgactaggcgaggagagaagaggagaggagaggagaggagaggtttggattgggaaggatcaccagctcaccacccgtttctctctctggcattgcgaggggaaggcggcgacgggaggcgcgcgcgggtgtagacgcgtagtgatggcggcgatggacctgcgggtggccgccccggcctccgtggccgcggcggcgcggtgcggcacgagcctggcgaggccgtggcctgcccgggcggtgggaggaggaggaggaggaggaggacggggccggcgtctctccgtgcggacgtccgtcgcgaccaccgaggccgccgccgccgccgtgggcgcctcggaggacgcggcgctggaggcgcgggactcgaagacggtggtggcggtcatcctcggcggcggcgcggggacgaggctgttcccgctcaccaagcgcagggccaagcccgcggtgcccattggcggagcgtacaggctgatcgacgtgccgatgagcaactgcataaacagcggcatcaacaaggtgtacattctcacccagttcaactccgcgtcgctcaaccggcacctttcccgggcgtataacttcagcaacggcgtcgcgtttggagatggattcgtcgaggtcctagcagcaactcagacgcctggatcggagggaaagaggtggtttcagggtacagctgatgctgttcggcaatttgactggctttttgatgatgccaaagctaaagacatcgatgatgtgctgattctttctggtgatcatctctaccgcatggactacatggactttgttcagagtcatcggcaaagaggtgcagacatcagcatctgttgcttgcctattgatgatagccgggcatctgattttggtctaatgaagatagacgacacaggaagagttatcgcatttagtgaaaaaccaaaaggagatgatttaaaggcaatgcaagttgacaccactgttctaggcttaccacaggatgaagcaaaagagaagccatacatagcgtcaatgggggtttatatatttaagaaagagatacttctaaatcttttgagatggcgttttcccacagcaaatgactttggatctgaaatcattcctgcttcagcaaaagaaatcaatgtaaaggcatatcttttcaatgattactgggaagacataggaactataaaatcattctttgaagccaatctttctcttgctgaacagccaccgagattcagcttttatgatgctaataaaccaatgtacacatcacggagaaacttaccgccatctatgatcaataatagtaagatcactgattcaatcatttcccatggatgtttcttggatagctgcaggatagagcacagtgttgttggaatccgttctaggataggttccaatgtgcacctcaaggatacagtaatgcttggtgctgatttctatgagactgatctggaaagaggagaactgctggctgaaggaaaggttcctattggaatcggggagaatacaaagattcagaactgcataatagacaagaatgcgaggatagggaagaatgtaacaatttccaactctgagggtgtacaggaagcagataggacctctgaaggcttctacatccgatcaggcatcaccatcgtattaaagaactcgataattgcagatggattagtcatctgaggtggaataaagccctccctaatccaaccagaaaaagccagccatgaccatttgcggcaggaatagaataaaatcatcagagctctttgttcttagttgtgtacttagcattcaagagcttctgcatgtctgtacaaaatcattgtctcgtgaatctaccgtgtgtgttttaacactaaacacatggtcatgaagcttgaaaaaaaaaacaaaattttatgatctggggtattggttgttccatgtaatctgcaggcgaagaaaaccttacctatctacaggtgtactctctccgtcaaaaaaaaaaacttaatctagatgggaatttgacacaaccttgaac

SEQ ID NO: 2573 - DNA, 1961 bp, Avena sativa
gtgcattgagtaggaggatattgaaagcgtcgcctcccgttccaccatttccacgctgccgagtagtggaaagcattagaatcacgaggggagccgagagaacgtaggattggacgctgccaccgcccagttccgtgacatttgcgagtggaggcgcggcgagcgaggctagctcacggttggatcaatccggcggccgcgcgcgatggacctgcgcgtcgctgcccctgcatccgcggccgcggccgcgcgccggggcgtgctcggcggcggaggcgccagcctccgggttccggtcggccgcaggcgcagcctctccgtgcggacgtccgtcgccaccacagagtccgccgccaccgccgccgtgggcgccttggaggatgatgacgtggagacgaggaacgcgaggacggtcgtggcggtcatactcggcggcggcgccgggacgaggctcttcccactcaccaagcgcagggccaagcccgcggtgccgatagggggcgcgtacaggctgatcgacgtgcccatgagcaactgcattaacagcgggatcaacaaggtgtatgtgctcacccagttcaactcggcgtccctcaaccgccacctctccaggtcctacaatttcagcaatggcgtgggttttggtgatggtttcgtcgaggtcctagcagcaactcagaggcctggcttggaggggaataggtggtttcagggtaccgccgacgcggttcggcagtttgcttggcttttcgatgatgccaaatctaaagacatagaggatgtgctgattctttctggtgatcacctctaccgtatggactacatggactttgttcagagtcatcggcagagagatgcaggcatcagtatctgttgcttgcctattgatgatagccgggcatctgattttggtctaatgaagatagacgacacaggaagagttatttcatttagtgaaaagccaaaaggagctgatctaaaggcaatgcaagttgacaccactattctaggcttaccgaaggaggaagcagaaaagaaaccatacatagcttcaatgggggtatacttatttaagaaagagctacttctaaatcttttaagatggcgttttcccactgcaaatgattttgggtctgaaataattcctgctgcagcaaaagagatcaatgtaaaggcatatcttttcaatgattactgggaagatatcggaactatcaaatccttctttgaagcaaatcttgccctggctgaacagcctccagggttcagcttctatgatgctagcaaaccgatgtacacatcacggagaaatcttccaccatctatgatcagcagtagtaaggtcaccgattcaatcatttcccatggatgtttcttggacagctgcaggatagagcacagtgttgttggcatccgttctcgagtaggctccaacgttcacctcaaggatacggtaatgctcggcgctgacttctacgaaactgatgcggaaagaggcgaccagctggccgaaggaaaggttccaatcgggatcggggagaacacgtcgattcaaaaatgcatcattgacaagaatgcgaggatagggaagaatgtgatcatcgcaaactctgagggtgtacaggaggctgacagaacatcggaaggcttccacatccgatccggcatcacggttgtactgaagaactcggtgattgcggacggattagtcatctgagctgaaacccaaagtgctccaattcagcaaagagaggtctagcacaaggattcgcgactggaacagaacactcattaggattcgttgtactcttccaataagatgtgtagcagtcgtgagctgctccttgtgtatacaagatcattttggctcgcaaatctatgcgtgtcgacgtttcgttttcaaactcgaacatcgttgtgaaacatggcatcaatgctacaaaaaccttccgccgttccaa

SEQ ID NO: 2574 - DNA, 1825 bp, Avena sativa
gtgcattgagtaggaggatattgaaagcgtcgcctcccgttccaccatttccacgctgccgagtagtggaaagcattagaatcacgaggggagccgagagaacgtaggattggacgctgccaccgcccagttccgtgacatttgcgagtggaggcgcggcgagcgaggctagctcacggttggatcaatccggcggccgcgcgcgatggacctgcgcgtcgctgcccctgcatccgcggccgcggccgcgcgccggggcgtgctcggcggcggaggcgccagcctccgggtgccggtcagccgcaggcgcagcctctccgtgcggacgtccgtcgccaccacggagcccgccgccaccgccgccgtgggcgccttggaggatgaggacgtggagacgaggaacgcgaggacggtcgtggcggtcatcctcggcggcggcgccgggaccaggctcttcccactcaccaagcgcagggccaagcccgcggtgccgatagggggcgcgtacaggctgatcgacgtgcccatgagcaactgcattaacagcgggatcaacaaggtgtatgtcctcacccagttcaactcggcgtccctcaaccgccacctctccaggtcctacaatttcagcaatggcgtgggttttggtgatggtttcgtcgaggtcctagcagcaactcagaggcctggcttggaggggaataggtggtttcagggtaccgccgacgcggttcggcagtttgcttggcttttcgatgatgccaaatctaaagacatagaggatgtgctgattctttctggtgatcacctctaccgtatggactacatggactttgttcagagtcatcggcagagagatgcaggcatcagtatctgttgcttgcctattgatgatagccgggcatctgattttggtctaatgaagatagatgacacaggaagagttatttcattcagtgaaaaaccaaagggagctgatttaaaggcaatgcaagttgacaccactattctaggcttacccaaggaggaagcagaaaagaaaccatacatagcttcaatgggggtatacttatttaagaaagagctacttctaaatcttttaagatggcgttttcccactgcaaatgattttgggtctgaaataattcctgctgcagcaaaagagatcaatgtaaaggcatatcttttcaatgattactgggaagatatcggaactatcaaatccttctttgaagcaaatcttgccctggctgaacagcctccagggttcagcttctatgatgctagcaaaccgatgtacacatcacggagaaatcttccaccatctatgatcagcagtagtaaggtcaccgattcaatcatttcccatggatgtttcttggacagctgcaggatagagcacagtgttgttggagtccgttctcgagtaggctccaacgttcacctcaaggatacagtaatgcttggcgctgacttctacgaaactgatgcggaaagaggcgaccagctggccgaaggaaaggttccaatcgggatcggggagaacacgtcgattcaaaaatgcatcattgacaagaatgcgaggatagggaagaatgtgatcatcgcaaactctgagggtgtacaggaggctgacagaacatcggaaggcttccacatccgatccggcatcacggttgtactgaagaactcggtgattgcggacggattagtcatctgagctgaaacccaaagtgctccaattcagcaaagagaggtctagcacaaggattcgcgactggaacagaacaatcgttaggattcggagttgtactcttccaataagatg

SEQ ID NO: 2575 - DNA, 1130 bp, Saccharum officinarum
agctgagaatcaattgctagtacgatctcttctctccccaaagcggccaagccaccaaccaaccctctttctcgcgatcgtctcgggactccagagtgccggctctccgcctgttcgtgtcgtcgctgctcctttccccgtgagcttaaaatatatacaggatgtcggaaagttctgagagtgcaactgaaaagattatgagcagcatcatggatacaattgctgacaaccttcctaagcagaagtccgggcactttgacccaggttcagtctctgacaaagtgaagaacaagctgtttggtcgtcagaagaccttgcacggagttctgggtggtggaaaatctgctgatgtgctattatggaggaacaagaagatatcatcgagtgttctggctcttgcaacagctatttgggttttcttcgagtggcttgactaccactttctgacaattgtttcgtttgcccttgttcttggaatggttatccagtttgtctggtccaacttctcaaacatgctaagcggatccccttctcaggtgccccgagttgaattgcctgatgagttatttgtgaacattgctgttgcaatcggtgcccaagtaaacaagttcctgtgcttccttcaggatgtgtcttgtgaaagaaacttgaagcattttgtagtggcgattgccggactgtgggctgctgcagtgattggaagttggtgcaatttcctgacagtcatatatatcgggtttgtttgtgttcacacacttcctgtgctctatgagaagtacgaagaccaagtcgatgatttcctctacaacctgcttggtctgctgcgagatcagtatcagaagcttgaccaaggcgtcttgagcaagattcccaaggggaacatgaaggctaagaagaacgaatagtttagcagctggtttctcatgaatgaatgggttggtgaactgatgttgtgccctcttgtgcatcgcagacttgcgtcaattgttacttaagctgtgtgccattctgaacatgggtgttagttcattgcccacaggatttaaactattaagctgcaatgcatgttgtccactattcaagtccttggactcgtttaaattgctgatccgattacttgtgggatattg

SEQ ID NO: 2576 - DNA, 1204 bp, Sorghum bicolor
ctccccaagtggccaaagccaccaaccacgaccagcccctttttctcttctatttcatccacgctgctcgtgctcggctgctcgctgcctgcttctagcgatcgtctcgggactccagagtgccggccggctctccgcctgttcgtatcgtcgctgctcctttccccgtgagtttaaaatatacacagtacaggatgtcggaacgttctgagagtgcaactgaaaagattatgagcagcatcatggataccattgctgacaaccttcctaagcagaagtctgggcactttgacccaggttcagtctctgacaaagtgaagaacaagctgtttggtcgtcagaagaccttacatggagttctgggtggtggaaaacctgctgatgtgctgttatggaggaacaagaagatatcatcgagtgttctggctcttgcaacagctatttgggttttctttgagtggcttgactaccactttctgacaattgtttcgtttgcccttgttcttggaatggttgtccagtttatctggtccaacttctcaaacatgctaagcggatctccttctcaggtgccccgagttgaattgcctgaagagttatttgtgaacattgccattgcaatcggtgcccaagtaaacaagttcatgtgcttccttcaggatgtgtcttgtgaaagaaacttgaagcattttgtagtggcgattgccggactgtgggccgctgcagtgattggaagttggtgcaatttcctgacagtcatatatattgggtttgtttgtgttcacacacttcctgtgctctatgagaagtatgaagaccaagtcgatgatttcctctacaaccttcttggtctgctgcgagatcagtatcagaagcttgaccaaggcgtcttgagcaagattccgaaggggaacatgaaggctaagaagaacgagtagtttagcagctggtttctctgaatgaatgaatgggttggtgaactgatgttgcgccctcttgtgcatcgcagacttgcgccaattgttgcttaagctgtgtcccattctgaacatgggtgttagttcattgcccactgggtttaaaaactattaagctgcaatgaatgttgtccactattgaagttcttcgactcaattcacatttctgatctgatcacttatgggatattgacacactgctcaagtaatgaagtgtgcccataacc

SEQ ID NO: 2577 - DNA, 1128 bp, Pennisetum glaucum
cacgctgctcgtgctcgccgcctgctcctcgcgatcgtctccggggggcgccggctcaccgtcgctccgtcttcgtgtccccgctgctcttcccccgtgagcttaaagttcttgaggatgtcggaacgttctgagagtgcaactgaaaagattatgagcagtataatcgataccatcgctgacaatcttcctaagcagaagtctgggcaattcgatccaggttcggtctcagacaaggtgaagaacaagctctttggtcgtcagaagaccctgcatggagctctgggtggtggaaaacctgctgatgtgctgttatggaggaacaagaagatatcatcaagcgttctggctgttgcaacagctatttgggttttctttgagtggcttgattaccacttcctgacaatcatttcgtttgcccttgttcttggaatggtcggccagtttgtctggtccaatttctcaaacatgctaaacggatctccttctaaagtgccccgagttgagttgcctgatgagctgtttgtgaacattgctgttgcaatcggtgcccaagtgaacaagttcctgaacttccttcaagatgtgtcttgtgaaagaaacttgaagcattttgtagtggcgatcgctggactgtgggctgctgcagtgattggaagctggtgcaatttcctgacagttatatatatcggatttgtttgtgctcacacacttccagtgctctacgagaagtatgaagatcaagtggatgatttcctctacaaccttctcggtctgctgcgagatcagtaccagaaactcgaccaaggtgtcttgagcaaaatacccaaagggaacctgaaggctaagaagaatgagtagttcagcagctggatgtcaagaatgaatgggtgatgtgccgttttgtgtgttgcagttttgtatcaattgttacttgaacgctgggtgtggctttctgaacatgggcgctagttcactgcccactgccaccagatttagacttctaagctgcaatgcatgtggtctactattcgcataatgcgagtcgtttagttgattacattccttcctgctcctattgtacttgtgagatattggctaattggcatactgctcaagtaatgaagt

SEQ ID NO: 2578 - DNA, 2876 bp, Setaria italica
cgctcgtcgaatcacatgacccgcgccgccgctccccctcccggaatcgcgaatcaatttctgctagtaggatttcttcccccaaagccaccaaccagccttttccacggcacgctgctcgtgctcgactcctgctcctcgcgatcggagagggcgcgccggctcaccgtcgcttcgtcttcgtacccccgctgctctttccccgtgagcttaaagttattgaggatgtcagaacgttctgagagtgcaactgaaaagattatgagcagcatcattgacaccattgctgacaatcttcctaagcagaagtctgggcaatttggtccaggctcggtctctgacaaagtgaagaacaagctgtttggtcgtcagaagaccctgcatggagctctgggtggtggaaaacctgctgattgcctgttatggaggaacaagaagatatcatcaagcgttctggctgttgcaacagctatctgggttttcttcgagtggcttgattaccacttcctgacaatcgtttcatttgcccttgttcttggaatggtcgtccagtttgtctggtccaatttctcaaacatgctaagcggatctccttctcaagtgccccgagttgagttgcctgatgagctgtttgtgaacattgctgttgcaattggtgcgcaaataaacaagttcctgagcttccttcaagatctgtcttgtgaaagaaacttgaagcattttgtagtggcgattgctggactgtgggctgctgcagtgattggaagttggtgcaatttcctgacagttatatatattggatttgtttgtgctcacacacttccagtgctctacgagaagtatgaagaccaagtcgacaatttcctctacagccttcttggtctgctgcaagatcagtatcagaagctcgaccaaggtgtcttgagcaagatacccaaagggaacctgaaggctaagaagaacgagtagtttagcagctggatgtcaagaatgaatgggctggtgaactattgctgtgccctcttgtgcgttgcaagcttgtatcaattgttacttgaacgctgcgtgtggctttctgaacatgggcgctagttcattgcccaccgccaccgggtttagacttctaagctgcaatgtatgtcatctactattcgtgttctgactcatttacattccttctcctattacttgtgggatattggctaattggcaagtaatgaagtgtgcccatgattcatttctgaaaactggaagttgcgggcatgctcttttttcttctttgtttctataagagtctgccttttctcagacattctcagacaagctcaaactgcaaggataagttctagcatataaatatgtatgtaggactgatgtattccttgtttctcaattaaattaactcgataaaattacataacgttttcacaaaatgaaagccttcatcccgtgactgccaaggactacgtaaaatggctgagaacatgtcttaagaacgctatataaactgaaacatcccttgtatataaaaacaaatgaaaacaaagccgaaacgtgaaaaaacctgtaagggaaaatgtgaatcaagaagcaatggcaggtttggatgtactagaagccattaagcatgaatcatcttgatctgcgtagttctgaattctgaatgctaaaccaagtagcttaacttacgtgatagatgcttcacgcctgagacatgaacagcagcagtcaaaacgatcagttcattcagaaaaaggaatgcaggtcaccgcgatccaacctaactgctctccatccatgctataaaacttgcagagagagaccatgccatgcgtctcctcaccgatcacctcaccggcggaagcaaagggagccacaagaagctccgcgcgaagcagcaacaagccatggagcagaagctgctgtccgtcctcctcctcctcgccgtcctctgcgccgggccctgccacgccctgcgcctcctcaacgacgccgacggcggccgggagttctccttcggctccaaggccgccgcagcgggggccgccgagaccgagccgctggacccgtccctgagcgacgactacgagaacgagatcagccacgtggagttcgagccggagctcggcagcgtggcgccgcacgccacggccgcggcggcgcccgtgcccgccgccgcgaccacggccaccgtcaccgtcgccgccgcggggccggccccggagccggtgagggcccgcaacgccgccgcagcggagagcgccgccggcacccggagcatgaagtggtggctgccgccgtcgaccatgccgtcgttcccgctgttcccgaaccccggcggcatgcccggcatcccggggctcccgatgcccggcatgccgttccaccccatcggcggctggggcgtgccggcgccgcccgaccagtccccgccggcaccccctgcggccgccgcaagcaccaacgccaacgacccgaacgcgaacggcggcgtcaactgaccagcgagctcgctgctcgcctctatatgatcggcgcgccgcggtggacggtgctagagctcaccgttccttctcggttcttatcactactcgtgtctcgcctactaccaccgagttcacccctactaaggcctagtcgtgcctcgtgtgtgttcgcttcgaatgttgggctgtgaacttgattgttaccatgttgttggccgcatgaacttgtgttgccttcaacgagggcgtgccatttgttctgctgctctaacttacacgagtgagatagacaaacctgccgtgactctactgctacaaatataggttcttgtagcatgaaaaaagttactgtgctgatatgttgtcaatatacacggatcttatatgcgc

SEQ ID NO: 2579 - DNA, 1231 bp, Setaria italica
tcacatgacccgcgccgccgctccccctcccggaatcgcgaatcaatttctgctagtaggatttcttcccccaaagccaccaaccagccttttccacggcacgctgctcgtgctcgactcctgctcctcgcgatcggagagggcgcgccggctcaccgtcgcttcgtcttcgtacccccgctgctctttccccgtgagcttaaagttattgaggatgtcagaacgttctgagagtgcaactgaaaagattatgagcagcatcattgacaccattgctgacaatcttcctaagcagaagtctgggcaatttggtccaggctcggtctctgacaaagtgaagaacaagctgtttggtcgtcagaagaccctgcatggagctctgggtggtggaaaacctgctgattgcctgttatggaggaacaagaagatatcatcaagcgttctggctgttgcaacagctatctgggttttcttcgagtggcttgattaccacttcctgacaatcgtttcatttgcccttgttcttggaatggtcgtccagtttgtctggtccaatttctcaaacatgctaagcggatctccttctcaagtgccccgagttgagttgcctgatgagctgtttgtgaacattgctgttgcaattggtgcgcaaataaacaagttcctgagcttccttcaagatctgtcttgtgaaagaaacttgaagcattttgtagtggcgattgctggactgtgggctgctgcagtgattggaagttggtgcaatttcctgacagttatatatattggatttgtttgtgctcacacacttccagtgctctacgagaagtatgaagaccaagtcgacaatttcctctacagccttcttggtctgctgcaagatcagtatcagaagctcgaccaaggtgtcttgagcaagatacccaaagggaacctgaaggctaagaagaacgagtagtttagcagctggatgtcaagaatgaatgggctggtgaactattgctgtgccctcttgtgcgttgcaagcttgtatcaattgttacttgaacgctgcgtgtggctttctgaacatgggcgctagttcattgcccaccgccaccgggtttagacttctaagctgcaatgtatgtcatctactattcgtgttctgactcatttacattccttctcctattacttgtgggatattggctaattggcaagtaatgaagtgtgcccatgattcatttct

SEQ ID NO: 2580 - DNA, 1595 bp, Panicum virgatum
aagacggaaaatctctcagacggaccacgcttccctcgggctctataccagcacttgatttgcccggagccccggacaaaccattcaggtgacgttggcctccccttactagcgggccccgccacgaccatccttccctccaggcccacctgtaagcggacacgccgcaaattcggcagcgtgcgcgtagcaactagcaaggcccctcctgtggggtccgccgaggcttttgcctcacgtacagcagcgcaacggccacttctccgttgggaactccaagagtggagtccgggatggtcccacaagccagtgacccgctcgtcagaatcacatgacccgccgctccccctcgccgaatcgagaatccaatattcaattgctagctgtacgatttcttcttcccccaggccaccaaaaccagcctttccctttccattgcacgctgctcgtgctcgccgcctgctcctcgcgatcgtctctgggggcgccgccggctcaccggcgcttcgtctccgtgccccggctgctctttcccggcgagcttaaaatctattgaggatgtcggaacgttctgggagtgcaaccgaaaagattatgagcagcatcattgatagcattgctgacaaccttcctaagcagaagtctgggcaattcgatccaggtgcagtctctgaaaaggtgaagaataagctgtttggtcgtcagaagaccctgcatggagttctgggtggtggaaaacctgctgatgtgcttttatggaggaacaagaagatatcatcaagcgttctggctcttgcaacagctatttgggttttcttcgagtggcttgattaccacttcctgacaatcgtttcgtttgcccttgttcttggaatggttgtccagtttgtttggtccaatttctctaacatgctaagcggatctccttctcaagtgccccgagttgagttgcctgatgagatgtttgtgaacattgctgttgcaatcggtgcccaagtaaacaaattcttgagtttccttcaagatgtgtcttgtgaaagaaacttgaagcattttctagtgtcgattgctggactgtgggctgctgctgtgattggaagctggtgcaatttcctgacagttatatatattggatttgtttgtgctcacacgcttcctgtgctctacgaaaagtatgaagaccaaattgatgatttcctctacaacctcctcggtctgctgcgagatcagtatcagaagctcgaccaaggtgtcttgagcaagatacccaaagggaacatgaaggctaagaagaatgagtagtttagctgctggattctcatgaatgagtgggttggtgaactattgttgtgtcgacttgtgcatcgcagactcgtgtcaattgttacttgaaagctgtgtgtgccttgctgaatatgggtgcttgttcattgcccagcaccactgggattaaacttcatgcaatgcatgtcatctactatattcgtgttcttcaactcatttacattcatgctcctatgacttgtgggatattggcatactgcttatgtaatgaggtgtgcccatgatccatttttaaaaagtggaaagttgcc

SEQ ID NO: 2581 - DNA, 753 bp, Panicum virgatum
tttccagcgagcttaaaatatattgaggatgtcggaacgctctgggagtgcaactgaaaagattatgagcagcatcattgatagcattgctgacaaccttcctaagcagaagtctgggcaattcgatccaggtgcagtctctgaaaaggtgaagaacaagttgtttggtcgtcagaagaccctgcatggagttctgggtggtggaaaatctgctgatgtgctgttatggaggaacaagaagatatcatcaagcgttctggctcttgcaacagctatttgggttttcttcgagtggcttgattaccacttcctgacaatcgtttctttgcccttgttcttggaatgtttgtccagtttgtttggtccaatttctcaaacatgctaagcggatctccttctcaagtgccccgagttgagttgcctgatgacctgtttgtgaacatcgctgttgcaatgggtgcccaagtaaacaagttcttgagcttccttcaatatgtttcttgtgaaagaaacttgaagcattttctagtggcaatcgctggactgtgggctgctgcagtgattggaagctggtgcaatttcctgacagttatatatattggatttgtttgtgctcacacgcttcctgtgctctacgagaagtatgaagaccaaatcgattatttcctgtacagccttctcggcctactgtgtgatcaatatcagaagctcgaccaaggtgtcttgagcaagatacccaaagggaacatgaag

SEQ ID NO: 2582 - DNA, 1149 bp, Oryza sativa
gctactagtccccttgaagaacacttccccatctactactactactactcctactttgaatacctgctcttgctcttcgcctcgttcgtctccaagaagctcgagagccgagggcttctccgtctcttcgttcatctgctgctgtgtctcccctggtgaggtacgacaagatgttggaacattcggagagtgcaacagaaaaaattatgagcagcatcatggataccattgctgagaaccttcctaagcagaaatctgggaaatttgacgtaggcgctgcctctgacaaaatgaaggagaagctgtttggtcgtcagaagaccattcatcgagttctgggtggtggaaagcctgctgatgtgttgctatggaggaacaagaagatatcctccagtgtcctggctcttgcaacagcaatttgggtattctttgagtggctcgactaccacttcctaacaattgtttcatttgcccttgtccttggaatggttgtccagttcgtgtggtccaatttctcaagtgctctaagcggatctccttctaaagtaccccgtgttgagctgccagaagagctgtttgtgaacattgcagttgcagttggtacccaagtaaataagttcttgagttttcttcaggatgtgtcttgtgaaagaaacctgaagcactttgtactggcaatcgttggactgtgggctgcggctgttattgggggctggtgcaatttcttaactgtcatttacattggatttgttagcgctcacacgctgcccgtgctctacgagaagtatgaagatcaagttgatgatttcctatacaatattcttggcctcctgcgtgaccagtatcagaaacttgatcaaggtgtcttgagcaagataccgaaggggaacatgaagttcaagaagagcgagtagattgtctgggttttaagaactgaaatcatagattagctgggttttcatcagtggaatgaatcaagaatttgtaccatgctcagttgcgtattgcagacattggttgtcagttgtcatctgagagctgtgtgctttcctgaatggggcgctcatttgctgcaatctgaattaatatttcaactgctctgccctgcatttcttctgttatgtagtgttattcaagtggctcaattaa

SEQ ID NO: 2583 - DNA, 856 bp, Echinochloa colona
gccatcttaattagctagtgtatggaatatttggcgtacgtcacggcctcacgggccaccatataccgacatcatctctgtttgtctgtactgcacttgtctttgttgtcagtttgcagcatcatggataccattgctgacaaccttcctaagcagaagtctgggcacttcgatccaagttcagtctctgacaaagtgaagaacaagctgtttggtcgccagaaaaccctgcatggagttctgggtggtggaaaacctgctgatgtgctgttatggaggaacaagaagatatcatcgagtgttatggctcttgcaacagctatttgggttttcttcgagtggcttgactaccactttctgacaattgtttcatttgcccttgttcttggaatggttgtccagtttgtttggtccaacttctcaaacatgctaagcggatctccttctcaagtgcccagagttgagttgcctgatgagctatttgtgaacattgctgttgcaatcggtgcccaagtaaacaagttcctgagcttccttcaagatgtgtcttgtgaaagaaacttgaagcattttgtagtggcgatcgccggactgtgggctgctgcggtgatcggaagctggtgcaatttcctgacagttatatatattggatttgtttgtgctcacacgcttcctgtgctctacgagaagtatgaagaccaagtcgatgatttcctgtacaaccttcttggtctgctgcgagatcaatatcagaagctcgaccaaggtgtcttgagcaagatacccaaagggaacatgaaggctaagaagaacgagtagtttagctgctggaatctcatgaatgactggggttggt

SEQ ID NO: 2584 - DNA, 2470 bp, Sorghum bicolor
ccctattaaaccaccgagctgggcgcctccccgtggcgctcgcggccgcactagcgaggagatcgagagacaagagagggggaaggcggcggcggcggcggcggcttaccggctgaagccttctctccctccgtcgcctcctccctacccttctctaggaacggcttcttcctcctgaatggagacgtcggcgccgcccaatgccgccgctccgccggcgcagcagccacggaggcggctgccggacttccagcagtcagtgcggctcaagtatgtgaagctggggtaccactacctcatctcccacgggatgtacctgctgctgtcgccgctgatggcgctcgtcgccgtgcagctctccaccgtctccccgcgcgacctcgccgacctgtgggagcagctccgcttcaacctcctctccgtcgtcgcctgctccacgctgctcgtcttcctctccaccgtctacttcctcacccgcccgcgccccgtgtacctgctcgacttcgcctgctacaagccggagccggagcgcaagtgcacgcgccagaccttcatgcactgctccaacctcaccggatccttcacggacgacaacctcgaattccagcgcaagatcctcgagcgctccggcctcggcgaggacacctaccttccccccgccgtgctccgggtgccccccaacccgtgcatggacgaggcgcgcaaggaggcgcgcgccgtcatgttcggcgccatcgaccagctgctcgagaagaccggggtcaggcccaaggacattggcgtcctagtggtcaactgcagcctgttcaacccgacgccgtcgctgtcagccatggtggtgaaccattacaagctgagggggaatattgtgagctacaacctcggcgggatgggctgcagcgctgggctgctgtccattgacctcgccaaggatctgctgcaggtgcaccccaactcttacgcgctggtgatcagcatggagaacatcacactgaattggtacttcgggaacaaccggtccatgctcgtgtcgaattgcctgttccggatgggtggtgcggccatcctgctctccaacaggcggtctgacaggcggaggtccaagtatgagctggtgcacacggtgcgcacgcacaagggcgccgacgacaagtgcttcggctgcgtgacccaggaggaagatgagattggcaagattggtgtgtcgctgtccaaggacctcatggcggtggccggagacgcgcttaagaccaacatcaccacgctggggccgttggtgctcccgttatcagagcagcttctcttcatgggcacactgattgccaagaaggtgctcaagatgaagatcaagccgtacatccctgacttcaaactggcattcgagcacttctgcatccatgctggtggccgtgctgtgctggatgagctggagaagaacctggagctaactgactggcacatggagccatcgaggatgaccctgtataggtttggcaacacatcaagcagctcactctggtacgagctggcatacactgaggccaagggcaggatcaggaagcgcgacaggatctggcagatcgcgttcggttctggattcaagtgcaacagcgccgtctggaaggcgctccggactgtgaacccggccaaggagaagagcccctggatggatgagattgacaacttcccggtggatgttccaaagatttcaaaggttggcggtgcttgaagaacttccctggttcttcttcttaggtggcaagtggagttggggtggttgtcaggggctgggcagaggtttattccattccattgtttccaccgtcagttcttgttttcagttgtagcatggcatctgtgaaggaacttgaagtagatgattcggttaggtagaaagggtgtgatttcttcggtagggtcgtctgaatgcctgatatgtcatattttttcagattggggaaagcaattgattttcggtgtcgaattcttcgctgcctgattgagacgtttcgattgtaggccaactgaaacttgaattcccctattcaattgattggttctgttctaacatctggagattaccagtgtcttggattgcaactatagtttgttatcgggaggtactgaatgtgatgtgccacttgtgtgctgctgtgacggcgtgattgcccggaatgactttcagcttgctggttctgatgtggatctgagcttgcttaaatgaatgatccagaaggaagagcctgtcaattaagcattcatacttgtaatcaatatccgacctgtaacttattgcgtgatagcagctgtagcctgtctggttgtctcagcattgtttcgaattaaaatagagttgaccacttgatcttggtatcactggattcattgaggaaaaacatccaacagggtgtacacatgtatgtttatggtttgtacaagaaatcttgttttgccagcaagaaaaggtgcg

SEQ ID NO: 2585 - DNA, 3135 bp, Panicum virgatum
cagaatggggacatcggcggcggagcccaatgccgcgcccgcgccgccggccgcggagccggcgcagccgcggcggcggatgccggacttccagcagtcggtgcggctcaagtacgtgaagctggggtaccactacctcatctcccacggcatgtacctgctgctgtcgccgctcatggcgctcgtcgccgtgcagctctccaccgtctccccgcgcgacctcgccgacctgtgggagcagctccgcttcaacctcctctccgtggtcgcctgctccacgctgctcgtcttcctctccacggtctacttcctcacccgcccgcgccccgtgtacctgctcgacttcgcctgctacaagccggagccggagcgcaagtgcacgcgcgagaccttcatgcactgctccaagctcaccggctccttcaccgacgacaacctcgagttccagcgcaagatcctcgagcgctccgggctcggcgaggacacctacctgcccgccgccgtgctccgggtgccccccaacccgtgcatggacgaggcgcgcaaggaggcgcgcgccgtcatgttcggcgccatcgaccagctgctcgagaagaccggggtcaggcccaaggacattggcgtcctcgtggtcaactgcagcttgttcaacccgacgccgtcgctgtcagccatggtggtgaaccattacaagctgagggggaacattgtcagctacaacctcggcgggatgggctgcagcgccgggctgctgtccatcgacctcgccaaggatctgctgcaggtgcatcccaactcgtacgccttggtgatcagcatggagaacatcacgctgaattggtactttgggaacaaccggtccatgctcgtgtcgaattgcctgttccggatgggtggtgccgccatcctgctctcgaacaagcggtccgacaggcggaggtccaagtatgagctggtgcacacggtgcgcacgcacaagggcgccgacgacaagtgcttcggctgcgtgacgcaggaggaggacgagattggcaagatcggcgtgtccctgtccaaggatctgatggcggtcgctggcgatgccctcaagaccaacatcaccacgctggggccactggtgctcccgctgtcggagcagctcctcttcatggccacactggttgccaagaagttgctcaagatgaagatcaagccgtacatccccgacttcaagctggccttcgagcacttctgcatccacgctggtggccgcgcggtgctggatgagctggagaagaacctggagctcactgattggcacatggagccatcgaggatgaccctgtacaggtttggcaacacgtcgagcagctcgctctggtatgagctggcgtactccgaggccaaggggaggatcaggaagcgcgacaggatctggcagatcgccttcgggtccgggttcaagtgcaacagcgccgtctggaaggctctccggaccgtgaacccggccaaggagaagaacccctggatggatgagatcgacaacttcccggtggatgttccaaggatctcaaaggttggcaacgcgtgaagaacactggctgttcccaggtggcaattggagttggtcatcgtccgctgccaaggcagaggtttaagcttatgatcccatcgttcgcgctgtcagttattggtttcagttgagtagcatggcatctgtgtggggcacttgaagtagacgatttgattaggtagagggtgtggtttcttcgctagggttgcctgaatgtctgatatgtccagtttattcagattggggaaagcaattgcttttcagtatcggtatcacattctttgctgcctgatcgagatgtctcagttgcaggcccagctgatacttgaattcccctgttcaattgattgatcggttctgtcctgatgaaaaccttctagactatcatcgtttggcattgccaaggtggttgtgggggaggtgctgagcgtgatgtgccagtcgtgcgtggaggatgcgatgattttccaagaagcgatcccccgtcagctgtttgtgatgtggatctgagctttgctcgggtggttttaggtggaagcgcctgtcaatcatgcactcatgcttgtaatcaattgtccaagctgtcgaactattgcgtgatggcctgtctctgcactattttgaagtaaaatgaaaccggagttgaccacgtgatcttggcatcactggatgctctttacgtttacacaggaaattcgtgctctgtcagagcccagtagcacctaagaacaatgcgtttcatcttcgtggcacaggaatttgggcatggaacacgcacatcaatccagcctgcagccaagcgtgcactgcacagggagtcagaacctcggtgaggtcctcggaccccgggctctcgtcgctctcgaggtcccccgtgcccggcatctgcatccggccgatttgttgctgcctggcgcgcgcgcctgcatctgtggctgcagaggcgtgagctcccagctccggccgccaaccccatcctgacatcctgaaacgccccctcctgctcctctcgtggaagcggtgctggccaggctgccgtccaggcgcgccgcaggcaacgggatcggtatccagcggcgcttcccgtctgctgtttggtgcagggggcgacgcagaagcctacaatgtcctgtgacactggcaccacgtgaggccagtacaagacgaggcaccgagacaacagacaaggtcatgactgcaaggttgtccattgcagtgcccatttttcttagaaacaatttgctgtgtgcgtttagtttagacactcagatctgaggttcttttctttcaggaaaggggggaaaaaactgaagctgtagaccattatggtccaatactagtaccagggtaccgcatacagcaggtggtctggcgccaatcatgagatggccatgaacagtgattccacgtgcacgccgcgcccggagaaaaggcccatcagatacacgcagccatgggccggttcacatggcggggcatgtgacgcgattcctttttgcgaacgccgtgacgaggacgggctgctacggagtaccattcttgcacaacatgcatgcgccaatgccatcttctagaagaccccg

SEQ ID NO: 2586 - DNA, 2375 bp, Panicum virgatum
gcgctcacggccgcattaccgcggagatcgagagacaagagagggaagggcggcgactctgccggctgaagccttctcctctcctctcctctccgtcgccgcctccctgctccacccccggaaactaatccctcacctgaatggggacatcggcggcggagcccaatgctgcccccgcgccgccggctgcggagccggcgcagccgcggcggcggatgccggacttccagcagtcggtgcggctcaagtatgtgaagctggggtaccactacctcatctcccacggcatgtacctgctcctgtcgccgctcatggcgctcgtcgccgtgcagctctccaccgtctccccgcgcgacctcgccgacctgtgggagcagctccgcttcaacctcctctccgtggtcgcctgctccacgctgctcgtcttcctctccacggtctacttcctcacccgcccgcgccccgtttacctgctcgacttcgcctgctacaagccggagccggagcgcaagtgcacgcgcgagaccttcatgcactgctccaagctcaccggctccttcaccgacgagaacctcgagttccagcgcaagatcctagagcgctccgggctcggcgaggacacctacctgccccccgccgtgctccgggtgccccccaacccgtgcatggacgaggcccgcaaggaggcgcgcgccgtcatgttcggcgccatcgatcagctgctcaagaagaccggggtcaggcccaaggacattggcgtcctcgtggtcaactgcagtttgttcaacccaacgccgtcgctgtcagccatggtggcgaaccattacaagctgagggggaacattgtcagctacaacctcggcgggatgggctgcagcgccgggctgctgtccatcgacctcgccaaggatctgctgcaggtgcatcccaattcgtacgccttggtgatcagcatggaaaacatcacgctgaattggtactttgggatcaaccgatccatgctcgtgtcgaattgcctgttccggatgggtggcgctgccatccttctctcgaacaagcggtctgacaggcggagatccaagtacgagctggtgcacacagtgcgcacgcacaagggtgccgacgacaagtgcttcggctgcgtgactcaggaggaggatgagattggcaagatcggcgtgtcgctgtccaaggacctgatggcggtcgccggtgatgccctcaagaccaacatcaccacgctggggccgctggtgctcccgttgtcggagcagctcctcttcatggccacattggttgccaagaaggtgctcaagatgaagatcaagccgtacatccccgacttcaagctggccttcgagcacttctgcatccacgccggcggccgcgcggtgctggatgagctggagaagaacctggagctcaccgactggcacatggagccatcgaggatgaccctgtacaggttcggcaacacgtcgagcagctcgctctggtacgagctggcgtactccgaggccaaggggaggatcaggaagcgcgacaggatctggcagatcgctttcgggtccgggttcaagtgcaacagcgccgtctggaaggcgctccggactgtgaacccggccaaggagaagaacccctggatggatgagattgacaacttcccggtggatgttccaaggatctcaaaggttggcaacgcatgaaggacgctttgctgttcccaggtggcaagtggagttggtcatcttcaggtgccagggcagaggtttacgcttatgatcatcccatcgttcgcgccgtcagttcttgttttcagttgtggcatggcatctgtgtgggggcacttgaagtaggcaatttgattaggtagtgggtgtgatttcttcgctagggttgcctgaatgtctgatatgtcatatgtccagtttattcagattggggaaagcaattgcttttcagtaacggtgtcacattctttgccgcctgattgagatgtctcaattgcaggcccagctgaaacttgaattcccctgtccaattgatcggttctgccctgaaaaccttccaagaccatcagcttttttgcattgccaaggtggttgtggggaggtgctgagcgtgatgtgccggtcgtgcgtgcaggatgccatgatttttccaagcgatctccgtcagctgtttctgatgtggatctgagctttgctcgggtggttttaggtggaagagcctgtcaatcatgcactcaacttgtaatcaatgtccaagctgtcaaactattgcgtggtagtctgtctccgcactattttgaactaaaccagagttgaccacttgatcctggcatcactggatgctctttatgtttgcacaggaaa

SEQ ID NO: 2587 - DNA, 2179 bp, Setaria italica
ggccccctattaaaccaccgcgctgggcgcctccccgtggcgctcgcggccgcattagcgcggagatcgagagacaagagagggaagggcggcggcttgccggttgaagccttctcctcttccccctccgtcgcctcctccctctgctcctcttcgggaaaccaatcctcctcctgtaaaagtatggggacatcggcggcggagcccaatgctgcccccgcgccgccggcgccggagccggctcggccgcggcagcggctgccggacttccagcagtcggtgcggctcaagtacgtgaagctgggataccactacctcatctcccacgggatgtacctgctgctgtcgccgctcatggcgcttgtcgccgtgcagctctccaccgtctccccgcgcgacctcgccgacctgtgggagcagctccgcttcaacctcctctccgtggtggcctgctccaccctgctcgtcttcctctccaccgtctacttcctcacccgcccgcgccccgtgtacctgctcgacttcgcctgctacaagccggagccggagcgcaagtgcacgcgcgagaccttcatgcactgctccaagctcaccggctccttcaccgacgagaacctcgagttccagcgcaagatcctcgagcgctccggcctcggcgaggacacctacctgccccccgccgtgctccgggtgccccccaacccgtgcatggacgaggcgcgcaatgaggcgcgcgccgtcatgttcggcgccatcgaccagctgctcgagaagactggggtcaggcccaaggacattggcgttctcgtggtcaactgcagcttgttcaacccgacgccgtcgctgtcagccatggtggtgaaccattacaagctgagggggaacattgttagctacaacctcggcgggatgggctgcagcgccgggctgctgtccattgacctcgccaaggatctgctgcaggtgcatcccaactcgtacgcgttggtgatcagcatggagaacatcaccctgaattggtattttgggaacaaccggtccatgctcgtgtccaattgcctgttccggatgggtggtgctgccatcttgctctcgaacaagaggtccgacaggcggaggtccaagtacgagctggtgcacacagtgcgcacgcacaagggcgccgatgacaagtgctttggctgtgtgacgcaggaggaggatgagattggcaagatcggtgtgtcactgtccaaggacctcatggcggtcgccggtgatgctctcaagaccaacatcaccactttggggccgctggtgctcccgttgtcagagcagcttctcttcatggccacattggttgccaagaaggtgctcaagatgaagatcaagccgtacatccccgacttcaagctggccttcgagcacttctgcatccacgccggcggccgtgccgtgcttgatgagctggagaagaacctggaacttactgactggcacatggagccatcgaggatgaccctgtacaggtttggcaatacgtcgagcagctcgctctggtatgagctggcgtacagtgaggccaaggggaggatcaggaaacgcgacaggatctggcagatcgcgttcgggtccgggttcaagtgcaacagtgccgtctggaaggcactccggaccgtgaacccgaccaaggagaagagcccctggatggatgagatcgacaacttcccggtggatgtcccaaagatctcaaaggttggcaacgcatgaagatactagttgttcccaggtggcaagtggagttgggtcattgtcaagggctgggcagaggtttacgcttctgatcccatcgtacgcaccgtcagttcttgttttcagttgtagcatggcatccgtgagggaacttggagtagatgatgatttgattaggtagaaagggtgtgatttcttcactagggctgcctgaatggcttaatgtctgatatgtccaatttattcagattggcggaatcaattggttttgtcgcattctttgctgcctgacgtctcaattgcagcccaactgaaacttcaattcccctattcaattaatctgttctgtcctagtatcatctagattgtcgtgttttggattggtataggttgttatggggaggtactgatgtgtctcaattgcagcccaactgaaacttgaattccc

SEQ ID NO: 2588 - DNA, 2161 bp, Setaria italica
tggccccctattaaaccaccgcgctgggcgcctccccgtggcgctcgcggccgcattagcgcggagatcgagagacaagagagggaagggcggcggcttgccggttgaagccttctcctcttccccctccgtcgcctcctccctctgctcctcttcgggaaaccaatcctcctcctgtaaaagtatggggacatcggcggcggagcccaatgctgcccccgcgccgccggcgccggagccggctcggccgcggcagcggctgccggacttccagcagtcggtgcggctcaagtacgtgaagctgggataccactacctcatctcccacgggatgtacctgctgctgtcgccgctcatggcgcttgtcgccgtgcagctctccaccgtctccccgcgcgacctcgccgacctgtgggagcagctccgcttcaacctcctctccgtggtggcctgctccaccctgctcgtcttcctctccaccgtctacttcctcacccgcccgcgccccgtgtacctgctcgacttcgcctgctacaagccggagccggagcgcaagtgcacgcgcgagaccttcatgcactgctccaagctcaccggctccttcaccgacgagaacctcgagttccagcgcaagatcctcgagcgctccggcctcggcgaggacacctacctgccccccgccgtgctccgggtgccccccaacccgtgcatggacgaggcgcgcaatgaggcgcgcgccgtcatgttcggcgccatcgaccagctgctcgagaagactggggtcaggcccaaggacattggcgttctcgtggtcaactgcagcttgttcaacccgacgccgtcgctgtcagccatggtggtgaaccattacaagctgagggggaacattgttagctacaacctcggcgggatgggctgcagcgccgggctgctgtccattgacctcgccaaggatctgctgcaggtgcatcccaactcgtacgcgttggtgatcagcatggagaacatcaccctgaattggtattttgggaacaaccggtccatgctcgtgtccaattgcctgttccggatgggtggtgctgccatcttgctctcgaacaagaggtccgacaggcggaggtccaagtacgagctggtgcacacagtgcgcacgcacaagggcgccgatgacaagtgctttggctgtgtgacgcaggaggaggatgagattggcaagatcggtgtgtcactgtccaaggacctcatggcggtcgccggtgatgctctcaagaccaacatcaccactttggggccgctggtgctcccgttgtcagagcagcttctcttcatggccacattggttgccaagaaggtgctcaagatgaagatcaagccgtacatccccgacttcaagctggccttcgagcacttctgcatccacgccggcggccgtgccgtgcttgatgagctggagaagaacctggaacttactgactggcacatggagccatcgaggatgaccctgtacaggtttggcaatacgtcgagcagctcgctctggtatgagctggcgtacagtgaggccaaggggaggatcaggaaacgcgacaggatctggcagatcgcgttcgggtccgggttcaagtgcaacagtgccgtctggaaggcactccggaccgtgaacccgaccaaggagaagagcccctggatggatgagatcgacaacttcccggtggatgtcccaaagatctcaaaggttggcaacgcatgaagatactagttgttcccaggtggcaagtggagttgggtcattgtcaagggctgggcagaggtttacgcttctgatcccatcgtacgcaccgtcagttcttgttttcagttgtagcatggcatccgtgagggaacttggagtagatgatgatttgattaggtagaaagggtgtgatttcttcactagggctgcctgaatggcttaatgtctgatatgtccaatttattcagattggcggaatcaattggttttgtcgcattctttgctgcctgacgtctcaattgcagcccaactgaaacttcaattcccctattcaattaatctgttctgtcctagtatcatctagattgtcgtgttttggattggtataggttgttatggggaggtactgatgtgtctcaattgcagccc

SEQ ID NO: 2589 - DNA, 2133 bp, Oryza sativa
agtttccaccttttccctctcttcctccgcttattaaaaggcggcgtccctccccgtggtgctcgccgccgtattcaagcggaggaagagagagagagagagagaatcaaggcagtagtcgtcttcctctcctctcgccgccgcatccgaccggagaaagatcccttctttccctcctccaagcccgcctcggtatccagagatggagacctcggcggcggcggcgcccaatggcggcgcggcggcggcggagcagcagcagcggcgtcggctgccggacttccagcagtcggtgaggctcaagtacgtgaagctggggtaccactacctcatctcccacggcatgtacctgctgctgtcgccgctgatggcgctggtggccgtgcagctctccaccgtgtccccgggcgacatcgccgacctgtgggagcagctccgcttcaacctcctctccgtcgtcgcctgctccaccctcctcgtcttcctctccaccctctacttcctcacccgcccccgccccgtctacctcctcgacttcgcctgctacaagcccgacccccagcgcaagtgcacccgcgagacattcatgcgctgctccagcctcaccggctccttcaccgacgccaacctcgacttccagcgcaagatcctcgagcgctccggcctcggcgaggacacctacctccctcccgccgtgctgcgcgtcccgcccaacccgtgcatggacgaggcccgcaaggaggcccgcaccgtcatgttcggcgccattgaccagcttcttgagaagacgggtgtgaagcccaaggacattggtgtggttgtcgtcaattgcagcttgttcaacccgacgccgtcgctgtccgccatggttgtgaaccactacaagctgagggggaatgtcatcagctacaacctcggcgggatggggtgcagtgccggcttgctgtccgtcgatctcgccaaggacttgctgcaggtgcacccaaactcgtacgcgctggtggtcagcatggagaacatcacgctcaattggtactttggcaacaaccggtcgatgctcgtgtcgaattgcctgttccggatgggcggcgccgccatcctgctgtcgaacaggcggtctgaccgccggaggtccaagtatgagcttgtgcacaccgtgcgcacgcacaagggcgccaacgacaagtgctttggctgtgtcacccaggaggaagacgagatcggcaagatcggcgtgtcgctctccaaggacctgatggcggtggccggagacgcgctgaagacgaacatcaccacccttgggccgctcgtgctcccgttgtcggagcagctgctcttcatggccacattggttgccaagaaggtcctcaagatgaagatcaagccatacattcccgatttcaagctggcatttgagcatttctgcatccatgccggtggccgtgccgtgctggatgagctggagaagaacttggagttgactgactggcacatggagccatctaggatgacactgtaccggtttggcaacacatcgagcagctcactctggtatgagctggcgtacaccgaggcgaaggggaggatcaggaagcgggacaggatctggcagattgcatttggatctggtttcaagtgcaacagcgcagtctggaaggcgctgcgaacagtgaacccggcgaaggagaagaacccctggatggatgagattgacaacttcccggttgaagttccaaagatatcaaaggttggaaatgcatgacatgaaatgccttgtttgtctcaagagtagtaaaaagtatggtgggttgagtggcattgtgcattggcattggtagggcaggaagttcatcttcagggttctaaatccatttgcaattgttcaagagttctttggttttcagttgtagcatctgtgaggggaactttaaaaagaaaactgtagctgattcaattaggtagaaaaagggtgtgttttcttcacttagggctgtctgataatgctgtatttattcagattggagaaaacaattggagtcttcatgtgacgtttattcatcgttgcctgattgtgattgcccttgtagcactgtcacattctcattaaatttatctcattaaattgattggttt

SEQ ID NO: 2590 - DNA, 2301 bp, Hordeum vulgare
tcaaagtccaacactgaaagccgagaggagggaaggctgtcgccatgggtgatacttcgaggaaagccggcccaagtcacgcagagccgccgcgcgcgggctcggagcggaggttggaagttggagctggaaccaaactgatgagaagaagaaaaggcaacgtgacgtgactttctcctcctccagctgccttggctttgtttcccgtgccgtttttctcctctgcctccctccccccctattaaagacgcgcgaggccgagccgcctgccggatcggtgccacgcacagggagagcgagagagagagggaaggggggcggcggagcggctcgagtcttcttccgctcctcctcgtcctcccacgcggcgcgcagcagatcgggtgtctccgtccgtcgccgagtccgccgcttctcccgtctgccctgcctggaataatggatactccggcgcccaatgccgccaacacgccggcgcaggcggcggcggagccagcagcgcagccgcggctgctgccggatttcctccagtcggtgcggctcaagtacgtgaagctggggtaccaccacctgatctcccacggcatgtacctgctgctgtcgccgctcatggcgctggtggccgttcagctgtccaccgtgtccccgagcgacctggccgacctgtgggagcagctccggttcaacctcgtctccgtggtcgtctgctccaccctcctcgtcttcctctccaccgtctacttcctcacccgcccccgccccgtctacctcgtcgacttcgcctgctacaagccggggccggagcgccggtgcacgcgccagaccttcatgcgctgctccgaggccaccggctccttcaccgacgccaacctcgacttccagcgcaagatcctcgagcgttcggggctcggcgaggacacctacctgccccccgccgtgctgcgggtgccccccaacccgtgcatggacgaggcgcgcaaggaggcgagcaccgtcatgttcggcgccatcgaccagctgctggagaagacgggggtcaggcccaaggacatcggcatcctggtggtcaactgcagcctgttcaacccgacgccgtcgctgtcggccatggtggtgaaccattacaggctgagaggcaacgtggtgagctacaacctcggcgggatgggctgcagcgcggggctgctgtccatcgacctcgccaaggacctgctgcaggtgcacccaaactcgtacgcgctggtgatcagcatggagaacatcaccctcaactggtacttcgggaacgaccggtcgatgctggtgtccaactgcctgttccggatgggcggcgcggcgatcctgctctccaacaaacgctcggaccggcggcgctccaagtacgagctcgtccacacggtgcgcacccacaagggcgccgacgacaagtgcttcggctgcgtgacgcagcaggaggacgatgccggcaaggtgggcgtgtcgctgtccaaggacctgatggcggtggccggcgacgcgctcaagaccaacatcaccacgctcggcccgctggtgctgccgctgtcggagcagctgctgttcatggcgacgctggtggcgaagaaggccttcaaggtgaagatcaagccctacatcccggacttcaagctggcgttcgagcacttctgcatccacgcgggcgggcgcgccgtgctggacgagctggagaagaacctggggctcacggagtggcacatggagccgtcgcggatgacgctgtaccggttcggcaacacgtccagcagctcgctgtggtatgagctcgcctacagcgaggccaagggccgcatcggacggcgcgacagggtctggcagatcgccttcggctccggcttcaagtgcaacagcgccgtctggagggcgctgcgcgcggtggcgccggaggcggaggggacgaacccatggatggacgagatcgaccgcttccccgtcgaggttcccagggtctccagggttgggaccgcatgatccactgctgcttgtccgagctggcaactttgattgattgggtgatcaccattgacatctcctgggtcctcgtacaatatcctttggcaacgtgcatgattgggctgttgttttcagctgtacgtagcaagcatctgggtagggtgggcaagctaaacaaactttaggttaagattccctttgttttaacatgattatgatccatcagttgtgggtcagtggaagcgttcttcttacttgcgttgtccggaacggattgattgattgatttacctcccttcgcgattacttgtc

SEQ ID NO: 2591 - DNA, 1916 bp, Brachypodium distachyon
gacggagcggggcggctctagtcttcttcctcttcgtcctgcctccatccggccggaaaatcccgtccctctccagtctgggactctggttatacatctcgaattctccatacctcccgtatcggcaacgagagatttttatttgactacgtacgtgcctgttttcgccagcagtatggagacctcgccctcggctccgcccaatgccgccaccccgccgtcgccggcgccggagccgcggcggctgccggacttcctgcagtcggtgcggctcaagtacgtgaagctggggtaccaccaccacctgatctcccacggcaagtacctgctgctctcccctctcatggcgctggcagccgtgcagctctccaccgtgtcccccggcgccctgtggctgcagctccgcttcatcaacctcctctccttgctcgcctgctccacgctcctcttctccctctccaccgcctacttcctcacccggccgcgccccgtctacctcctcgacttcgcctgctacaagccggaacccgagcgccggtgcacccgccgcaccttcatgcgctgctccgaggccacgggcgtcttcaacgccgccaacctcgacttccagcgcaagatcctcgagcgctccgggctcggcgagcacacgtacctgccccccgccgtgctccgtgtcccccccaacccgtccatggccgaggcccggaaggaggcgcgcgccgtcatgctcggcgccatcgaccagctgctggagaagaccggcgtccggcccaaggacatcggcatcctcgtcgtcaactgcagcctgttcaacccgaccccgtcgctctccgccatggtggtgaaccattacaagctcaggagcaacgtcgcgagctacaacctcggcgggatggggtgcggcgccgggctgctgtcggtggatctcgccaaggatctgctccaggtgcgcccggactcgtacgcgctggtggtcagcatggagaacatcaccctgaattggtacttcgggaacgaccgctcgatgctggtctccaactgcctgttccggatgggcggcgcggccatcctgctgtcgaaccggcaggccgaccggcggcggctggcgaaatacgagctcgtgcacaccgtgcgcacgcacaagggcgccgatgacaggtgcttcggctgcgtgacgcaggaggaagacgaggccggcaaggtcggcgtgtcgctctccaaggacctcatggcggtggccggggacgcgctcaagacgaacatcacgacgctggggccgctcgtgctcccgttctcggagcagctgctcttcatggccacgctggcggccaagaagctgctcaaggtgaagaggatgaagccgtacatcccggacttcaagctggccttcgagcacctgtgcatccacgccggcggccgcgccgtgctggacgagctggagaagaacctggagctcacggagtggcacatggagccgtccaggatgacgctctaccgattcggcaatacgtcgagcagctcgctgtggtacgagctggcctacagcgaggccaagggcaggatcagcaggggggacagggtctggcagatcgccttcgggtccgggttcaagtgcaacagcgccgtctggaaggcgctgcgcacggtgaacccggccgaggagaagaacccctggatggacgagatcgacgacttccccgtggaagtccccaagatttcaaaggttgggaacgcatgaagtttgtctctggtgactgatcactgatcagcactgccagatcagcaggaagtttcttcatcttatttgagttcttgttttcagttgtagcatctggggttgggttggccggttggggacctagacgttagtagttgatctatctgatctattattatatattaaaagtacatggcgg

SEQ ID NO: 2592 - DNA, 2159 bp, Brachypodium distachyon
ctcgcccctcctcccgtgttgctcgcgacggcaaaggcagggagagagaaggcggcggcggcggcagcggcagcagcggatccggcggtggatcccttcttcttagagtcggaatctgctctcgctccggccattttgtttcagcgcccgcaggttgaccatggacaacgacgcagcgccgccggccgatgccgccgcgggggagcgcgcggcgtcgccgtcgcggcggctgccggacttcctgcagtcggtgcggctcaagtacgtgaagctggggtaccactacctcatcacccacggcatgtacctgctgctcaccccgctcatcgtgctcgtcgccgtccacctctccacgctctccccgggcgaggtcgccgacctgtgggcgcacctccgcttcaacctcgtctccgtcgtcgcctgctccacgctgctcgtcttcctctccaccgtctacttcctcacccgcccgcgccccgtctacctcgtcgacttcgcctgctacaagccggagccggagcgccggtgcacgcgtgacaccttcatgcgctgctccaagctcaccggcaacttcaccgacgccaacctcgagttccagcgcaagatcctcgagcgctccgggctcggcgaggacacctacctgccgccctccttggtcagcgtgccgcccaacccctccatggacgaggcgcgcaaggaggcgcagctctgcatgttcggcgccatcgacgacatgctcgccaagaccggggtgaagcccaaggacattgggattcttgtggtgaattgcagcctgttcaacccgacgccttcgctgtcggccatggtggtgaaccattacaagctgagggggaacataatcagctacaatctgggaggaatgggctgcagtgctggcctcctgtccatagatctggccaaagatttgctgcaggtgcatcccaactcgtatgcgctggtggtcagcacagagaacatgactctgaattggtattttgggaacaaccgttcgatgcttgtgtcgaattgcctgttccggatgggggccgcagcgatcctgctgtcgaacaagagatcagacagatggaggtccaagtacgagctggtgcacactgtgagaactcacaagggtgcagatgacaaatgcttcagctgcgtcacccaggaggaggacgatgatggcaaggttggtgtggcactgtcaaaggacctcatggcggtggctggtgatgcgctcaagacaaacatcacgacacttggcccgcttgtgctaccattctcagagcagctgttattcatgctcacgttggttggtaagaagttgctcaagatgaagatcaagccatacattcctgacttcaagctcgcatttgagcacttctgcatccatgccggtgggcgcgctgtgctggatgagatagagaagaacatggacctcaccgattggcacatggagccgtcacggatgacattattccgcttcggtaacacgtccagcagctcgctctggtacgagctggcctacagcgaggcgaaggggaggatcaggagacgcgacaggatctggcagatagcgttcggttcagggttcaagtgcaacagcgcagtctggaaggcgctacgatcagtgaacccggcgaaggagaagaacccctggatggacgagatcgacacgttcccggtggatgttccgaaggtttcaaaggtctcgagcgtctgaaatactttgcctgttgagcactgtcactcacagtgcgtctgatgaatcttagtattggatttctgtttttcattgttagggtgatatgttgggggattaattttagatgattccattaggtggcacagaggaggtcccagcagggcggtggtgttttgttcagtttatggcatcgatcggtttctgcaaattctgattgaatatgtttttaatatctggtgtttcatgtggatcaagaatcctggccccagaggagggtaccgcattagtttttcatatgcactacaatcatcattgctgtgaaccgccggtccgcctgagatttcatctcatatggctgatgtacatggagttttgactcttgaggctatgtgaataatctcctatcttgactggaccaagaatggtcgatgagagaacatcagaccaggcaacgagg

SEQ ID NO: 2593 - DNA, 2421 bp, Brachypodium distachyon
ctcctcccgtgttgctcgcgacggcaaaggcagggagagagaaggcggcggcggcggcagcggcagcagcggatccggcggtggatcccttcttcttagagtcggaatctgctctcgctccggccattttgtttcagcggtatgcttccgaatcttttgggttttcgtttctgttctggatcggtatttacgcgttactccgtctttgggggccgaaaggccgccaggaactcaaaacgcatcccgattcgcagccttttttttgccaggacaagaaaacaatattcgttttgccttgtagatgtaaccgagggtggaaatttcggctcccagatctcgcattttgaattctcttgcgcagatttttttctgaccccaacccaaccaaatctgccatccttcagcccgcaggttgaccatggacaacgacgcagcgccgccggccgatgccgccgcgggggagcgcgcggcgtcgccgtcgcggcggctgccggacttcctgcagtcggtgcggctcaagtacgtgaagctggggtaccactacctcatcacccacggcatgtacctgctgctcaccccgctcatcgtgctcgtcgccgtccacctctccacgctctccccgggcgaggtcgccgacctgtgggcgcacctccgcttcaacctcgtctccgtcgtcgcctgctccacgctgctcgtcttcctctccaccgtctacttcctcacccgcccgcgccccgtctacctcgtcgacttcgcctgctacaagccggagccggagcgccggtgcacgcgtgacaccttcatgcgctgctccaagctcaccggcaacttcaccgacgccaacctcgagttccagcgcaagatcctcgagcgctccgggctcggcgaggacacctacctgccgccctccttggtcagcgtgccgcccaacccctccatggacgaggcgcgcaaggaggcgcagctctgcatgttcggcgccatcgacgacatgctcgccaagaccggggtgaagcccaaggacattgggattcttgtggtgaattgcagcctgttcaacccgacgccttcgctgtcggccatggtggtgaaccattacaagctgagggggaacataatcagctacaatctgggaggaatgggctgcagtgctggcctcctgtccatagatctggccaaagatttgctgcaggtgcatcccaactcgtatgcgctggtggtcagcacagagaacatgactctgaattggtattttgggaacaaccgttcgatgcttgtgtcgaattgcctgttccggatgggggccgcagcgatcctgctgtcgaacaagagatcagacagatggaggtccaagtacgagctggtgcacactgtgagaactcacaagggtgcagatgacaaatgcttcagctgcgtcacccaggaggaggacgatgatggcaaggttggtgtggcactgtcaaaggacctcatggcggtggctggtgatgcgctcaagacaaacatcacgacacttggcccgcttgtgctaccattctcagagcagctgttattcatgctcacgttggttggtaagaagttgctcaagatgaagatcaagccatacattcctgacttcaagctcgcatttgagcacttctgcatccatgccggtgggcgcgctgtgctggatgagatagagaagaacatggacctcaccgattggcacatggagccgtcacggatgacattattccgcttcggtaacacgtccagcagctcgctctggtacgagctggcctacagcgaggcgaaggggaggatcaggagacgcgacaggatctggcagatagcgttcggttcagggttcaagtgcaacagcgcagtctggaaggcgctacgatcagtgaacccggcgaaggagaagaacccctggatggacgagatcgacacgttcccggtggatgttccgaaggtttcaaaggtctcgagcgtctgaaatactttgcctgttgagcactgtcactcacagtgcgtctgatgaatcttagtattggatttctgtttttcattgttagggtgatatgttgggggattaattttagatgattccattaggtggcacagaggaggtcccagcagggcggtggtgttttgttcagtttatggcatcgatcggtttctgcaaattctgattgaatatgtttttaatatctggtgtttcatgtggatcaagaatcctggccccagaggagggtaccgcattagtttttcatatgcactacaatcatcattgctgtgaaccgccggtccgcctgagatttcatctcatatggctgatgtacatggagttttgactcttgaggctatgtgaataatctcctatcttgactggaccaagaatggtcgatgagagaacatcagaccaggcaacgaggtgcc

SEQ ID NO: 2594 - DNA, 2814 bp, Zea mays
cggcggggcggggcggggcgaatccctgactttcttctccacgccgtgctctgcttcgagtgaggcctggttcagattttacaggggttcggttcgatctggtgtccgacggaggcggcggcggcggctcctctgctgttcgattgagggagaggggccatggaaaacccggcgccgccgaccaacccggcctccgccacgccgtcgccgtcgcggcagctgccggacttccagcagtcggttcgtctcaagtacgtgaagctggggtaccattacctcatcacccacggcatgtacctgctgctcaccccgctgatggtgctcgtggccgtgtacctctccacgctctccccgcgcgacgtcgccgacctgtgggcgcacctccgcctcaacctcatctccgtgctcgcctgctccacgctcctcgtcttcctcggcacggcctacttcctcacccgcccgcggcccgtgtacctggtcgacttcgcctgctacaagcccgggccggagcgccggtgcacgcgcgacaccttcatgcgctgctccaggctcaccggctgcttcaccgacgccagcctcgagttccagcgcaagatcctggagcgctcggggctgggcgaggacacgtaccttccccccgccgtcacgcgggtgccgcccaacccgtccatggacgaggcgcgcgcggaggcgcgggaggtcatgttcggcgccgttgacgagctgctcgccaagacgggggtcaagcccaaagacatcgggatcctcgtggtgaactgcagcctgttcaacccgacgccgtcgctgtcggccatggtggtcaaccactacaagctgcgcgggaacgtggtgagctacaacctcggcgggatggggtgcagcgccgggctgctgtccgtggacctcgccaaggacctgctgcagacgcacccggggtcgtacgcgctggtcatcagcacggagaacatcacgctcaactggtactcggggaacgaccgctccaagctggtgtccaactgcctgttccggatgggcggcgccgcggtgctgctctcgaatcggcggtccgaccggcggcgggccaagtacgagctggtgcacacggtgcgcacgcacaagggcgcggacgaccggtgcttcggctgcgtgacgcaggaggaggacggcgagggcgtcgtgggcgtgtcgctgtcgagggacctgatggcggtggcgggcgacgcgctcaagacgaacataacaacgctgggcccgctggtgctgccgctgtcggagcagctgctgttcatggcgacgctggtcgccaagaagctgctcaagatgaagaaggtgaagccgtacatcccggatttcaaactggcgttcgagcacttctgcatccacgccggcggccgtgccgtgctggacgagctggagagcaacctggcgctcacggattggcacatggagccgtcgcggatgacgctgcaccggttcgggaacacgtccagcagctcgctctggtacgagctggcctacagcgaggccaaggggaggatccggcgccgccaccgggtgtggcagatcgcgttcgggtcagggttcaagtgcaacagcgccgtgtggagggcgctccggtcggtgaacccggcggaggagacgaacccgtggatggacgagatcgacaggtttcccgtggatgttcccaaggtctctaaggtttcaagcgactgaaatgcattgctagttgcgtgaatgatggagcttgcaattgtttggatagaagatctggttggaatttttcatagttcattactatatagttgtaggagataggaaaggcgatcgacttctctaatcttgaattatacatctgttaatgttgtttctgtatggcactcggtccctggcctatctatatagttgactgctcggtgttctgacagttctactatatctgttcattctccaactgttgatcactgttcttccacaaatgaaccatctgaacgatttgttggcccttcggcaattagggaatatatgtgattaaatctcggagtggattcttgccttttctttttcatagcagtacctgttcttttttcccccttttggtctgctggtgttctctaatgctcagcagctcatcgtgttcgtctctgaatatcctaaaactgcatgattaggcaaggtgttagccggattcaaggtgttaacctgaaactgaactagaaattaatgttgtgacagcattttggaaacttcactaaatagtttatatcttttttttccacttcggatccgtgttgtcccactaatctgatgaagcttacaatgttgctacactaagttcactgaatctgatagattcatgattctgtatgtgcctgctgaattaagttcatgctatatagtaggtcatcctgttgctacactaagttaactgaatctgatatattcatgattctgtttgtgtcttgaatgtcttgcaaacgggtgtcagtcatactggaactacaactgaaactatagctgaaggcatctgcaactgcaagacacaagccgtcgtcttcttcttcttcatgaaagcctttcaaatcctgacctgaagcattgctcaatcatactggataaagctcacgaacgcagtttaaacatatatggtgatttgtatctgaattacgtctacatacatgctcagcttgactcatgtggctttgtttgggaattatgtctgtaacaatatggttcctgtgttcatcaatagtggcttcattcatgtgcctttgtttgggaatttgtaaggtccatacaggaacaaatagttgggcg

SEQ ID NO: 2595 - DNA, 2101 bp, Ananas comosus
gttcatccattctccagggaaaaagaaaatatctgtctttgattcgtcgggttcgctccttttagctccaaagtcccgaacgatggcggaaccaaacccacccagcaccaccgccggcggtaacggcgccaacgccaatgcgtcgtcgtcgcggcggctgccggatttccaacaatcggtgcggctgaaatacgtgaagctggggtaccactacctgatctcgcacggcatgtacctgctgctgtcccctctgatcgggctggtggccgtgcagctgtcgaccttctccgtggaggacctccaggagctgtaccggcacctccggttcaacctgatctccgtggtgctctgctccgccgcgctggtgttcctgtcgaccctctacttcctcacccggccccgccccgtctacctcgtcgacttctcctgctacaagcccgaccccgcccgcaagtgcacccgcgccatcttcatggagcgctcggccctcaccggctccttcacccccgacaacctcgacttccagcgcaagatcctcgagaggtccggcctcggcgagagcacctacctccccgacgccgtcctcaacgtgccccccaacccttccatggccgaggcccgcaaggaggccggcgccgtcatgttcggcgccgtcgacgagctcctcgccaagaccaacgtcaggcccaaggacatcggcgtcttggtcgtcaactgcagcctcttcaacccgaccccctcgctctccgccatggtcatcaaccactacaagctcaggggcaacgtcgtcagctacaacctcggcgggatgggctgcagcgccggcttgatctccgtcgacctcgccaaggatctcctccgagtgcaccccaattcctacgctctcgtcatcagcatggagaacatcactctcaattggtacttcggcaacagccgctccatgctcgtctccaattgcctcttccggatgggcggggccgccatcctcctctccaacaggcggtccgaccgccgccgctccaagtacgagctggtccacaccgtccgaacccacaagggcgccgacgataagtgcttcagctgcgtgacccaggaggaggactccgttgggaagatcggcgtctctctctccaaagatctcatggtggtcgccgccgacgccttgaagaccaacatcaccacgctgggcccgctcgtgctgcccgtctccgagcagctgatcttcttggccacgttgatcgccaagaaggtgtttaagatgaagatcaagccctacattcccgatttcaagctggccttcgagcacttctgcattcacgccggcgggagggccgtgctcgatgaattggagaagaacctgcagctctcggactggcatatggagccgtccaggatgacgctctaccgattcgggaacacctccagtagctctctgtggtacgagctggcgtacaccgaagccaaagggaggatcaggaagcgggacaggatctggcagatcgcattcgggtcgggtttcaagtgtaacagcgcggtgtggaaggcgctgaggacggtgaatcccgccaaggagaagaacccgtggatggacgagattgaaaacttcccggttccggtcccaaaattctcggcgatttgaagacccctggatggggtttgagaatggctgtttaacaattgcttgcaatttgtcttttgatcttgtttgcatgaattgctgttgtttattcttggatgatgatgatcatcctttgtggttttcgcttccattttagtagttattcactaggcgattcaggggctcggcttagtagaggggtaatttggtaggggatgcagctttgagccttatcttttgtttaggatatgatcatggattaattgagagagattattattggagggtggatgagtgacatgcgatgctatctatgtaataccaaaccctgtagcgttggattctccaatccctattaattttgttgccatatgtgaatccaatttctcttcatagagttctcgtgccctggttgttctccatgttgcgtctattcttgagcagcaatatagtactgggtttggctctatcgaatacagggtc

SEQ ID NO: 2596 - DNA, 2362 bp, Setaria italica
gcctaattagtcaatatttggacaataattcacaaatacaaacgaaacgctacagtgtgctacagtgctgtaacagtaatttgacacctcccaaattccccaactaaacaaggccctagtcgcacgactactactgtctctgttaccagagtttgatttcacatcggctactgttgccttattcccagattgaactcctgctaatcccctccctaaactcctgctaatcccctcccagaagatgcaaatttcaaatcagcgcacaaatactcaactggcagatgatacacctcgagacggccgggccgtccatcggtcaacgcccagcgtacggctggcgtgccgccgctcgcggggccggggcggacggctcttccttatcgctcctcttccttctcgcgaggagacctggttggttggctggttccgatcggggggatttggtaccgtccgtcgctcgcgcccttcgattggggccatcgccatggacaacccggcgccggcaacaaatgccgccaccgcggccgcctcgccgtcgcggcggcttccggacttccagcagtcggtgcggctcaagtacgtgaagctggggtaccactacctcatctcccacggcatgtacctgctgctgatgcccctcatgtcgctcgtggccgtgcacctctccacgctctccccgcgcgacgtcgccgacctgtgggcgcacctccgcctcaacctcatctccgtgctcgcctgctctacgctcctcgtcttcctcgccaccgcctacttcctcacccgcccccgccccgtctacctcgtcgacttcgcctgctacaagccggggcccgagctccggtgctcgcgcgacaccttcatgcgctgctcccgcctcacgggctccttcaccgacgccagcctcgagttccagcgcaagatcctcgagctctcggggctcggcgaggacacgtacctcccgcccgccgtgacgcgggtgccccccaacccgtccatggacgcggcgcgcgccgaggcacgggaggtcatgttcggcgccgtcgacgagctcctcgccaagacgggggtgcggcccaaggacatcggggtactcatcgtcaactgcagcctcttcaacccgacgccgtcgctgtcggccatggtggtgaaccactacaagctccgcgggaacgtggtcagctacaacctcggcggcatggggtgcagcgccgggctgctgtcggtggacctcgccaaggacctgctccagacgcacccggggtcgtacgcgctggtgatcagcacggagaacatcacgctcaactggtactcgggcaacgaccgctccaagctcgtgtccaactgcctgttccggatgggcggcgccgccgtgctgctctccaaccggcgttccgaccggcggcgggccaagtacgagctggtgcacaccgtgcgcacgcacaagggcgccgacgaccggtgcttcggctgcgtgacgcaggaggaggacggcgaggggaacctcggcgtgtcgctgtcgagggacctgatggcggtggcgggcgacgcgctcaagaccaacatcaccacgctgggcccgctggtgctgccggtgtcggagcagctcctcttcatggcgacgctggccgcgaggaagctgctcaagatgaagaaggtgaagccgtacatcccggacttcaagctggcgttcgagcacttctgcatccacgccggcggccgcgcggtgctggacgagctggagagcaacctggcgctcacggactggcacatggagccgtcgaggatgacgctgcaccggttcgggaacacgtccagcagctcgctctggtacgagctcgcctacagcgaggccaagggcaggatccggcggcgagaccgcgtgtggcagatcgccttcgggtccgggttcaagtgcaacagcgccgtgtggagggcgctccggtcggtgaacccggccgaggagaccaacccgtggatggacgagatcgacaggttcccggttgatgttccgaaggtctccaaggtttccagcggctgaaatgcgatgatcttttgccctgttcgtcgttctggtgattggtgctatcacctggcatttgcgcaaacgagatagagcttaccattggatttcgttcggggagtttgtgattgtttggagtcaggaattggtggggatttgtcatagatcatcacattaggcggtagtaagggcgatcgacttctctgactcttgagctcggatttatatgtaaattttgttgttctgtatggcactcgtttatacagttgattgttcttagttctgacacaactctaccatctctcgatttataatacaatggaagaaacttttgatggaacc

SEQ ID NO: 2597 - DNA, 9835 bp, Setaria italica
acacgcacactaacactaacactgacagaaatggttcactcctatctcctcctcctagtgttcctctctttcatctccagctcgccatccatgtcgcagaccaactccagcgactatgagacactcctaactgtcaagaaagcctggggcagcccttctgctctcagctcatggatttcccagaactcttcctactgcagctgggcaggggtaagctgcaacaatggccgagtgaccaagctctcctttcaaaatttcaacataatcaatccgatcccagcttccatttgtagcctcaagaacctgtcctacctagacctttcctacaacaacctcaccgaccagttcccgacggtgctctatggctgctcggctctgagctacctcgacctgtccaacaatctcttctccggtgccctcccggccgacatcgataaattgtcgtcggagatggagcacctcaacttgtcgttcaatggcttcacaggaagcgtgccatcagcaattgctgtcttccccaagctcaagtcccttgttcttgacactaatagcttcaacgggacatacccggcctcggccattgcagagctcaacgagctcgagacgctaactctagcagataatcatttcgcgccaggcctgatccctgatgagttcagcaagcttaccaatctgaagacgctgtggctgtcagggatgagccttactggtggcatccccgacaaactctcgtcgctcactgagctgaccatgttggctctgtacagcaacaagcttcacggtgaaatcccggcatgggtttggaagcttccgaagcttgagttcctgtacctttacgcgaacagcttcaccggtgggattgagcccgaggtcacgtgcttcaaattgcagcagctcgacctgtcttcgaacttgctcaccggaacgataccggaggcgatcggcaagatgaagaacttgacaatgctctatttatactacaacaacctcaccgggtcgattcctccgagcatcgggctgctccccaacctcgctgagatctggctattcaataacatgctctccggacccctcccgccggagctcgggaagcactcgccactcggcagcctggaagtgggcaacaacttgctctccggcaagcttccagacaccctctgctacaacaagaagctgtacgacctcgtggtgtccaacaacagcttctccggcgtgttgccggcgaacattggggattgccacacactggacaacatcatggcgtacaacaacaacttcaccggggagttcccagagaaggtatgggcgttacctatgctgaccattgtcatgatacagaacaacggcttcaccggcactctgccctgtgtgatatcccccaacatgatacggattcagatggggaacaatctgttctccggtgccgtgtgttagagatataatgttttgtaatcttgtataccacgagataagctttggccggtgttgtagtctatctaggagatagagtttgttgtaatcagaattgaagagattttgtatagtttgcttagagatcaaggcatatctctaggtgtctatatattgtaaagctccctatgcaattacacatcttcaatcaacacgcaaccgtcgcacccaaggatcagggttgatattctcccacgctttaacgcctctgaaactttacatggtaatcagagcttaagattgattccatggcatccagttcaagcacctccaacccactgcttggcgttcagatcaccgagaagcttgccaagaccaaccacgtgctttggaaggtggaggtgctcaccgctatacgtggtgcgcgtatggagggtcatgtcaccagcaaggccgtcgctccagttgctgtgatcaacaagaagaaggccgacaacactatcgttgctacgccaaatccgacgtacgaggagtggtatgcctgggaccaataggtcctagggctgatcttctcatcggtggggaaggacatcctcgcctagattgccgctgcaaagacagcggtgcaggcatgggatgaggtggagcgcatgttttctgcccagactcgtgccaggacaatgaatgtgcgatttgcacttacaactaccaagaaaggtaacttgtccattgttgattattttgccaagatgaaaggatacgcagatgagatgcttactgctgggaagcctatggatgatgaagaatttgcctcccacatctgcaacggccttgacttggagtacaacccgatggtgacagcagttgccgcaagagttgagccgatctcgacccctgagctctactctcaactgctcagtttcgagactcgtcttgatcttcaagatcctctgctcatgtcgccaacagagggggtcggggcacacccatccgatcagatttcataaccaacttccataaaccatacacatacatgcagcaacgaatggcaaaagccagtcattttaggttctctgcacaaatcagacgttcaccgaccaaacaagcaggggagacgtaacctggactgttccgacccaggtcgccgcgatgccgcctttgaaccccgcatgccgcgtctactgcatcggttaagccatcgagaagtaagagcagcaagaaattccagcctccacctccatcatccattggtgtactgaatactgaacctcactagtatcagccaggtacaagaagggatgaacgagacaaataggggcgacgtgctgacgccgtcgacctgttcgaagaaatgggtgaaggagtggcagtcggacttgtccacgccttcctgcgttcggcggccggaacatccccggcagccgcgagaccggctgctttggcaccgcttccctccccctccatccccggcctcccccctcagcatattcgccgcccaaggctccaggcgacgccgcactgatcccctccgccggaccccggacgctatgcgcgccgcgtgcctccatctctgtgtctcgcttggccaacgcgatgcccccacccacccacccactcatgtccggccgcaagcgagggtcctgtctcgctggtgtccggaggaggaggatagtgtccatgacaagtggaccccgccaggttcccaggctccaggtgcagagaagcacccacttgtgaatcgtgtgattgtcatgcgaatcagcttttgattgttatgcatcccacgccgaaaagcgacgcgtggcgtgcaggcacggctccggctattttgcaaaaacgccctccggttttgtaggaatcgcaactcagtccagcacatccaaccctgagcgtctggcactagacaatgcccaatggggtgaattcatgaattcatcctcatttctgtaaactgtttatgatttgcaatatatctttgaagtataaaaagaaaaagtccgaacgggcccagcccaagcgttgctgtgcggcttttcctccccctctggcggcggctcgtcgcaagttggctccgaatcgaagccctgacctgccccgtcagaggaaggactgatcgggcggagcaaagcagaggattcctcgactcgatctggagcgacaacgaaggtgccgtggtggtaatggtacggcgccatgggggtgccgctgtcgttgaagctactgattacgccgcaggagcggcggcgccggcggcgtcacaaacgcatactccaagctcgcagtaaaccgcctcctcctgttacctccgttcactcgtcggcgtggtttgctcctgtttgctcgatcgtgggctactgtgcttatcctagtatacaagtacaatctgtattgctcatggtgtattgcaaacttgcagatggatcgatcacttccaggtctaaagcaaagaagggtaactctcatcgtggtaacagattgagaagtttagggccggacctgcctgaggtacggggtgaaacttttaacagatgaaaagaataaaacactagagctatgctagctagtagataaaattcacaaacggacctcatacagtacttcactactttgctactgtggtttgtaacgaggtgagtttcgttgcatggcagaattgacatttggcaaccaatatatgattggagaagatgtgattgtagaaaggttttgttgctcccctccagtgtgtttataggagaaagatgcacttctatagttgaatgatatcgtcagagtcgctaatctaggcaatatttcccaatgcactaccaacctctttctttgatgctgaacactttatgcaaacaatgcacaaagcaccgaatggtcctatatggttgaagtaacaatttgccttaatagccccaatgctgctcaactatctttccattcttgtgcaggacttctggtgccatatgcactccctattgccgatctaagattctgcacgtgctgcttctgtatctcgcacattcttacgctcatggagatgccgtcccaaccttatactcactaaggaaacactgtgcttgaaagagtacgtgagcggagagggtgatatagcaagggctttgacgcacaaaattgaccagattctgaaaaaccactcaggcactggcgtcaagacacttgagcttgatctatctgaatgttgtgatctcgacgcttgttatctcaacaattggcttcaggttgctattactccagtgattgaaaacttcaccttttcgccgtcttcaaaatgccaggaagaatacagcttgccccgctcacttttatttggacagaatggagggtcaattcagtatcttcacctcacttgttgtgacttccatccacggctgacattggttgcttgagaaacctaacaaagctttatctgagctacgtgcgtattacaggggaagagttaggctgccttctttcaaattctcttgctttgatgcagttggaactcgaggattgtagtgaaataatctgcctaaagatacatgcatgctggagcagctcagctgtctgactgtttctgattgcagtatgctgcaaatgatagaaagccaagctccgaacctcaccaccttcgactttgaaggtgacaatctggtacaactctcactccaacaatcattgcaggtgaagaacctactcatggaatgccatttagaggagaactttctctgttaccctgttaccaagcttccatatatggtgccaaatcttgaatctcttaccttatcttcaaatggtgagaggctaaacgtgtcaatggtgcctgtcaaattcctatacctcgagttcttggaaatttgtttggatggagatctttccccaggatatgattatctttctttgctttcttttctcgatacttctcctgttttggagactgcgtaagtcattgttcttcaagcaaagatatctattatctgtcatgaactgattgttctagtgaccttagtttgtatcctttgcagcccatctagggctcaaggccatcgaaagatacattgtggggaaagttccctctgccgttaagctagatgttcgggagccttgcagccggtgccatacttcaagttggttgagtaactcttactcctaaatcctaatgttgaaggaaccgacagtttagctacgtaaaacgcttgtttattgaagttaccgtgacttttacatgtaacatgttctttctccaaacacacggctttattcgatgaacattgtaggcgtgccatacctgaaacgcacctgcttgctcgcttatcccatctacactgaatgtcaattgctaaagattcaagataatataaaaatgatataatgtcaattgctaaagattcaatataatataatgtcaattgctaaagattcaatataatataaaaatgactttgagtaaaatatattgttgcaaattttatactacaccgaatgtgtatataatttaaataattagttatcaaaatttgtaaagtttgacttcttcctaatcaaaatacgcctataatttgtgaatgtagggaatatctaatggttatcttcactcggcactacttttcatacaacaggattaatgttttgggtaataggtgattagatcaacttaatcaaatctccacggctacataccatatcacagaaccatctctttttgcaaaaacttgtcttgaattgttagtcacaacttgtgcaattttctagcaagaaaacgtgatgaccatattcttaatttcaaaaaagaaaagggtgatcatatatattcatgccacagcgcgatcggacaagcaggcgacgtagcgcgatcggacggctagtattcctgaagaagcttcttgtccgacgttggaatcgtccgtcctgcaccgcacgtccttctcccctctcctcgcgacgtgtcgtcggacgatacccttcctcctagtagcaagttgaagtggtggtccccacctgactacgctgctggcttgcgccgggccggtgctaggtagccggccggtcaaaggttcccagtacctgcttctagaacggcggcgacgcggctccacgcgcgccgaggacgtgtggaagcttccgtcctgttccagcgttctcgaaggcctgcgctgtgctgggcctagtcatagcgttctccttccttccttccttccttcctaggagcatacttgtcagagggaccggggacatactaggccatgtttagttactcccaactcccaactttgacactatgcaaaaagaagattccccatcacatcaaacttgcggtacatgcatggagtactaaatgtagatgaaattaaaaactaattgcacagttttgttgtactttgcgagacgaatcttttgagcctaattagtcaatatttggacaataattcacaaatacaaacgaaacgctacagtgtgctacagtgctgtaacagtaatttgacacctcccaaattccccaactaaacaaggccctagtcgcacgactactactgtctctgttaccagagtttgatttcacatcggctactgttgccttattcccagattgaactcctgctaatcccctccctaaactcctgctaatcccctcccagaagatgcaaatttcaaatcagcgcacaaatactcaactggcagatgatacacctcgagacggccgggccgtccatcggtcaacgcccagcgtacggctggcgtgccgccgctcgcggggccggggcggacggctcttccttatcgctcctcttccttctcgcgaggagacctggttggttggctggttccgatcggggggatttggtaccgtccgtcgctcgcgcccttcgattggtacgtatcgagatgcctttcctctagttccgtgatcgcgcggcgcgttgatccgttctgttcctgttgttttctttttctgtacttcccttgagatgcccgtgttcgtgatttggtctgagctcacaagagagattcgacgtcttgattagttccatccacccagttagtttgcagtgatctctagaaccagactgtcgtatgccgtgcaatttcttgggaattactctgttcttcctccatttcttctctgaattgctgccgttttgcacggaaaggcagaaattaccgcaaatttagtccagacctatgatgttttttttccttttttggttgaatcttttggtcatttgttgactcgattttggtaaaaatttcaagagaatccattgcgtttctgtcatccagatttctgcgttgcaaaatttccgcgtttttctgacccaactctgcgtcacaggggccatcgccatggacaacccggcgccggcaacaaatgccgccaccgcggccgcctcgccgtcgcggcggcttccggacttccagcagtcggtgcggctcaagtacgtgaagctggggtaccactacctcatctcccacggcatgtacctgctgctgatgcccctcatgtcgctcgtggccgtgcacctctccacgctctccccgcgcgacgtcgccgacctgtgggcgcacctccgcctcaacctcatctccgtgctcgcctgctctacgctcctcgtcttcctcgccaccgcctacttcctcacccgcccccgccccgtctacctcgtcgacttcgcctgctacaagccggggcccgagctccggtgctcgcgcgacaccttcatgcgctgctcccgcctcacgggctccttcaccgacgccagcctcgagttccagcgcaagatcctcgagctctcggggctcggcgaggacacgtacctcccgcccgccgtgacgcgggtgccccccaacccgtccatggacgcggcgcgcgccgaggcacgggaggtcatgttcggcgccgtcgacgagctcctcgccaagacgggggtgcggcccaaggacatcggggtactcatcgtcaactgcagcctcttcaacccgacgccgtcgctgtcggccatggtggtgaaccactacaagctccgcgggaacgtggtcagctacaacctcggcggcatggggtgcagcgccgggctgctgtcggtggacctcgccaaggacctgctccagacgcacccggggtcgtacgcgctggtgatcagcacggagaacatcacgctcaactggtactcgggcaacgaccgctccaagctcgtgtccaactgcctgttccggatgggcggcgccgccgtgctgctctccaaccggcgttccgaccggcggcgggccaagtacgagctggtgcacaccgtgcgcacgcacaagggcgccgacgaccggtgcttcggctgcgtgacgcaggaggaggacggcgaggggaacctcggcgtgtcgctgtcgagggacctgatggcggtggcgggcgacgcgctcaagaccaacatcaccacgctgggcccgctggtgctgccggtgtcggagcagctcctcttcatggcgacgctggccgcgaggaagctgctcaagatgaagaaggtgaagccgtacatcccggacttcaagctggcgttcgagcacttctgcatccacgccggcggccgcgcggtgctggacgagctggagagcaacctggcgctcacggactggcacatggagccgtcgaggatgacgctgcaccggttcgggaacacgtccagcagctcgctctggtacgagctcgcctacagcgaggccaagggcaggatccggcggcgagaccgcgtgtggcagatcgccttcgggtccgggttcaagtgcaacagcgccgtgtggagggcgctccggtcggtgaacccggccgaggagaccaacccgtggatggacgagatcgacaggttcccggttgatgttccgaaggtctccaaggtttccagcggctgaaatgcgatgatcttttgccctgttcgtcgttctggtgattggtgctatcacctggcatttgcgcaaacgagatagagcttaccattggatttcgttcggggagtttgtgattgtttggagtcaggaattggtggggatttgtcatagatcatcacattaggcggtagtaagggcgatcgacttctctgactcttgagctcggatttatatgtaaattttgttgttctgtatggcactcgtttatacagttgattgttcttagttctgacacaactctaccatctctcgatttataatacaatggaagaaacttttgatggaaccagcttcatctcatcctgaaccaaacattgtaaaggacatgtgtcatgtggccgagcgtctgaaacaagtggagcgtctgaaaacgatcaagagggttcgcaccctgcgttaacgagactctgctgcaactggagtaaggaggctccctacaaaattccaccatttcgtccgggtgctgttacatgaaacccaacccctattacaacacaacagacca

SEQ ID NO: 2598 - DNA, 2476 bp, Sorghum bicolor
gtccatcggtcaacgccagcgtacggctgccgtgccaccgctcgtgcgcctggggggccgaagctgctgtcaggtgggccctcgcaccgttccgccttcggttcgcctccctcctcgtcctcccctattaaaaccccccgactccggcgagcggggcagcgaacggtggcggccgcttctctaatccctcacttccttccccgtcgtggttgaagcctggttccggtcacaaaggacttgatctggtgtccgacggaggcggcggcggcggctcctctgcagtttgattgaggggccatggaaaacccggcgccgccgaccgatcctgccgccgccacgggcgccacgccaacgccgtcgtcgtcgccgtcgcggcagctgccggacttccagcagtcggtgcggctcaagtacgtgaagctggggtaccactacctcatcagccacggcatgtacctgctgctgaccccgctgatggtgctcgtcgccgtgcacctctccacgctgtccccgcgcgacgtggccgacctgtgggcacacctccgcctcaacctcatctctgtggtggcctgctccacgctgctcgtcttcctcggcacggtctacttcctgacgcggccgcggcccgtgtacctggtggacttcgcctgctacaagccgggtcccgagcggcggtgcacgcgcgacaccttcatgcgctgctccaggctcaccggctgcttcacggacggcagcctcgagttccagcgcaagatcctggagcggtcggggctcggcgaggagacgtaccttccccccgccgtcacgcgggtgccgcccaacccgtccatggacgaggcgcgcgcggaggcgcgggaggtgatgttcggcgccgtggacgagctgctggccaagacgggcgtgaagcccaaggacatcgggatcctggtggtgaactgcagcctgttcaacccgacgccgtcgctgtcggccatggtggtgaaccactacaagctgcgcgggaacgtggtgagctacaacctcggcgggatggggtgcagcgccgggctgctgtcggtggacctcgccagggacctgctgcagacgcacccggggtcgtacgcgctggtgatcagcacggagaacatcacgctcaactggtactcgggcaacgaccgctccaagctggtgtccaactgcctgttccggatgggcggcgcggcggtgctgctctcgaaccggcggtccgaccggcggcgggccaagtacgagctggtgcacacggtgcgcacgcacaagggcgccgacgaccggtgcttcggctgcgtgacgcaggaggaggacggcgagggcgtcctgggcgtgtcgctgtcgagggacctgatggcggtggccggggacgcgctcaagaccaacatcacgacgctgggaccgctggtgctgccgctctcggagcagctgctgttcatggcgacgctggtcgccaagaaggtgctcaagatgaagaaggtgaagccgtacatcccggacttcaagctggcgttcgagcacttctgcatccacgccggcgggcgcgccgtgctggacgagctggagagcaacctgtcgctcacggactggcacatggagccgtcgcggatgacgctgcaccggttcgggaacacctccagcagctcgctctggtacgagctggcctacagcgaggccaaggggaggatccggcggcgccaccgggtgtggcagatcgcgttcgggtcagggttcaagtgcaacagcgccgtgtggagggcgctccggtcggtgaacccggcggaggagaccaacccgtggatggacgagatcgacaggttccccgtggatgtccccaaggtctccaaggttaccagcgactgaaatgtgcacccctgatcgtggttagcgatagtgattattattattccttgggagtttgcaattgtttgggtaaggccttgttcgtttgacagggtttgagggtgggaattgttccagctaatctatattagtagaaataaacctatcaatccacctggaataattccagggcatccaatccggatgaaacgaacgggccctaaaggatctggtgggaattttcttgagtttatatcactacgaaaagcgatgattgacttgtctgagttctggttattataccgtgttgtttctgtatggccctcggcccctggcctatccagcagttgacagttctgtgttctgacaattctactctctctcgatggcttggctcatgtttgatctgagccaacctgctcttcggtactggaaccatctcagctcactgactgaaatttggcttatgctgttgtttaagctgattttgttgtaaaagaaaaagcattgtttcttcactaaaaagtactattgaagtagtgctgagaaacactattttttcaccgaaaaatacttgaaccaaccaaaggacatgacgctgagctatggatgaaaacggattgga

SEQ ID NO: 2599 - DNA, 2013 bp, Saccharum officinarum
gatgtaccttgcaggtacggtccggaatcccgggtcgcaccacgcgtccgccctgacctcgttcttcgtcgtgcggcgagcgaagcctggttccgatcagaggggacttgatctggtgtcagacggaggcggcggctcctctgcagtttgattgaggggccatggaaaacccaacgccgccgaccaatccggcctccgccacgggcgccacgccaacgccgtcgccgtcgctgtcgcggcagctgccggacttccagcagtcggtgcggctcaagtacgtgaagctggggtaccattacctcatcacccacggcatgtacctgctgctgaccccgctgatggtgctggtcgccgtgcacctctccacgctgtccccgcgcgacgtggccgacctgtgggcgcacctccgcctcaacctcatctccgtggtggcctgctccacgctgctcgtcttcctcggcacggcctacttcctgacccgcccgcggcccgtgtacctgtgggacttcgcctgctacaagccggggcccgagcggcggtgcacgcgcgagaccttcatgcgctgctccaggctcacgggctgcttcacggacgccagcctcgagttccagcgcaagatcctggagcgctcggggctcggcgaggacacgtacctgccccccgccgtcacgcgggtgccgcccaacccgtccatggacgaggcgcgcgcggaggcgcgggaggtgatgttcggcgccgtggacgagctgctggccaagacgggcgtcaagcccaaggacatcgggatcctggtggtgaactgcagcctgttcaacccgacgccgtcgctgtcggccatggtggtgaaccactacaagctgcgcgggaacgtggtgagctacaacctgggcgggatggggtgcagcgccgggctgctgtccgtggacctcgccaaggacctgctgcagacgcacccggggtcgtacgcgctggtgatcagcacggagaacatcacgctcaactggtactcgggcaacgaccgctccaagctggtgtccaactgcctgttccggatgggcggcgcggcggtgctgctctcgaaccggcggtccgaccggcggcgggccaagtacgagctggtgcacacggtgcgcacgcacaagggcgccgacgaccggtgcttcggctgcgtgacgcaggaggaggacggcgagggcgtcctgggcgtgtcgctgtcgagggacctgatggccgtggcgggcgacgcgctcaagaccaacatcacgacgctgggcccgctggtgctgccgctgtcggagcagctgctgttcatggccacgctggtcgccaagaaggtgctcaagatgaagaaggtgaagccgtacatcccggacttcaagctggcgttcgagcacttctgcatccacgcgggcgggcgcgccgtgctggacgagctggagagcaacctgtcgctcacggactggcacatggagccgtcgcggatgacgctgcaccggttcgggaacacgtccagcagctcgctctggtacgagctggcctacagcgaggccaagggcaggatccgccggcgccaccgggtgtggcagatcgcgttcgggtcggggttcaagtgcaacagcgccgtgtggagggcgctccggtcggtgaacccggcggaggagaccaacccgtggatggacgagatcgacaggttccccgtggatgttcccaaggtctccaaggtttccagcgagtgaaatgcaccaccgatcgtggttaacgatagtgcttactattccttcggagtttgcaattgtttgggtaaaggatctggtgggaattttctttagtttatatcactataggtaaggcgatgattgacttctctgagttcggattatacatagcaatagcattcgtgttgtttctgtatggccctcggccctggcctatctagcagttgacagttcttttttttttttcgagaacgtgcaaggcacgtatttcattaagcagaggaaaaagagttgtgtt

SEQ ID NO: 2600 - DNA, 2042 bp, Hordeum vulgare
tctccctccccctcccgtgttgttcgcgacggcaaggtcaggagagagacgagtgcggcgccagaaggcggcaaccgcggcggcggcggaggaggaggacccggcgccgtctccgaggcggagtccggtggcactgatcgtcgctccggccatttgagcggggcaccatgtccatggaggacagcacgccgccggccggtgccaacgccggcgaacgcgcgagctcgccgtcgccgtcgcgtcgcctgccggacttcctgcagtcggtgcggctcaagtacgttaagctggggtaccactacctcatcacccacggcatgtacctcctgctgaccccactcatcgtgctcatcgccgtccacctctccacgctctctccgggcgacgtcgcagacctgtggacgcacctccgcttcaacctcctctccgtcatcgcctgctccacgctcctcgttttcctctccaccgtctacttcctcacccgcccgcgctccgtctacctcgtcgacttcggttgctacaagcccggcccggagcgccggtgctcgcgtgacaccttcatgcgctgctccaagctcacaggcaacttcaccgaagctaacctcgatttccagcgcaagatccttgagcgctccggtctcggcgaggacacttacatccctcctgccttggtcaccgtgccgcccaacccctccatggacctggcgcgccaggaggcgcaggtctgcatgttcggtgccatcgacaacatgcttgccaagaccggggtgaagcccaaggacattgggattcttgttgtgaattgcagcctgttcaacccgacgccgtcactgtccgccatggtggtgaaccattacaagctgagagggaacataatcagctacaatctgggaggaatggggtgcagtgccgggctcttgtccatagatctggccaaggatttgcttcaggtgcatcccaactcgtacgccatggtggtcagcaccgagaacattaccctgaattggtattttgggaacaaccggtcgatgctcgtgtcgaattgcctgttccggatgggttgcgctgcgatcctgctgtcgaacaagcggtcagacaggaggaggtccaagtacgagctggtacacaccgtgagaactcacaagggtgcagatgacaagtgcttcagctgtgtcacccaggaggaggatgacagtggcaaggttggcgtcgcactgtccaaggacctcatggcggtggctggggatgcgctcaagacgaacatcacaacgcttgggccgcttgtgttgccattctcggagcagctgctgttcatggtcacattggttggcaagaagctgttcaagatgaagatcaagccatacattcctgacttcaagctggcattcgagcacttctgcatccacgctggtgggcgcgctgtgcttgatgagatagagaagaacatggacctcaccgattggcacatggagccgtctcggatgactctcttccgtttcggcaacacgtccagcagctcgctgtggtacgagctggcctacagcgaggcaaaggggaggatcaggaggcgtgacaggatatggcagatagcgttcggctcggggttcaagtgtaacagcgccgtctggaaggcactgaggtcagtgaacccagcgaaggagcagaacaacccctggatggacgagatcgacacattcccggtggaggttcccaaggtgtccaaggttgctgaataattttgccttttcagcattgtcacccgaaacaggaagcgcgcaaatcttgccattgaattcgactgtattcaatatgtttgggtgatctgtcgggtattaattttagatgattccatttaggtggtacagaggggtgtgatgtcgtgctgttcactatttatgccattgatcagttctaaacatcttgtgttccatgtgcatcgactgccttgcattaattttccatgtgcgctacgcatttgatttgttccgagtgttggccatcatatcgtgctaacctgtcgtctatgataaattccgtcttcg

SEQ ID NO: 2601 - DNA, 1902 bp, Hordeum vulgare
tccgtttcctggatccacaggggcaccatgtccatggaggacagcacgccgccggccggtgccaacgccggcgaacgcgcgagctcgccgtcgccgtcgcgtcgcctgccggacttcctgcagtcggtgcggctcaagtacgttaagctggggtaccactacctcatcacccacggcatgtacctcctgctgaccccactcatcgtgctcatcgccgtccacctctccacgctctctccgggcgacgtcgcagacctgtggacgcacctccgcttcaacctcctctccgtcatcgcctgctccacgctcctcgttttcctctccaccgtctacttcctcacccgcccgcgctccgtctacctcgtcgacttcggttgctacaagcccggcccggagcgccggtgctcgcgtgacaccttcatgcgctgctccaagctcacaggcaacttcaccgaagctaacctcgatttccagcgcaagatccttgagcgctccggtctcggcgaggacacttacatccctcctgccttggtcaccgtgccgcccaacccctccatggacctggcgcgccaggaggcgcaggtctgcatgttcggtgccatcgacaacatgcttgccaagaccggggtgaagcccaaggacattgggattcttgttgtgaattgcagcctgttcaacccgacgccgtcactgtccgccatggtggtgaaccattacaagctgagagggaacataatcagctacaatctgggaggaatggggtgcagtgccgggctcttgtccatagatctggccaaggatttgcttcaggtgcatcccaactcgtacgccatggtggtcagcaccgagaacattaccctgaattggtattttgggaacaaccggtcgatgctcgtgtcgaattgcctgttccggatgggttgcgctgcgatcctgctgtcgaacaagcggtcagacaggaggaggtccaagtacgagctggtacacaccgtgagaactcacaagggtgcagatgacaagtgcttcagctgtgtcacccaggaggaggatgacagtggcaaggttggcgtcgcactgtccaaggacctcatggcggtggctggggatgcgctcaagacgaacatcacaacgcttgggccgcttgtgttgccattctcggagcagctgctgttcatggtcacattggttggcaagaagctgttcaagatgaagatcaagccatacattcctgacttcaagctggcattcgagcacttctgcatccacgctggtgggcgcgctgtgcttgatgagatagagaagaacatggacctcaccgattggcacatggagccgtctcggatgactctcttccgtttcggcaacacgtccagcagctcgctgtggtacgagctggcctacagcgaggcaaaggggaggatcaggaggcgtgacaggatatggcagatagcgttcggctcggggttcaagtgtaacagcgccgtctggaaggcactgaggtcagtgaacccagcgaaggagcagaacaacccctggatggacgagatcgacacattcccggtggaggttcccaaggtgtccaaggttgctgaataattttgccttttcagcattgtcacccgaaacaggaagcgcgcaaatcttgccattgaattcgactgtattcaatatgtttgggtgatctgtcgggtattaattttagatgattccatttaggtggtacagaggggtgtgatgtcgtgctgttcactatttatgccattgatcagttctaaacatcttgtgttccatgtgcatcgactgccttgcattaattttccatgtgcgctacgcatttgatttgttccgagtgttggccatcatatcgtgctaacctgtcgtctatgataaattccgtcttcg

SEQ ID NO: 2602 - DNA, 1894 bp, Triticum aestivum
ggggcaccatgtcgatggaggacagcacgccgccggccggtgccggtgccagcgccggcgaaggcgcgagctcgccgtcgccgtcgcgtcggctgccggacttcctgcagtcggtgcggctcaagtacgtcaagctggggtaccactacctcatcacccacggcatgtacctcctgctcaccccgctcatcgtgctcatcgccgtccacctctccacgctctctccgggcgacgtcgccgacctgtggacgcacctccgcttcaacctcctctccgtcatcgcctgctccacgctcctcgtcttcctctccaccgtctacttcctcacccgcccgcgctccgtctacctcgtcgacttcggctgctacaagcccggcccggagcgccggtgctcgcgtgaaaccttcatgcgctgctccaagctcaccggcaacttcaccgaagccaacctcgatttccagcgcaagatcctcgagcgctcgggtctgggggaggacacttacatccctcccgccttggtcaccgtgccgcccaacccctccatggaattggcgcgccaggaggcgcaggtctgcatgttcggtgccatcgacaacatgctcgccaagaccggggtgaagcccaaggacattgggattcttgttgtgaattgcagcctgttcaacccaacaccgtcactgtccgccatggtggtgaaccattacaagctgagagggaacatagtcagctacaatctgggaggaatggggtgcagtgccgggctcctgtcaatagatctggccaaggatttgctccaggtgcaccccaactcgtatgcaatggtggtcagcacggagaacattaccctgaattggtattttgggaacaaccggtcgatgcttgtgtcaaattgcctgttccggatgggctgcgctgcgatccttctgtcgaacaagcggtcagacaggaggaggtccaagtacgagctggtacacactgtgaggactcacaagggtgcagatgacaagtgcttcagctgtgtcacccaggaggaggatgatagcggcaaggttggcgtggcactgtccaaggacctcatggcggtggctggggatgcgctcaagacgaacatcacaacgcttggcccgcttgtgttgccattctcggagcagctgctgttcatggtcacattggttggcaagaagctgttcaagatgaagatcaagccatacattcctgacttcaagctggcattcgagcacttctgcatccacgctggtgggcgcgctgtgcttgatgagatagagaagaacatggacctcaccgactggcacatggagccgtcccggatgactctcttccggttcggcaacacgtccagcagctcgctctggtacgagctggcctacagcgaggccaaggggaggatcaggaggcgcgacaggatctggcagatagcgttcggttcggggttcaagtgcaacagcgctgtctggaaggcgctgaggtcagtgaacccagcgaaggagcagaacaacccctggatggacgagatcgacacattcccggtggatgttcccaaggtttccaaggttgctgaatagctttgcctgttcagcaataccacccggaacagcaagtgagcaaatcttgccattgaattcgactgtatgcaatttgtttgggtgatctgtcggggtattaattttagatgattccatttaggtggtacagaggggtgtggtgtcgtgctgttcactttttatgtcattgatcagttcttaacatctttgtgttccatgtggatcgagaatcttggccccgaaaggagcaactgcgttgcattaatttttccatgtgcactgcgcatttgatttgttccgaatgttggccatcatatcgtgctaacctgtcg

SEQ ID NO: 2603 - DNA, 3565 bp, Chelidonium majus
agtttatccggcgagattggctcgctccctgtgaatctgtggccgaatttctggtttgagggattttggctatttatgaagctgcatctctgaaacctacttaaagggtcttaatctttcctctcaatttgattcttcaggatcttctgaaacctcctactcttttcctgttctagagtttcaataatgaccctctgttgttgttgttgttgttgatggttcatcaccttaaatcccaacaacaacaaatccttgccactttaagttctttattgtttatttttagcatcctctgttatctgatttgaactcatataccttaaattcctgcaaaatggcagacccaaaaccagatacacccttgattcgtccacaaacttctagaaagcttccagatttcaaacaatctgttaaactgaaatatgtaaaacttggataccattacctaatcacccatggaatgtatttgtgtctctctcctcttgtagttctcattgcagcccaaatctccacattctccattaaagatcttcatgacctctgggatcacctccgtttcaatctgatatcagtgatcgtctgttcaacactgcttgttttcctatccaccctttattttcttaccagacctcgtccggtttaccttgttgacttcgcttgttacaagccagaggatgctagaaaatgcaccagacagatctttatggagagatcagaattaacgggttccttcaccaaagagaatcttgaattccaacgtaaaattctcgaaagatcaggccttggtgaatcaacttacctgccacctgctgttcttcgagttcctccgaacccatcaatggcagaagctagaaaagaagctgaaatagtgatgtttggggcacttgatcagctgttcgcaaaaacatctattaaaccgaaagatattgggattcttattgtgaactgtagtttgttcaatccaaccccatctctatctgccatggttattaaccattacaagcttagggggaatattgttagttacaatttaggcgggatgggttgcagtgcaggtttgatctccatagatcttgccaaagaccttctccaagttcatccaaactcttatgctttggttatcagcatggaaaacataactttgaattggtattttgggaatgaaaggtccatgcttgtatcgaattgtttgttcagaatgggaggtgctgccattctgttatcgaacaaaaattccgagaggagacgatccaagtaccgtttggtccatactgttcgaacccacaaaggagctgatgacaaatgcttttcttgtgttacacaagaagaggatccaaatggaaagatcggtgttgctttgtcaaaagatttgatggccgttgcaggagatgctctaaaaaccaacattacaacattgggacctcttgttcttccaatgtctgagcagttactgtttttcgcgacattggttggaaagaaacttttcaagatgaagatcaagccttacatcccagatttcaaattggcgttcgagcatttctgcattcatgccggaggaagagctgtattggatgaattggagaagaatttgcagttaactgagtggcatatggaaccatcaagaatgacactttaccgatttggtaacacttcaagcagttctctttggtatgaattggcttacacggaagctaagggaaggatcaagaagggagatagaacttggcagatagcttttgggtctggtttcaagtgtaacagcgctgtttggaaggctctaaggactgtaaatccggcaaaggagaagaacccatggatggatgagatccagcagttcccagttgacgttccaaggatagcatctatctaatctgtaccgcagttcttcaaccgttattggggtatctcattattccctggatggttatttgaatggtgaaacattctgtctcttcatttgaaatttcatactgcatgagctacagtagtcattgggttgggtgagatgggccgtgttagttttagagggtggtaatgtgtgtgattttagcgtagaaattgtggggttcattgggtactgatttcgtttgcaaattgctttgagtgttgtctgggagaatttctgtattagggatttgagttagacgcagtttaagaaccaaattgggtgattcatgcttactattcttcatgactcgagtaaaggagggaggggggagccaccatctaccaccaccagaaccgataatcgcacccgtcgccgtcctgatctaactcttcctctccctaaacgtgaaccttctctagccgtccctcttcctctccctccacctattaacaacaacccatcttcctcctcctcatccggttcacaaccaccaccaactcagcatactcaactcagcttctcggaactcgataaagaacgtcgaatcggtagtggaagcggtggtacagtttacaaagtgcgtcatcgacccaccgggaaaatatttgctctcaaagtcatctatggtacccatgaagattccgtccgccgacagatctgccgagagatcgaaatcctccggcaagttaataaccccaacgttgttaaatgtcacggaatgttcgacaacgccggagaaatccaagttgttcttgaatacatggatggtggatctttagaaggaacccatataccaaatgaaagctctctttcagatctttctcgacagatcctttgtgggttatgttatcttcaccggagaaagatagtacatcgagatatcaaaccatcaaatctattgatcaatgcgaaaagagaagtgaaaattgctgattttggggttggaaggattcttgcacaaacaatggatccatgtaattctgcagttggtacaattgcttatatgagccctgagaggatcaatacagatctgaatcaaggtgtttatgatgggtatgctggtgatatatggagttttggggtgagcatattggaattttatatgggtaggtttccatttaatgttagtagacaaggagattgggcaagtttgatgtgtgcaatttgtatttcaccaccacctgaagctcctcatactgcatcaagagatcttagaagttttttagcttgttgtttacagagagagccttcaaagagatggactgctgagaaattattacttcatccatttattgctatcaatcagaatcaggttcagaatcagaatcagacccagacccagagtcaagttcttcatcatcaacatcatcaccagcatcttctaccacctcaacaacatttttcatcctcacaaggatgatttttttgagtttaatttgaagatttgggttgaggtgattgatcaattgaaggattgggaagatgggtttttttaaatttcctctgatgattctgcatctggtggaggattttaagaaatgggtatgtatcaaatcaatctcttaccctctctcttatctctgattattactgtccaagttgggttatgggtgttcttcttctttttatcagagattagatgggttgttgttttattacttttctactgtttttttt

SEQ ID NO: 2604 - DNA, 2020 bp, Avena sativa
gtgttgctcgcgacggcaaggtcaggggagagaggactcggtgtgtgcgcgagaaggcggcggcggcggggtaggatccggcgccgtctccgtgggggatttcactctccggcgtggagctcgtaggctgtgattgtctctccggccatttgactgcgacaaccatgtcgacggaaaacgtcgcgccgccgccggccggtggcaacgccggaggacgcgccgagtcgccgtcgccgccgcgtcggctgccggacttcctgcagtccgtgcggctcaagtacgtcaagctggggtaccactacctcatcacccacgggatgtacctcctgctcaccccgctcatcgtgctcatcgccgtccacctctccacgctctccccggccgacgtcgccgacctctggacgcacctccgcttcaacctcctctccgtcgtcgcctgctccacgctcctcgtcttcctctccaccgtctacttcctcacccgcccgcgctccgtttacctcgtcgacttcgcctgctacaagccgggcccggagcgccggtgctcgcgcgagacattcatgcgctgctccacgctcaccggcaacttcacccagggcaacctcgacttccagcgcaagatcctcgagcgctcgggtctcggcgaggacacctacatacctcctgccttggtcagcataccgccaaacccctccatggaattggcgcgccaggaggccatggtctgcatgttcggtgccatcgacaacatgctcgccaagaccggggtcaagcccaaggacattgggatccttgttgtgaattgcagcctgttcaaccctacaccgtcgctgtccgccatggtggtgaaccattacaagctcagagggaacataatcagctacaatctgggaggaatggggtgcagcgctgggctcctgtccatagatctggccaaggatttgctgcaggtgcatcccaactcgtatgccatggtggtcagcaccgagaacatcactctgaattggtatttcgggaacaacaagtcgatgctcgtgtccaattgcttgttccggatgggctgcgccgcaatcctgctgtcgaacaagcggtcagacaggaggaggtccaagtacgagctggtgcacaccgtgagaactcacaagggtgcggatgacaagtgcttcagctgcgtcacccaggaggaggacgacagcggcaaggtcggtgtggcgctgtcgaaggacctcatggcggtggccggggacgcgctcaagaccaacatcacgacgcttggcccgcttgtgttgccagtctcggagcagctgatattcatggccacattgattgccaagaaggtgttcaagatgaagatcaagccatacattcctgacttcaagctggcattcgagcacttctgcattcacgctggtgggcgtgccgtgcttgatgagatcgagaagaacatggacctcaccgactggcacatggagccgtcccggatgactctcttcagattcggcaacacgtccagcagctcgctctggtacgagctgtcctacagcgaggcaaaggggaggatcaggaggtctgacaggatctggcagatagcgttcggttcagggttcaagtgcaacagcgccgtctggaaggcgctgaggtcggtgaacccggcgaaggagatgaacaacccctggatggacgagatcgacacattccccgtggatgttcccaaggtttcaacggttgtggtcgactgaatagctttgcctgttgggcactgtcatctggcgctgcgcaagtcttaccatttgggtgatttgctgtttgcatttgtttgggtgatctgttgggaggattaattttagatgattccatttagggggtacagcgtggggtggtggtgttctgttcagtttatgctattgatcagcttttaacatctggtgttccatgtggatctagaatcttggccccaaattaggaattgcgttgcatttatttttccatgtgaactactactcttatgtatttcttccac

SEQ ID NO: 2605 - DNA, 2082 bp, Secale cereale
tgcggcgccagaagaaggcggcggcggaggaggacccggcgccgtctccgattggactccggcggcgctgattgtcgctccggccatttgagcggggaaccatgtccatggaggacagcacgccgccagccggtgccggtgccagcgccggtgaacgcccgagctcgccgtcgccgtcgcgtcgcctgccggacttcctgcagtcggtgcggctcaagtacgttaagctggggtaccactacctcatcacccacggcatgtacctcctgctcaccccgctcatcgtgctcatcgccgtccacctctccacgctctctccgggcgacgtcgcggacctgtggacgcacctccgcttcaacctcctctccgtcatcgcctgctccacgctcctcgttttcctctccaccgtctacttcctcacccgcccgcgctcggtctaccttgtcgactttggctgctacaagcccggcccggagcgccggtgctcgcgtgaaaccttcatgcgctgctccaagctcaccggcaacttcaccgaagccaacctcgatttccagcgcaagatcctcgagcgctcgggtctcggcgaggacacttacatccctcctgccttggtcaccgtgccgcccaacccatccatggaattggcgcgccaggaagcgcaggtctgcatgttcggtgccatcgacaacatgctcgccaagacaggggtgaagcccaaggacattgggattcttgttgtcaattgcagcctgttcaacccaacgccgtcactgtccgccatggtggtgaaccattacaagctgagagggaacatagtcagctacaatctgggaggaatggggtgcagtgccggtctcctgtcagtagatctggccaaggatttgctccaggtgcatcccaactcgtatgcgatggtggtcagcaccgagaacattactctgaattggtattttgggaacaaccggtcaatgcttgtgtcgaattgcctgttccggatgggctgcgccgcgatcctgctgtcgaacaagcggtcagacaggaggaggtccaagtacgagctggtacacactgtgagaactcacaagggtgcagatgacaagtgcttcagctgtgtcacccaggaggaggatgatagtggcaaggttggcgtggcactgtcgaaggacctcatggcggtggctggggatgcgctcaagacgaacatcacgacgcttgggccgcttgtgttgccattctcggagcagctgctattcatggtcacattggttggtaagaagctgttcaagatgaagatcaagccatacattcctgacttcaagctggcattcgagcacttctgcatccacgctggtgggcgcgctgtgcttgatgagatagagaagaacatggacctcaccgactggcacatggagccgtcccggatgactctcttccggttcggcaacacgtccagcagctcgctctggtacgagctggcctacagcgaggccaaggggaggatcaggaggcacgacaggatctggcagattgcgttcggttcggggttcaagtgcaacagcgcggtctggaaggcgctgaggtctgtgaacccagcgaaggaggagaacaacccctggatggacgagatcgacacattcccggtggaggttcccaaggtttccaaggttgctgaataactttgcctgttctgcaccgtcattgggaacaggaagtccgcaaatcttgccgttgagtttgactgtatgcaatttgtttgggcgatctgtcggggtattaattttagatgattccatttaggtggtacagaggggtgtgtggtgtcgtgctgttcactttttatgccattgatcagttcttaacatcttccgtgtggatccagaatctttggcccggaaaggagcaactgcgctgcattaattttccatgtgcacggcgcatttgatttgtttcgaatgttggccatcatgtcgtgctatgatgagttctgtctttgatgtgcattgccgatgtagttgagatttcatctgatacggctagtacatatagttttgatgtgatacttgtgaataattttcaccttga

SEQ ID NO: 2606 - DNA, 1788 bp, Panicum virgatum
atttattttggcgtttttctgaccgaaatctgcttcacagggggccatatggacaaccccgcgccgccaccgaatgccgcggccggcgcgccgtcgccgtcgcggcggctgccggacttccagcagtcggtgcggctcaagtacgtgaagctggggtaccactacctcatctcccacggcatgtacctgctgctcaccccgctgatggtgctcgtggccgtgcacctctccacgctctccccgcgcgacgtcgccgacctgtgggcgcacctccgcctcaacctcgtctccgtgctcgcctgctccgcgctcctcgtcttcctcgccaccgcctacttcctcacccggccgcgccccgtgtacctggtcgacttcgcctgctacaagccggggcccgagcgccggtgctcgcgcgacaccttcatgcgctgctcccgcctcacgggctccttctctgacgccagcctcgagttccagcgcaagatcctcgagcgctcagggctcggcgaggacacgtacctgccccccgccgtcacgagcgtgccgcccagcccgtccatggacgcggcgcgcgccgaggcgcgggaggtcatgttcggcgccgtggacgagctgctcgccaagacgggcgtgcggcccaaggacatcggcgtcctggtcgtcaactgcagcctcttcaacccgacgccgtcgctgtcggccatagtggtgaaccactacaagctccggggcaacatcgtgagctacaacctcggcggcatgggctgcagcgccgggctgctgtccgtggacctcgccaaggacctgctgcagacgcacccggggtcgtacgcgctggtgatcagcacggagaacatcacgctcaactggtactcgggcaacgaccgctccaagctcgtgtccaactgcctgttccggatgggtggcgcggcggtgctgctctccaaccggggcgccgaccggcggcgcgccaagtacgagctggtgcacaccgtgcgcacgcacaagggcgccgacgaccggtgcttcgggtgcgtgacgcaggaggaggacggcgagggccgcgtcggcgtgtcgctgtcgcgggacctgatggccgtcgccggcgacgcgctcaagaccaacatcacgacgctgggcccgctggtgctgccgctgtcggagcagctgctgttcatggcgtcgctggccgccaggaagctgctcggggcgaagcgggtgcggcggccgtacatcccggacttcaagctggcgttcgagcacttctgcatccacgccggcggccgcgccgtgctggacgagctggagagcaacctggcgctcacggactggcacatggagccgtcgcggatgacgctgcaccggttcgggaacacgtccagcagctcgctctggtacgagctcgcctacagcgaggccaagggcaggatccggcggcgcgaccgggtgtggcagatcgccttcgggtcggggttcaagtgcaacagcgccgtgtggcgggcgctccggtcggtgaacccggcggaggagaccgccaacccgtggatggacgagatcgacaggttccccgtggatgttcccaaggtctccaaggtttccagcgactgaaatgctctcgacctgccattgccgttccttcagttcagagttcgcaattctttgttgggaattcgtcataccgtagatcatcatcagcttctctgactctgagctcgggttacacatacgtgacatttgttgttgtttctgttctgtataccactcgttttatatatagctagctgattg

SEQ ID NO: 2607 - DNA, 2204 bp, Musa acuminata
cgctctcacaagtgtgggaatctgggcattgaaagcccccgtttcactcccgacatccctccttgtccgatccgattaggagcgtacctttccttcccctcagtggcgctctcacaagtgctgcaaaggacggtacacaagcgggtatgccgtaaagagttgcaaacttttattcttgatcattcaaaagagagagagagagagagaccacacctctttctcgtgtgtcgcttctcctccgcctcctcggtgcccacctcctgtcttatgaaccaggggggagcggtccggattaggcttcttccggctgttccttgagcggattcggcgctcgaggttgtctaatcgctgatcatcgggaatacttgttgtgtctgaggtttaggggaaagtcgaacctgagaatccctgtccttcctcctccatcccttccggatcagaattttggttggttggaatatggcggagcaaaggtcggacgccccattgctcggatcaccttccggccgactccctgatttcaagcagtccgtcaagctcaagtacgtcaaacttggctaccactacctcatcacccatgggatgtacctcttcctcacacccctcgtcttcctcgtcgccgcccagctgtccaccttctccctcgacgacctccatgacctctgggaccatctccgcttcaacctcgtttccgtcatcctctgctccaccctcctcgtgttcctctccaccgtctacttcctcacccgtccccggcccgtttatctcctcgacttcgcttgctacaaacccgaagacgcccggaaatgcaccaggcagctcttcatggagcgttccaggacgacgggctcgttcacggaagagaaccttgttttccagcggaggatcctggagagatctggacttggcgaagacacctacctcccagaggccgtcctctgcgtcccgcctaatccctgtatggcggaggcaaggaaggaagccagggatgtcatgttcggagccatcgacgagctgctagccaagaccgacgtgaagcccaaggacatcgggatcttgattgtgaattgtagcttgttcaatccgacaccctctctctctgccatggtcgtgaaccattacaagctccggggaaacgtcgtcagctataatctaggtgggatggggtgcagtgctgggctcatctccatggatctggccaagaatctacttcaagtctaccccagttcctatgccttggtgatcagcatggagaacatcaccttgaactggtacttcggcaacaaccgctccatgctcgtttccaactgcttgttccgtatgggtggagccgcgattcttctctccaataagaggtccgatcgtggacggtccaagtaccaactggtgcacacctttcgaacccacaaaggtgccgacgacaagtgcttcggctgtgtgacccaggaggaggatgggaacggaaaaattggtgtttctctctcgaaagatctaatgggagtcgccggtgatgcactgaagaccaacataacgacgttgggccctcttgtcttgcccatgtccgagcatttgatcttcctggctaccttggtggcgaagaaggttttcaagatgaagataaagccttacattccggatttcaagctggccttcgagcacttctgcattcacgccggaggaagggccgtcttggacgagctggagaagaacctgcagctttccgagtggcacatggagccttcgaggatgacgctctacaggtttgggaacacctccagcagctctctctggtacgaattggcatatgcggaagggaaagggaggatcaagaagagggaccgaatctggcaaatagcatttggttccgggttcaagtgtaacagcgccgtatggagggctttaagaacggtgaatcctggcaaggagaagaatccctggatggatgaaatcgacgcgttcccagtctcggtgcccaaggtggcatccctttgaatccgcatctcaggtcgatgggggcgtgaagttaagaatctgcaagagacggtggtaaactgggaaggcgcttttcatcgaagaagatgcccgcttgcgtgcgtcgtgattatggtttcaagattagtgttgtcggtatttgccattgttttatgttgatcatgtaggctttcggtactgaatcttgtcaaatcacaaaatggtccgacgag

SEQ ID NO: 2608 - DNA, 1977 bp, Avena sativa
cgacaaccatgtcgacggaaaacgtcgcgccgccgccggccggtggcaacgccggaggacgcgccgagtcgccgtcgccgccgcgtcggctgccggacttcctgcagtccgtgcggctcaagtacgtcaagctggggtaccactacctcatcacccacgggatgtacctcctgctcaccccgctcatcgtcctcatcgccgtccacctctccacgctctccccggccgacgtcgccgacctctggacgcacctccgcttcaacctcctctccgtcgtcgcctgctccacgctcctcgtcttcctctccaccgtctacttcctcacccgcccgcgctccgtctacctcgtcgacttcgcctgctacaagccgggcccggagcgccggtgctcgcgcgagacattcatgcgctgctccacgctcaccggcaacttcacccagggcaacctcgacttccagcgcaagatcctcgagcgctcgggcctcggcgaggacacctacatacctcctgccttggtcagcataccgccaaacccctccatggaattggcgcgccaggaggccatggtctgcatgttcggtgccatcgacaacatgctcgccaagaccggggtcaagcccaaggacattgggatccttgttgtgaattgcagcctgttcaaccctacaccgtcgctgtccgccatggtggtgaaccattacaagctcaggaggaacataatcagctacaatctcggaggaatggggtgcagtgctgggctcctgtccatagatctggccaaggatttgctgcaggtgcatcccaactcgtatgccatggtggtcagcaccgagaacatcactctgaattggtatttcgggaacaacaagtcgatgctcgtgtccaattgcttgttccggatgggctgcgctgcaatcctgctgtcgaacaagcggtcagacaggaggaggtccaagtacgagctggtgcacaccgtgagaactcacaagggtgcagatgacaagtgcttcagctgcgtcacccaggaggaggacgacagcggcaaggtcggcgtggcgctgtcaaaggacctcatggcggtggccggggacgcgctcaagaccaacatcacgacgcttggcccgcttgtgttgccggtctcggagcagctgatattcatggccacattgattgccaagaaggtgttcaagatgaagatcaagccatacattcctgacttcaagctggcattcgagcacttctgcatccacgctggtgggcgcgccgtgcttgatgagatcgagaagaacatggacctcaccgactggcacatggagccatcccggatgactctcttcagattcggcaacacgtccagcagctcgctctggtacgagctgtcctacagcgaggcaaaggggaggatcaggaggtctgacaggatctggcagatagcgttcggttcagggttcaagtgcaacagcgccgtctggaaggcgctgaggtcggtgaacccggcaaaggagatgaacaacccctggatggacgagattgacacattccccgtggatgttcccaaggtttcaacggttgtggtcgactgaatagctttgcctgttcggcactgtcatctggcgctgcgcaagtcttaccatttgggtgatttgctgtttgcatttgtttgggtgatctgttgggaggattaattttagatgattccatttagggggtacagcgtggggtggtggtgttctgttcagtttatgccattgatcagcttttaacatctggtgttccatgtggatctagaatcttggccccaaattaggaattgcgttgcatttatttttccatgtgaactactactcttatgatttgttaccactacgtgctggccatcatatcatgtgctcacggtctgtagttcagatttatataggattgatatacatactcttgtgtgaataatttgtttaccttgacttaaactgaagaaat

SEQ ID NO: 2609 - DNA, 2395 bp, Aquilegia formosa
cgagaaaaataaagattggagaaagcacgaataacacttttctttgtaaaacagatcttataatctctctctcttcgtgtgatttcaatccattttcgttacaaattttgctagtctccattcctgtttttattcttttctgttcgcttgaatatttcgcgtggatttcattcattaaaaacaagtagagattgaagtaaatcgccatatcagatttgttgttcaagggttttggggttgttaatagagctgaaaaaaagtagccattttcatctagattgattcattctatcaattggaatcctttgagaaacccattcttctatacatagttcttatatttcttttgaatctgaaaccagttctgtagaaatagaggcgatagaacctatgcttttaagttattaaaattttgatagattgttcttcttgtgtttgattttgatcctgacccatttccttgattactataaacaatggcggatcggaaattaaatatgcctttgataccaccattatcgtcgcgaaagcttcctgatttcaaacaatcagttaaattgaagtatgtgaaacttggttaccattacctcatcactcatggaatgttcctcttcctttctcctcttatcattcttattgctgcccagatgtccacattctccttaaaagatctccatgatctttgggaccatctacgattcaatcttatctctgtgattgtatgttcaactctcctcgtctttttatctaccctttatttccttacccgacctcgccctgtttacctagtggacttcgcatgttacaagcctgaagaagctagaaaatgcactagacagatatttatggagcgatctgctttgacgggttcttttactgaaggaaatcttgagttccagagaaagattcttgagagatcaggccttggtgagtctacttacctccctgatgctgttcttcgtgttccaccaaatccatcaatggcagaagccaggaaagaagctgaggcagtgatgtatggtgcccttgatcaactttttgagaagaccaaggtaaagcctaaagacattggcatcctgattgtaaattgtagtctgttcaatcctactccatctctctccgccatgattatcaaccactacaagctcagagggaatataattagttacaacctaggtgggatgggttgcagtgctggcctgatttcaattgatctagcaaaggatcttcttcaagtgcatccaaactcttatgctattgttattagcatggaaaacatcactttgaattggtactttgggaatgagcgatcaatgcttgtctcaaattgtttgttccgaatgggaggagcagcgattttgctttccaataggagctctgacagacggcgatcgaaatataggttggtccacactgtgagaactcacaaaggagctgatgataagtgcttttcatgtgtcacccaagaggaggatccaaatggaaaggttggtgtttcattgtccaaagatctgatggctgttgcaggagatgctttgaagaccaacatcacgaccttgggacctcttgttcttcccatgtcagaacaattgctcttctttgccacattggttgggaagaaactttttaagatgaagattaaaccctacatccctgacttcaaattagctttcgagcatttctgcattcatgctggaggaagagctgttttggatgagttagaaaagaatttgcatttatctgattggcatatggaaccatctaggatgacacttcacagatttggtaacacatccagcagctctctctggtatgaattggcttatacagaagccaagggaaggatgaagaagggagataggacatggcagatagcatttggatctggatttaagtgtaacagtgcagtttggaaggcattaagaaccgtaaacccagcaaaggagaagaacccatggatggatgagatccacaacttccctgttgatgttccaaaggtttcagctctctagtttctcatagctttcaaagtcatttgtgatatttcattgatgagtgctttggttatttgaatggtctatggttgtagcctgtaggatggtggaaattgttttttcagttcatgtgtaggtggtggaaattgttggtatttgatattggctataggggaaggatgtatgttaggagatgttttggctgtttattttaactatttgatttagggtagtatgaatgaatgtaccaatccggcctgccggcctggttggaagagaaaggtgtgaaattgttttgggattcattgtagtcatcaaagaacaagcattggtattcttttggaaatattagctaggagctttgtaattaggttgactgttttttaatttataagaatgaa

SEQ ID NO: 2610 - DNA, 2973 bp, Musa acuminata
agcttcctccgtcgacgcacacgctgacgcccatcgatgccatcgagaagaacggcaaagcgtcttttatagccccttcttcctccgccttctccgccccgcgttccacacactgtggcctttcctccttccttctccccggaccagcggtcggagcggagatcggatcggcctcttctcgccccattcgccggcggagactgcattagaggtgtccgctttctgctttctttcgccaatctcttgatcctcttcttcctattgatctcaggccgaaaaatcccacctttctcccccaacttcatttttcctttgtagcagattgctcttgtttcgatctcgaaaatggccgagagtgaacaaagagcgaatgccgctctgttgcaatcatcatcctcccggctccctgatttcaagcaatccgtcaagctcaaatatgtcaagcttggttatcactacgtcatcacccatgggatgtatctgttcttctcgcccctcattgccgtcctcgtggcgcagctttccaccttctccatcaaggacctccatgacctctgggaccatctccgtttcaacctcatctctgcggtactctgctccacgcttcttgtcttcctctccaccgtctacttcctcacgcgccgcaggccagtttatctggtcaacttcgcatgctataagcccgaggatccccggaaatgtactaggcaaatcttcatggaccggtctacattaacggggtcgttcacggaagagaacctcgcattccagcgtaagatccttgaaaggtctggtcttggtgaatccacctacctccccgaggcagtcctcaatgttcctccgaatccctgcatggctgaggccaggaaggaagccagaactgttatgtttggagccatcgatgagcttttgacaaagactaatgtgaaacccaaggacatcggtatcttgattgtgaattgtagcttgttcaacccgacgccttctctctctgccatggttgttaaccattacaagcttcgaggaaacattgtcagctataatctgggtggaatggggtgcagtgcaggtcttctctcgattgatcttgccaaggatcttcttcaggtctatcccaattcctatgccttggtcgtcagcatggagaacatcaccttgaactggtactttggcaacaaccgctccatgcttgtctccaactgcttgttccgtatgggtggtgctgcaatccttctatccaacaagagatctgatcgcaggcgctcaaagtaccagctcgtgcacactgttcgcactcataaaggtgctgatgataagtgcttcagctgtgtcacccaagaagaggatgagaacggcaagatcggtgtctctctttctaaagacctcatggcagtcgccggcgatgccctgaagaccaacattactacgcttggcccactggtgttgcccatgtccgaacaactcatctttttggctacattggtagcgaagaaagtcttcaaaatgaagatcaggccttacattcccgacttcaagttggcctttgagcatttctgcattcatgccggaggaagggcagtgttggatgaaatagagaagaacctgcaactctccgattggcatatggagccgtcgaggatgacactctataggtttggaaacacttcgagcagctctctctggtatgaattggcatattcagaaggcaaaggaaggattaagaagaaggacagaatttggcaaatagcattcgggtcggggttcaagtgcaacagtgctgtctggaagtctctgaaatccatcaatcccgcaaatgagaagaacccatggatggatgaaattaacaacttcccagttgcggttccgaaggtgtcagcactttgagcataatcgctggttagaaagtgatatcacatgcagaattagaatctgcacaggtgaaacattcgtcatgatttgttttaattgttttggtgttggaaggtgcatttttcatgtggacaatgaatttgattgctagatttaaagataaaccatgcactcaactgtaagtagactaggagggtcaagtagcactatatttcatatttttgctgttaatgcagacattgggcctcgattcttgtcataatcattttcttttgcagtatcattgccttatatatgaatcttatattgattagtgtcatttcattgtattatccactattttaatgaatgtcaagatctcttgatgcatcctctataccttgttaaaatgtcagccatcaattatgtggcactgttagaaaatactatgggtttctggaaattatctggataatctttctgtcaacataatttacattgtttctgtgagatgcttgcatagcccctcttccctgatgggaagtgaaagcaaacaccaatacctccaaccttagtgaggtaatcctgcctaacgggacagtgtagagccaagggggattactcatcaaagttgtcgattgcttcgcggttgttgcattatatactgaaatgacagtcagaataagctactgatgacaaaaggcttgaaggtgatcatgctcagcaaaacctgaatttgttggatcttgtaatctctggcacagcatattcatatagagcatatggcaagggctgcaacacagccgaatctctttgttgagctgctgacccagagaaagaaaaaaacattacatgtttggtgatttccttaacctggttaaaggttaactgaccttcctaaggttcaatttactcaaatagttttgtaagtttagtgtgaggacacaccatactttctgtaaaatactgaatatcttggtgtggttgtatagtgctcaatatcactattttcttggcacttttaagactatctattattaggctgtctatggcctaaattttccgtatgatcttttgagtctgtattctcaggcaggatgggtttagaaatataagtatgcacag

SEQ ID NO: 2611 - DNA, 1692 bp, Musa acuminata
gttccttgagcggattcggcgctcgaggttgtctaatcgctgatcctcgggaatacttgttgtgtttgaggtttaggggaaagtcgaacctgagaatccctgtccttcctcctccatcccctccggatcagaattttggttggtcggaacatggcggagcaaaggtcggacgccccattgctcggatcaccttccggccgactccctgatttcaagcagtccgtcaagctcaagtacgtcaaacttggctaccactacctcatcacccatgggatgtacctcttcctcacacccctcgtcttcctcgtcgccgcccagctgtccaccttctccctcgacgacctccatgacctctgggaccatctccgcttcaacctcgtttccgtcatcctctgctccaccctcctcgtgttcctctccaccgtctacttcctcacccgtccccggcccgtttatctcctcgacttcgcttgctacaaacccgaagacgcccggaaatgcaccaggcagctcttcatggagcgttccaggacgacgggctcgttcacggaagagaaccttgttttccagcggaggatcctggagagatctggacttggcgaagacacctacctcccagaggccgtcctctgcgacccgcctaatccctgtatggcagaggcgaggaaggaagccagggatgtcatgttcggagccatcgacgagctgctagccaagaccgacgtgaagcccaaggacatcgggatcctgattgtgaattgtagcttgttcaatccgacaccctctctctctgccatggtcgtgaaccattacaagctccggggaaacgtcgtcagctataatctaggtgggatggggtgcagtgctgggctcatctccatggatctggccaagaatctacttcaagtctaccccagttcctatgccttggtgatcagcatggagaacatcaccttgaactggtacttcggcaacaaccgctccatgctcgtttccaactgcttgttccgtatgggtggagccgcgattcttctctccaataagaggtccgatcgtggacggtccaagtaccaactggtgcacacctttcgaacccacaaaggtgccgacgacaagtgcttcggctgtgtgacccaggaggaggatgggaacggaaaaattggtgtttctctctcgaaagatctgatgggagtcgccggtgatgcactgaagaccaacataacgacgttgggccctcttgtcttgcccatgtccgagcatttgatcttcctggctaccttggtggcgaagaaggttttcaagatgaagataaagccttacattccggatttcaagctggccttcgagcacttctgcattcacgccggaggaagggccgtcttggacgagctggagaagaacctgcagctttccgagtggcacatggagccttcgaggatgacgctctataggtttgggaacacctccagcagctctctctggtacgaattggcatatgcggaagggaaagggaggatcaagaagagggaccgaatctggcaaatagcatttggttccgggttcaagtgtaacagcgccgtatggagggctttaagaacggtgaatcctggcaaggagaagaatccctggatggatgaaatcgacgcgttcccagtctcggtgcccaaggtggcagccctttgaatccgcatc

SEQ ID NO: 2612 - DNA, 1952 bp, Avena sativa
gtgttgctcgcgacggcaaggtcaggggagagaggactcagtgtgtgcgcgagaaggcggcggcggcggggtaggatccggcgccgtctccgtggttgatttcacccctccggcgcggagctcgtcggctgtgattgtctctccggccatttgactgcgacaaccatgtcgacagaaaacgtcgcaacgccgccggccggtggcaacgccggaggacgcgccgagtcgccgtcgccgccgcgtcggctgccggacttcctgcagtcggtgcggctcaagtacgtgaagctggggtaccactacctcatcacccacgggatgtacctcctgctcaccccgctcatcgtgctcatcgccgtccacctctccacgctctccccggccgacgtcgccgacctctggacgcacctccgcttcaacctcctctccgtcgtcgcctgctccacgctcctcgtcttcctctccaccgtctacttcctcacacgcccgcgctccgtttacctcgtcgacttcgcctgctacaagccgggcccggagcgccggtgctcgcgcgagacattcatgcgctgctccacgctcaccggcaacttcacccagggcaacctcgacttccagcgcaagatcctcgagcgctcgggtctcggcgaggacacctacatacctcctgccttggtcagcataccgccaaacccctccatggaactggcgcgccaggaggccatggtctgcatgttcggtgccatcgacaacatgctcgccaagaccggggtcaagcccaaggacattgggattcttgtggtcaattgcagcctgttcaacccgacgccgtcgctgtccgccatggtggtgaaccattacaagctgagagggaacataatcagctacaatctgggaggaatggggtgcagtgctgggctcctgtccatagatctggccaaggatttgctgcaggtgcatcccaactcgtatgccatggtggtcagcacagagaacattactctgaattggtatttcgggaacaacaagtcaatgctcgtgtccaattgcctgttccggatgggttgcgccgcaatcctgctgtcgaacaagcggtcagacaggaggaggtccaagtacgagctggtgcacacagtgagaactcacaagggtgcggatgacaagtgcttcagctgcgtcacccaggaggaggacgacagtggcaaggtcggcgtggcgctgtcgaaggacctcatggcggtggccggggacgcgctcaagaccaacatcacgacgcttggcccgcttgtgttgccagtctcggagcagctgatattcatggccacattgattgccaagaaggtgttcaagatgaagatcaagccatacattcctgacttcaagctggcattcgagcacttctgcatccacgctggtgggcgagccgtgcttgatgagatcgagaagaacatggacctcactgactggcacatggagccgtcccggatgactctcttcagattcggcaacacgtccagcagctcgctctggtacgagctgtcctacagcgaggcaaaggggaggatcaggaggtctgacaggatctggcagatagcgttcggttcagggttcaagtgcaacagcgctgtctggaaggcgctgaggtcggtgaacccagcaaaggagatgaacaacccctggatggacgagatcgacacattccccgtggatgttcccaaggtttcaacggttgtggtcgactgaatagctttgcctgttcggcactgtcatctggcgctgcgcaagcatttgggtgatttgctgtttgcatttgtttgggtgatctgttgggaggattaattttagatgattccatttagggggtacagcgtggggtggtggtgttctgttcagtttatgccattgatcagcttttaacatctggtgttccatgtggatctagaatcttggcccca

SEQ ID NO: 2613 - DNA, 1896 bp, Elaeis guineensis
aaaaaaagcatcctttctcctcctcccaagtttccaattttctcataatccgatcatggcggaaccattgctcaataaatcatcctcgagccgtctccccagcttcacgcaatcagtgaagctcaagtatgtcaaacttggttaccactacctcatcacccatggcatgtacctcttcctcacacccctcgtcgtcctggtcgctgcccaactctccaccttctctgtccaagacctccatgacctctgggaccatctccggtttaatctcatctccgtgatcctctgctccacgctcctcgtattcctttccaccctctacttcctcacccgtcctcggcctgtctatctcgtcaacttggcatgctacaagccggaggacgcccggaagtgcaccaggcaaatttttatggagcattctaagctgacgggctcgttcacagaagagaacctcgaattccagcgtaagatcctcgaaaggtcaggccttggtgagaacacttacctccctgaggctgtcctcaatgttcctcctaatccctcgatggccgaggccaggaaggaagctagggctgttatgtttggcgccattgacgaactttttgccaagactaatgtgaagcccaaggacattgggatcttgattgtgaattgtagcttgttcaatccgacccatctctttctgccatggttgtgaaccattacaagcttcgaggaaacatagtgagctataacttgggtgggatggggtgcagtgcagggctgatttctatcgatcttgccaaggatcttcttcaagttcatcccagtacctatgccttggttatgagcatggagaacatcaccttgaactggtactttggcaacaatcgttccatgcttgtttccaactgcttgttccgaatgggtggagctgcaatccttctctccaacaagagctccgatcgctgccgctccaaataccaattggttcacacggttcgaacccacaagggtgctgatgataagtgcttcagctgtgtcacccaagaagaggacgccaatgggaaaattggtgtttctctttcgaaagatctgatgggagttgctggtgatgccttgaagaccaacatcacgacattgggtcctcttgtcctacccatgtctgagcagctactcttctttgctacattggtggggaggaaggtcctcaagatgaagattaggccttacattcctgatttcaagttggcctttgaacatttctgcattcatgctggtggaagggctgttttggatgaactggagaagaacttgcagctttcggagtggcacatggagccttcgaggatgacgctgtacagatttggaaacacttcaagcagttctctctggtatgaactggcatacacggaagggaagggaaggatcaggaagagggacagaatttggcagatagcattcggatcaggattcaagtgtaatagtgcagtatggaaggctttgaagactatcagtcctgcaaaggaaaagaacccctggatggacgagatccacaacttcccagttgacgttccaagggtgtcggcactttgaatcgtagtcctgctggggatgtgagttgcaagaccttgctgttgggttgtgaaattggtctttgatctggtttcagggattgcaataattttacattcggttgtagggtacaatttgcgggcctttggaggttgattcttattatgggtggagaatttgttaggaaaggtgtatttttctctctcttttttggtgtagtcatgtaggatatgatcattggtttgaaggcaaaatgggctggattgctagacgaggaggaggtcagggatgaatgttgtgttatcatgtggtttgatttatgcaacttaagccattgactct

SEQ ID NO: 2614 - DNA, 1710 bp, Avena sativa
gagagaagactcagtgtgtgcgcgagaaggcggcggcggcggggtaggatccggcgccgtctgcgggttggatttcgccctccggcgcggagctcgtcggctgtgattgtctctccggccatttgactgcgacaaccatgtcgacagaaaacgtcgcaacgccgccggccggtggcaacgccggaggacgcgccgagtcgccgtcgccgccgcgtcggctgccggacttcctgcagtcggtgcggctcaagtacgtgaagctggggtaccactacctcatcacccacgggatgtacctcctgctcaccccgctcatcgtgctcatcgccgtccacctctccacgctctccccggccgacgtcgccgacctctggacgcacctccgcttcaacctcctctccgtcgtcgcctgctccacgctcctcgtattcctctccaccgtctacttcctcacccgcccgcgctctgtttaccttgtcgacttcgcctgctacaagccgggaccggagcgccggtgctcgcgcgagaccttcatgcgctgctccacgctcaccggcaacttcacccagggcaacctcgacttccagcgcaagatcctcgagcgctcgggtctcggcgaggacacctacatacctcctgccttggtcagcataccgccaaacccctccatggaactggcgcgccaggaggccatggtctgcatgttcggtgccatcgacaacatgctcgccaagaccggggccaagcccaaggacattgggatccttgttgtcaattgcagcctgttcaacccgacgccgtcgctgtctgccatggtggtgaaccattacaagctgagagggaacataatcagctacaatctgggaggaatggggtgcagtgctgggctcctgtccatagatctggccaaggatttgctgcaggtgcatcccaactcgtatgccatggtggtcagcacagagaacattactctgaattggtatttcgggaacaacaagtcaatgctcgtgtccaattgcctgttccggatgggttgcgccgcaatcctgctgtcgaacaagcggtcagacaggaggaggtccaagtacgagctggtgcacaccgtgagaactcacaagggtgcagatgacaagtgcttcagctgcgtcacccaggaggaggacgacagtggcaaggtcggcgtggcgctgtcgaaggacctcatggcggtggccggggacgcgctcaagaccaacatcacgacgcttggcccgcttgtgttgccagtctcggagcagctgatattcatggccacattgattgccaagaaggtgttcaagatgaagatcaagccatacattcctgacttcaagctggcattcgagcacttctgcatccacgctggtgggcgagccgtgcttgatgagatcgagaagaacatggacctcactgactggcacatggagccgtcccggatgactctcttcagattcggcaacacgtccagcagctcgctctggtacgagctgtcctacagcgaggcaaaggggaggatcaggaggtctgacaggatctggcagatagcgttcggttcagggttcaagtgcaacagcgctgtctggaaggcgctgaggtcggtgaacccagcaaaggagatgaacaacccctggatggacgagatcgacacattccccgtggatgttcccaaggtttcaacggttgtggtcgact

SEQ ID NO: 2615 - DNA, 2084 bp, Daucus carota
agggagtttctgctgcattttgttgatttatttggttcagattaggaatctttgggaaccctttttgttatcattcttttcatcttcatatctaggaggatttagtgattcattgggattaatcttgatttggtaattttgagtgtgactttggatttgattgatttataaattctagtcatagcccaagttttgaattgttggcaaaatgagtgaagctaaggtgaaccagcctttgatcccaccatcttatttgcgaaaacttcctgattttaagcagtctattaagttaaagtatgttaaacttggctatcattaccttattactcatggaatgtacctatttttatcccctcttgtggttgttcttgcggctcaattgtctacattttcgctccgagatatctacattctttgggaccatttgaggttcaatcttatatcggtggttgtttgttcgacccttctggtctttctttcaaccctctacttccttacccgtcctcgccctgtttaccttgttaacttttcatgctataaacctgaagaggataggaaatgcacgaggcagactttcatggagaaatccaagctcacaggcaactttacggatgcaaaccttgattttcagaggaaaattcttgagaggtcaggtcttggcgaagatacataccttcctgaagctgtacttagagtacctccaaatccgtgtatggcggaagcaagaaaggaagctgaacttgtgatgtttggtgctatcgatgagctcttagcgaaaacctctctgaagccgaaagacattggggttttaattgtcaactgtagtttgtttaatcccaccccttctcttgcatctatggttattaatcattacaaacttcgagggaatatcttgagttataatcttggtgggatgggttgcagcgctggtttaatctcaatcgatttagctaaagatcttcttcaagtccatcccaattcatatgctctagtaatcagcatggagaacatcacattgaattggtattttggaaatgagaggtcaatgcttgtttctaattgcttattccgtatgggaggggctgctattctgctttcaaacaagaggtcagatcggcgtcgatccaagtaccagctggtccatactgtcagaacccacaaaggttccgatgacaaatgcttttcttgtgttactcaattggaggatcctgctggaaaagttggagttgctttgtcaaaggatctgatggccgttgctggggatgctttgaagaccaatataactacacttggtcctcttgtgctgccaatgtctgaacagctgctcttctttgctacattggtcgggaagaaacttttcaggatgaagataaagccttacatcccagattttaaacttgcattcgagcatttctgcattcatgctggaggaagagctgtgctggatgaactggagaagaacctgcagctcagtgattggcatatggagccatcaaggatgacacttaatcgatttggaaacacttctagcagctctctgtggtatgaattggcatattcagaagcaaaagggaggatcaagaagggagatagagcatggcagatagcatttggttctggattcaagtgtaatagtgcagtttggaaggctctgaggactctcaaccccgcaaaggagaaaagtccatggatggatgagattcacaaattcccagtggatgttccaaaggtctctgctgtctaaagtctgagaaagtataattttattaccaactgcattttacataattctgcttcgtgtcagattattggagttactcagggtagtggggaaatgactagagcatgtctggttaaagattagtcgtgtttgtttaagattacaaattgtaacctggtgatgaccaaaatttaaatcttatttattggcagatgcgtattggcatgaatatttattttggggcccaactttaaataagctggtctactttaagccgtttcataatgattttgaaatctcatttgcatttatttttgtctcacgttatgttcatgatttgtagttgtttatatgttcacttggg

SEQ ID NO: 2616 - DNA, 2101 bp, Cocos nucifera
caaaaaagacctttctcctcccaagttccctattttctcataatccgatcatggccgaaccattgctcaataaatcatcctcgagccgtcttcccagcttcacgcaatcagtgaagctcaagtatgtcaaacttggttaccactacctcatcacccatggcatgtacctcttcctcacacccctcgtcggcctcgtcgctgcccaactctccaccttctctgtccaagacctccatgacctctgggaccatctccggtttaatctcatctccgtgatcctctgctccacgctcctcgtattcctttccaccctctacttcctcacccgtcctcggcctgtctatctcgtcaactttgcatgctacaagccggaggacgcccggaagtgcaccaggcaaatctttatggagcagtcaaaactgacgggctcgttcacagaagagaaccttgaattccagcgtaagatcctcgaaaggtcaggccttggtgagaacacttacctccctgaggctgtcctcaatgttcctcctaatccctcgatggccgaggccaggaaggaagctagggctgttatgtttggcgccatcgatgaactttttgccaagactaatgtgaagcccaaggacattgggatcttgattgtgaattgtagcttgtttaatccgaccccatctctttctgccatggttgtgaaccattacaagcttcgaggaaacatagtaagctataacttgggtgggatggggtgcagtgcagggctgatttctatcgatcttgccaaggatcttcttcaagttcatcccagtacctatgctttggttatcagcatggagaacatcaccttgaactggtactttggcaacaatcgttccatgcttgtttccaactgcttgttccgaatgggtggagctgcaatccttctctccaacaagagctccgatcgccgctgctccaagtaccaattggttcacatggttcgaacccacaaaggtgctgatgacaagtgcttcagctgtgtcacccaagaggaggacgccaaggggaaaattggtgtttctctttcgaaagatctgatgggggttgctggtgatgccttgaagaccaacatcacgacattgggtcctctcgtcctacccatgtctgagcagctactcttttttgctacattggtggggaggaagatcctcaagatgaagattaggccttacattcctgatttcaagttggcctttgaacatttctgcattcatgctggtggaagggctgttttggatgaactggagaagaacttgcagctttcggagtggcacatggagccttcgaggatgacactctacagatttggaaacacttcaagcagttccctctggtatgaactggcatacacggaagggaaggaaaggatcaggaagagggacagaatttggcagatagcattcggatcaggattcaagtgtaacagcgcagtatggaaggctttgaagactatcagtcctgcaaaggaaaagaacccctggatggacgagatccataacttcccagttgacgtcccaagggtgtcggcactttgaatcatagtcctgctggggatgggtggtgaaattggtctttgatctggtttcatggattgcaataattttacattcagttgtagggtacaatttgtgggcctttggaggttgattcttattatgggtggagaatttgttaggaaaggtgttttattccctcttttttggtgtagtcatgtaggatatgatcattggtttgaaggtaagatgggctggattgctagactaggaggaggtcagggatgaatgttatgtgtcatcatgtggtttaatttatgcaacttaaaccattgactctgcttaaatttcatctatttgatcagcagcaatttttctgtgattgttaaaaactagatgctctgagcaagctttccaattgcttagaagtcattcatcattttagcccacggtactaaatgtgtttttgttgatgaccgagctttatcccaacaagatgcggtttatgaccagtcattcatattaaaaaacaaaccaactgtcatgaccgcattttctttatgacaatgtca

SEQ ID NO: 2617 - DNA, 2468 bp, Musa acuminata
ccctcttcctgaccttttccgctcctcgtcccatcgcccgcgtccccttcctccctcttcccgaaaaaccaagcgagcgcttgggtcggagacgggatcggcttcttctctccccattcgccagcggagctcgcattccaggtccctccttcgaagatctctttgtttgcgaaatcgcttcttgattcacttggtgtttgatctctgtttgatgcttgggtgctggctgcattggggtcgttcgcttgttcttggcctttccaagaaacgtgactttgatttcctggatgcttcgtcgccgaatccagatctattgtcacatgatttgctgcgacgctattgtggattctgtgtctcgagccgtgttcttttcgattttatgggcaaaataccacctttccgcgcatgtttccttggtgcccccattttatccttgttcaagatccattctttcccctaattattctgcaagacgagcaattttttttggtcaagatccgatctttcactcaggtgttcttggtggtgttgattgttttgttcaaaatcgtttctttttcctgatagtggatgattcggtttgccagaagaacaaaagaaacacgaggtttggaataccattctatgcttaatgttttaccttcatcaacttcgtgttggagaggagaggaagagaaaggaatcatcgcttttgttcttcttcttgtgatatatgaatgttctaatcttgtttctcttctgcattgttcaggtctccacttttcgatttcaatcatcaatttcttgatcgaatccctcattcctgtttcccctgttgatctcagggcgaaagatcccgcctttctacctccaagcggcaggttactcttatttcgatctcgatcatggccgaggccgaacagagacccaatgcccctttgctccaatcatcgtcctcccgtctccctgatttcaagcaatccgtgaagcttaagtatgtcaagcttggttatcactacctgatcagccatgggatgttcctgttcttctcgcccctcatcgccgtcgtcgtcgcccagctctccaccttgtccgtcaaggacctgcacgacctctgggaccatctccgcttcaatctcatctccgtgatcttgtgctccgcgcttctcgtcttcctcttcaccgtctacttcctcaggcgcccccgcccggtttatctggtcaacttcgcatgctataagcccgaagaagcccggaaatgcacgaggcaagtcttcatgaacaggtccacgctaacaggctcattcacggaagagaacctcgcgttccagcgtaagatcctcgagaggtctggtcttggcgaatccacctacctccctgaggctgtcatcaacatccctcccaacccctgcatggccgaggcccggaaggaagccagaaccgtcatgtttggagccatcgatgagcttttggcgaagacgaatgtgaagcccaaggacatcggcatactcatcgtgaactgcagcctgttcaatcccacgccttctctttccgccatggttgtcaatcactacaagcttcgtggaaacatcgtcagctacaatctcggcggaatggggtgcagcgcaggccttctctccattaatctcgccaaggatctcctccaagtctatcccaactcatatgcattggtcatcagcatggagaacatcaccttgaactggtacttcggcaacaaccgatccatgctcgtctccaactgcttgttccgcatggggggagccgcaatcctcctctccaacaagagatccgaccgcaggcgatcaaagtaccaactggtgcatagtgttcgaacccacaagggagccgacgacaagtgcttcagttgtgtcacccaagaagaggacgagattggcaagatcggcgtctccctctcgaaagatctcatggcagtcgcaggtgatgccctgaagaccaacatcaccactctcggcccgctagtcctgcccatgtccgagcaactcatcttcttcgcgacgttggtggccaagaagttgttcaagatgaaggtcaggccttacattccggatttcaagttggcattcgagcacttctgcatccatgcgggaggaagggcggtgttggacgagatagagaagaacctgcagctctcggagtggcacatggagccatcgaggatgacactctacaggttcgggaacacctcgagcagctctctgtggtatgaattggcgtactcggaggggaagggaaggataaagaagaaggacaggatctggcaaatagcattcgggtcggggttcaaatgcaacagtgctgtgtggaaggctctcaagactatcaatcctgccaaggagaagaacccatggatggatgagattaatgacttcccggttgtggttcccaaggtgtcagcactctgaatgatacacgatctttgttcgcgaggcagcagtgtgtccgattca

SEQ ID NO: 2618 - DNA, 2248 bp, Papaver somniferum
caaaccattggataagtaaaggtgtgacctttttcaatttctggattttgtttgggcaatgttgttggagattcaataaattctaatcttaatccaaacaaaaaagggattttttggttgtgttctgaaatctgcaatcaattttctttaaagggtttctcctgtttcctgatttgatctgagttgaccaaaatggcagacaacccaaaaccagaaacaacaccattgattagaacaaaatcagcaagaatacttccagatttcaaacaatcaatcaaactgaaatatgtgaagcttggttatcattatcttatcacccatggaatgtatttgtgtttatctccgcttgtagtactcattgcagctcaaatctcaacattctctttaaaagaccttcatgatttatgggatcatcttcgattcaatcttatatctgtcattgtttgttcaacccttcttgttttcttatccaccctttacttccttacaagaccaaggcctgtttatcttgttgacttctcttgttacaagcctgaggatgaaaggaagtgcactagacagatctttatggagagatcagggttaaccggttcgtttaccgagcagaatcttgagtttcagaggaaaattctagagagatcgggtcttggtgaatcgacttacctcccgcctgctgttcttagagttcctcctaatccgtctatggctgaagcgagaaaagaagctgagattgttatgtttggggcgttggatcaattgtttgcaaaaacttcggtcaagccgaaagatattggaattctgattgttaattgtagtttgttcaatccgactccatctctgtctgccatggttattaaccattacaagcttcgagggaatattgtgagttacaatctaggtgggatgggttgcagtgcaggtttaatctctattgatcttgccaaagatcttcttcaagttcatccgaattcttatgctttggttatcagcatggaaaacattactttgaattggtattttgggaacgaaagatcgatgcttgtttcgaattgtttgtttagaatgggaggtgctgctatcttgttgtcaaataagaattcagaaaggaggagatctaaataccagttggttcacactgttcgtacccataaaggagctgacgacaaatgtttttcatgtgttacccaagaggaggatccagctggaaaggttggtgtttctctatccaaagatctgatggctgttgcaggggacgctttgaaaaccaacatcaccacattaggacctcttgttcttccgatgtccgaacagttacttttcttcgctacattggtcgggaagaaactctttaagatgaaaattaagccgtatattccagatttcaaattggcttttgaacatttctgcattcacgctggtggaagagctgtcttggacgaactggagaagaatttgcagttatctgaatggcacatggagccctctagaatgacgctttacagatttggtaacacttcaagcagttctctttggtatgaattggcttacacagaagctaaaggaaggatcaagaagggagacagaacttggcagattgctttcgggtctggtttcaagtgtaacagtgctgtttggaaggctttgaggaccgtaaatccggcgaaggagaagaacccatggatggatgagattcaacagttcccagtcgacgttccaagggtcgcagcaatctaaacttaaaggttgttcttctactgctcttggtttatcgaaaactgattattcttttgatggtttatatgaatggacaacaatccgaatgctgcacgctgctgtagctatttggttgtgagatgctcgtagggagaaaggaaatcagttgggattgataatttgtgtgagtgaagatttagactagaaatttgtgatatttatgttggttttctttgggtactgaaattgtttgagtgtttttttttactccattagggaatttgagttttagactctgattaagaagccgaaattgggttactcaggctaacttaattcatgacttatgtggggaaggagggaaagaagaagagggggtttagagaatgtctgtctgtatttggaccctaattccatttagtggaattcaatagattcattattttgatctctgttccaactttgttatatattcttttaaattttacttggctatattttttggggaatactgctgctgctgtcaggtattcca

SEQ ID NO: 2619 - DNA, 2428 bp, Musa acuminata
tggcccccctcttcctgaccttttccgctcctcgtcccatcgcccgcgtccccttcctccctcttcccgaaaaaccaagcgagcgcttgggtcggagacgggatcggcttcttctctccccgttcgccagcggagcccgcattccaggtccctccttcgaagatctctttgtttgcgaaatcgcttcttgattcacttggtgtatgatctctgtttgatgcttgggtgctggctgcattggggtcgttcgcttgttcttggcctatccgagaaacgtgactttgatttcctggatgcttcgtcgccgaatccagatctattgtcacatgatttgctgcgacgctattgtggattctgtgtctcgagccgtgttcttttcgattttatgggcaaaatacgacctttccgcgcatgtttccttggtgcccccattttatccttgttcaagatccattctttcccctaattattctgcaagaagagcaattttttttggtcaagatccgatctttcacgcaggtgttcttggtggtgttgattgttttgttcaaaatcgtttctttttcctgatagtggatgattcggtttgccagaagaacaaaagaaacacgaggtctccgcttttcgatttcaatcatcaatttcttgatcgaatccctcattcctgtttcccctgttgatctcaggccgaaagatcccgcctttctacctccaagcggcagtttactcttatttcgatctcgatcatggccgaggccgaacaaagacccaatgcccctttgctccaatcatcgtcctcccgtctccctgatttcaagcaatccgtgaagctcaagtatgtcaagcttggttatcactacctgatcagccatgggatgttcctgttcttctcgcccctcatcgccgtcgtcgtcgcccagctctccaccttgtccgtcaaggacctccacgacctctgggaccatctccgcttcaatctcatctccgtgatcttgtgctccgcgcttctcgtcttcctcttcaccgtctacttcctcaggcgcccccgcccggtttatctggtcaacttcgcatgctataagcccgaagaagcccggaaatgcacgaggcaagtcttcatgaacaggtccacgctaacaggctcgttcacggaagagaacctcgcgttccagcgtaagatcctcgagaggtctggtcttggcgaatccacctacctccctgaggctgtcatcaacatccctcccaacccctgcatggccgaggcccggaaggaagccaaaaccgtcatgtttggagccatcgatgagcttttggcgaagacgaatgtgaagcccaaggacatcggcatactcatcgtgaactgcagcctgttcaatcccacgccttctctttccgccatggttgtcaatcactacaagcttcgtggaaacatcgtcagctacaatctcggcggaatggggtgcagcgcaggccttctctccattaatctcgccaaggatctcctccaagtctatcccaactcatatgcattggtcatcagcatggagaacatcaccttgaactggtacttcggcaacaaccgatccatgctcgtctccaactgcttgttccgcatggggggcgccgcaatcctcctctccaacaagagatccgaccgcaggcgatcaaagtaccaactggtgcatagtgttcgaacccacaagggagccgacgacaagtgcttcagttgtgtcacccaagaagaggacgagattggcaagatcggcgtctccctctcgaaagatctcatggcagtcgcaggtgatgccctgaagaccaacatcaccactctcggcccgctagtcctgcccatgtccgagcaactcatcttcttcgcgacgttggtggccaagaagttgttcaagatgaaggtcaggccttacattccggatttcaagttggcattcgagcacttctgcatccatgcgggaggaagggcggtgttggacgagatagagaagaacctgcagctctcggagtggcacatggagccatcgaggatgacactctacaggttcgggaacacctcgagcagctctctgtggtatgaattggcgtactcggaggggaagggaaggataaagaagaaggacaggatctggcaaatagcattcgggtcggggttcaaatgcaacagtgctgtgtggaaggctctcaagactatcaatcctgccaaggagaagaacccatggatggatgagattaatgacttcccggttgtggttcccaaggtgtcagcactctgaatgatacacgatctttgttcgcgaggtagtagtgtgtccgattcagagttgagagaaggtggtgcatcatcttctgtgtaagcgaaggatttggtcactagagttgagagaagacatgcacccaaaaaaatgtcagactagta

SEQ ID NO: 2620 - DNA, 2257 bp, Tabernaemontana elegans
agaggtttaggaatttcttcagtggcccttttctgttgggaatatatagatctcggatatttgattttgatctatttgtcattcctaaattcttggatcttagcattacctactaggacccttaatatgcgaaaattccgagaaataactttggactgtagtaatccctctggtgttattgaattagcttttccttgctagctgttatccaatcttgagcagactttgagagttaaaaggtttccagagatgagtgattcaaagacaagcacacccttgataccgccctcatcttcaaggaagcttccggatttcaaacaatctgttaaattgaaatatgtgaagcttgggtatcattaccttataactcatggaatgtaccttttcttgtcccctctagttgttgttattgctgctcagctttccacgttctccctccaagacctttatgttctatgggaccatctgagattcaatctcatatctgttgttgtctgctctacccttttggtctttttgtcaactgtttatttcatcacccgtcctcgtcctctataccttgtaaatttctcgtgctataagccagaggatgctaggaaatgcacgcggcaaattttcatggagagatcacggtcgactggttcattcacccccgaaaaccttcagttccaaaggaaaattcttgagaggtcagggcttggtgagtcaacttacctccctgaagctgtattaagagtccctccaaatccatgcatggcagaggctagaaaagaagctgaagctgtgatgtttggtgccattgatgagcttcttgccaaaacttctctaaagccgaaggacattggtattttgattgtgaattgcagtttgtttaatccaaccccatcattgtctgctatggttattaatcattataaacttcgaggaaatattgttagttataatcttggtggaatgggttgtagtgctggtttgatctccattgatcttgctaaagatcttcttcaagtacatcccaatacctatgcacttgttattagcatggaaaacatcactttaaattggtattttgggaatgagaggtcaatgcttgtttctaattgtttatttcgaatgggaggtgctgcaattttgctttccaataaaaggtctgatcgaagaaggtccaagtaccagttggtccacactgtcagaacccacaaaggtgctgatgacaaatgcttttcttgtgttacacagatggaggattctaatggaaaaataggtgtttctttatcaaaggacttgatggcggtagctggtgatgccttgaaaaccaatatcactacattgggtccccttgtgctgcctatgtctgaacaattactcttctttgccacattggtgggaagaaaattgttaaagatgaagataaaaccttacattccagatttcaaattggcttttgaacatttctgcattcatgctggtggaagagctgtcctggatgaactagaaaagaatctccagctctctgattggcatatggaaccatctaggatgactctctatcgtttcggtaacacctcaagcagctcactttggtatgagttggcatactctgaagctaaaggaaggattaagaggggagacagaacttggcagatagcatttggctctggcttcaagtgtaacagtgcagtttggaaggccttaagaactgtcaacccagccaaggagaagaatccatggatggatgagatccaccagttccctgtggaagtccccagggtctcagccctctgatcaaaagaattatcttctatttggttgctcatgcatgactatgagttattgtatccatgttctagccatgtctttgttgacatgacagcttccctagtgtctgaaaatatggtagttaactgaatcctgagtttttatccttctttcctcgtggcaccatgtaggttgatggctctgctgcgtatttgtggttgtagaaagcatgcattccgtagtctctagattattgggttattcataattgaaagttgactggagattctccacattaattgagggctgagaataatttgttttgaactcctgctgggggagacttttagctagaaggttgttaggaagagggaatggcttctcttctcgatgagtccatggtttgggtttactttgctatgtaactcttgatgaacttaatgaatatcatttatttatttttctgttactgattgattgatgtaagaaaatttattga

SEQ ID NO: 2621 - DNA, 2210 bp, Amorphophallus konjac
gagagagagagaggaatagccatgtttaggcatctttcgtctctccatctcctctagtctgtggacgcgccgggcattgcctcgcggcagatccgcggccgtggttccaagtccgggtgagagatccttctgcctctgcggttcttcccctgaaacccaggattaaattaacaaagaacacatctttctgaaggaagaagaccagaatcacccccatggcggaggcaagaccagaaggagcccctctgccgcaggcgccgtccagcgggctccccgacttcaagcaatccgtcaagctcaagtacgtgaagctgggctaccactacgtcatcacccacgggatgtacctcttcctgacccccctcgtcgccgccatcgccgcccagctctccaccctgtccctgcgggacatccacgacctctgggagcacctccgcttcaacctcatctccgtcatcctctgctccgccctcctcgtcttcctctccaccctctacttcctcacccgcccccgccccgtctacctcgtcgacttctcctgctacaagccggaggacgccaggaagtgctcccgccagatcttcatggagcggtcccgactgacgggctccttcaccgacgagaacctcgagttccagaggaagatcttggagaggtccggcctgggcgagtccacctatctcccccaggcggtgctcaacgttcctcccaatccctgcatggcggaggcccggaaggaggccgagaccgtcatgttcggggccctggatgagctcttcgccaagacccacatgaagcccaaggacatcggcatcctgatcgtgaactgcagcctgttcaacccgactccttccctctccgctatgatcgtcaaccattacaagctcagggggaacatcttgagctacaacctcggcgggatgggctgcagcgccggcctcatctccctagatctcgccaaggacctcctccaagcgcaccccaactcctacgccctggtcgtcagcatggaaaacatcaccttgaactggtacttcggcaacaaccggtcgatgctcgtgtccaactgcctgttccggatgggaggggcggcgattctcctgtccaacaggaggtcggatcggcgcagatccaagtaccagcttgtccacacggtccggacgcacaagggcgcagacgacaagtgcttcagctgcgtcacccaggaggaggacgccaacggcaagatcggagtttccctgtcgaaggatctgatgggtgttgcaggcgatgccctcaagaccaacattaccacgctcggtcctctcgtcctccccatgtccgagcagctgctgttcttcgcgaccctggtggggaagaagctcctcaagatgaagattaagccctacatccccgacttcaagctggcctttgagcacttctgcatccacgccggggggcgggccgtcctggacgagatagagaagaatctgcagctgtcggagtggcatctggagccatcgaggatgacgctctacaggttcgggaacacctcgagcagctccctctggtatgagctggcttacacggaggccaagggaaggatcaggaggggggacaggacgtggcagattgccttcgggtccggtttcaagtgtaacagtgctgtctggaaggccttgaggactgtgaatccggcgaaggagaggaacccatggatggatgagatcgatcagttccctgtgcaggttccaaggttctcagccatctcctcctcctcctcctgagtaggaggaagacctggtttgatgcagttgccataggagggaggctgagtggaatgtaggaaggggaggaagaaagctgtttcctttttcttttttccaaattgtgggagggtgaccccagtattcttttctcttctcttctcttctcttccaggtggggggggggataggattactacattctgattgggttctagaggaggaacagattcctgatgatttgattctgggaatgtggccattgggtggctgacctgttagttgtccattggcattcgtagtccatatttctggaacccaaattgtatgatgatttgtgttcttgctggttacttattggttaggttctgcatgcgcttcataaatctgaattatttgttggaacgaacgaatcatccatgtcgtaacggtatgcagattgcaggcacttaacgcagcctaatc

SEQ ID NO: 2622 - DNA, 2201 bp, Cajanus cajan
gagtgagtggagatggaagtgagttaaagctcatggtctgattttgatctctcttccttctctcgcatttctcatgttactgttactgtctctgtaaacagtgaacatgttatgtccatgcttttagcgattcccttctggccctgttattatcactcacactcacacactcacattatttatttcactttaaataaactaccgaatctctttcattcgaaaattaaaattcattaaatcctaatccctccctctattatctgtcatcatctctctctctatttaataactacaattattccttctcacttcgctaacctccttttctttcttccttctctctgctctacattcctgggatctgctggctttgcttttaaagggcaaaatgacagatgcaaagccagatgcaccctcgatggcatcatcatcgcgaaagcttcccgatttcaagaagtctgtcaaattgaagtatgtgaagcttggttatcattacctcatcactcatggaatgtacctgtgtctttcccctcttgtggtgttgattgctgctcagctctccaccttctccccccaagacctgtatgatctttgggagcatctacaatacaatttgatatctgttattctttgctcaacactccttgtttttctgtccacactctactttctaactcgtcctcgaccagtgtatcttgtcaatttctcatgttacaagcctgaagaatcccggaaatgcacgaaaaggatatttatggatcactctcggttgactggttctttcacagaggaaaatcttgaattccagcggaaaatccttgagagatctggccttggagactccacttaccttcctgaggctgtcctcaacattcctcccaacccttcaatgaaagaagctagaaaagaagctgaggctgtgatgttcggtgccattgatgagctattagctaaaacctctgtcaagcctaaggacattggaattttgattgtaaattgtagtctgttcaacccaactccatcactttcggcaatgattgtcaatcattacaagcttcggggtaatataaaaagctacaaccttggtgggatgggttgcagtgcagggctgatctcaattgatcttgctaaagatcttctccaggccaatcccaactcctatgcattggtcattagtatggagaatatcacgttgaactggtattttggaaacgatcgatcaaagcttgtttctaattgtttatttcgaatggggggagctgcagttttgctttccaataaaaactcggacagaagaagatccaaataccgattggtcaccacggttcgcactaataaggcagctgatgacaagtgctttagctgtgtaacccaagaagaagatgccgatggcaaggttggtgttactttgtcaaaagatcttatggcggttgcaggtgatgctttaaaaaccaatatcaccacactggggcctctagtacttccaacatccgagcagctactgttctttgccacgttagttgggaagaaaattctcaagatgaagatcaaaccttatattccagatttcaagctagcttttgaacatttttgcatccatgctggtggtagagctgttttggatgaactggagaaaaacttgcagctatccccttggcatatggagccatcaaggatgactctttatcgtttcggaaacacatccagcagttcgctttggtatgagctagcttatacagaagccaaagggaggatcagaaagggagatagaacatggcaaatagcattcggttctggattcaagtgtaacagtgccgtttggaaggctctcaggacaatcaaccctgctaaggagaagagtccttggatggatgagattgaccagtttccagtcgatgttcctagggtatcttccatttaatcaatgaaattttaaatatttgtgtatcactatcagcattaggttgtagctgttggactggtgaaaatctcctgcaaagttgttgtaatacattgttaatttcagagtattgtagggtttttattaggccaaaacttatatgcaatgttgttccttaggtgttcttggtgttgtttttaatctgaattagagttttaacttggtaacttatgttgatatttaatgcaaatctttaatatataaattactgagattaaattccaattctgatggaagaaat

SEQ ID NO: 2623 - DNA, 2210 bp, Papaver somniferum
gggggctgtttatattgcatccatcaaaccattggataagtaaaggtgtgacctttttcaatttctggattttttctgggcaatgttgttggagattcaataaattctaatcttaatccaaacaaaaaggattttttggttgtgttctgaaatctgcaatcaattttctttaaagggtttctttcgtttcctgatttaatctgagttgaccaaaatggcagacaacccaaaaccagaaacaacaccattgattagaacgaaatcagcaagaatacttccagatttcaaacaatcaatcaaactgaaatatgtaaagcttggttatcattatcttatcacccatggaatgtatttgtgtttatctcctcttgtagtactcattgcagctcaaatctctacattctcattaaaagaccttcatgatttatgggatcatcttcgattcaatcttatatctgtcattgtctgttcaacccttctggttttcttatccaccctttacttccttacaagaccaaggcctgtttatcttgttgacttctcttgttacaagcctgaggatgagaggaagtgcactagacagatctttatggagagatcagggttaaccggttcgtttaccgagcagaatcttgagtttcaaaggaaaattttggagagatcgggtcttggtgaatcgacttaccttccgcctgctgttcttagagttcctcctaatccgtctatggctgaagcgagaaaagaagctgagattgttatgtttggggcactggatcagttgtttgctaaaacttcgctcaagccgaaagatattggaattcttattgttaattgtagtttgttcaatccgactccatcgttgtctgccatggttattaaccattacaagcttcgaggaaatattgtgagttacaatttgggtgggatgggttgcagtgcaggtttgatctctattgatcttgcgaaagatcttcttcaagttcatccgaattcttatgctttggttatcagtatggaaaacattactttgaattggtattttgggaatgaaagatcgatgcttgtttcgaattgtttgtttagaatgggaggtgctgcaatcttgttgtcaaataagaactcagaaaggaggagatctaaataccagttggttcacactgttcgtacccataaaggagctgacgacaaatgtttttcatgtgttacccaagaagaggatccagctggaaaggttggtgtttctctatccaaagatctgatggctgttgcaggggatgctttgaaaaccaacatcaccacattaggacctcttgttcttccaatgtctgaacagttacttttcttcgctacattggttgggaagaaactctttaagatgaaaattaagccgtacattccagatttcaaattggctttcgaacatttctgcattcatgctggtggaagagccgtcttggatgaactggagaagaatttgcagttgtctgaatggcacatggaaccctctagaatgacgctttacagatttggtaacacttcaagcagttctctttggtatgaattggcttacacagaagctaaaggaaggatcaagaagggagacagaacttggcagatagcttttgggtctggtttcaaatgtaacagtgctgtttggaaggctttgaggaccataaatccagcaaaggaaaagaacccatggatggatgagattcaacagttcccagtcgacgttccaagggtcgcagcaatctaaatttaaaggttgttcttctaccgctcttggtttatcgaaaactgattattcttttgatggtttatatgaatggacaacaatctgaatgctgcacgctgctggagctctttggttgtgagatgcttgtcagggaaaaaggatatcagttaggattgataatttgtgtgagtgatgatttagactagaaatttgtgatatttatgttggttttctttgggtactgaaaattgtttgagtgttttttttactccattagggaatttgagttgtagaagcagattaagaagccgaaattgggttactcaggctaacttaattcatgacttatgtgggggaggagggaaagaagaagagggggtttagagagtgtgtctgtatttagaccctaattccatttagtggaattcaatagattcattattttgatctctgtttcaatcaactttgttatata

SEQ ID NO: 2624 - DNA, 1691 bp, Daucus carota
cagcctttgatcccaccatcttacttgcgaaaacttcctgattttaagcagtctattaagttaaagtatgttaaacttggctatcattaccttattactcatggaatgtacctatttttatcccctcttgtggttgttcttgcggctcaattgtctacattttcgctccgagatatctacattctttgggaccatttgaggttcaatcttatatcggtggttgtttgttcgacccttctggtctttctttcaaccctctacttccttacccgtcctcgccctgtttaccttgttaacttttcatgctataaacctgaagaggataggaaatgcacgaggcagactttcatggagaaatccaagctcacaggcaactttacggatgcaaaccttgattttcagaggaaaattcttgagaggtcaggtcttggcgaagatacataccttcctgaagctgtacttagagtacctccaaatccgtgtatggcggaagcaagaaaggaagctgaacttgtgatgtttggtgctatcgatgagctcttagcgaaaacctctctgaagccgaaagacattggggttctaattgtcaactgtagtttgtttaatcccaccccttctcttgcatctatggttattaatcattacaaacttcgagggaatatcttgagttataatcttggtgggatgggatgcagtgctggtttaatctcaattgatcttgccaaagatctacttcaagtacatcctaattcgtatgctctagtaattagcatggagaacatcaccctaaattggtattttgggaatgagaggtcgatgcttgtttccaactgcttgtttcgtatgggaggggctgccattctgctttcaaacaagagatcagatcgacaccgatccaagtatcagttggtccatactgtcagaacccacaaaggttctgatgataaatgcttttcttgtgttactcagatggaggatcctgttggaaaagttggagtcgctctgtcgaaagatctgatggcggttgctggggatgctttaaagactaatataactactcttggtcctcttgtgctgccaatgtctgagcagctgctcttctttgctacattggtcgggaagaaacttttcaggatgaagataaagccttacatcccagattttaaacttgcgtttgagcatttctgcattcatgctggaggaagagcagtgctggatgaactagagaagaatttgcagcttagcgattggcacatggaaccctcgaggatgactcttaaccgatttggcaacacctcaagcagttccttatggtatgaattggcatattcagaagcgaaagggaggatcaagaagggagatagagcatggcagatagcatttgggtctggattcaagtgtaacagtgctgtttggaaggctcttaggactctaaaccctgcaaaggagaaaagtccatggatggatgagattcacaaattcccggtagatgttcccaaggtatctgccgtctgaagttaaagcaaatactaattcattatcagccccattttataatgttgctcagaattgtgtcatgtatttatgtgatttgggtaattgggaattgactaaggcataagattacaagttgtaaccttgtgatagcctagattcgatcttattcatagggtagaagcgagttcagcttt

SEQ ID NO: 2625 - DNA, 3214 bp, Cocos nucifera
cggccattgagttttcttggcggagactggtcgagatttcggtcaaagccggccgcgccgccctcgttttttccgcaacccgcgaggtcgcataaaaaacaaacggaagcttctctggccccagcgatacgtggggcgcacacgttggcgcccatctcaccgtccatccgcttccccttccaaatccaaagcagacctctctttggtcttgggagggggccgaggagggctccttttggttatttatatgcctagtcggaccgctcttgatgtgccgcccggcttctctactctatttcttcgggtccctgctctggtcttccccaaggaggcggcttgtcggccgatttcctatcaggatcgggattcgagagttttgggctgatctctagtccttttcggagcagagaagcggccatctttttctcaaaagaacccccttttccatctgtctttgaaactggcttttaggttgggtcaaggagaaaaagagccattccctttcgacctctcaagtttctgatttctattgcttccacctcccataatccgatcatggccgaaccgttgatcgataaatcctccgcgagccggctccccagcttcacgcaatcggtgaagctcaagtacgtcaaactcggttaccactacctcatcacccatgccatgtacctcttcctcacaccactcctcctccttgtggctgcccagatctctaccttctccgtccaagacctccatgatctctgggaccacctccggtttaacctcgtctccgtgatcctctgctccacgctcctcgtcttcctctccaccctctacttcctcacccgccctcggccggtctatcttgtcgacttcgcatgctacaagccggaggaggcccggaggtgcaccaggcaaatctttatggagcggtctgcgctgacgggctccttcacagaagagaacctccaattccagcgtaagatcctcgaaaggtcaggccttggtgagaacacgtaccttcccgaggcggtcctcaatgttcctcctaatccctccatggctgaggccaggaaggaagccagagctgtcatgttcggcgccatcgacgaactattcgccaagaccaatgtgaagcccaaggacatcgggatcttggttgtgaattgtagcttgttcaatccaaccccctcgctctctgcgatggtggtgaaccattacaagcttcgcggaaacattctgagctatagcttaggtgggatgggctgcagcgcagggctgctttcgatcgatcttgccaaggatctgcttcaagttcaccccagcacctatgccttggtcatcagcatggagaacatcaccttgaactggtacttcggcaacaaccggtcgatgctcgtgtccaactgcttgttccggatgggcggggctgcaatccttctctccaacaggacttccgaccgccgccgctccaagtaccaattggttcacacggttcgaacgcacaaaggtgccgatgataagtgctttagctgtgtcacccaggaagaggatgctaatgggaagattggtgtatctctttcgaaagacctgatgggagttgctggcgatgccttgaagaccaacatcacgacattgggtccccttgtcttacccatgtccgaacagttgctcttctttgctacattggtggggaggaagatcctcaagatgaagattaggccctacatccctgacttcaagttggccttcgaacatttctgcattcatgctgggggaagggctgtgttggatgaattggagaagaacttgcagctttcggagtggcacatggagccttcgaggatgacactctacagatttggaaacacttcaagcagttccctctggtacgaactggcatacaccgaagggaaaggaaggattaggagaagggatagaatttggcagatcgcattcggatcgggattcaagtgcaacagtgcggtatggaaggctttgaagacgatcgatcctgcaaaggaaaggaacccctggatggatgagatccacaacttcccagttgaggttccaagggtatcggcaatttgaatcaatagtcctgccggggatgcgagttgcatgtccctgacgtctcttttttattttattttgaaagaaaaaactcggagttgttgagtataatctatggggcgtttggaggttgattcttatcatgcggggagaactttagtaacaaggttattccacctttgtggtgcagccatgcaggataggatcattgattcaaaacatgagtggcctggattgctagactaggagtaggttcagggatgaattttatcgtgtggtttaatttatgcacaggcttgagccattgactctgcttgtttggtctacaattttaattcttcgttcaaaacttgcagctccgagtaaggttggaacttatttgtcatatattttttcaacccacagttgtcggtgtgtttttgttaacgactagatttatcccaacaatatgaggtccatgacaggtcattcgtatgaaagctaattgcttggtcaacgtcttttctttatgatattgtcatgttcttagatcctctagcttgtttgtctatccatattacagctcaaaatatgtggaaaattgcgaacatctgcgcggccaaggccatggacagcatgattttgctgtgctgctgatgctgcttcgtttttctttctttgaagaaacaaagacttggaaggggttcttctaaccccatcctctatagaaaagcaaaagcctcttgaatcttcatcggcaagcagctacttttcataggctggacggaatgaaaggcaaagcgacgtcaatacccaccctcccgaagcccaggttccagacataactatgtttggcgcttgcaaagctaaaatgtcaacactgaatacgggagaattcgaggcacacctttcataatcgaacccatatcacttgtctcaaactgtaatgatgtataccatccgaactaatgctcggtgctgtagttctacctttttctcaaagcagcctttaatcaaaagagacaattcacatgtgtgcttctacgaggagatattataatattcctaccgttgtctccaggtccaaaatttggaggtccaaatattccttaccttatttcgtggtaccttccggcttggcctatattcgcgtcctagaatccttctgggtaacttc

SEQ ID NO: 2626 - DNA, 2498 bp, Theobroma cacao
ttgccgtctgccttttttctttctctctctctcttagcattttctaaatttaaaagagatgggaagcaaaagtgatactatagccagttaccaagaaactggcagcaacgggctgaaaccaagcggagccgtctgattgaaaacgacaacgtgtttttggccgtgaaccccgagagagaatacggtcaaacgtttccaaaccccagacggcgccgcctcttcaattcaaaacgcgtccattacgccactttcttcgtcggttttgtcatcattttcccatttcccttcacgttccctttttgtttttggtttatttttctattttggcagaaacggttttcattttttatttacaattgatgattcggtgctttttaaggtttactgtacttgattcgtttcaaattttttaatatccgttgatctctcttctctctttcaacgcacttacgcgcctcttatttgtagtcttttcttttagcatctctctcccttcctctctgtctccgtggtatttcttgaatagattcaattatcaagcgaccctttggtggcttttggggatcaagggaaaagatggctgagtccaaaccggaacaacctttgatcccatcatcatcatcatcatcatctcgaaaccttcctgattttaagaaatccgttaagctaaaatatgtgaagcttggataccattacctaatcacccatggaatgtacctcttcctttcccctcttgtagttgtaatagctgcacagctctcaacattttctatccaggacctttatgatctttgggagcatcttcaatacaacctcatttctgtgatcatctgctctactcttcttgttttcctatcaaccctctactttctaactcggccccgtcctgtttaccttgttaattttgcttgctacaaaccagaggaatctcggaaatgcacaaagaggatcttcatggatcagtctcgaatgactggtacatttacagaggagaatcttgagtttcagcgtaagatccttgaaagatctggacttggggattcaacttaccttccagaggcagtcctcaatattccccctaacccatcaatgcaagaagctaggaaagaagcagaggctgtaatgtttggtgctattgatgaacttttggctaagaccgctgtaaaacccaaagatattggaattttagttgtaaattgtagcttgttcaatccaacaccgtcattgtctgccatggttatcaaccattacaagcttcgaggaaatatacaaagttacaatttgggaggaatgggctgtagtgcaggtttaatttcaatagatcttgctaaaaatcttcttcaagtccatcccaactcctatgcattggttatcagcatggagaacatcaccttgaactggtactttgggaatgatcgctcaaaacttgtttcaaactgcttgtttaggatgggaggcgctgcaatattgctctcgaacaaacgctctgacagaagaagatccaaatatgaattggttcacactgtgcgcactcacaagggtgctgatgataagtgcttttcctgtgttacccaggaagaagactctgcggggaaggttggtgttacattgtcaaaggatctgatggcagttgctggtgatgctttaaagaccaacatcaccacattgggacctctggtcttgccaatgtccgagcagctgcttttctttggtacattggttgggaagaaactatttaaaatgaaagttaagccatacattccagatttcaagctagcttttgagcatttctgcattcatgctggaggaagagccgttttagatgaactggagaagaatttgcagctgtctgagtggcacatggaaccatcaagaatgactctttaccgatttggcaatacctccagcagttctctttggtatgaattggcttattcagaagctaagggtaggattaggaagggggatagaacatggcaaatagcatttggttccggattcaagtgtaacagtgcagtgtggaaggctttgagggcagtgaatccagctaaggagaaaaacccatggatggatgagatcgatagattccctgttgatgtcccaagggtctcatccatctaaattcaggaatcagttgctgcgggcttcatgtaatgctgtcttgcttttgtgattcatcctttccatgacaggatgactagtagtttcagcgcattgagtgcaggacatcttgcatttattatctagtttttagttatttcagggctgtaccattgtgcagcttgagtgagattaattcttggtgtaacaactttgggaatcattgattttatgggaatattactggctcgttttcctaagatcaatttgcgtggcttttatgtttctcatcctatgatccagatagaaactaggattggaagttgtaaataatttaatttttgagcagttatttagactggtgcttttgatctttatatggtaagcaatggttcaca

SEQ ID NO: 2627 - DNA, 2037 bp, Gossypium raimondii
aaatttcttaaaccaagcacagcttaataccggtactttatatagtcgtttttatatttatcatttctctttctctctctctctctctctctccgaggccgttcctgtatagatttgagtgaccttggttgggttttggggattaaggtaaaatatgactgattcaaaaccagagcaaccattgatcccatcatcgtctcggaagctacctgattttaagaaatcggttaagctaaaatatgtgaagcttgggtaccattacttgatcacccatggaatgtatctcttcctttcccctcttgtagttgtaatcactgcacaactctcaacattttctatcctggatctttatgatctttgggagcatcttcaatacaatctcatatctgtcatcatctgctcgactcttcttgttttcttgtcgactctctactttctcactcgtcctcgtcctgtttaccttgtcaactttgcttgctataaaccggatgaatctcggaaatgccccaaaaggatcttcatggatcggtctcaattggccggtaccttcacagaggaaaatcttcagtttcagcgtaagattcttgaaaggtccgggcttggcgaggagacatatcttccagaggctgtcctcaatgttccacctaacccatcaatgaaagaagctagaaaagaagctgagattgttatgtttggtgctattgatgaacttttggctaagacctccgtaaaacccaaagacattggaattttggttgtgaactgcagcttgtttaatccaacgccatctttgtctgccatggttatcaaccattacaagcttcgagggaatattcaaagctacaacttgggaggaatgggctgtagtgctggtttgctctcaatagatcttgcaaagaatctacttcaagtccatccgaactcctatgcactggttatcagcatggagaacatcaccttgaactggtacttcggaaatgatcgctcaaaacttgtttcaaactgcttattcaggatgggaggcgcggcaatactgctctctaacaaacgctctgacagaagaagatccaaataccaattggttcacactgttcgcactcacaagggtgcggatgataagtgctttgcttgtgttacacaggaagaagactctgcaggaaagattggtgttacattgtcaaaggatctcatggcagttgctggtgatgctctaaagaccaacatcaccacattggggcctctggttcttccgatgtctgagcagctgcttttctttgctacattggttggaaagaagcttttcaaaatgaagatcaagccttacattccagatttcaagctagcttttgaacatttctgcattcacgctggaggaagagctgttttggatgaactggagaagaatttgcagctctccgaatggcatatggaaccatcaagaatgactctcttccgatttggcaacacctcaagcagttctctgtggtatgaattggcatattcggaagctaagggtaggattaggaaaggggacagaacatggcaaatagcatttggttctggattcaaatgcaacagtgctgtatggaaagctttgaggaccgtaaatccagcaaaggagaaaaacccatggatggatgagatccagaatttcccagttgatgttccaaaggtatcatccatctaatttccagacttgctgctgttgtggtaaaattttcataacataatgagtggtagtttcagcattgactaagtaaatcttgcatttagatatctggtttcaagtatagcttgagtgggattactaatgtgtaacaaattagggatgcattgatttgagggtgttatggaaaaaccatcagagcttttttttttttaccaatatcactgcatgagaggcctgggatatgtatcaagattttatcgtatgatccagagattgaattggaatgagaaataactcaaatttggttgatcttcaattcaatttatttatgtagccaacgctttgattattaactgtggttgattaag

SEQ ID NO: 2628 - DNA, 2138 bp, Citrus clementina
ccgaaaatgcatgaaaactctgttcagggattttaaatctccttcgggcttcattttctgattcagtgcttcaaaatttgatttttgatctatttttctgttctatcaaccttttgtgaaatacccctttcgttatttcattttggtgccgtttctatctcattaattcctctttcaggattcttgcttttgtcaaattttgatcagttttaagttcctacaaaatgcctgattcagttcactacaaatccttgattcaaccttcttgttctcgaaaacttcctgatttcaagcaatctgtgaaactgaaatacgttaagcttggctaccattatgttattactcatggaatgtacttgtttttgtcaccccttgttgctcttattgctgctcaactctcgacattctcaattcaagatatctatgacctttgggaacatcttaggttcaatttcatatctgtgatcctgtgctccacactgcttgtgtttttgtcgaccctttactttctaacccgtccccagcccgtttatcttgtcaattttgcttgttataagccagaggatgctaggaaatgtactaggcagatttttatggaaaggtccgggttaacaggaactttctctcaggagaatcttgatttccagaggaaaattcttgagaggtcaggccttggagagtcaacatatctccctgaagccgtgttgagggttcctccgaatccttgtatggcagaggcgagaaaggaggccgagtatgtaatgtttggtgcacttgatgagttgtttgcaaaaacatctttgaaaccaaaagatattgggatcttgattgtgaattgtagcttgtttaatccaacaccttcattgtctgctatggttataaatcactacaagctcagagggaatattgttagttataatctgggtggtatgggttgcagtgctggtttgatctccattgatcttgcaaaagatcttctccaagtccatccaaattcctatgctttggtcattagcatggagaacattacattgaattggtattttgggaatgagaggtcaatgcttgtatcaaattgcttgtttagaatgggaggggctgcaattctgctttcaaacaagagatctgatcgatggcgatccaagtacagattggtccatactgttcggacacacaaaggtgctgatgataagtgcttctcttgtgttacccagcaagaggatcctactgggagaataggagtgtctttgtcaaaggatctgatggcagttgccggggatgctttgaagactaatatcacaaccttgggccctcttgtgttgccgatgtctgaacagttgctcttctttgccacattggttgcaaggaaagttttcaagctgaaaattaagccttacatcccagatttcaagttggcttttgagcatttctgcattcatgctggagggagagcagtgctggatgaattggagaagaacttacagctttcggataggcatatggagccttcaaggatgacactatatcggtttggtaacacttcgagcagctctctttggtatgaattggcttatagtgaagctaaggggagaataaagaggggagacagaacgtggcagatagcatttggatctggtttcaagtgtaacagtgcagtttggaaggctttgcgaacaattaatccagctaaggagaagaacccatggatggatgagatccaccagttcccagttgatgttccaaaggtttcaaccatctagtatttatgatagtaacttgttcccatttcatttgcattgtctttttgagtgatgaaaagatgattgcattggtgaggtcctctatgttcggaatttattgtatttccgctgtagttgaatgcttgtgttgggatctgatgttgcatttggtaggaaatttaaggataattttggttatggattcaccacggcatttaggttgattagtttagttctagtgagaatatggaatttgggaagctagtgatattctcgcaactttacaagtaattctttgtttcttggaacttgggaaccagatgaggattaggcttactatttcatgacaacaaattcttcatgggggattatagagcaacattccactttgtattcatc

SEQ ID NO: 2629 - DNA, 1874 bp, Gossypium hirsutum
aggccgttcctgtatagatttgagtgaccttggttgggttttggggattaaggtaaaatatgactgattcaaaaccattgcaaccattgatcccatcatcgtctcggaagctacctgattttaagaaatcggttaagctaaaatatgtgaagcttgggtaccattacttgatcacccatggaatgtatctcttcctttcccctcttgtagttgtaatcactgcacaactctcaacattttctatcctggatctttatgatctttgggagcatcttcaatacaatctcatatctgtcatcatctgctcgactcttcttgttttcttgtcaaccctctactttctcactcgtcctcgtcctgtttaccttgtcaactttgcttgctataaaccagatgaatctcggaaatgccccaaaaggatcttcatggatcggtctcaattggctggtaccttcacagaggaaaatcttcagtttcagcgtaagattcttgaaaggtccgggcttggcgaggagacatatcttccagaggctgtcctcaatgttccacctaacccatcaatgacagaagccagaaaagaagctgagattgttatgtttggtgctattgatgaacttttggctaagacctccgtaaaacccaaagacattggaattttggttgtgaactgcagcttgtttaatccaacgccatctttgtctgccatggttatcaaccattacaagcttcgagggaatattcaaagctacaatttgggaggaatgggctgtagtgctggtttgctctcaatagatcttgcaaagaatctacttcaagcccatccgaactcctatgcactggttatcagcatggagaacatcaccttgaactggtacttcggaaatgatcgctcaaaacttgtttcaaactgcttattcaggatgggaggggcggcaatactgctctctaacaaacgctctgacagaagaagatccaaataccaattggttcacactgttcgcactcacaagggtgcggatgataagtgctttgcttgtgttacacaggaagaagactctgcaggaaagattggtgttacattgtcaaaggatctcatggcagttgctggtgatgctctaaagaccaacatcaccacattggggcctctggttcttccgatgtctgagcagctgcttttctttgctacattggttggaaagaagcttttcaaaatgaagatcaagccttacattccagatttcaagctagcttttgaacatttctgcattcacgctggaggaagagctgttttggatgaactggagaagaatttgcagctctccgaatggcatatggaaccatcaagaatgactctcttccgatttggcaacacctcaagcagttctctgtggtatgaattggcatattcggaagctaagggtaggattaggaaaggggacagaacatggcaaatagcatttggttctggattcaaatgcaacagtgctgtatggaaagctttgaggaccgtaaatccagcaaaggagaaaaacccatggatggatgagatccagaatttcccagttgatgttccaaaggtatcatccatctaatttcgagacttgctgctgttgtggtaaaattttcataacataatgagtggtagtttcagcattgactaagtaaatcttgcatttagatatctggtttcaagtatagcttgagtgggattactaatgtgtaacaaattagggatgcattgatttgagggtgttatggaaaaaccatcagagttttttttttaccaatatcactgcatgagaggcctgggatatgtatcaagatttcatcgtatgatccagagattgaattggaatgagaaataactcaaattt

SEQ ID NO: 2630 - DNA, 2138 bp, Citrus sinensis
ccgaaaatgcatgaaaactctgttcagggattttaaatctccttcgggcttcattttctgattcagtgcttcaaaatttgatttttgatctatttttctgttctatcaaccttttgtgaaatacccctttcgttatttcattttggtgccgtttctatctcattaattcctgtttcaggattcttgcttttgtcaaattttgatcagttttaagttcctacaaaatgcctgattcagttcactacaaatccttgattcaaccttcttgttctcgaaaacttcctgatttcaagcaatctgtgaaactgaaatacgttaagcttggctaccattatgttattactcatggaatgtacttgtttttgtcaccccttgttgctcttattgctgctcaactctcgacattctcaattcaagacatctatgacctttgggaacatcttaggttcaatttcatatctgtgatcctgtgctccacactgcttgtgtttttgtcgaccctttactttctaacccgtccccagcccgtttatcttgtcaattttgcttgttataagccagaggatgctaggaaatgtactaggcagatttttatggaaaggtccgggttaacaggaactttctctcaggagaatcttgatttccagaggaaaattcttgagaggtcaggccttggagagtcaacatatctccctgaagccgtgttgagggttcctccgaatccttgtatggcagaggcgagaaaggaggccgagtgtgtaatgtttggtgcacttgatgagttgtttgcgaaaacatctttgaaaccaaaagatattgggatcttgattgtgaattgtagcttgtttaatccaacaccttcattgtctgctatggttataaatcactacaagctcagagggaatattgttagttataatctgggtggtatgggttgcagtgctggtttgatctccattgatcttgcaaaagatcttctccaagtccatccaaattcctatgctttggtcattagcatggagaacattacattgaattggtattttgggaatgagaggtcaatgcttgtatcaaattgcttgtttagaatgggaggggctgcaattctgctttcaaacaagagatctgatcgatggcgatccaagtacagattggtccatactgttcggacacacaaaggtgctgatgataagtgcttctcttgtgttacccagcaagaggatcctactgggagaataggagtgtctttgtcaaaggatctgatggcagttgctggggatgctttgaagactaatatcacaaccttgggccctcttgtgttgccgatgtctgaacagttgctcttctttgccacattggttgcaaggaaagttttcaagctgaaaattaagccttacatcccagatttcaagttggcttttgagcatttctgcattcatgctggagggagagcagtgctggatgaattggagaagaacttacagctttcggataggcatatggagccttcaaggatgacactatatcggtttggtaacacttcgagcagctctctttggtatgaattggcttatagtgaagctaaggggagaataaagaggggagacagaacgtggcagatagcatttggatctggtttcaagtgtaacagtgcagtttggaaggctttgcgaacaattaatccagctaaggagaagaacccatggatggatgagatccaccagttcccagttgatgttccaaaggtttcaaccatctagtatttatgatagtaacttgttcccatttcatttgcattgtctttttgagtgatgaaaagatgattgcattggtgaggtcctctatgttcggaatttattgtatttccgctgtagttgaatgcttgtgttgggatctgatgttgcatttggtaggaaatttaaggataattttggttatggattcaccacggcatttaggttgattagtttagttctagtgagaatatggaatttgggaagctagtgattttctagcaactttacaagtaattctttgtttcttcgaacttgggaaccagatgaggattaggcttactatttcatgaagacaaattcttcatgggggattatagagcaacattccactttgtattcatc

SEQ ID NO: 2631 - DNA, 2958 bp, Petroselinum crispum
aaaaaacatttctcaataagaatttaaaaagcaagtgcatcatctcattttagtcgccccaaaaatctggactacactgattgtctcgcaaggtcgagttggatccactctgtccccctcaaggtctgctcttctcttttcttcatctgggccactttattttcctcatttatcatctgggtttatctcaattttatatatgcttctctcatttcttgttcttttagatcttgtatgtgtatatatataaagattgtatgtacatgtttatacatttgcttttatgtttaaagtttgaatcttcatgctgttttgttgatttgcagggagtttgagctgcgttttcttgattcttttggttaacattaggaatttttagaaacccttttttgttatcagcctttaatcttcatatctagtattttatatggttattttttgatccttgatttgaaatttgggtctaatcttgatttggtaattgtttgagtttattagaggatttgcgttattcataaattctggttttagccccttcttttttgaattgttagcaaaatgagtgaagcacaggtgagccatcctttgatcccaccatcttatttgcggaaactacccgattttaagcaatctatcaagttaaagtatgttaaacttggttatcattaccttattactcatggaatgtacctatttttatcccctcttgtggttgttcttgcggctcaattgtcaacattttcactccaagatatctatattctttgggaccatttaaggttcaatcttatatcggtggttgtgtgttcgacccttcttgtctttctatcaaccctttatttccttacccgccctcgccctgtttaccttgtgaacttctcgtgctataaacctgaagaggatcgaaaatgcacgaggcagacttttatggagaaatccacgctgacaggcaactttacggatgcaaaccttgatttccagaggaaaattcttgagcggtcaggtcttggtgaagacacatacctccctgaagctgttcttagagtacctccaaatccatgtatggcggaagcaagaaaagaagctgaacttgtaatgttcggtgccattgatgagctcttagcaaaaacctccctgaagccgaaagaaattggaattttgattgtcaactgtagtttgtttaatcctactccctctcttgcgtctatggttatcaatcattataaactaagagggaacatcttgagttataatcttggtgggatgggttgcagtgctggtttgatctccattgatctagctaaagatctgcttcaagtccatcccaattcgtatgctctagtaatcagcatggagaatatcactttgaattggtattttggaaatgagaggtcgatgcttgtttccaattgcttgttccgtatgggaggggctgctattctgctttcaaacaaaaggtcagatcgacgtcgatccaagtaccagctggtccatactgtcagaacccacaaaggttctgacgacaaatgcttttcttgtgttactcaaatggaggatcctgttggaaaagttggtgttgctttgtcaaaggatctgatggcggttgctggggatgctttaaagaccaatataactacacttggtcctcttgtgctgccaatgtctgaacagctgctcttctttgctacactggtcgggaagaaactgttcaggatgaagataaagccttatatcccagattttaaattggcgttcgagcatttctgcattcatgccgggggaagagctgtgttggatgaactagagaaaaatctgcagctcagtgattggcatatggagccctcaaggatgacactcaaccgatttggcaacacctcaagcagctccttatggtatgaattggcatattcagaagcaaaagggaggatcaagaggggagatagagcatggcagatagcattcggttctggatttaaatgtaacagtgcagtttggaaggctctgaggactcttaatcctgcaaaggagaaaagtccttggatggatgagattcacaaattcccggttgatgttccaaaggtctctgctgtctgacgtctaggcaaactatattctattaccaattgcatttttatagaatcttgcttcgtgtcaaattaattgagttacttgggtagtggggaattgactagagcatgtctggtagtggttgaagatttatcatgtttgtttaagattacaaattgtaacctggtgataaccaaaatttattcttatttattggcagacatgaagttgtctatagttttattatattggcatgattaatcattttggggccagactttaaagagctcgtacttctttcttaactgttttatgatgattgtgggagttcattcacattcatgtttcctcctattattttatgttcatgatttgtagttctatatatgttaagtgggttaattcctgatgcttggatgttagtattttgatagtcccagctgctcactgccattgctgatttgtttatgtagtctgtgagtttattgttttgcttctatactcttttctttggcaccgaggtcttgtttccttaagtgctgcctgtttatatattctctttctggaaactgttcttcgggtgttccttatctgacacttgcatccttgtttggtaatatggccgagaatccatatatcttggttgttttttggggtaataacatattactgagggaaggagaatatttttccaagatgtcttggtttctgttgagtgcacatagaatccttagtttcacctgctattgtttgcagccgtgtccgaagaaggcccgatagaaatatttactgtccatggagcttgaaattggagatgctcaccgacactgatatgattactcaaaacatgaatgcatttgtgaacatgataaaagccaaaaactaaacttt

SEQ ID NO: 2632 - DNA, 1820 bp, Gossypium hirsutum
ggtaaaatatgactgattcaaaaccagagcaaccattgatcccatcatcgtctcggaagctacctgattttaagaaatcagttaagctaaaatatgtgaagcttgggtaccattacttgatcacccatggaatgtatctcttcctttcccctcttgtagttgtaatcactgcacaactctcaacattttctatccaggatctttatgatctttgggagcatcttcaatacaatcttatttctgtcatcatctgctcgactcttcttgttttcttgtcgactctctactttctcactcgtcctcgtcctgtttaccttgtcaactttgcttgctataaaccggatgaatttcggaaatgccccaaaaggatcttcatggatcggtctcaattggccggtaccttcacagaggaaaatcttcagtttcagcgtaagattcttgaaaggtccgggcttggcgaggagacatatcttccagaggctgtcctcaatgttccacctaacccatcaatgaaagaagctagaaaagaagctgagattgttatgtttggtgctattgatgaacttttggctaagacctccataaaacccaaagacattggaattttggttgtgaactgcagcttgtttaatccaacgccatctttgtctgccatggttatcaaccattacaagcttcgagggaatattcaaagctacaacttgggaggaatgggctgtagtgctggtttgctctcaatagatcttgcaaagaatctacttcaagtccatccgaactcctatgcactggttatcagcatggagaacatcaccttgaactggtactttggaaatgatcgctcaaaacttgtttcaaactgcttattcaggatgggaggcgcggcaatactgctctctaacaaacgctctgacagaagaagatccaaataccaattggttcacactgttcgcactcacaagggcgcggatgataagtgctttgcttgtgttacacaggaagaagactctgcaggaaagattggcgttacattgtcaaaggatctcatggcagttgctggtgatgctctaaagaccaacatcaccacattggggcctctggttcttccgatgtccgagcagctgcttttctttgctacattggttggaaggaagcttatcaaaatgaagatcaagccttacattccagatttcaagctagcttttgaacatttctgcattcacgctggaggaagagctgttttggatgaactggagaagaatttgcagctctccgaatggcatatggaaccatcaagaatgactctcttccgatttggaaacacctcaagcagttctctgtggtatgaattggcatattcggaagctaagggtaggattaggaaaggggacagaacatggcaaatagcatttggttctggattcaaatgcaacagtgctgtatggaaagctttgaggaccgtaaatccagcaaaggagaaaaacccatggatggatgagatccagaatttcccagttgatgttccaaaggtatcatccatctaatttccagacttgctgctgttgtggtaaaattttcataacataatgagtggtagtttcagcattgactaagtaaatcttgcatttagatatctggtttcaagtatagcttgagtgggattactaatgtgtaacaaattagggatgcattgatttgagggtgttatggaaaaaccatcagagcttttttttttaaaccgatatcactgcatgagaggcctgggatatgtatcaagattttatcgtatgatccagagattgaattggaatgagaaataactc

SEQ ID NO: 2633 - DNA, 2572 bp, Capsicum annuum
tcttggctgccccacaaacaagtgtatgtacaactatacaacattgttgtaatttctcattgtgttgcctcctccatgcactctctttattatttattataaacctcattatatctctattttcaaatcaccattctctctcattctctctcatacagacacacagtacataggaatctccgttgtgggctgtttgggtttgtctgcgttgacataagatggttctctaattttggactgagtgaggttttaaatcccatttcttgttagatctgtctgtttttagaaaccccttgttgttgttaaacccttagaccttgtaaaaattcaatcttggaacttcctataacctttggaccttataaccttataaaaattcaatcttagatcagtgagtaaccttttgagcttaaagattccaattttgtatccttgaacttcctattgtctgtagagtttgttgagttcatcaaaatgagtgaatccaaaccagaagtgccagttaacaaccccccttcttatgcaagaaactttcctgatttcaaacaatctgtgaagctgaagtatgtgaaacttggttatcattacctcattactcatggaatgtacctatttttatcccctttagttattgtccttgctgctcaactctctacattttcgcctagtgatttgtatgtcctttgggagcagcttaggttcaatctcatatctgtggtcatttgttctacccttttggtcttcttgtccaccctctatttcctaacccgtcctcgtcctgtataccttgttaacttctcgtgctataagcctgaagatgctaggatatgcacaaggaagattttcatggagaggtctaagttgactggttcgttccctgatgaaactcttgagttccagaggaaaattcttgagaggtctggccttggtgaatcaacgtatctccctgaagctgtgcttagggtaccaccaaatccatgtatggcagaagcacgaaaagaagctgagactgttatgtttggtgccattgacgagctccttgctaaaactggtgttaagccaaaggatattggaattcttgttgtaaattgcagcttgtttaatccgacaccctcgttgtctgcaatgattgtgaaccattacaagcttcgtggaaacatcgttagctacaatctaggtggaatgggttgcagtgccggtttaatctcaatcgatcttgcaaaagatcttcttcaagtccaccccaacacatatgccttggtgctcagcatggaaaacatcaccctgaactggtattttgggaccgagaaatccatgctgcttccaaattgcttattccgtatgggaggtgctgctgtattgctctccaacaaaggatctgagcgaagaagatcaaagtaccagttggtgcatactgtcagaactcacaaaggttctgatgacaagtgcttttcttgtgtttaccaaatggaagatcccaatggaaaagttggagtatctctgtcgaaggatttgatggcagtagctggcgatgctctaaagaccaatatcaccacattgggtcctcttgtgcttcccatgtccgagcagttgcttttcttcgccaccctcgtgggaagaaaacttttgaagatgaagatcaagccttatatcccagattttagattggcctttgagcatttctgcattcacgccggtggtagagctgtgttagatgaaatagagaaaaacctccacctcactgactggcacatggagccttcaaggatgacattgtatcgatttggaaacacctcaagcagttccctttggtatgaattggcctactcagaagctaagggaaggatcaagaggggagaccgaacttggcagatagcatttggttcagggttcaaatgtaacagtgcagtttggaaagccttacgatcaattaatccggccaaggagaagaacccgtggatggatgagatcgaccaattccccgtggatgttccaaggattgcaaaaatctaacaatccaatggcgctttcgtttagtatagtgttccatcaaaatcgcagatgattattcttttatcagttgccatgtgccatgatgtgctgttcagttgtttccttgtgattctcaagttagtctatagctgatctaattctatttgagaagcttagatagggaattctacttgctatcaaatgtattatgaggatcaagtaagtgttattctcattttgatgtttctggatatcgagtttaggatcattaacttattgttaatttggaattcagagggtaattactgaatatctatgagttgatattcgtgtacctatttcttattcgtgatttatcctagagaattattcatcatgtaatgttgattgtttaatcagtgcaacacaatgtggacagcagttgttaatgtgtcaatgtggacaacacaatgttttcaatatccattcccttattcattgaaaagatactaaagaaaacgaaacaaaatttctcttgtttttctttttttggaagaaaaattaggtgaagttacaacaacattccccagtgtaaacccac

SEQ ID NO: 2634 - DNA, 2136 bp, Petroselinum crispum
agggagtttgagctgcgttttcttgattcttttggttaacattaggaatttttagaaacccttttttgttatcagcctttaatcttcatatctagtattttatatggttattttttgatccttgatttgaaatttgggtctaatcttgatttggtaattgtttgagtttattagaggatttgcgttattcataaattctggttttagccccttcttttttgaattgttagcaaaatgagtgaagcacaggtgagccatcctttgatcccaccatcttatttgcggaaactacccgattttaagcaatctatcaagttaaagtatgttaaacttggttatcattaccttattactcatggaatgtacctatttttatcccctcttgtggttgttcttgcggctcaattgtcaacattttcactccaagatatctatattctttgggaccatttaaggttcaatcttatatcggtggttgtgtgttcgacccttcttgtctttctatcaaccctttatttccttacccgccctcgccctgtttaccttgtgaacttctcgtgctataaacctgaagaggatcgaaaatgcacgaggcagacttttatggagaaatccacgctgacaggcaactttacggatgcaaaccttgatttccagaggaaaattcttgagcggtcaggtcttggtgaagacacatacctccctgaagctgttcttagagtacctccaaatccatgtatggcggaagcaagaaaagaagctgaacttgtaatgttcggtgccattgatgagctcttagcaaaaacctccctgaagccgaaagaaattggaattttgattgtcaactgtagtttgtttaatcctactccctctcttgcgtctatggttatcaatcattataaactaagagggaacatcttgagttataatcttggtgggatgggttgcagtgctggtttgatctccattgatctagctaaagatctgcttcaagtccatcccaattcgtatgctctagtaatcagcatggagaatatcactttgaattggtattttggaaatgagaggtcgatgcttgtttctaattgcttgttccgtatgggaggggctgctattctgctttcaaacaagaggtcagatcgacgtcgatccaagtatcagttggtccatactgtcagaacccacaaaggttctgacgacaaatgcttttcttgtgttactcaaatggaggatcctgttggaaaagttggtgttgctttgtcaaaggatctgatggcggttgctggggatgctttaaagaccaatataactacacttggtcctcttgtgctgccaatgtctgaacagctgcttttctttgctacattggttgggaagaaactgtttaggatgaagataaagccttatatcccagatttcaaacttgcatttgagcatttctgcattcatgctggaggaagagctgtgttggatgaattagagaagaatctgcagcttagcgattggcacatggagccctcgaggatgactctgaaccgatttggtaacacctcaagcagttccctttggtatgaattggcgtattcagaagcgaaagggaggatcaagaagggagatagagcatggcagatagcatttgggtctggattcaagtgtaacagtgctgtttggaaggctcttaggactttaaaccctgcaaaggagaaaagtccatggatggatgagaattgagattcaaaaattcccggtagatgttccgaaggtatctgctgtctgaagtctaagcaaatgttaattcatatcagctgcagtttatataatgttgctcagaattctgtcattaattatgttattggggggtaatggggaattgactttatcatgtactcatacttgtttgtttaagattacaaatcgtggccaggtgttaacctagattcaatcttatttgttgggaaaatttgagtttagctatcaactgtgagttgtgacattgtcttggatattcgtgtgcttaaattttgtcccgcgcctctcttctaactgtttaatgatgatgattcagaaaattcagatagtacattgtcttggagtataattttattttcatgatttgtagtttctatatatatgttg

SEQ ID NO: 2635 - DNA, 2362 bp, Petroselinum crispum
tctctctctcatttggtttcttctcattttataccccatttgtttttccctgatctcatctctaatctctcaactacacttcattacatgtttttactttaaagtttgaatctttaagtcaattgggcctttatttctgcattttcttgattatttcttgattcatttcctatttagtagcctcttttagttttttatagttgtcttttatatcttatttgttgaatcttgatttgaatatgtgggctaatcttgattttgtatttatttgagtttatccaaggatttggttagttctcaaatttaagttttagcccaatttcttgaattcttgtttagcaaaatatttttatagaatttgaaagtgttagcaaaatgagtgaagcaaaagtggagcagcagcagcctttgatcccaccatcttatttgcgaaaacttcctgattttaagcaatctatcaagttaaagtatgtgaaacttggttatcattgtcttataactcatggaatgtacctatttttatcccctcttgttgttgttcttgctgctcaattgtctacattttcacttcaagatatctatattctttgggaccatttaaggttcaatcttatatcggtgattgtgtgttcgactcttctagtttttctgtcgaccctctatttcctcacccgtcctcgccctgtttaccttgtgaatttctcatgctataaacctgaagtggaacggaaatgtacgaggcagacttttatggagaaatccacgcttactggtaactttactgatgcaaaccttgattttcaaaggaaaattcttgaaaggtcaggtcttggtgaagacacatatcttcctgaagctgtgcttagagtacctccaaatccatgtatggcggaagcaagaaaagaagctgaacttgtaatgtttggtgccattgatgagctcttagcgaagacctctatgaagccgaaagatattgggattttgattgttaactgtagtttgttcaatcctactccttctcttgcctctatggttataaatcattacaaacttcgagggaatatcttgagttataatcttggtgggatgggttgcagtgctggtctaatctcaattgatctagctaaagatctgcttcaagtccatcccaattcgtatgctctagtaattagcatggagaacatcacactgaactggtattttggaaatgagaggtcgatgcttgtttctaattgcttgttccgcatgggaggggctgccattctgctttcaaacaagagatcagatcgacgccgatccaagtatcagttggtccatactgtcagaacccacaaaggttctgatgatagatgcttttcatgtgttacgcagatggaggatcctgctggaaaagttggagtggctttgtcaaaggatctgatggcggttgctggggatgctttaaagaccaatataactactcttggtcctcttgtgctgccaatgtctgaacagctgcttttctttgctacattggttgggaagaaactgtttaggatgaagataaagccttatatcccagatttcaaacttgcatttgagcatttctgcattcatgctggaggaagagctgtgttggatgaattagagaagaatctgcagcttagcgattggcacatggagccctcgaggatgactctgaaccgatttggtaacacctcaagcagttccctttggtatgaattggcgtattcagaagcgaaagggaggatcaagaagggagatagagcatggcagatagcatttgggtctggattcaagtgtaacagtgctgtttggaaggctcttaggactttaaaccctgcaaaggagaaaagtccatggatggatgagattcacaaattcccggtagatgttccgaaggtatctgctgtctgaagtctaagcaaatgttaattcatatcagctgcagtttatataatgttgctcagaattctgtcattaattatgttattggggggtaatggggaattgactttatcatgtactcatacttgtttgtttaagattacaaatcgtggccaggtgttaacctagattcaatcttatttgttgggaaaatttgagtttagctatcaactgtgagttgtgacattgtcttggatattcgtgtgcttaaattttgtcccgcgcctctcttctaactgtttaatgatgatgattcagaaaattcagatagtacattgtcttggagtataattttattttcatgatttgtagtttctatatatatgttgagtaaatgaagtcctgatgcttggctctaaatgtacatgtgtgatgttgctccttggttctctactcatttcttttttaatcctct

SEQ ID NO: 2636 - DNA, 2027 bp, Quercus alba
atggggcacaaactcaacatccaataattttaaaaattagttttatcttacctatttttccttaaccttttttttaatttattaccatttaatttaatctctctctctctctcggaggtctctctttttgtctttccctttggttgctctggggagttttctacgatctctggtgggattcgacgttcaaggaaagaatgacagagacaaaatcaaacgtgtccttgaaaccgtcatcatcatcgcgaaatctccctgatttcaaaaaatcaattaaactaaaatatgtgaagcttggttaccattacctcatcacccatggaatgtacctcttcatcacccctctcgtagtcctaattgccgtgcagctctcaacattttcattccaagatctttatgatctttgggagcatctccaatacaatctaatctccgtgatcatttgctcaactctccttgttttcttgtccaccgtgtactttgtcactcgtcctcgtcctgtataccttgtcaatttctcttgctacaagcctgaagagtctcggaaatgcaccaaaaggatcttcatggatcaatctcggctgactggtacattttcagatgagaatcttgaattccagaaaaagatccttgagagatctggccttggtgattctacttacctgccagaggctgttttgaatattcctccaaatccctccatgaaagaagctagaaaagaagctgaggctgtgatgtatggtgctattgatgagctttttgccaagacctctgtcaagcccaaagacattggcattttggttgtgaattgcagcttgttcaatccgaccccatctctttctgccatggttatcaatcactacaagcttcggggtaacatagttagctacaatctgggtgggatgggttgcagtgcaggtcttatttcaattgcacttgctaaagatcttcttcaggtccatcccaactcctatgcattggtcatcagcatggagaacatcactttgaattggtattttggaaatgacagatcaaagctcgtttcaaattgcttattccgaatgggaggagcggcgatactactttctaacaaaagctctgatagaagaagatccaaataccaattggtacatgctgttcgtacccacaagggtgcagatgacaagtgctttggctgcgtcacccaagaagaagactccaatgggaaggttggtgttacgttgtcaaaggatcttatggcagttgctggtgatgccctgaagaccaacatcaccactttggggcctcttgttctgccaatgtcagaacagctgctattctttgctacattgattgggaaaaaactattcaagatgaagatcaagccttatattccagattttaaactagcttttgagcatttctgcattcatgctggaggaagagctgttttggatgaactggagaagaatttgcaactatctgattggcatatggaaccatcaaggatgacactccaccgatttggcaacacctcaagcagttctctgtggtatgaattggcttatacagaagcaaagggaagaatgaagaagggagataggacatggcaaatagcttttggttcagggtttaaatgtaacagtgctgtttggaaggctctaaggaccataaacccagcaaaggagaagagcccttggatggatgaaattcatagtttcccagtggatgttccaaagatatcggcaatctaatgaaaaaaaaaatggtgaattttggcacatggtgttggctttcgcgaatggtgaatttttttttcttctttttttaactgaggtgttggattcatttctacttttcatatctagatttggggacttgattgtgcttgtacggctgtggaatggtagtcttgggatgagaggacatttgcatatttttattggatcaattgatattcatcgggcaaattatgtttttggtattctcttaggatctaagattgaaattagaagttggtactaattatttctagtaataacatcttt

SEQ ID NO: 2637 - DNA, 1864 bp, Vinca minor
aggaggcttcctgatttccaacaatctgttaaactgaaatatgtgaagcttggatatcattacctaattacacatggaatgtatctttgtttgtcccctttagttgttgttattgctgctcagctgtccacgttctcgcttcaagacctttatgttctatgggaccatttgagatttaatcttatttctgttgttgtttgctcaacccttttggtgtttttgtctactgtttatttcatcacccgccctcgtcctgtatacctcgtcaatttctcgtgttataagccagaggatgctaggaaatgtactaggcaaattttcatggagagatcgaagttgaccggttcgttcacctctgaaaaccttgagttccaaaagaaaattcttgagaggtcgggtcttggtgagtcgacttaccttcctgaagctgtgttaagagttcctccgaatccgtgcatggctgaagctaggaaagaagctgaaactgtgatgttcggtgccattgatgaactccttgcgaaaacttctttgaagccaaaggatattgggattttgattgtgaattgtagcttgtttaacccaaccccgtcattgtctgctatggttatcaatcattataaacttcgaggaaacattgttagttacaatcttggtggaatgggttgcagtgctggtttgatctctattgatcttgcgaaggatcttcttcgagtacatccaaatacctatgcacttgttattagcatggaaaacatcaccctgaattggtatttcgggaatgagaggtcgatgcttgtttcaaattgtttattccgaatgggaggtgcggcgattttgctttctaacaaaagttccgaccgaagaagatccaagtaccagttggttcacactgtcagaacacacaaaggttccgatgacaaatgcttttcttgcgttactcagatggaggatcctgatggaaaaattggtgtcgctttgtcaaaagatctgatggcggtagctggtgatgctttgaagaccaatattactacattgggtccccttgtgctgcccatgtctgaacagttgctcttttttgccacattggttggaagaaaattattaaagatgaagataaggccttatatccccgatttcaaattggcctttgaacatttctgtattcatgctggtggaagagctgtactggatgaactagaaaagaatctccagctctccgattggcatatggaaccatctagaatgactctctaccgttttggcaacacatcaagcagctcgctttggtatgaattggcatactcggaagctaagggaaggattaagagaggagataggacttggcaaatagcatttgggtctggcttcaagtgtaatagtgcagtttggaaggccttaaaaaccgtcaacccggctaaggagaagaatccatggatggatgagattcaccagttcccagttgaagtcccgagggtcgcagctctctgatcattccaggagacaagttatggtatccatgtactaatcgtgtctttgttgacaggaaagcatccctagtatctggaaatatgttagtttaagattttatccgtcttccttcatttcctcgttatggcactgcatatttggatggttcttgctgcttatttatagttgtagaaagcatgaaatccgtagttcgtagattattgagttattcataattgggatttgattggagattgtccattttttattgagatttgattgttttgaacttctactggggaaactttttaggaagaagggttggttagggagagggaattcgcttcatttatcgatgttttcatggttctggttcggaatgagtttgttgtgtaac

SEQ ID NO: 2638 - DNA, 1572 bp, Prunus persica
ctcctcaaattttctgaaaaatgtcagcttccaatttaaggactcctttaaaccctccatcatcagtatccccatcctcattgaagcttcctgatttcaaacaatctgtgaagctgaagtatgtgaagcttggctaccattacctcatcacccatgggatgtacctgttcctatcccctctatttgttctcactgtggcacagctctctacattttcactccaagatctccatgacctttgggaccatctcaggttcaatctcatatctgttgtcctttgctcaactcttttggtcttcttattgaccctttatttccttactcgtccacgccccgtttaccttgttgatttctcatgctataagccggaggatgcccgaaaatgcccgagacaaatattcatggataggtctcattttataggaacattcactggggagaacctcgagtttcaacgaaaaattcttgagagatcaggtcttggggagtcaacctacctccctgaagctgttatacaggttcctcctaatccatgtatggcagaggccagaaaagaagctgagatggtaatgtttggtgcccttgatcagctctttgagaaaacttctataaaaccaaaagacattggtattctgattgtaaattgtagcttgtttaatccaacaccatctttgtcagctatggttatcaatcattataagctacgagggaatattattagttataatcttggtgggatgggatgtagtgctggcttgatctcgattgatcttgctaaagatcttcttcgagtccaccccaatacctatgctttggtcattagcatggaaaacatcactttgaattggtattttgggaatgatagatcaatgcttgtttcaaactgcttgtttagaatgggaggagctgcaatattgctttcaaacaatgggtctgacagacgtcgatccaagtaccaactggttcatactgttcgaacccacaaaggtgccgatgacaagtgcttctcatgtgtaacccaaaaagaggattttgcaggtaaaattggagtttctctgtcgaaagatcttatggcagttgctggagatgctttgaagaccaacatcactaccttgggtcctcttgtgttacctatgtctgaacagttgctcttctttgccacacttgttgggagaaagcttttcaagatgaaggtgaagccttacatccctgattttaaattagcttttgaacatttctgcattcatgccggaggaagagctgtgctggatgaattggagaagaacttgcagctttcggatcgccacatggagccgtcaaggatgacactttacagatttggcaacacttcaagcagctctctttggtatgaattggcttatacagaagccaaggggaggatgaaaaagggagacagaacttggcagattgcgttcgggtctggcttcaagtgcaacagtgcagtttggaaggctttgagaactgtgaatccagcaaaagagaagaatccatggatggatgagatccatcagttcccagtggatgttccaaaggtctcagccctctaattcc

SEQ ID NO: 2639 - DNA, 2628 bp, Vitis vinifera
tttatcatcaccagttaaggccacctacgagttatgacatttggaatttgctagacgtacaatgaacaaaagttcagtgaaagaattctgaataaacgactttgatagtcctgcattttcatttcatttggaacaaagagaagatcggaaaagagccatgtctttcacttcactactcaggatacccagctggttggcacagaaccttctttcaaaaaaggaaaggggaccctcaaaaaattccctgaaagaagccaaaaggaggaggaatacaatcaggaccgtttataatggcaaaacagaaagccgccacgcagaaaaggacacgctgtacagtccacacagtcaacctccaatgaagtttcaaagccaatatatttatagtgctctctgcgtctcgttccttctctttggctcctccggcgcgattgaactttggaacgatcggtggagggttgtggcgttagaggggaaaatgtcagaagcgaaggtagacacgccattgatctcaccatcatcatcacgaaatctccctgatttcaaaaagtctgttaaattgaagtacgtaaagcttggttaccattacttgatcacccatggaatgtacctctttctttcccctcttgtcgttgtaattgccgctcagctctcgacattttctctccaagatctacatgatctttgggaccatcttcgattcaacctcatctccgtgattctttgttcaactcttcttgttttcctctcgaccctttactttctcacgcgtcctcgcccagtgtatcttgtggattttgcctgctacaagcctgaagaatctcggaaatgcacgaggaagatttttatggatcagtctcagatgactggttcatttacagaatcgagccttgagttccagcggaagatccttgagaagtctggccttggggagtcaacttaccttcctgaggctgttctcaatatccctccaaacccatcaatgcaagaagctagaaaagaagccgcgactgtaatgtttggtgccctcgatcagctttttgcaaagacatctttgaagcctaaagacattggaattctggtcgtgaattgtagcttgttcaatccaactccatccctttctgctatggtcatcaaccattacaagcttagaggtaatataattagctataatttgggtgggatgggttgcagtgctggtttaatctcaatcgatctcgctaaagaccttcttcaggtccatcccaactcttatgcattggttatcagcatggagaacatcactttgaactggtattttgggaaccagaggtccatgcttgtttccaattgtttattcaggatgggaggagctgctgtgctgctttcaaataaaagctctgacagaagaaggtctaaataccgattggtgcatactgtccgaacccacaagggtgctgatgataagtgctttgcctgtgttacccaagaagaagatgccgaaggaaaggttggtgtttctttgtctaaggatcttatgggagtcgcaggcgatgctttaaagaccaacatcactaccttaggccctcttgttctgccaatgtctgaacagttgctcttctttgctacattaattgggaggaaacttttcaagatgaaactcaagccttatattccagatttcaaactagcttttgagcacttctgcattcatgctgggggaagagctgttctggatgaattagagaagaacttgcacctctctgactggcatatggagccatcaaggatgacactttatcgatttggcaacacctcgagcagttctctttggtacgaattagcctatactgaagccaagggcagaattaagaagggggatagaacatggcagatagcatttggatctgggttcaagtgcaatagtgcagtgtggaaggctttaaggaccataaacccagcacaggagaagaacccatggatggatgaaattgacatgtttccagtgaatgttccaaaggtatcagccctctaaagccagaaatggtatttttgttccccattcttttgcagctgtaattcgagatgtgggcaagacatttgaatggtaaaatctttgattctttctatttttcggattggactgtgttttggccaccatgaggagggtggttgttagccttttgcttttctttcaattgtggtcttgaagcagatggaagatagcttcttgttggggagatggattatttgcatcgaagagttttagtaattgctgtgaggttctgtcttcgttactagggattaatgtgattcaatttggaatttgaactatttgtctagtgatattcttttggaacggtgttttgcatttctcctgcctctgtcgttgggatcattttgctacttacactgggacactatttttgcttccttgcattataatcacccagaacatcacggataaactattttgagattttatttattaatttattcctattattatttcagcactgcctcattagtccacccctgtttcctaatggtgaggacattaaggagattaacaacatcaaattgatggatgagaacaagaggcaggcaaggcgatgcatgccatacagggatcatgattttttgtcatctcag

SEQ ID NO: 2640 - DNA, 2596 bp, Vitis vinifera
ctctcttctatctctctctctctaaaccttctcgcctccgttgatttcgccggccataacaatgcagtctctgctcagattcgccgtttaaggatttttggttctttgacgctgcattttctgattctctgttgagagttgtatttcgagtcctcattttgacacatcaaccgcggagctgttttatttgctttcttgaaatccgagaaaatcgagtttccaacgcttcgggaatgttcgagaaaaacaaatcgtgcccaatgagctactggtgatttcgctgcagacctggatcgtcgatttctggggaagtccgagaaaatccagttcaacccagttttctagaagtgatttgtgtatgacccagatccttgaacgtcacagtttgttgggaaactgggaaaaagaaaaggaaaaaaaatcaaacactagatttgacctcgaaagccacaaatctctgtttcaaggcaacttggtggttggtattctctgtctgtgagttattcaatttaaaagtgttttgatttcttccaattcactccaaaatgtcggaaacaaatccaaacacacccttgattccaccatcgccatcccgaaagcttcccgatttcaaaaagtctgtgaaattgaaatacgtgaaacttggctaccattacctcattacccatggcatgtaccttttcctatcgcctctcattgtcctcattgctgcccagctctccacattctctctccaagatctccatgatctctgggaaaatcttaaattcaatctcatttcagtgatcctttgctcggctctccttgtctttttatcgaccctctttgtccttactcgtcctcgccctgtttatctagttgatttctcgtgctataagcctgatgatgctaggaaatgttctaggcagattttcatggatcggtccaagcagattggttcatttacagaggaaaatattgagtttcaaaagaaaattatcgagagatcagggcttggggagtcaacttacctccctgaggctgttatcaatgttccaccaaatccatcaatggcagaagccagaaaagaagctgagatggtgatgtttggggcacttgatcagctttttgaaaagacgatggtgaaaccgaaagatattgggattttgattgtgaattgtagtttgtttaatccgactccgtctctttcagcaatggtcattaaccattataagcttcgagggaatattattagctataatctaggtgggatgggctgtagtgctggtttgatatcaattgatcttgccaaaaatctccttcaagttcatcctaattcctatgctttggtcattagcatggaaaacatcactttgaattggtactttgggaatgagaggtcaatgcttgtttcaaattgtttgttcagaatggggggtgctgccattttgctttcaaacaagtggtctgacaggcgacgatccaagtatcagttggttcatactgttcgaacccacaaaggttctgatgataagtgttttgcttgtgttacccaaaaggaggattccaatgggaagatcggagtgtctttgtcgaaggatttgatggctgttgctggagatgctttgaagactaatatcactaccttgggtcctcttgtgctgccgatgtctgaacagctgcttttctttgccacattggtagggaaaaaggttttcaagatgaaggtgaagccctatattccagacttcaaactggctttcgagcatttttgcattcatgctggaggaagagctgtgctggatgaattagagaaaaacttgcagctttcggattggcatatggaaccttcgaggatgaccctctaccggtttggcaacacttcaagcagctctctttggtatgaattggcttatacagaagccaaagggagggtgaagaagggagacagaacatggcagatagcatttggctctggattcaaatgtaacagtgcaatttggaaggctcttcggactgtgaatccagcaaaggagaagaacccatggatggatgagatacactggttcccagtggatgttccaatggtctcaaccctctagaatccaagtgatggtctctcatttgcaatggtgttttggtgattggtatctggctgtttgagtggtgaaaccttcagcttttgctgcagagtctgtttctttagggtagtcccatgaggaatatgcatatggcatgtgtggtagaaaaatgtaggaaaagtggccttttgttttcaacttcattcttgtttctgagtaggataatgatgcttgttggtagggagtaagtgttagaattagtaggaatttgagaggtattagtttgtcaatttgtgatggcgtttgggttaggttgagactagagtttagtttcgtgagaatgtaatgcccatatttatttagcttcattttgatctctgttcagtgatgttaagatgaattgtttcacttccttggctgtggttctatgtttatcagaatcttatgtggcagtaattcaaatatctatccattctgataatttaagcggttttttgtttgatctttaacccttgatatgaacttctgaacaccta

SEQ ID NO: 2641 - DNA, 2355 bp, Sesamum indicum
ctctctctctacacactcacacatagttttctcagggaaattctttgccgtggatgagaaaagtattagggattttctgagattttgaattttggagctgcattacaagcttctttaatagagagagtgtgtggaaagagggtcgaggatttaattagtgaaaaaatgagtgagacgacagcaagcacacccttgattccaccctcttcgtctcggaagctccctgatttcaaacaatctgtaaagttgaagtatgtgaagcttggttatcattacctcataacccatgggatgtacctgtttttgtcgcctctagttgtggtgattgcagcccaagtgtccacattttctctccaagacctttatgttctctgggaccatcttagattcaatctcatatcagtgatagtttgctcggccctcttggtctttttatcgactgtctatttcctcacccgtcctcgccccgtgtacctcgtgaacttctcgtgttataagcccaatgatgataggaaatgcacaaggcagattttcatggagagatcacggttgactgggacgtttactgaagaaaatctcgagttccagaggaaaattcttgagaggtcaggccttggtgagtctacttatctccctgaggctgtgctgcgggttccaccaaatccctgtatggcggaagcaagaaaagaggctgagactgtgatgtttggtgcaattgatgaactgcttgccaaaacctctctaaagccgaaggacattgggattttgattgtcaattgcagtcttttcaatcccacaccttctttatctgctatggttattaaccattacaaactcaggggaaacataattagttacaatctaggtgggatgggttgtagtgctggtttaatatcaattgatcttgccaaagatcttctacaggtacatcccaatacttatgctctggtaatcagcatggagaatattactctgaattggtattttgggaatgagagatccatgcttgtttcaaactgtctcttccgtatgggaggtgctgccattttgctgtcaaataaacgatctgactactggagatccaagtaccgattggtccatactgttagaacccacaagggttcggacgataaatgtttctcttgtgtcacccaaatggaggattccaaagggaaaattggagttgctttgtcaaaggacttgatggccgttgctggtgatgccttgaagaccaatattacaactttgggtcctcttgtgctgcccatgtctgaacagttgcttttctttgccaccctggtggggaaaaagctgttcaagatgaagctaaagccttacatacctgatttcaaattggcttttgaacatttctgcatccacgctggtggaagggctgtgctggatgaattagagaaaaacctccaactctctgactggcacatggagccttcaaggatgactctctatcgattcggcaacacctcaagcagctctctctggtacgaattggcatattcggaagccaaaggaaggattaaaaggggagacaggacctggcagatagcttttggatctggtttcaaatgtaacagcgctgtttggaaagctctaaggactataaatccagcaaaggagaagaacccatggatggatgaaattcaccaatttcctgtggaggttcctaaggtctcagccatctgatacttgagccttttgcatctggtggaatgtgcagtttgggatggaactagtggttaaattgcagttagcttttgtttttctctttccatttgttttgcacttggcctaccggtggactatgctgctgccatgcaaaggttgtaggagaagaacgcgttgtgttaggtgctaggaattgccattgaagtgtctagtttgtagttgaccttccatctgatttattctggcaagttgctggcattcccggagatatacgagggatgcattttgacctggggatcacattgagaacatgctaggcttctcgttttgacttgtttattgcttctattgaggtcattgtgctgaatatgtattacttgatctgaatcttaatttctaatttattcatcttcagttttaactgttaagagagctaagcaattatcatttgtactcgttggaaaatgcttctggctgttaattacgttgcttgatgaattcttgtctagggccttcaattctcaaactatattcatctagtcatctgggcgcataattaaccccttccaactaaagattcatgcaggcgactctgctagtgatttgattagacctgactactggttgaacagttgtgtctctacttgaacaaacctgtcatgacaaatggtg

SEQ ID NO: 2642 - DNA, 2293 bp, Prunus mume
cattcattttgcagggttgtttaggtcctttgagtttgagctgcatttgctgttctctattgttaaagtccttctctttgatctctctcacttcactgtgatcgatcaaaccctcttagattctttttcttgttaggttgattatccaaagcaaatcccatttctgaaaccccaaataaagcagaatgtcataggaaatccagtccaacccaactacctaatctattttactgtttattgaccacccaaattatagattcctgatctcctattctagaggaaatcgcttcctgtagtcgaaaatgttgtttaaattgcggttcaagagaaagggattcatgcttctttaacatcactgttccattgagatcacccaagtctccaaattttgtcaatttagatcaacccatctcctcaaattttttgaaaaatgtcagcttccaatttaaggactcctttaaaccctccatcatcagtatcctcatcctcattgaagcttcctgatttcaaacaatctgtgaagctgaagtatgtgaagcttggctaccattacctcatcacccatgggatgtacctgttcctatcccctctgtttgttctcactgtggcacagctctctacattttcactccaagatctccatgacctttgggaccatctcaggttcaatctcatatctgttgtcctttgctcaactcttttggtcttcttattgaccctttatttccttactcgtccacgccccgtttaccttgttgatttctcatgctataagccggaggatacccgaaaatgctcaagacaaatattcatggataggtctcattttataggaacattcactggggagaacctcgagtttcaacgaaaaattcttgagagatcaggtcttggggagtcaacctacctccccgaagctgttatacaggttcctcctaatccatgtatggcagaggccagaaaagaagctgagatggtaatgtttggtgcccttgatcagctctttgagaaaacttctataaaaccaaaagacattggtattctgattgtaaattgtagcttgtttaatccaacaccatctttgtcagctatggttatcaatcattataagctacgagggaatattattagttataatcttggtgggatgggatgtagtgcaggcttgatctcgattgatcttgctaaagatcttcttcgagtccaccccaatacctatgctttggtcattagcatggaaaacatcactttgaattggtattttgggaatgatagatcaatgcttgtttcaaactgcttgtttagaatgggaggagctgcaatattgctttcaaacaatgggtcagacagacgtcgatccaagtaccaactggttcatactgttcgaacccacaaaggtgctgacgacaagtgcttctcatgtgtaacccaaaaagaggattttgcagggaaaattggagtttctctgtcaaaagatcttatggcagttgctggagatgctttgaagaccaacatcactaccttgggtcctcttgtgttacctatgtctgaacagttgctcttctttgccacacttgttgggagaaagcttttcaagatgaaggtgaagccttacatccctgattttaaattagcttttgaacatttctgcattcatgccggaggaagagctgtgctggatgaattggagaagaacttgcagctttcggatcgccacatggagccatcaaggatgacactttacagatttggcaacacttcaagcagttctctttggtatgaattggcttatacagaagccacggggaggatgaagaagggagacagaacttggcagattgcgttcgggtctggcttcaagtgcaacagtgcagtttggaaggctttgagaactgtgaatccagcaaaagagaagaatccatggatggatgagatccaccagttcccagtggatgttccaaaggtctcagccctctaattccagtggcagtttcccatttcttctagcaatataaaatatattaggggtagctagttttctgtttcactgctacaatcttcatgtttggctttaatggagttactgtttggctttagttattagggcaggagatagatggtgttagtgtttggtttacagtgtatccatgtggttttgacttgtgattatatgcctaattaatcggctgtttgttttattatggtatttgtcttgttggtttgagggttttatgctgtttggtgatccataaactgggattaatatccaatgagaaggattattcttaatcat

SEQ ID NO: 2643 - DNA, 1675 bp, Castanea mollissima
aattattaccatttaacttaatttctctctctctctctctctctctctgagggtctcgtaaatatctctctttttgtctttcccttcggttgctccgaggagttttctacgatctctggtgggattcgacgttcaaggaaagaatgacagagccaaaatcaaatgtgtccttgaacccgtcatcatcatcgcgaaacctccctgatttcaaaaaatcagttaaactaaaatatgtgaagcttggttaccattacctcatcacccatggaatgtacctcttcatcacccctctcgtagtcctaattgccgtgcagctctcaacattttcattccaagatctttatgatctttgggagcatctccaatacaatctaatctccgtgatcatctgctcaactcttcttgttttcttgtccaccgtgtactttgtcactcgtcctcgtcctgtataccttgtcaatttctcttgctacaagcctgaagagtctcggaaatgcaccaaaaggatcttcatggatcaatctcggctgactggtacattttcagcggagaatcttgaattccagaaaaagatccttgagagatctggcctcggtgattctacttacctgccagaggctgttttgaatattcctccaaatccctccatgaaagaagctagaaaagaagctgaggctgtgatgtatggtgctattgatgagctttttgccaagacctctgtcaagcccaaagacattggcattttggttgtgaattgcagcttgttcaatccgaccccatctctttctgccatggtcatcaatcactacaagcttcggggtaacatagttagctacaatctaggtgggatgggttgcagtgcaggtcttatttcaattgcacttgctaaagatcttcttcaggtccatcccaactcctatgcattggtcatcagcatggagaacatcacattgaattggtattttggaaatgacagatcaaaactcgtttcaaattgcttattccgaatgggaggagcggcgatactactttctaacaaaagctctgatagaagaagatccaaataccaattggtacatgctgttcgtacccacaagggtgcagatgacaagtgctttgcctgcgtcacccaagaagaagactccaatgggaaggttggtgttacattgtcaaaggatcttatggcagttgctggtgatgccctgaagaccaacatcaccactttggggcctcttgttctgccaatgtcagaacagctgctattctttgctacattgattgggaaaaaactattcaagatgaagatcaagccttatattccagatttcaaattagcttttgagcatttctgcattcatgctggaggaagagctgttttggatgaactggagaagaatttgcaactatctgattggcatatggaaccatcaaggatgacactccaccgatttggcaacacctcaagcagttctctgtggtatgaattggcttatacagaagcaaagggaagaatgaagaagggagataggacatggcaaatagcttttggttcagggtttaagtgtaatagtgctgtttggaaggctctaaggaccatagacccagcaaaggagaagaacccttggatggatgaaattcataggttcccagtggatgttccaaagatatcagcaat

SEQ ID NO: 2644 - DNA, 1859 bp, Phaseolus vulgaris
gttttgaacagggcaaaatgacagatgcaagggaaggtgcaccctcgatggcctcttcgtcgcgaagccttcctgatttcaagaaatctattaagttgaagtatgtgaagcttggttatcattacctcatcacccatggaatgtacctttgccttaccccccttgtggtgctgattgctgctcagctgtccaccttctccttccaagacttttatgatatttgggagcatctgcaatacaacttgatatctgttattctatgctcgactctccttgttttcctatcaaccctctacttcctcactcgtcctcggccggtgtaccttgtcgatttctcttgttacaagcctgaagaatctcgccagtgcacaaagaggacattcatagaccactctcggttgaccggttctttcacagaggaaaatcttgaattccagcggaagatccttgagagatctggccttggggagaccacttaccttcctgaagctgtcctcaacatccctcccaacccttcaatgaaagaagctagaaaagaagctgaggctgtgatgtttggtgccattgatgagctattagccaaaacctctgtaaagcctaaggacattgggattctgattgtaaactgtagcctgttcaaccctactccatcactttcggcaatgattgtcaatcattacaagcttcgggggaatataaggagctacaaccttggtggaatgggttgcagcgcagggctcatctcaattgatcttgccaaagatcttctccaggccaatcccaactcctatgcattggtcattagcatggaaaatatcacgttgaattggtattttggaaacgatcgatcaaagcttgtttccaattgcttgtttcgtatgggaggagctgcagttctgctttccaataaaagctcggacagaagaagatccaagtacagattggttaccacggttcgcactcataagggtgctgatgacaagtgctttagctgtgtaacacaagaagaagatgccaatggcaagattggtgttactttgtcaaaagatctgatggctgttgctggtgatgctttaaaaaccaatatcactacactgggacctctcgtacttccaacatcagaacagctgctattctttgctacgttagttgggaagaaaattttcaagatgaagatcaaaccttatattccagatttcaagctagcttttgaacatttttgcatccatgctggtggtagagcagttttggatgaactggagaaaaacttgcagctgtctacttggcatatggaaccatcaaggatgaccctctatcgtttcggaaacacatccagcagttcactttggtatgagctggcttacactgaagccaaagggaggataagaaaaggagacagaacatggcaaatcgcatttggttctggattcaagtgtaacagtgcagtgtggaaggctctcaggaccatcgactctgctaaggaaaagagtccttggattgatgagatcgaccagtttccagtggatgttcctagagtatcttcattttaaacaatgtaattttaaacatttgtgtatcacactatcagcaataggtggtactttttggactactgaaattttcctgcaaagttgttgtaatacgttgctaatttcagagaactgtaggattttcattaggacaaaacttaggtgtattgcagttatttaggtgtttttgattttattttctttctagaattaaaggttcacctttaattcaaggcttaattaattaggtttattgtcctcatgttcagaataaaatccgtgtttgtctctctaatttcgaacaatgctcttaaattaaaaaaaaaaaaa

SEQ ID NO: 2645 - DNA, 1798 bp, Olea europaea
caggagttaaatttcaatacgtacttaaattaattgcaatatcctaatagttcatttttgctgaaatctaataatacctattctgcaggaaactgaaggaaattgctaataaaatgagcgaatcagaagcaaatacaccctcgcttcctccctcatcttcacgaaagcttcccgtaattttaaaaaatctgtgaaattgaaatatgtgaagcttggataccattaccttataacccatggaatgtatctatttttatccccagtggttgtgcttattgcagcccaattgtccacattttcactccaagaccttaatgatctttgggaccatctcagattcaatctgatatctgtaatcgtgtgctcgaccctcttagtctttttatcaacagtctatttcctcactagcccgcgaccagtgtatctagtgaatttctcgtgttataagcctgatgatgataggaaatgcactaggcagattttcatggagagatcgcggttgaccggttcatttactgaggaaaatcttgagtttcagaggaaaattcttgaaaggtcgggccttggtgagtcaacttatctacctgaggctgtactgaagataccaccaaatccgtgtatggctgaagcaagaaaagaagctgaagctgtaatgtttggtgccattgatgagctgcttgctaaaacgtctctaaagccaaaggacattgggattttgattgtgaattgcagcttgtttaatccgacaccttctttgtctgccatggttattaaccattacaagctccgggggaacattattagttacaatctaggtgggatgggttgtagtgcaggtttgatatccatcgatcttgctaaagatcttctacaggtccatcccaacacttatgctctagcaatcagcatggagaatattacactaaattggtacttcgggaatgagaggtcaatgcttgtttcaaattgcttgttccggatgggaggggctgctattttgctttcaaacaaaagatctgatcggtggcgatccaagtaccgattggtccatactgtaagaacccacaaaggttctgatgataaatgcttttcttgtgtcactcagctggaggattcgcaggggaaagttggagtttctctgtcaaaggaattgatggcagtagctggtgatgctttgaagacaaatatcactacattgggtccccttgtgctgcctatgtccgaacaattgattttcttagccacattggtcgggaagaagctgtttaaaatgaagctgaagccttacatcccagatttcaaattggctttcgagcatttctgcatccacgcaggtggaagagctgtgttggatgaattagagaaaaatctgcaactatctgattggcagatggagccttcaaggatgactctataccgatttggcaatacctcaagcagctcactttggtatgaattggcatactcagaagccaaagggaggattaggaggggagacaggatgtggcagatagcatttggatcagggtttaaatgtaatagtgcagtatggaaagctttgaggaccataaatccagcaaaggagaagagcccatggattgatgagattcatcaattccctgtggaggttccaaaggtctcgactatataaagtttcccttccttgacattttcattagttgtgggttcttgactgaaaatgcatctagcatatttgggtttttgtgtcttaactaaggtacttaaatggagtccaggttatgttttctctcgtctttgtagactcagcctagtgtgc

SEQ ID NO: 2646 - DNA, 1820 bp, Fragaria vesca
aaaatgtcagggtccaatctaaacaaatctttgatatctccatcattatcatcacctaagctccctgacttcaaacaatctgtgaaattgaagtatgtaaagcttggctaccattacctcataactcatggaatgtacttgttcctaacccctctttttgttctcactgctgcacaagtctccacattctcactccaagacctccatgacctttgggatcatttgaggttcaatctcatatctgttgtcctttgctcaactctcttggtcttcttgtccaccctttacttcctcactcgtccccgtcctgtttaccttgttgatttctcatgctacaagcctgaagatgctcaaaaaaccactaggcaagtgttcatgaaatgctcacattcgatagggacattcactggggagaatcttgagtttcagcgcaaaattcttgagaggtcaggtcttggggagtctacatacctccctgaagctgttataagggtgcctcctaatccatgtatggcagaggcaagaaaagaagctgaaatggtaatgtatggtgcccttgatcagctgtttgagaaaacttctataaaaccgaaggacattggtattttggttgtgaattgtagcttgttcaatccaacaccgtctttgtcagctatgttgatcaatcattataagctaagagggaatattattagttacaatcttggtgggatgggatgcagtgctggtttgatctcgattgatcttgcgaaagatctccttcaagtccacccgaacacctatgctttggtgattagtatggagaatatcactttgaattggtattttgggaatgacagatcaatgctggtgtcaaactgcttgtttagaatggggggagctgcaatgttgctttcgaacaataggcatgacaggtgtcgttccaagtaccagttagtccatactgttcgaacacataaaggtgctgatgacaagtgcttctcttgtgtaactcaaaaagaggatcctgcagggaaaattggagtttctttgtcaaaggatcttatggcagtagctggggatgctttgaagaccaacattacaactttgggtcctttggtgttacctatgtcagaacagttgctcttctttgctacacttgttgggagaaagcttttcaagatgaaggtgaagccctacatcccagatttcaaattggcttttgagcatttctgcattcatgctggtggaagagctgtgctggatgaattggagaagaacttgcagcttttggacagacatatggagccttcaaggatgaccctttacagatttggcaacacttcaagcagctctctttggtatgaactggcttatacagaagccaaggggaggatgaagaaaggtgacagaacatggcagatagcgttcgggtctggcttcaagtgtaacagcgcggtttggaaggctttgaggactgtgaatccagtgaaggaaaagaacccgtggatggatgagatcgacatgttccctgtggatgttcccaaggtctcatccatctgaaactcctgacagtttcccatttcatctaggtgtgttagcctgttaggggtagttcgctttgtagttggctttctcttttagtagtaaaacttcttgtttgtgcttgaatagtctcactatgctgttatttcctgggagatccatgattcacaatcaatcattagtaaccctcgatcataaatgattgatagttcttggattctgccaacttttttgtctgaaacctgagtttagtatgttgaaacgggtgaagcttgatacattagacaaatcttttg

SEQ ID NO: 2647 - DNA, 3182 bp, Sorghum bicolor
ccaccccacctcctaaaccctacccgcgcgcctccgcttctctgctccgctgcgcccccctctttttcactcccccctcccccgccggagttgcgtttcatttgaataggcgagcggggaagcatctcctaaaccaccctccgctctccccaaccgccccgaaccctagactcccttccgcgccgccgccaccccgcgccgccggttcggatctcttgggctcgcgtgcggcggggatccgtccaggcttggattgatttctcctctgcgcggatacaaccatggatatcactcaggttctgctagctgctcaatctccagatgctaaccttcgaacagtagcagaaagcaacctcacacagttccaggagcagaatcttcctaacttcctcctctccctatcaatagagctctcaaatgatgaaaaacctccagagtctagaaggcttgctggtattatccttaagaattctttggatgcaaaggattctgcgaaaaaggagctattgactcagcaatgggtaagcgtggatccatctgtcaaattgaagatcaaggagttgttgctggtgacactaggatcttcggtgcatgatgcaagacatacctcttcgcaagtcattgccaaggttgcatcaattgagataccacgtcgagaatggcaagaccttgttgccaacttactgggcaacatgacttctccaggtgcatccgctcctttgaaacaagcaacactagaggcattggggtatgtgtgtgaggagatttctccacaggacttggagcaggaccaagtgaatgctgttctgactgctgttgtccagggaatgaatcagacagagctcagccctgaggttcgtctagctgcagttaaggccctatataatgctcttgactttgccgagagtaactttgcaaatgaaatggagaggaattatataatgaaggtggtttgtgagactgctgtgtccaaagaagtggagatcagacaggctgcatttgaatgccttgttgcaatagcatccacatattattcacacttagatccttatatgcaaaccatattcaacctgacagcaaatgcagtgaaaggtgatgaggaaccggttgcacttcaagctgttgagttctggagcgctatttgtgatgaagagattgcactccaagatgaatacgagggatctgaggatggcaactctactgtacactttcgctttattgaaaaggccctcccttcacttgtaccgatgctgctagaaactttattgaagcaagaggaagatcaagatcaagatgataatgtttggaacatttctatgagtggtgggacgtgccttggactcatttctagaactgttggtgatgcagttgttcctcttgtgatgccatttgttgaggccaacatcacaaagcctgattggcattgtcgcgaggcagctacttttgcatttggttctatccttgaaggcccctctgttgaaaaacttgctccacttgtccagggtggtcttgatttcttgcttaacacaatgaatgatgcaaatagccaggtaaaagatactactgcttggactcttgggagggtatttgagctcttgcattctccagctggtgcaaacccaatcataaataattcaaaccttcctcgtatcatgtctgtgctgcttgagagtagtaaagattctccaaatgtggctgagaaagtctgtggagctatttattttcttgcccaaggatatgaagatgcagagtcaatgtcttctgtgctcacaccttatctacctaatatcattgctgctcttctttctgccgcggaccgtgctgataccacccatttcaggcttcgtgcttctgcttatgaagcactgaatgagattgtgagagtcagcaacatacctgaaacttcaggcatcataggccaattgttgcaggagatcatgagaagattaaaccttacatttgatctccatatactttcttctggtgataaggagaagcaaagcgatctgcaggctttgctatgtggtgttctgcaggtcatcatccagaagctgaatagcacagatgcaaagtccataatttctcagactgctgatcagctgatgatgctgtttttgcgtgtctttgcctgccacaattctactgttcatgaagaagcaatgcttgcaattggtgctcttgcatatgctactggtccagattttgttaaatacatgcctaacttcttcacatacctggaggctggcttgcagaattatgaagagtaccaagtgtgttccatctctgttggggtggtcggtgatatttgtcgtgccttggaagataaaatcttgcccttctgtgatcgcattatgactgttcttctaaaggatctatcaagctctatgctcaatcggtctgtgaagcctccaattttctcatgctttggagatattgctcttgctattggtgagaattttgagaaatacctaccatatgccatgccaatgcttcaaggagctgcaggactccttggtactcttgatcggagtgatgatgatatggttgattatggcaaccaactcagacgtggcatttttgaggcgtactctggtatactccagggcatcaagggcccgaaagctcagctgatgatcccatacgcaacccatctactacagttcactgaagctgtcttcaaagataggagcagggatgacagtgtgacaaaggctgcagttgctgtaattggggatctcgcagacacgcttggccagagctcgaaggatctgttcaagacccacctattccatgttgaattcttgagggagtgccaagcccaagagtttgatgatgaagttcgggagactgcacaatgggcccaggggatgataaaccaggcggtggtctcttgatgtgggaatattttggtctgttgggtgtgtgaggttcttttgtggctgtgccaagttcatttgccacagatgaacgaaaagataccaatatatatgtagcgtcagtcttaggatcatggtagtcatttgtgcgttgttggtctgtcaagccggtgtgcgtcacattggaccgggtggtttatgtccgtggatgtcttgaacagcaaaacatggttcatttatcttggtatttttcaatgctggtgatgtgcttgcttcctgtttttcatccatttcttgtccagctga

SEQ ID NO: 2648 - DNA, 3200 bp, Zea mays
cctaaaccctagccgcctctgcttctctcctccgctccgcaccctctttttcactccccctcccccgccggagttgcgtttcatttgaataggcgagcggggaagcatctcctaaacaacctccgcactccccaaccgccccgaacactcgcctccattccgcgccgccgccgccacctcgcgtcgccgtccggatctcttgggctcgtgtgcggcagggatccattgatttctcctctgcgagccatggatatcactcaggttctgctagctgctcaatctccagatgctaaccttcgaacagtagcagaaggcaacctcacacagttccaggagcagaatcttcctaacttcctcctctccttatcaatagagctctcgaacgatgaaaaacctcctgagtctagaaggcttgctggtattatccttaagaattctttggacgcaaaggattctgcgaaaaaggagctactgactcagcaatgggtaagcgtggacccatctatcaaattgaagattaaggagtcgttgctggtgacactaggatcttcggttcatgatgcaaggcatacctcttcacaagtcattgccaaggttgcttcaattgagataccacgtcgagaatggcaagatctcattgccaaattactggagaacatgacttctccaggtgcatctgctcctttgaagcaagcaacactagaagcattggggtatgtgtgtgaggagatttctccacaggacttggagcaggaccaagtgaatgctgttctgactgctgttgtccagggaatgaaccaggcagagctcagccctgaagttcgtcttgctgcagttaaagccctatataatgctcttgactttgctgagagtaactttgcaaatgaaatggagaggaattatataatgaaggtggtttgtgagactgctatgtctaaagaagtggagatcagacaggctgcatttgaatgccttgttgcaatagcatccacatattattcacacttagacccttatatgcaaaccatattcgacctgacagctaatgcagtgaaaggcgatgaagaaccggttgcacttcaagctgtcgagttctggagcgctatttgtgatgaagagattgcactccaagacgaatatgagggatctgaggatggcaactctactgtacactttcgctttattgaaaaagccctccctttactcgttccgatgcttctagaaactttgttgaagcaagaggaagatcaagatcaagatgataatgtttggaatatttctatgagtggtgggacgtgcctcggactcatttctagaactgttggtgatgcagttgtccctcttgtgatgccatttgtggaggccaacatcacaaagcctgattggcattgtcgtgaggcagctacctttgcatttggttctatccttgaaggtccctctgttgaaaaacttgctccactggtccaggctgggcttgatttcttgctcaacacaatgaatgatgcaaatagccaagtaaaagatactactgcttggactcttgggagggtatttgagcttttgcattctccagctggtgcaaacccaatcattaataattcaaaccttcctcgtatcatgtctgtgttgcttgagagtagtaaagatgctccaaatgtggccgaaaaagtctgtggagctatttattttcttgcccaaggttatgaagatgcggagtcaatgtcttctgtgctcacgccttatctacctaatatcattgctgcacttctttctgctgcggaccgtgctgattccacccattccaggcttcgtgcttctgcttatgaagcactgaatgagattgtgagggtcagcaacatacctgaaacttcaggcatcataggccaattgttgcaggagatcatgagaagattaaaccttacatttgatctccatatactttcttctggtgataaggagaagcaaagtgatctgcaggctttgctatgtggtgttctgcaggtcatcatccagaaactgagcagcactgatgcaaagtccatagtttctcagactgctgatcagctgatgatgctgtttctgcgtgtctttgcctgccacaattctactgtccatgaagaagcaatgcttgcaattggtgctcttgcatatgctactggtccagattttgtgaaatacatgcctaacttcttcacatacctggaggctggtttgcagaattatgaagaataccaagtgtgttccatctctgttggggtggttggtgatatttgccgtgccttggaagataaaattttgcccttctgtgatcgcattatgactgttcttcttaaggacctatcaagctctatgctcaatcggtctgtgaagcctccgattttctcatgctttggagatattgctcttgctattggtgagaattttgagaaatacctaccatatgccatgccgatgcttcaaggagctgctgaacttcttggtactcttgatcagagtgatgatgatatggttgattatggcaaccagctcagacgtggcatttttgaggcatactctggtatactccagggcatcaagggcccaaaagctcagctgatgatcccatatgcaacacatctactacagttcactgaagctgtcttcaaagataggagcagggatgacagtgtgacaaaggctgcagttgctgtccttggggatcttgcagacacgcttggccagagctcaaaggatctgttcaagacccacctattccatgttgagttcttgagggagtgccaagcccaacagttggatgatgaagttcgggagactgcacaatgggcccaggggatgataaaccaggcggtggtctcctaatgtaggttgattttggtttgtttgttatgggaggtttcttgtggttgtgccaagttcatttgccacagacgaaagaaaggctaccaatatatatgtagcgtcagtcgtaggatcctggtagacatatttgtgcgttgttggtctgtcaagtcggtgcgcgtcacattgtaccgagtggtttctgtccgagtatgtcttgaacagcaaaacttggttcatttatcttggtatttttcaatgctggtcatgtgtttcctttttttttcatttcttgtccagctgatcaagtttatatatgatacacacgcagactgatacatttaatcaaaatttgatctgct

SEQ ID NO: 2649 - DNA, 3217 bp, Setaria italica
ccccctcttccccacgctggagttgcgttttcatttgaataggcgagcggggaagcatcttataaaccacacctccgctccaccgacccgccccgaatcctagcctccatcccgcgccgccgccggccccgcccccagcgacgccgtccggatctcgcgtgctcgcgtgcgggcgggattcgtccgggcctggattgatttctcctctgcgcgatagggcatttgctacaggcatggatattacacaggttctgctagccgctcaatctccggatgctaaccttcgaactgtagcggaaagcaacctcacgcagttccaggagcagaatcttccaaacttcctcctctccttatccatagagctctcgaatgatgaaaaacccccagagtccagaaggcttgctggtatcatccttaagaattctttggatgcaaaggattctgcaaaaaaggagctactgactcagcaatgggtcagcgtggatccatctataaaatcaaagatcaaggagtcgttgctggtaacactaggatcttcagtccatgatgcaaggcatacctcatcacaagtcattgccaaggttgcatcgattgagataccacgtcgagaatggcaagacctcattgcccaattactggggaacatgacatccccgggtgcatctgctcctttgaagcaagcaaccctagaggcattggggtatgtatgtgaggagatttccccgcagcacttggagcaggatcaagtgaatgctgttcttactgctgtggtccagggaatgaaccagacagagctcagccctgaagttcgtcttgcagcagttaaagccctttataatgctcttgactttgctgagagtaactttgcaaatgaaatggagaggaactacataatgaaggtgatttgcgatactgctgtgtctaaagaagtggagatcagacaggcggcatttgaatgccttgttgcaattgcatccacatattattcgcacttagatccttatatgcaaaccatattcaacctgactgctaatgcagtgaaaggagatgaagaacaggttgcacttcaagctgttgagttctggagcgctatttgtgatgaagagattgcactccaagatgaatatgagggatctgatgatggcaactctactatacattttcgttttattgaaaaggctctcccttcacttgttccgatgctgctagaaactctattgaagcaagaggaagaccaagatcaagatgataatgtatggaacatttctatgagtggtgggacgtgccttggactcattgctagaactgttggtgatgcaattgtccctcttgtgatgccgtttgttgaggccaacatcacgaagcctgattggcattgtcgcgaggcagctacctttgcatttggttctatccttgaaggcccctctgttgaaaaacttgctccgctggtccaggctggtcttgatttcttgctcaacacaatgaacgattcaaacagccaggtaaaagatactactgcttggactcttgggagggtttttgagatcttgcattctcctgctggtgccaacccaatcataaataactcaaatctccctcgtatcatggctgtgttgcttgagagtagtaaggatgttccaaatgtggctgagaaagtctgcggtgctatttattttctggcccaaggttatgaagatgcagagtccatgtcttctgtgctcacaccttatctacctaatgttattgctgctcttctcaatgctgcggatcgtgctgataccacccatttcaggctccgtgcttctgcttatgaagcactaaatgagattgtgagagtcagcaatatacctgaaacttcaggcattattggccagttattgcaggagatcatgagaaggttaaaccttacatttgatctccatataatttcttctggtgacaaagagaagcaaagtgatctgcaggctttgttgtgtggggtactgcaggtcatcatccagaaactgagcagtacagatgcaaagtccataattgtccagactgctgatcagctgatggttctgtttctgcgtgtctttgcctgccacagttctaccgtgcatgaagaagcaatgcttgcaattggtgctcttgcatatgctactggttcaggttttgagaaatacatgcctaacttcttcacatacctggaagctggcttgcagaattatgaagagtaccaagtctgctccatctctgtaggggtggtgggtgatatttgccgtgccttggaagataaaattctgcccttctgtgatcggattatggctgttcttctcaaggacctatcaaactctatgctcaatcggtctgtgaagcctccgattttctcatgctttggagacatagctcttgctattggtgagaattttgagaaatacttgccatatgctatgccgatgcttcagggagctgcagaactccttggtactcttgatcagagtgatgatgatatggttgattatggcaaccagctcagacggggcatttttgaggcatactctggtatactccagggtatcaagggcccaaaagcgcagctgatgattcgatatgcaacccatctactgcagttcactgaagctgtttccaaagataggagcagggatgatagtgtgacgaaggctgcagttgctgtccttggggatcttgcagacacacttggcgcgagctcaaaggatctgttccagacccacctcttccatgttgagttcttgagggagtgccttgacttggatgatgaagttcaggagactgcatcatgggcccagggtatgataaaccaagcggtggtctcttaatgtgagatggttttgttctgttggttatgggaggtttcttttgtggctgtgccaagtccatttgccacaggtgaacgaaaggataccaatatatatgtagcgtcagtcctaggatctttgtcgtagcagtcgcgtggtgttgttggtctgtcaaagccgttgtgcgtcgcattagactgggtggattctgtctgtggatgtcttgaacagcaaaaacttggttaatttgtcttactcctgttattattcgatgctgctgctgatgcgtcctctgttcaatgtccatccgatcaaattttgagagaatgtatctgctgatgatcaaacgcacatagctggatgcattctcccagaatttgatctgatgtacatgcttt

SEQ ID NO: 2650 - DNA, 3089 bp, Setaria italica
cccacgctggagttgcgttttcatttgaataggcgagcggggaagcatcttataaaccacacctccgctccaccgacccgccccgaatcctagcctccatcccgcgccgccgccggccccgcccccagcgacgccgtccggatctcgcgtgctcgcgtgcgggcgggattcgtccgggcctggattgatttctcctctgcgcgatagggcatttgctacaggcatggatattacacaggttctgctagccgctcaatctccggatgctaaccttcgaactgtagcggaaagcaacctcacgcagttccaggagcagaatcttccaaacttcctcctctccttatccatagagctctcgaatgatgaaaaacccccagagtccagaaggcttgctggtatcatccttaagaattctttggatgcaaaggattctgcaaaaaaggagctactgactcagcaatgggtcagcgtggatccatctataaaatcaaagatcaaggagtcgttgctggtaacactaggatcttcagtccatgatgcaaggcatacctcatcacaagtcattgccaaggttgcatcgattgagataccacgtcgagaatggcaagacctcattgcccaattactggggaacatgacatccccgggtgcatctgctcctttgaagcaagcaaccctagaggcattggggtatgtatgtgaggagatttccccgcagcacttggagcaggatcaagtgaatgctgttcttactgctgtggtccagggaatgaaccagacagagctcagccctgaagttcgtcttgcagcagttaaagccctttataatgctcttgactttgctgagagtaactttgcaaatgaaatggagaggaactacataatgaaggtgatttgcgatactgctgtgtctaaagaagtggagatcagacaggcggcatttgaatgccttgttgcaattgcatccacatattattcgcacttagatccttatatgcaaaccatattcaacctgactgctaatgcagtgaaaggagatgaagaacaggttgcacttcaagctgttgagttctggagcgctatttgtgatgaagagattgcactccaagatgaatatgagggatctgatgatggcaactctactatacattttcgttttattgaaaaggctctcccttcacttgttccgatgctgctagaaactctattgaagcaagaggaagaccaagatcaagatgataatgtatggaacatttctatgagtggtgggacgtgccttggactcattgctagaactgttggtgatgcaattgtccctcttgtgatgccgtttgttgaggccaacatcacgaagcctgattggcattgtcgcgaggcagctacctttgcatttggttctatccttgaaggcccctctgttgaaaaacttgctccgctggtccaggctggtcttgatttcttgctcaacacaatgaacgattcaaacagccaggtaaaagatactactgcttggactcttgggagggtttttgagatcttgcattctcctgctggtgccaacccaatcataaataactcaaatctccctcgtatcatggctgtgttgcttgagagtagtaaggatgttccaaatgtggctgagaaagtctgcggtgctatttattttctggcccaaggttatgaagatgcagagtccatgtcttctgtgctcacaccttatctacctaatgttattgctgctcttctcaatgctgcggatcgtgctgataccacccatttcaggctccgtgcttctgcttatgaagcactaaatgagattgtgagagtcagcaatatacctgaaacttcaggcattattggccagttattgcaggagatcatgagaaggttaaaccttacatttgatctccatataatttcttctggtgacaaagagaagcaaagtgatctgcaggctttgttgtgtggggtactgcaggtcatcatccagaaactgagcagtacagatgcaaagtccataattgtccagactgctgatcagctgatggttctgtttctgcgtgtctttgcctgccacagttctaccgtgcatgaagaagcaatgcttgcaattggtgctcttgcatatgctactggttcaggttttgagaaatacatgcctaacttcttcacatacctggaagctggcttgcagaattatgaagagtaccaagtctgctccatctctgtaggggtggtgggtgatatttgccgtgccttggaagataaaattctgcccttctgtgatcggattatggctgttcttctcaaggacctatcaaactctatgctcaatcggtctgtgaagcctccgattttctcatgctttggagacatagctcttgctattggtgagaattttgagaaatacttgccatatgctatgccgatgcttcagggagctgcagaactccttggtactcttgatcagagtgatgatgatatggttgattatggcaaccagctcagacggggcatttttgaggcatactctggtatactccagggtatcaagggcccaaaagcgcagctgatgattcgatatgcaacccatctactgcagttcactgaagctgtttccaaagataggagcagggatgatagtgtgacgaaggctgcagttgctgtccttggggatcttgcagacacacttggcgcgagctcaaaggatctgttccagacccacctcttccatgttgagttcttgagggagtgccttgacttggatgatgaagttcaggagactgcatcatgggcccagggtatgataaaccaagcggtggtctcttaatgtgagatggttttgttctgttggttatgggaggtttcttttgtggctgtgccaagtccatttgccacaggtgaacgaaaggataccaatatatatgtagcgtcagtcctaggatctttgtcgtagcagtcgcgtggtgttgttggtctgtcaaagccgttgtgcgtcgcattagactgggtggattctgtctgtggatgtcttgaacagcaaaaacttggttaatttgtcttactcctgttattattcgatgctgctg

SEQ ID NO: 2651 - DNA, 3314 bp, Panicum virgatum
cggccccgcccgcagcccacctccctcctaaaccctagccgcctctccccctcccctctcccctccccgctccactccccctctttttcacgcgcccccttcccccgccggagttgcgtttcatttgaataggcgagcggggaagcatctcataaaccaccctccgctccgccgacccgtccccaaccctagcctccctcccgcgccgccccgacgtgacgccgcccggacctcgtgtgctccagtgcggcggggattcgttcgggcccggattgatttcctctctgcgtggatagggcatttgctacagccatggatattactcaaattctgctagctgctcaatctccggatgctaaccttcgaacagtagcagaaagcaacctcacacagttccaggagcagaatcttccaaacttcctcctctccttatcagtggaactctcgaatgatgaaaaacccccagagtctagaaggcttgctggtattatccttaagaattctttggatgcaaaggattctgcaaaaaaggagctattgactcagcattgggtcagtgtggatccttctatcaaatcgaagatcaaggactcgttgctggtaacactaggatcttcggtgcatgatgcaaggcatacctcatcacaagttattgccaaggttgcatcaattgagatcccacgtcgagaatggctagacctcattgccaagttattgggaaacatgacactaccgggtgcatcagctcctttgaagcaagcaacactagaggcattggggtatgtatgtgaggagatttctccgcagcacttggagcaggatcaagtgaatgctgttctcactgctgtggtccagggaatgaaccagacagagctcagccctgaagtccgtcttgcagcagttaaagccctttataatgctcttgactttgctgagagtaattttgcaaatgaaatggagaggaattatataatgaaggtggtttgtgacactgctgtgtctaaagaagtggagatcagacaggctgcatttgaatgccttgttgcaattgcatccacgtattattcacacttagattattatatgcaaaccatattcaacctgacagctaatgcagtgaaaggagatgaggaaccggttgcacttcaagctgttgagttctggagcgctatttgtgatgaagagattgctctccaagatgaatatgagggatctgatgatggcaactctactatacattttcgctttattgaaaaggcccttccttcacttgttccgatgctgctagaaactctgttgaagcaggaggaagatcaagaccaagatgataatgtctggaacatttctatgagtggtgggacgtgccttggactcattgctagaactgttggtgatgcaatcgtccctctggtcatgccatttgttcaggccaacatcacaaagccagattggcattgtcgtgaggcagctacctttgcatttggttctatcctagaaggcccctctgttgaaaaacttgctccactggtccagggtggtcttgattttttgctcaacacaatgaatgattcaaatagccaggtaaaagatactactgcttggacgctggggagggtatttgagctcttgcattctcctgctggtgcaaacccaattataaataattcaaaccttcctcgcatcatggctgtgttgcttgagagtagtaaagatgttccaaatgtggcggagaaagtctgtggagctatttattttctggcccaaggttatgaagatgcagagtccatgtcttctgtgctcacaccttatctacctaatgtcattgctgctcttctttctgctgcggatcgtgctgataccacccatttcaggcttcgtgcttctgcttatgaagcactgaatgagattgttagagtcagcaacgtacctgaaacttcaggcattatagggcagctactgcaggagatcatgagaagattaaaccttacatttgatctccatatactttcttctggtgacaaagagaagcaaagcgaccttcaggctttgctgtgtggtgtactccaagtcatcatccagaaactgagcagcacagatgcaaagtccataattgcccagactgctgatcagctgatgactctgtttctgcgggtctttgcctgccacagttctactgtgcatgaagaagctatgcttgctattggtgctcttgcctatgctactggtccagattttgtgaaatacatgcctaacttcttcacgtacctggaagctggcttgcagaattatgaagagtaccaagtgtgctccatctctgtaggagtggtgggtgatatttgccgtgccttggaagataaaattctgcctttctgtgatcgaattatgactgttcttcttaaggatctatcaaactctatgctcaatcggtctgtgaagcctccgattttctcatgctttggagatatagcgcttgctattggtgagaattttgagaaatacctgccatatgctatgcctatgcttcagggagctgctgaactccttggtacacttgatcagagtgatgatgatatggttgattatggcaaccagctcagaagggggatttttgaggcgtactctggtatactccagggtatcaagggcccaaaagcacagttgatgatcccatacgcaacccatctactgcagttcactgaagctatcttcagagataggagcagggatgatagtgtgacgaaggctgcagttgctgtcctcggggatcttgctgacacacttggcgcgagctcaaaggatctgttccagacccacctcttccatgctgagttcttgagagagtgccttgacttggacgatgaagttcgggagactgcgtcatgggctcaggggatgataaaccaagcggtggtctcttaatgtgagacggttttgttttgttggctatgggaggtttcttttgtggccgtgccaagtccatttgccacaggtgaacgaaaggataccaatatatatgtagcgtcagtcgtaggatccttgtcgtaggcatttctgcgttgtcgttgctctgtcaggccgttgtgtgtctaattagactgggtggattctgtcagtggatgtcttgaacagccaaacttggttcggttattctattgctggtattatcattttttatgttcggcagattaagttttgggggaaggttttaggctgtctgtttgccgtgcggtgttcatgtcatctgcatctgttccagatgatttccatctcagcctaaccgttggttatgtggaatattgtttcctgttggttaa

SEQ ID NO: 2652 - DNA, 3321 bp, Panicum virgatum
cctctccccctcctggctccctcccctcccccgctccgctcctctttttcatgcgccccctccccccgccggagttgcgtttcgtttgaataggcgagcggggaagcatctcataaaccaccctccgctccgccgacccgtccccaaccctagcctccctcccgcgccgccccgacgcgacgccgtccggatctcgtgtgctccagtgcggcggggattcgtccgggcctggattgatttcctctctgcgcggcggatagggcatttcctacagccatggatattactcaaattctgctagctgctcaatctcctgatgctaaccttcgaacagtagccgaaaccaacctcacacagttccaggagcagaatcttccaaacttcctcctctccttatcagtggaactctcaaatgatgaaaaacccccagagtctagaaggcttgcaggtattatccttaagaattctttggatgctaaggattcttcgaaaaaggagctattgactcagcaatgggtcagtgtggatccttctatcaaatcgaagatcaaggagtcattgctgggaacactaggatcttcggttcatgatgcaaggcgtacctcatcccaagttattgccaaggttgcatcaattgagatcccacgtcgagaatggcaagacctcattgccaaattattgggaaacatgacactgccgggtgcatcagctcctttgaagcaagcaacactagaggcattggggtatgtatgtgaggagatttctccacagcacttggagcaggatcaagtgaatgctgttctgactgctgtggtccagggaatgaaccagacagagctcagctctgaagtccgtcttgcagcagttaaagccctctataatgctcttgactttgctgagagtaactttgcaaatgaaatggagaggaattatataatgaaggtgatttgtgacactgctgtatctaaagaagtggaaatcagacaagctgcatttgaatgccttgttgcaattgcatccacatattattcacacttagattattacatgcaaaccatattcaacctgacagctaatgcagtgaaaggagatgaggaaccggttgcacttcaagctgttgagttttggagcgctatttgtgatgaagagattgctctccaagatgaatatgaaggatctgatgatggcaactctactatacattttcgctttattgaaaaggcccttccttcactggttcctatgctgctagaaactttattgaagcaagaggaagatcaagaccaagatgacaatgtctggaacatttctatgagtggtgggacgtgccttggactcatcgctagaactgttggtgatgcaatcgtccctcttgtcatgccatttgttgaggccaacatcacaaagccagattggcattgtcgtgaggcagctacctttgcatttggttctatccttgaaggcccatctgttgaaaaacttgctccactggtccagagtggtcttggtttcttgctcaacacaatgaatgattcaaatacccaggtaaaagatactactgcttggacgcttgggagggtatttgagctcttgcattctcctgctggtgcaaacccaattataaatagttcaaaccttcctcgtatcatggctgtgttgcttgagagtagtaaagatgttccaaatgtggctgagaaagtttgtggagctatttattttctggcccaaggttatgaagatgcagagtccatgtcttctgtgctcacaccttatctacctaatgtcattgctgctctactttctgctgcggatcgtgctgatacgacccatttcaggcttcgtgcttctgcttatgaagcactgaatgagattgttagagttagcaacgtacctgaaacttcaggcattatagggcagctactgcaggagatcatgagaagattaaaccttacatttgatctccatatactttcttctggtgacaaagagaagcaaagcgaccttcaggctttgctgtgtggtgtactgcaggtcatcatccagaaactgagcagcacagatgctaagtccataattgccctgactgctgatcagctgatgactctgtttctgcgggtctttgcctgccacagttctactgtgcatgaagaagctatgcttgctattggcgctcttgcctatgctactggtccagattttgtgaaatacatgcctaacttcttcacgtatctggaagctggcttgcagaattatgaagagtaccaagtgtgctccatctctgtaggagtggtgggtgatatttgccgtgccttggaagataaaattctgcccttctgtgatcgaattatgactgttcttcttaaggatctatcaaactctatgctcaatcggtctgtgaagcctccgattttctcatgctttggagatatagctcttgctattggtgagaattttgagaaatatctgccatatggtatgccgatgcttcagggagctgctgaactccttggtactcttgatcagagtgatgatgatatggttgattatggcaaccagctcagaaggggaatttttgaggcgtactctggtatactccagggtatcaaaggcccaaaagcacagctgatgatcccatacgcaacccatctactgcagttcactgaagctgtcttcagagataggagcagggatgatagtgtgacgaaggctgcagttgctgtcctcggggatcttgctgacacacttggcgcgagctcaaaggatctgttccaggcccacctctttcatgttgagttcttgagggagtgccttgacttggatgatgaagttcgggagactgcgtcatgggctcaggggatgataaaccaagcggtggtctcataatgtgagacggttttgttatgttggctatgggaggtttcttttgtggctgtgccaagtccatttgccacaggtgaacgaaaggataccaatatatatgtagtgtcaggcttaggatccttgtcgtaggcatttgtgcgttgttgttgatctgtcaagccgttgtgtctaattagacttggtggattctgtcagtggttgtcttgaacagccaaacttggttcgtttatcctattgctggtattatcatttttcatgctcggcagattgagttttgggacaaggttttaggctgtctgccgtgcgatgttcatgtcatctgcatctgttccaaattatttccatctcagcctaaccgttgggttatgctgaatattgttgcctgttggttaatttgtcagttattcatggtagataagtttacatgtgaatgaattcaaa

SEQ ID NO: 2653 - DNA, 3042 bp, Echinochloa colona
tcccccgccggagtcgcgtttcattcgaatttgaataggcgagcggggcagcctctcatgaaccacctccgctccgctctgccgacccgtcccgaaccctagcctccctcccgcgccgccgcccggatctcgcgtgctcgcttacggcggggattcgtccgggcctggattgatttctcctctgcgcggatagggtatttgctacagccatggatatcactcaggttctgttagctgctcaatctccggatgctaaccttcgaacagcagctgaaagcaacctcacacagttccaggagcagaatcttcctaatttcctcctctccttatcagtggaactatcagatgatgggaaacccccagagtctagaaggcttgctggtattatccttaagaattctttggatgcaaaggattctgcaaaaaaggacctactgactcagcaatgggtcagcgtggatccatctatcaaatcaaagatcaaggagtcattgctggttacactagcatcttcggtgcatgatgcaagacatacctcatcacaagttattgccaaggttgcagccatcgagataccacgtcgagaatggcaagacctcattgctaaattactggggaacatgacaacgccgggtgcatctgctcctttgaagcaagcaaccctggaggcactggggtatgtgtgtgaggagatttctccgcagcacttggagcaggatcaagtgaatgctgttctgactgctgtggtccagggaatgaaccagacagagctcagccctgaagtccgtcttgcggcagttaaagccctttataatgctcttgactttgctgagagtaactttgcaaatgaaatggaaaggaattatataatgaaggtggtttgcgatactactgtgtctaaagaagtggtgatcagacaggcggcatttgaatgccttgttgcaattgcatccacatattattcacacttagatccttatatgcaaaccatattcaacctgacagctaatgcagtgaaaggagatgaggaaccggttgcacttcaagctgttgagttctggagtgctatttgtgatgaagagattgcactccaagatgaatatgagggatctgatgatggcaactcaactatacattttcgctttattgaaaaggcccttccttcacttgttccgatgctgctagagacacttttgaagcaagaggaagatcaagatcaagatgataatgtctggaacatttctatgagtggtgggacgtgccttggactcattgctagaactgttggtgatgcaattgtccctcttgtgatgccatttgttgaggccaacatcacgaagcctgattggcattgccgtgaggcagctacctttgcatttggttctatccttgaaggcccctctgttgaaaaacttgctccgctggtccaggctggtcttgatttcttgctgaacacaatgaacgattcaaacagccaggtaaaagatactactgcttggactcttgggagggtatttgagatcttgcattctcctgctggtgcaaacccaatcataaataattcaaacctacctcgtatcatggctgtgttgcttgagagtagtaaagatgttccaaatgtggctgagaaagtatgtggagctatttattttctggctcaaggatatgaagatgcagagtctttgtcttcagtgctcacaccttatctaccgaatgtcattgctgctcttcttaatgctgcggatcgtgctgataccacccatttcaggctccgtgcttctgcttatgaagcactgaatgagattgtcagagtcagcaacatacctgaaacttcaggcattgtaggccagttactgcaggagatcatgagaagattaagccttacatttgatctccatatactttcttctggtgacaaggagaagcaaagcgatttgcaggctttgttgtgtggtgtgctgcaggtcatcatccagaaattgagcagcacagatgcaaagtccataattacccagactgctgatcagcttatgacactgtttttgcgtgtctttgcctgccacagttcaaccgtgcatgaagaagcaatgcttgcaattggtgctcttgcctatgctactggtccagattttgtgaaatacatgcctggcttcttcacatatctggaagctggcttgcagaattatgaagaataccaagtgtgctccatctctgtaggggtggtgggtgatatttgccgtgccttggaagataaaattctgcccttctgtgatagaatcatgactgttcttctcaaggacctatcaaactctatgctcaatcggtctgtgaagcctctgattttctcatgctttggagacattgctcttgctattggtgagagctttgagaaatacctgccatatgctatgccaatgcttcagggagctgcagaactccttggtactcttgatcagagcgatgatgatatggttgattatggcaaccaactcagacggggcatttttgaggcatactctggtatacttcagggtatcaagggcccaaaagctcagctgatgatcccatacgcaacacatctgctgcagttcaccgaagccgtcttcagagataggagcagggatgatagtgtgacaaaggctgcagttgcagtccttggggatcttgcggacacacttggtgcaagctcaaaggaactgttccatacccaccttttccatgttgagtttttgagggagtgccttgacttggatgatgaagttcgagagactgcatcatgggcccaggggatgataaaccaagcgttggtctcttaatgtgaggtggtttttattttgttggttatgggaggtttcttttgtggctgtgccaagtccatttgccaccggtgaacgaaaggataccaatatatatgtagcgtcagtttcgtaggcatttgtgcgttgttggtctgtcaagccggtgtgcttcacattagacttggtggattctgtctgtcgatgtcctgaacagcaaacctggttcatttgtcttattactggt

SEQ ID NO: 2654 - DNA, 3222 bp, Pennisetum glaucum
ggcggattcatttgaatagacaagcgggggagcatctataaaccacacctccgctccaccgacccgccccgaatcctagcctccatcccgcgccgccgccggctccgcccccagcgacgccgttcggatctcgcgtgctcgcctgcgggcgggattcgtccgggcctggattgatttctcctctgcgcggatagggcatttgctacagccatggatattacacaggttctgctagcagctcaatctccggatgctaaccttcgaacagcagcagaaagcaacctcacgcagtttcaggggcagaatcttccaaacttcctcctctcattatccatagagctctcgaatgatgaaaaacccccagagtctagaaggcttgctggtattatcctcaagaattctttggatgcaaaggattctgcaaaaaaggagctactgactcagcaatgggtcagcgtggatccatctttaaaatcaaagatcaaggagtcgttgctggtaacactaggatcttcagtccatgatgcaaggcatacctcatcacaagtcattgccaaggttgcatcgattgagataccacgccgagaatggcaagacctcattgcccaattactggggaacatgacatccccgggtgcatctgctcctttgaagcagcaccctagaggcattggggtatgtatgtgaggagatttccccgcagcacttggagcaggatcaagtgaatgctgttcttactgctgtggtccagggaatgaaccagacagagctcagccctgaagttcgtcttgcagcagttaaagccctttataatgctcttgactttgctgaaagtaactttgcaaatgaaatggagaggaattacataatgaaggtgatttgtgatactgctgtgtctaaagaagtggagatcagacaggcggcatttgaatgccttgttgcaattgcatccacatattattcacacttagatccttatatgcaaaccatattcaacttgactgctagtgcggtgaaaggagatgaagagcaggttgcactccaagctgttgagttctggagcgctatttgtgatgaagagattgcgctccaagatgaatatgagggatctgatgatggcaactctactatgcactttcgttttattgagaaggctcttccttcacttgttccgatgctgctagaaactctattgaagcaagaggaagatcaagatcaagatgataatgtatggaacatttctatgagtggtgggacgtgccttggactcattgctagaactgttggtgatgcaattgtgcctcttgtgatgccgtttgctgaggccaacatcacaaagcctgattggcatagtcgcgaggcagctacctttgcatttggttctattcttgaaggcccctctgttgagaaacttgttccacttgtccagggttgtcttgacttcctgctcaacacaatgaatgattcaaatagccaggtaaaagatactaccgcttggacccttgggaggatttttgagatcttgcattctcctgctggtgcaaacccaatcataaataactcaaatctccctcgtatcatggctgtgttgcttgagagtagcaaggatgttccaaatgtggctgagaaagtctgcggtgctatttattttctggcccaaggttatgaagatgtagagtccatgtcttctgtgctcacaccttatctacctaaagttattgccgcgcttctcaatgccgcggatcgtgctgataccacccatttcaggctccgtgcttctgcttatgaagcactgaatgagattgtgagagtcagcaatgttcctgaaacttcaggcattattggccagttattgcaggagatcatgagaagattaaaccttacatttgatcttcatatactttcttctggtgacaaagagaagcaaagcgatctgcaggcgttgttgtgtggggtactgcaggtcatcatccagaaactgagcagcacagatgcaaagtccataattgtccagattgctgatcagctgatggttctgtttctgcgtgtctttgcctgccacagttctactgtgcatgaagaagcaatgcttgcaattggtgctcttgcatatgctactggttcagattttgagaaatacatgcctaatttcttcacattcctggaagctggcttgcagaattgtgaagagtaccaagtctgctccatctctgtaggggtggtgggtgatatttgccgtgccttggaagataaaattctgcccttctgtgatcggattatggctgttcttctgaaggacctatcaaactctatgctcaatcggtctgttaagcctccgattttctcatgctttggagacatagctcttgctattggtgagaattttgagaaatacttgccctatgcgataccaatgctccagggagctgcagaactcctcggtactcttgatcagagtgatgatgatatggttgattatggcaaccagctcagacggggtatttttgaggcgtactctggtatactccagggtatcaagggcccaaaagcgcagctgatgattccatatgcaacccatctactgcaattcactgaagctgtttccaaagataggagcagggatgatagtgtgacaaaggctgcagttgctgtcctcggggatcttgcagacacacttggtgcgagctcaaaggatctgttccagacccacctcttccatgttgagttcttgagggagtgccatgaattggacgatgaagttcaggagactgcatcatgggcccagggtatgataaaccaagcggtggtctcttaatgtgagatggttttgttgaggtttcttttgtggctgtgccaagtccatttgccacaggtgaacgaaaggttaccaatatatatgtagcgtcagtcctaggatccttgtcatagaacttgcgtgttgttggtctgttgaagctgctgtgcgtcacagtagactgggtggattctgtctggggatgtcttgaacagcaaaaaatttggttaatttgtgttattcatggtattattcaatgctgttgccgatgctgatgcatcctatgatcatgtccatctgatcatattttggtatctgctgatgatgaaacgcatatagctgggtgcattctcccagaatttgaatagtacatgctttttctgccgagggcaaaagtctacttgagctcctgaggcaaacaaaatgtt

SEQ ID NO: 2655 - DNA, 3112 bp, Setaria italica
cgcccgcagccgcaggcctcccgcccgcaggccaccttccctcctaaaccctagccgcctctcccctgccctcccctccccgctcctctgttcttcgcgcccccggcgacgccgtccgtatcggcgtgcagcggggattcgtccaggcctggattgatttccctgtgcggatagggcatttgctacagccatggatataactcagattctgctagctgctcaatctccggatgctaatcttcgaacagtagcagaaagcaatctcaagcagttccaggagcagaatcttcctaacttcctcctctccttatcagtagagctctctaatgatgaaaaacccccagagtctagaaggcttgctggtattatccttaagaattctttggatgcaaaggattctgcaaaaaaggagctactgactcagcaatgggtcagcatggatccatctatcaaattgaagatcaaggagtcgttgctggtaacactaggatcttcggtgcatgatgcaagacataccacatcacaagtcatcgccaaagttgcgtcagttgagataccacgtcgagaatggcaagacctcattgccaaattactggggaacatgacatcaccgtctgcatatgctcctttgaagcaagcaactctagaggcactggggtatgtatgcgaggagatttctccgcagcacttggagcaggatcaagtgaatgctgttctgacagctgtggtccagggaatgaaccagacagagctcagctttgaagtccgtcatgctgcagttaaagccctttataatgctcttgactttgctgagagtaactttgcaaatgaaatggagaggaattatataatgaaggtggtttgtgatactggtgtgtctaaagaagtggagatcagacaggcggcatttgaatgccttgttgcaattgcatccatatattattcgcacctagatccttatatgcagaccatattcaatctgacagctaatgcagtgaaaggagatgaggaatcggttgcacttcaagctgttgagttctggagtgctatttgtgatgaagagattgcactccaagatgaatacgagggatctgatgatggcaactctactgtgcatttccactttatagaaaaggccctcccttcacttgttcctatgttgctagaaactctattgaagcaagaggaagatcaagatcaagatgataatgtatggaatatttctatgagtggtgggacgtgccttggactcattgctagaactgttggtgatgcaatcgtccctcttgtgatgccgtttgttgaggccaacatcacgaagcctgattggcattgtcgtgaggcagctacctttgcatttggttctatccttgaaggcccctctgttgaaaagcttgttccgctggtccaggctggtcttgatttcttgctcaacacaatgaatgattcaaatagccaggtaaaagatactactgcttggactcttgggagggtattcgagctcttgcattccccagctggtgcaaacccaatcataaataattcaaaccttcctcgaatcatggctgtgttgcttgagagtagtaaagatgttccaaatgtggctgagaaagtctgtggagctatttattttctggcccaaggttatgaagatgtagaatccatgtcttctgtgctcacaccttatctgcctaatgtcattgctgctcttctttctgctgcggatcgtgctgataccacccatttcaggcttcgtgcttctgcttatgaagcactgaatgagatcgtgagagttagcaacatacctgaaacttcaggcattataggccagttattgcaggagatcatgagaagattagaccttacatttgatctccagatactctcttctggtgacaaagagaagcaaagcgatctgcaggctttgctgtgtggtgtactgcaggtcatcatccagaaactgagcagcacagattcaaagtccataatcacccagactgctgaccagctgatgcttttgtttctgcgtgtctttgcctgccacagttctacggtgcatgaagaagcaatgcttgcaattggtgctcttgcatatgctactggttcagattttctgaaatacatgcctcagttcttcacatacctggaagctggcttgcataattatgaagagtaccaagtgtgctccatctctgtaggggcgttgggtgatatttgtcgtgccttggaagataaaattctgcccttctgtgatagaattatgactgttcttctcaaggacctatcaaactctatgctcaatcggtctgtgaagcctttgattttctcatgctttggagacattgctcttgctattggtgagaattttgagaaatacctgccatattctatgccgatgcttcagggagctgcggaactccttggtactcttgatcagagtgatgatgacatggttgattatggcaaccagctcagacggggcatttttgaggcatactctggtatactccagggtatcaagggcccaaaagctcagctgatgattccatacgcagcccatctactgcagtttaccgaagctgtcttcaaagataggagcagggatgagagtgtgacaaaggctgcagttgctgtccttggggatcttgcggacacacttggcgcaagttcgaaggatatgttccagaccaacctcttccatgttgagttcttgagggagtgcatcgactcagacgatgaagttcgggagactgcatcttgggcccaggggatgataaaccaagtggtggtctcgtaatgtgagatagtttcatcttgttggttagaggtttttgtggctgtgccaagtccatttgccaatatatatgtagtgccagtcttaggatccttgtaggcatctgtgcattgttgtcgatctttcgagctgtcgtgactcacattagacctgttggattctgtctgtcggtgtcttgaacagcaaaacttctttcatttgtcttattgctggtattattcagtgctgctgatgacgcttccttttccatgcctagcagatcaatttttgagaaaatgtatctgctgatgacaagaacattgcacggcaaacacgtgt

SEQ ID NO: 2656 - DNA, 3016 bp, Setaria italica
gccaccttccctcctaaaccctagccgcctctcccctgccctcccctccccgctcctctgttcttcgcgcccccggcgacgccgtccgtatcggcgtgcagcggggattcgtccaggcctggattgatttccctgtgcggatagggcatttgctacagccatggatataactcagattctgctagctgctcaatctccggatgctaatcttcgaacagtagcagaaagcaatctcaagcagttccaggagcagaatcttcctaacttcctcctctccttatcagtagagctctctaatgatgaaaaacccccagagtctagaaggcttgctggtattatccttaagaattctttggatgcaaaggattctgcaaaaaaggagctactgactcagcaatgggtcagcatggatccatctatcaaattgaagatcaaggagtcgttgctggtaacactaggatcttcggtgcatgatgcaagacataccacatcacaagtcatcgccaaagttgcgtcagttgagataccacgtcgagaatggcaagacctcattgccaaattactggggaacatgacatcaccgtctgcatatgctcctttgaagcaagcaactctagaggcactggggtatgtatgcgaggagatttctccgcagcacttggagcaggatcaagtgaatgctgttctgacagctgtggtccagggaatgaaccagacagagctcagctttgaagtccgtcatgctgcagttaaagccctttataatgctcttgactttgctgagagtaactttgcaaatgaaatggagaggaattatataatgaaggtggtttgtgatactggtgtgtctaaagaagtggagatcagacaggcggcatttgaatgccttgttgcaattgcatccatatattattcgcacctagatccttatatgcagaccatattcaatctgacagctaatgcagtgaaaggagatgaggaatcggttgcacttcaagctgttgagttctggagtgctatttgtgatgaagagattgcactccaagatgaatacgagggatctgatgatggcaactctactgtgcatttccactttatagaaaaggccctcccttcacttgttcctatgttgctagaaactctattgaagcaagaggaagatcaagatcaagatgataatgtatggaatatttctatgagtggtgggacgtgccttggactcattgctagaactgttggtgatgcaatcgtccctcttgtgatgccgtttgttgaggccaacatcacgaagcctgattggcattgtcgtgaggcagctacctttgcatttggttctatccttgaaggcccctctgttgaaaagcttgttccgctggtccaggctggtcttgatttcttgctcaacacaatgaatgattcaaatagccaggtaaaagatactactgcttggactcttgggagggtattcgagctcttgcattccccagctggtgcaaacccaatcataaataattcaaaccttcctcgaatcatggctgtgttgcttgagagtagtaaagatgttccaaatgtggctgagaaagtctgtggagctatttattttctggcccaaggttatgaagatgtagaatccatgtcttctgtgctcacaccttatctgcctaatgtcattgctgctcttctttctgctgcggatcgtgctgataccacccatttcaggcttcgtgcttctgcttatgaagcactgaatgagatcgtgagagttagcaacatacctgaaacttcaggcattataggccagttattgcaggagatcatgagaagattagaccttacatttgatctccagatactctcttctggtgacaaagagaagcaaagcgatctgcaggctttgctgtgtggtgtactgcaggtcatcatccagaaactgagcagcacagattcaaagtccataatcacccagactgctgaccagctgatgcttttgtttctgcgtgtctttgcctgccacagttctacggtgcatgaagaagcaatgcttgcaattggtgctcttgcatatgctactggttcagattttctgaaatacatgcctcagttcttcacatacctggaagctggcttgcataattatgaagagtaccaagtgtgctccatctctgtaggggcgttgggtgatatttgtcgtgccttggaagataaaattctgcccttctgtgatagaattatgactgttcttctcaaggacctatcaaactctatgctcaatcggtctgtgaagcctttgattttctcatgctttggagacattgctcttgctattggtgagaattttgagaaatacctgccatattctatgccgatgcttcagggagctgcggaactccttggtactcttgatcagagtgatgatgacatggttgattatggcaaccagctcagacggggcatttttgaggcatactctggtatactccagggtatcaagggcccaaaagctcagctgatgattccatacgcagcccatctactgcagtttaccgaagctgtcttcaaagataggagcagggatgagagtgtgacaaaggctgcagttgctgtccttggggatcttgcggacacacttggcgcaagttcgaaggatatgttccagaccaacctcttccatgttgagttcttgagggagtgcatcgactcagacgatgaagttcgggagactgcatcttgggcccaggggatgataaaccaagtggtggtctcgtaatgtgagatagtttcatcttgttggttagaggtttttgtggctgtgccaagtccatttgccaatatatatgtagtgccagtcttaggatccttgtaggcatctgtgcattgttgtcgatctttcgagctgtcgtgactcacattagacctgttggattctgtctgtcggtgtcttgaacagcaaaacttctttcatttgtcttattgctggtattattcagtgctgctgatgacgcttccttttccatgc

SEQ ID NO: 2657 - DNA, 3203 bp, Oryza sativa
ctagccgcctccgccgcctcctcccccctcaaatccccccacctcctcgcttccccccttcctccgcccgccggagcagagttccttctccttccatccattccgttcgggaatcaggcgagcgcgtcagcatccccctcctcctcctctcgcggccgccttcgtcgcaggcatcgccgtgctctgaccggagggcacttgttctttccttcgtcagagcggaggggagcggaggagcggagccggagatccagatctgcacgggaaggtatctcccgctgttggtacagccatgaatatcactcaaatcctgctatcagctcaatctgcagatggtaaccttcgggtagtagcagaagggaacctcaagcagttccaggagcagaatcttcccaacttccttctctccttgtcagtggaactttcggataatgaaaaaccaccagagtctagacgacttgctggtattatccttaagaactccttggatgcaaaggattctgcaaaaaaggaactactgattcagcaatgggtcagcctggatccatcaatcaaacagaagataaaggagtccttgctgataacgctaggatcttcggtgcatgatgctaggcatacctcatcacaagtcattgccaaggttgcatccattgagatcccccggcgtgaatggcaagaactcattgccaaattattgggcaacatgacacaacagggtgcacctgctccactaaagcaagcaactctagaggccttagggtatgtctgtgaggagatttctcctgaacacttggagcaggatcaggtgaatgctgttctaactgctgttgtccagggaatgaaccagacagagctaagccctgaagtccgtcttgcagcagttaaagccctatataatgctcttgattttgctgagagcaactttgcaaatgaaatggaaaggaattatatcatgaaggtaatttgtgatactgctgtatcgaaggaagtggagatcaggcaggcagcctttgaatgccttgttgcaattgcttccacatattatgtacacttggatccttatatgcaaaccattttcaacctgacagctaatgctgtcaaaggagatgaggaagcagttgcacttcaagctattgagttctggagcactatttgtgatgaagagattgagctccaagaagaatatgagggatctgatgatgctaattctactgtaaattatcgcttcattgagaaggccctcccttcacttgttccgatgctgctagaaactctgttaaagcaagaggaagatcaagatcaggatgataatgtatggaacatttccatgagtggtgggacatgccttgggctcattgctagaactgttggtgatgcgattgtgcctcttgtgatgccttttgttgagggtaacatcacaaaaccagattggcattgtcgtgaggcagctacttttgcatttggttctatccttgaaggtccatctgtggagaaacttgctcccctggtacaggctgggcttgacttcctgctgaacacaacaaaagacccgaatagtcaggtaagggacaccactgcatggactcttgggagggtatttgagctcctgcattctccagccagtgcaaatccaattataacaagcgcaaaccttactcgtatcatgactgtcttgctggaaagtagtaaggatgttccaaatgtggctgagaaagtctgtggagccatatattttcttgcccaaggttatgaagacgcagagtcgatttcatctgtgcttacaccttttcttcctaatctcattgctgctctcctttctgcggcggatcgtgctgataccacccacttcaggcttcgtgcatcagcttatgaagcattgaatgagattgtgagagtcagcaacatatctgaaacgtcaggcattataggtcagttactgcaggagatcatgaggagattgaatctgacgtttgatctccatatactttcatctggtgacaaggaaaagcaaagtgatcttcaggcattactgtgtggtgtactgcaggtcatcattcagaaattgagcagctcggatgctaagtcaataattgcccagactgctgatcagttgatgtttctgtttctgcatgtttttgcttgccacagctctactgtacacgaagaagcgatgcttgccatcggtgctcttgcttatgccactggtacagattttgtgaaatacatgcctgagtttttcaagtatctggaagctggcttgcagaattatgaagagtaccaagtctgttccatctctgttggagtggtgggtgatatttgccgtgccttggaagataaaattttgcccttctgtgatgggattatgactgttcttctcaaggacctgtcaaactcgatgcttaatcgttctgtgaagcctccgattttctcatgctttggagacattgctcttgctattggtgataattttgagaaataccttccttatgctatgccaatgcttcaaggagctgccgaacttcttgctgttttggaccatacagatgaggatatggttgattatggtaaccagctcagacggggaatctttgaagcttactctggcatactccagggtataaagggtgcaaaagctcagttgatgataccctatgcaagccatctattgcagttcactgaagctgtctacaaggaccgcagcagggatgagagcgtgacaaaggctgcagttgctgtcctgggggatcttgcggacacactcggctcaagctcaaaggatctgttcaaaagcaacctcttccatgttgagttcctgagggagtgccacgatttggatgatgaagttagggacaccgcgtcatgggcccagggaatgataaaccaagcactggtttcttaagaggggattattttgttttgtcagttattggggaggtttcttttgtggctgtgccaagaccatttgccacagattgaacgaaaggataccaacatatatgtagcgtcagtcgtaggctgcttctgtgcttttgtcgtcagtctgtcaagtcagtttatgcgtcgcatttggcgtgggtggattctggcattgaatgtcttgaacagctaaacctgttaatgttaatgtattctacctgtggtgtttatccattcgattctgctgatgttactgcctgcctaagagcaagtttaatagtatagcc

SEQ ID NO: 2658 - DNA, 3585 bp, Sorghum bicolor
ggaaatcctcgctctcacgagaccgcgccgccgcacctctgcctggctgcctgagcgccgccgctcctctgctctcctccacctgcgcgcagccgctcctctgcttacctccgactgagcaccgccgctgctccacctgcgcgcccctgtccgtcgctctacctctccacctgctactgttcgaagctgctcaatctccagatgctaaccttcgaacagtagcagaaggcaacctcacgcagttccaggagcagaatcttcctaacttcctcctctccttatcaatagagctctcgaacgatgaaaaacctccggagtctagaaggcttgctggtattatccttaagaattctttggacgagaaggattctgcgaaaaaggagctactgactcagcaatgggtaagcgtggatccatctgtcaagttgaagatcaaggagtcgttgctggtgacactaggatcttcggtgcatgatgcgaggcatacctcttcacaagtcattgccaaggttgcatcaattgagataccacgtcgagaatggcaagaccttgttgccaaattactgggcaacatgacttctccaggtgcatctgctcctttgaaacaagcaacactagaggcattggggtatgtctgtgaggagatttctccactggacatggagcaggaccaagtgaatgctgttctgactgctgttgtccagggaatgaaccagacagagctcagccctgaagttcgtcttgctgcagttaaggccctatacaatgctcttgacattgccgtgagtaactttgcaaatgaaatggagaggaattatataatgaaggtggtttgtgagactgctgtgtctaaagaagtggagatcagacaggctgcatttgaatgccttgttgcaatagcatccacatattatccacacttagatccttacatgcaaacgatattcaacctgacagctaatgcagtgaaaggtgatgaggaaccagttgcgcttcaagctgttgagttctggagcgctatttgtgatgaagagattatgctccaagatgaatatgagggatctgaggatggcaactctactgcacacttttgctttattgaaaaggccctcccttcacttgtaccgatgctgctagaagctttgttgaagcaagaggaagatcaagatcaagatgataatgtttggaacatttctatgagtggtgggacgtgcctcggactcatttctaaaactgttggtgatgcagttgtccctcttgtgatgccatttgtcgaggccaacatcacaaagcctgattggcattgtcgcgaggcagctacttttgcatttggttctatccttgaaggcccctctgttgaaaaacttgctccactggtccaggctggtcttgatttcttgcttaacacaatgaatgatacaaatagccaggtaaaagatactactgcttggactcttgggagggtatttgagctcttacattctccagatggtgcaaacccaatcataaataattcaaaccttcctcgtatcatgtctgtgttgcttcagagtagtaaagatgctccaaatgtggctgagaaagtctgtggagctatttattttcttgcccaaggttatgaagatgcagagtcaatgtcttctatgctcacaccttatctacctaatatcattgctgctcttctttctgccgcggaccgtgctgataccacccatttcaggcttcgtgcttctgcttatgaagcactgaatgagattgtgagagtcagcaatatacctgaaacttcaggcatcataggccaattgttgcaggagatcatgagaagattaaaccttacatttgatctccatatactttcttctggtgacaaggagaagcaaagcgatcttcaggctttgctatgtggtgttctgcaggtcatcatccagaaactgagcagcacagatgcaaagtccataatttctcagactgctgatcagttgatgatgctgtttctgcgcgtctttgcctgccacaattctactgttcatgaagaagctatgcttgcaattggtgctcttgcatatgctactggtccagattttgttaaatacatgcctaacttcttcacatatctggaggctggcttgcagaattatgaagagtaccaagtgtgttccatctctgttggggtggttggtgatatttgtcgtgccttggaagataaaattttgccattctgtgatagcattatgactgttcttcttaaaaacctatcaagctctatgctcaatcggtctgtgaagcctccgatcttctcatgctttggagacattgctcttgctattggtgagaattttgagaaatacctaccatatgccattccgatgcttcaaggagctgcaggactccttggtactcttaatcagagtgatgatgatatggttgattatggcaaccagctcagacgcggcatttttgaggcatactctggtatactccagggcatcaagggcccaaaagctcagcagatgattccatatgcaacccatctactacagttcactgaagctgtcttcaaagataggagcagggatgatagtgtgacaaaggctgcagttgctgtccttggggatctcgcagacacgcttggcgagagctcaaaggatctgttcaagacccaactattccatattgagttcttgagggagtgccaagcccaagagttggatgatgaagttcgggatactgcacaatgggcccaggggatgataaacctggcggtggtttcttaatgtgggatggttttggtttgttggttatgggaggtttcttttgtggctgtgccaagttcatttgccacagatgaatgaaaggatacctatatatatgtagcgttagtcttaggattctggtaggcatttgtgcgttgttgttggtctgtcaagccggtgtgcgtcacattggactgggtggcttctgtccgtggatgtcttgaacagcaaaacttggttcatttatcttggtatttttcaatgccggtgttgtgtttgcttcctgtttttaatttcttgtccagctgatcaaatttatataggatgcacacgtacatttaatcatgatttgatctgctggacatgtttggttactggttactccatttccctatcattatagcttctaagcattcagcctaattaggctgccataaaatgcaggattcatttaacatggactttttaggcgcagagtgtttcagtggcgcattaatatgatggctgaattgtggggcaaagttgatccatagcaaccataagcttgatgggaatatatggtgacaattgtggatgtggtgtgcagaatctatatgatatatggtgataacagtagtgagaatcagcaacaaaatctttatagaatgacaattttgagatgaacctcgacactctaaatctcgagatattttttgagacacatgtttagtgttttagaagttgcacattatctttgtattagataaaccggactataaatgcttagttatgctctgaatatgtgattgtaaatgaatatgcatgatgtagccagggaaaataatctgcagtt

SEQ ID NO: 2659 - DNA, 2870 bp, Secale cereale
tcagtgaacctgcgctcctcatcccgtcacccccaaaacccagtctcccgcctctaaaccctagccgccggcgctgcctatattcccctccctcccttcctcctccgcagtcctcttccatttgtctgggagaggcgggcgagcgagcgagcgagcgcggaagcatcccccggcagattcgttcttctgggcaggtgcaacagtcatggatatcactcagattctgctagctgctcagtctccagatggcaaccttcgctcagcagcagagggcaacatcaagcagttccaggagcagaatcttcccaacttcctcctatccttgtcagtggagttatcgaatgatgaaagaccaccagagtctagaagacttgctggtattatccttaagaattcactggacgcaaaggattctgcaaagaaggagctgctgactcagcaatgggtcagcttggatcactcgatcaaattgcagatcaaggagtcattgctgataacactaggatcttcggtgggtgatgcacgtcagacgtcatcacaagtcattgcaaagattgcatccattgagataccccgtcgggaatggcaagacctcattgccaaattactgagcaacatgacacagcctggggcctctgcgccactaaagcaagcaactctagaagcattggggtatgtctgtgaggagattcctcctgagcacttggagcaggatcaagtgaatgctgttctgactgctgtggttcaggggatgaaccagacagagctaagctctgaagtccgtcttgcagcagttaaagctctgtataatgctcttgactttgctgagagcaactttgcaaatgagatggagaggacctttataatgaaggtaatatgtgatactgctgtgtctaaagaagtggagatcaggcaggcagcctttgaatgccttgttgcaattgcatccacatattatgtgcacttagatccttacatgcaaaccatattcaacctgacagctaatgctgtcaaaggagatgaggaaccagttgcactgcaagctgttgagttctggagtactatttgtgaggaagagattgaactccaagaggaatatgagggatctgatgatgctaactcaactgtaaattatcgcttcattgaaaaggccctcccttcacttgttccaatgctgctagaaactctgttgaagcaagaggaagatcaagagcaagatgataatgcttggaacatttccatgagtggtggaacatgccttggactcattgctagaactgtcggtgatgcaattgtccctcttgtgatgccatttgtggaagctaacatcacaaagccggattggcgttgtcgtgaggcagccacttttgcatttggttctatccttgatggcccatcccttgagaaacttgctcccctggtacaggctggtcttgatttcttgctcaatacaatgaatgatccaaacagccaggtaaaagacaccactgcatggactcttggacgggtatttgagcttttgcattctccatgcagtgctaatccaatcatatcaaatgcaaaccttcctcgtatcatgtctgtgttgctagagagtagcaaagatgttccaaatgtggctgagaaagtctgtggagccatatatttccttgcccaaggttatgaagatgcagaggcagtctcatctttgcttacaccttatcttcctaatgttatcgctgcactccttactgctgcggatcgtggtgatatgacccatgtaaggcttcgtgcatctgcttatgaagcgctgaatgaggttgttagagtcagcaatatacccgaaacttcaagcattataggccagttattgcaggagatcatgagaagattgaacctgacttttgatcaccaaatattttcatcaggcgacaaggagaagcaaagcgatctgcaggctttgctgtgtggtgtactgcaggttattatccagaaattgagcagctcagatgcaaagtccatcattgcacagactgctgatcagttgatgcttctgttccttcgtgtctttgcttgccacagtgctactgtacatgaagaagcaatgcttgccattggtgctcttgcttatgccaccggtccagattttgtgaaatacatgcctgagtttttcaagtaccttgaggcaggattgcagaattatgaagaataccaagtatgctccatctctgtaggggtggtgggtgatatttgccgtgccttggaagataaaaatttgcccttctgtgatgggatcatgactgtgcttctcaaggatctctcaaactcacagctcaacaggtctgtcaagccccccattttctcatgctttggagacattgctcttgccatcggtgataattttgagaaatacctgccgtatgctatgccgatgcttcaaggggcggctgagcttcttgttgttttggatcaaaatgatgaggatatggttgattatggtaaccagctcagacggggaatatttgaggcatactctggcatactacagggcataaagggtgcaaaagctcagctgatgataccttatgcaggccatctattgcagttcaccgaagctgtctacaaagatcggagcagggatgagagcgtgacgaaggctgcggttgctgtcctgggggatctcgcggacacacttgggccaatctcgaaggatctgttcaagagccacctcttccatgttgagttcctgagggagtgccaagatctggatgatgaagtcagggagacggcgtcatggacccaggggatgataaaccaagcgatagtttcgtagacgagaaattatcttgcgttgtctgttatggtggatgtttggttttgttgctgcgcca

SEQ ID NO: 2660 - DNA, 3037 bp, Triticum aestivum
cccccggcagattcgttcttctgggcaggtgcaacagtcatggatatcactcagattctgctagctgctcagtctccagatggcaaccttcgctcagcagcagaaggcaacatcaagcagttccaggagcagaatcttcccaacttcctcctatccttgtcagtggagttatcaaatgatgaaagaccaccagaatctagaagacttgctggtattatccttaagaattcactggacgcaaaggattctgcaaagaaggagctgctgattcagcaatgggtcagtttggatccgtcaatcaaattgcagattaaggagtcattgctgataacactaggatcttcggtgggtgatgcacggcagacatcatcacaagtcattgcaaagattgcatccattgagataccccgtcgggaatggcaagacctcattgccaaattattgagcaacatgacacagcctggggcctctgcgccactaaagcaagcaactctagaagcattggggtatgtgtgtgaggagattcctcctgagcacttggagcaggatcaagtgaacgctgttctgactgctgtggttcaggggatgaaccagacagagctaagctctgaagtccgtcttgcagcagttaaagctctgtataatgctcttgactttgctgagagcaactttgcaaatgagatggagaggacctttataatgaaggtaatatgtgatactgctgtatctaaggaagtggagatcagacaggcagcctttgaatgccttgtggcaattgcatccacatattatgtgcacttagatccttatatgcaaaccatattcaacctgacagctaatgctgtcaaaggagatgaggaaccagttgcactgcaggctgttgagttctggagtactatttgtgaggaagagattgaactccaagaggaatatgagggatctgatgatgctaactcaactgtaaattatcgcttcattgagaaggccctcccttcacttgttccaatgctgctagaaactctgttgaagcaagaggaagatcaagagcaagatgataatgcttggaacatttccatgagtggcggaacatgccttggactcattgctagaactgttggtgatgcaattgtccctcttgtgatgccatttgtggaagctaacatcacaaagccagactggcgttgtcgtgaggcagccacttttgcatttggttctatccttgatggcccatcccttgagaaacttgctcccctggtacaggccggacttgatttcttgctcaatacaatgaatgatccaaacagccaggtaaaagacaccactgcatggactcttggacgggtatttgagcttttgcattctccatgcagtactaatccaatcatatcaaatgcaaaccttcctcgtatcatggctgtgttgctagagagtagcaaagatgttccaaatgtggctgagaaagtctgtggagccatatattttcttgcccaaggttatgaagatgcagagccggcctcatctttgcttacaccttatcttcctaatgttattgctgcactccttactgctgcggatcgtggtgatatgacccatgtgaggcttcgtgcatctgcttatgaagcgctgaatgagattgtaagagtcagtaacatacctgaaacttcaagcattataggccagttattgcaggagatcatgagaagattgaacctgacatttgatcaccaaatattttcatcaggcgacaaggagaagcaaagcgatctgcaggctttgctgtgtggtgtactgcaggtcattatccagaaactgagcagctcagatgcaaagtccataattgcacagactgctgatcagctgatgcttctgtttctccgcgtctttgcctgccacagtgctactgtacatgaagaagcaatgcttgccattggtgctcttgcttatgccacaggtccagattttgtgaaatacatgcctgagtttttcaagtaccttgaggcaggcttgcagaattatgaagaataccaagtatgctccatctctgtaggggtggtgggtgatatttgccgtgccttggaagataaaattttgcccttctgtgatgggatcatgactgtgcttctcaaggatctctcaaactcacagctcaacaggtctgtcaagcctccgattttctcatgctttggagacattgctcttgccatcggtgagaattttgagaaatacctgccgtatgctatgccaatgcttcaaggggcggctgagcttcttgttgttttggatcaaaatgatgaggatatggttgattatggtaaccagctcagacggggaatatttgaggcatactctggcatactacagggcataaagggtgcaaaagctcagctgatgataccttatgcaggccatctattgcagttcactgaagctgtctacaaagatcggagcagggatgagagcgtgacaaaggctgcagttgctgtcctgggggatcttgcggacacacttgggccaatctcgaaggatctgttcaagagccacctcttccatgttgagttcttgagggagtgcctcgatctggatgatgaagtcagggagacggcgtcatggacccaggggatgataaaccaagcgatagtttcctagacgagaaattatcttgcgtcgtctgttatggtggatgtttggttttgttgctgcgccatacccggtttggctcagatgaacagaagggtaccaaagtatagcgtcagtcagtcgtaggaacattgtcgtagatgtcttctgtggtggtttattattttcagtctgtcaagtcgttatgcgtcacattcgacggcagtggggtttatggtcattggacgtcttgaacagctaaacttattattgtattctactcgtttgtgttgcgtacttgcactatgcttctgcagggtgttgtgtagtctggttacaaaatcttgacaaactacaaaggtctttagtgaagcgaaaatacacgcacaacttcgtcacactatgctacaccacttgcaca

SEQ ID NO: 2661 - DNA, 3175 bp, Triticum aestivum
tcgcctactattcccctcctctccctcctccgcagcctccttccattgtctgggagaggcggccgagcgagcgagcgagcgcggaagcatcccccggcagattcgttcttctgggcaggtgcaacagccatggatatcactcagattctgctagctgcccagtctccagatggcaaccttcgctcagcagcagaaggcaacatcaagcagttccaggagcagaatcttcccaacttcctcctatccttgtcagtggagttatcgaatgatgaaagaccaccagagtctagaagacttgctggtattatccttaagaactcactggacgcaaaggattctgcaaagaaggagctgctgactcaacaatgggtcagcttggatcactcgatcaaattgcagattaaggagtcattgctgataacactaggatcttcggtgggtgatgcgcggcagacgtcatcacaagtcattgcaaagattgcatccattgagataccccgtcgggaatggcaagacctcattgccaaattattgagcaacatgacgcagcctggggcctctgtgccactaaagcaagcaactctagaagcattggggtatgtgtgtgaggagattcctcctgagcacttggagcaggatcaagtgaacgctgttctgactgctgtggttcaggggatgaaccagacagagctaagctctgaagtccgtcttgcagcagttaaagctctgtataatgctcttgactttgctgagagcaactttgcaaatgagatggagaggacctttataatgaaggtaatatgtgatactgctgtatctaaggaagtggagatcagacaggcagcctttgaatgccttgtggcaattgcatccacatattatgtgcacttagatccttatatgcaaaccatattcaacctgacagctaatgctgtcaaaggagatgaggaaccagttgcactgcaggctgttgagttctggagtactatttgtgaggaagagattgaactccaagaggaatatgagggatctgatgatgctaactcaactgtaaattatcgcttcattgagaaggccctcccttcacttgttccaatgctgctagaaactctgttgaagcaagaggaagatcaagagcaagatgataatgcttggaacatttccatgagtggcggaacatgccttggactcattgctagaactgttggtgatgcaattgtccctcttgtgatgccatttgtggaagctaacatcacaaagccagactggcgttgtcgtgaggcagccacttttgcatttggttctatccttgatggcccatcccttgagaaacttgctcccctggtacaggccggacttgatttcttgctcaatacaatgaatgatccaaacagccaggtaaaagacaccactgcatggactcttggacgggtatttgagcttttgcattctccatgcagtactaatccaatcatatcaaatgcaaaccttcctcgtatcatggctgtgttgctagagagtagcaaagatgttccaaatgtggctgagaaagtctgtggagccatatattttcttgcccaaggttatgaagatgcagagccggcctcatctttgcttacaccttatcttcctaatgttattgctgcactccttactgccgcggatcgtggtgatatgacccatgtgaggcttcgtgcatctgcttatgaagcgctgaatgagattgtaagagtcagtaacatacccgaaacttcaagcattataggccagttattgcaggagatcatgagaagattgaacctgacatttgatcaccaaatattttcatcaggcgacaaggagaagcaaagcgatctgcaggctttgctgtgtggtgtactgcaggtcattatccagaaactgagcagctcagatgcaaagtccataattgcacagactgctgatcagctgatgcttctgtttctccgcgtctttgcctgccacagtgctactgtacatgaagaagcaatgcttgccattggtgctcttgcttatgccacgggtccagattttgtgaaatacatgcctgagtttttcaagtaccttgaggcaggcttgcagaattatgaagaataccaagtatgctccatctctgtaggggtggtgggtgatatttgccgtgccttggaagataaaattttgcccttctgtgatgggatcatgactgtgcttctcaaggatctctcaaactcccagctcaacaggtctgtcaagccccccattttctcatgctttggagacattgctcttgcaatcggtgagaattttgagaaatacctgccgtatgctatgccaatgcttcaaggggcggctgagcttcttgttgttttggatcaaaatgatgaggatatggttgattatggtaaccagctcagacggggaatatttgaggcttactctggcatactacagggcataaagggtgcaaaagctcagctgatgataccttatgcaggccatctattgcagttcactgaagctgtctacaaagatcggagcagggatgagagcgtgacaaaggctgcagttgctgtcctgggggatcttgcggacacacttggaccaatctcgaaggatctgttcaagagccacctcttccatgttgagttcttgagggagtgcctcgatctggatgatgaagtcagggagacggcgtcatggacccaggggatgataaaccaagcgatagtttcctagacgagaaattatcttgcgtcgtctgttatggtggatgttgggttttgttgctgcgccatgccccgtttggctcagatgaacagaagggtaccaaagtatagcgtcagtcagtcgtaggaacattgtcgtagatgtcttctgtggtggtttattattttcagtctgtcaagtcgttatgcgtcacattcgacggcagtggggtttatggtcattggacgtcttgaacagctaaacttattattgtattctactcgtttgtgttgcctacttgcatccatgctatgctgctgctgatgtctcttctgcatggtgtttctgcgagctgcagtatgcactgaggcagtctggttacaaaatctggacaaactacaaggtctgtagtgaagcgaaaatacaagcacacctttgtcactatgctatgctacaccacttgcacaca

SEQ ID NO: 2662 - DNA, 4824 bp, Secale cereale
cgcgcgcgcccccacacaccgcgcgcgcgcgcgcgcgagcagtctacgaccctattccccctccgtcgtcggccctttgggccacgtactccaagacgcaggtacggtagtcaaacgcacgagtacgactggggacccccgaaaaccccagtctcccgccctccgtaaaccctacgccgccgggccgctacctatattcccctctctcccttcctcctccgcagtcctcttccatttgtctgggagaggcgggcgagcgagcgagcgagcgcggaagcatcccccggcagattcgttcttctgggcaggtgcaacagtcatggatatcactcagattctgttagctgctcagtctccagatggcaaccttcgctcagcagcagaagtcaacatcaagcagttccaggagcagaatcttcccaacttcctcctatccttgtcagtggagttatcgaatgatgaaagaccaccagagtctagaagacttgctggtattatccttaagaattcactggacgcaaaggattctgcaaagaaggagcagctgactcagcaatgggtcagcttggatcactcgatcaaattgcagattaaggagtcattgctgataacactaggatcttcggtgggtgatgcacggcagacgtcatcacaagtcattgcaaagattgcatccattgagataccccgtcgggaatggcaagacctcattgccaaattactgagcaacatgacacagcctggggcctctgcgccactaaagcaagcaactctagaagcattggggtatgtctgtgaggagattcctcctgagcacttggagcaggatcaagtgaatgctgttctgactgctgtggttcaggggatgaaccagacagagctaagctctgaagtccgtcttgcagcagttaaagctctatataatgctcttgactttgctgagagcaactttgcaaatgagatggagaggacctttataatgaaggtaatatgtgatactgctgtgtctaaagaagtggagatcagacaggcagcctttgaatgccttgttgcaattgcatccacatattatgtgcacttagatccttacatgcaaaccatattcaacctgacagctaatgctgtcaaaggagatgaggaaccagttgcactgcaagctgttgagttctggagtactatttgtgaggaagagattgaactccaagaggaatatgagggatctgatgatgctaactcaactgtaaattatcgcttcattgaaaaggccctcccttcacttgttccaatgctgctagaaactctgttgaagcaagaggaagatcaagagcaagatgataatgcttggaacatttccatgagtggtggaacatgccttggactcattgctagaactgtcggtgatgcaattgtccctcttgtgatgccatttgtggaagctaacatcacaaagccggattggcgttgtcgtgaggcagccacttttgcatttggttctatccttgatggcccatcccttgagaaacttgctcccctggtacaggctggtcttgatttcttgctcaatacaatgaatgatccaaacagccaggtaaaagacaccactgcatggactcttggacgggtatttgagcttttgcattctccatgcagtgctaatccaatcatatcaaatgcaaaccttcctcgtatcatgtctgtgttgctagagagtagcaaagatgttccaaatgtggctgagaaagtctgtggagccatatatttccttgcccaaggttatgaagatgcagaggcagtctcatctttgcttacaccttatcttcctaatgttatcgctgcactccttactgctgcggatcgtggtgatatgacccatgtaaggcttcgtgcatctgcttatgaagcgctgaatgaggttgttagagtcagcaatatacctgaaacttcaagcattataggccagttattgcaggagatcatgagaagattgaacctgacttttgatcaccaaatattttcatcaggcgacaaggagaagcaaagcgatctgcaggctttgctgtgtggtgtactgcaggttattatccagaaactgagcagctcagatgcaaagtccatcattgcacagactgctgatcagttgatgcttctgttccttcgtgtctttgcttgccacagtgctactgtacatgaagaagcaatgcttgccattggtgctcttgcttatgccaccggtccagattttgtgaaatacatgcctgagtttttcaagtaccttgaggcaggattgcagaattatgaagaataccaagtatgctccatctctgtaggggtggtgggcgatatttgccgtgccttggaagataaaattttgcccttctgtgatgggatcatgactgtgcttctcaaggatctctcaaactcacagctcaacaggtctgtcaagccccccattttctcatgctttggagacattgctcttgccattggtgataattttgagaaatacctgccgtatgctatgccgatgcttcaaggggcggctgagcttcttgttgttttggatcaaaatgatgaggatatggttgattatggtaaccagctcagacggggaatatttgaggcatactctggcatactacagggcataaagggtgcaaaagctcagctgatgataccttatgcaggccatctattgcagttcaccgaagctgtctacaaagatcggagcagggatgagagcgtgacgaaggctgcggttgctgtcctgggggatctcgcggacacacttgggccaatctcgaaggatctgttcaagagccacctcttccatgtcgagttcctgagggagtgccaagatctggatgatgaagtcagggagacggcgtcatggacccaggggatgataaaccaagcgatagtttcctaggcgagaaattatcttgcatcgtctgttatggtggatgtttggttttgttgctgcgccaaactccgtttgggtttggctcagatgaacagaagggtaccaaagtatagcgtcagtcagtcgtaggaaccttgtcgtagaagtcttctgtggtttattattttcagtctgtcaagtcgttatgcgtcacattcgacggcaatggggtttatgggcattggacgtcttgaacagctaaacttattattgtattctactcgtctgtgttgcgtacttgcattgcatccatgctatgctgccgctgatgtctcttctgcagggtgctgtgccagtctgcagtatgcactcaggtagtctggttacaaaatctggacaaactacaaggtctgtagtgaagcgaaaatacaagcacaactttgtcactatgctacaccactttgcacgcactgcgattccaactgttggtatacgaactcctgtgtatgatcagctccttcaggtggcctcggtggagatgatctccagctccgcccaccacagcggcgacaccttgggggtggcgacgtccggtggcatggccgtgatctccctcagccgcctcgccacctctgccatcgccggtcgccgcctcgcctcccggtcggtgcaggaccgtatcacgctgtccagcctgttgacggtctcgacctggaggggcgcgctccagctcaggccagggtccatcacgtccctcagctgcctctcccctcggaggaagctcgccgcccagccctccagcaggccgccggccgacgccgtgaacctgccggacatgatctccagcagcaccatgccgtagctgtacacgacgctctccctgtcggacagagccaggagggactgcaggctcgccatctccgccctcgtcgacgaggcgtcgtcggagcagaagaagacgtccgcgatcttggccgcgaagtcgtcggtcaggtatacggtggacgtgtcgagcgtcttgaggatctccggcgggctcagctggtgcatgtgctccaggcagtaggcgatccccaccgccacccgcagccgcgtcggccagtccaggtgaccgtcttccctcacatggagatggtcgtagagagtgccgttgggagcatactcgaacaccatcatccttgtgaatggctgctcttcctggcagtagcccagcaggttcacaaagttcttgtggttaactctggacaggcttgttatctttttcctgaactgcgcttcgcagtgcttggaccactccttgccggacttcgtcgtcgttgatatgacggcgatctcgacgccgctcgacaacgtccccttgtacatcatgtaatccgacaggcagccgatgacgttactgaaatcttcgcaggccgcctggagctccgacctcttgagcgctggcacgcctgtcacgaacgctttctgcagctgcccgctgaggccggtggcccacggcctgacggtgaccaccttattggacctgtagcacaggacgaacagtgccgccgaaatggccacaaggagggaagctcctgctccggcgatgacatagatacgctgcctggtaggagcatgccccgccgcctcagtcgacgcttctccgaccgtcgcagtgccgtgggtcaccaccgtcgctgccgtcggtggcaccgtgatactgtgcgcaggcttgtcggcgtcccgaggcggcaccgccagaggcttggcgacctccggcgacggcgcgggggcgcttgacggggagtcagcaccctgcaacggcggagaactcgtcgtccgcgtcggtgccggcgcccatggccagggtggccactgcgggaacgtcgtcgactgcttggacccgtacctggttggttgcggtagagcttctcggacgtgtaacg

SEQ ID NO: 2663 - DNA, 2954 bp, Brachypodium distachyon
ttgatatttgacagggcagttgtgacagccatggatatcactcagattttgctagctgcccaatctcctgatggcaatcttcgcgcagtagccgaaggcaacattaagcagttccaggagcagaatcttcccaacttcctcctgtccttatcagtcgagttatcgagtgatgaaagaccaccagagtctagaagacttgctggtattatccttaagaattcattggatgccaaggattctgcaaagaaggagctacttacccaacagtgggttagccttgatccattgatcaaatcgaggattaaggactcactactgattacactaggatcttcggtggctgatgcaaggcagacctcatcacaagtcattgcaaaggttgcatccattgagatacctcgtaaggagtggcaagacctcattgctaaattactgaataacatgacacagccgggggcatctgctgcagtaaagcaagcaactctagaagctttggggtatgtctgtgaggagatccctcctgagcacttggagcaggaacaagtgaatgcagttctcactgctgtggtccagggtatgaaccagacagagctaagctctgaagtccgtcttgcagcagttaaagctctatacaacgctcttgattttgctgagagcaactttgcgaatgaaatggagaggaattttataatgaaggtcatatgtgatactgctgtatctaatgaagtggagatcaggcaagcagcctatgaatgccttgttgcaattgcatccacatattatgtgcacttggatccttatatgcaaaccatattcaaccttaccgccaacgctgtgaaaggagacgaggaaccagttgcacttcaagctgttgagttttggagcactatttgtgaggaagagattgaactccaagaagaatatgtgggatctgatgatgctaactcaactgtaaattatcgcttcattgaaaaggccctcccttcacttgttccgatgctgctagaaactctcttgaagcaagaggaagatcaagaacaagatgataatgcttggaacatttccatgagtggtgggacgtgccttggactcattgccagaactgttggcgatgcaattgtccctcttgtgatgccatttgtggaggctaacatcacaaagccggattggcattgtcgtgaggcagccacttttgcttttggttctatccttgacggcccctctcttgagaaacttgctcctctggtacaggctggacttgatttcttgctcaacacgatgaaagatccgaacagccaggtcaaggacaccactgcatggactcttggccgggtatttgagcttttgcattctccatgcagttcaaatccaatcatatcaaacgcaaaccttccgcgtatcatgaccgtattgctggatagtagtaaagatgtcccaaatgttgctgagaaagtctgtggagccatatactttcttgcccaaggttatgaagatgcagagctggtctcatcttcgcttacaccttatcttcctaatgttatcgctgctctcctttctgctgcggatcgtgccgacaccacccatttcaggcttcgtgcatctgcttatgaagcactgaatgagattgtgagagtcagcaacataccagaaacttcaagcattataggccagttattgcaggagatcatgagaagattgaacctgacatttgatcaccaaatattttcatctggcgacaaggaaaagcaaagcgatctgcaggctttgctatgtggtgtactgcaggtcattatccagaaactaagcaactcggatgcaaagtccatcattgcccagactgctgatcagttgatgtttctgttcctccgtgtatttgcttgccacagttctactgtccacgaagaagcaatgcttgccattggtgctcttgcgtatgccactggtccagattttgtgaaatacatgcctgagtttttcaagtacctcgaagcaggcttgcagaatcatgaagaataccaagtatgctctatctctgttggggtggtgggtgatatttgccgtgccttggaagataaagttttgcccttctgtgatggaattatgactgttcttctcaaggatctctcaaacccagtgctgaaccggtctgtcaaacctccaatcttctcatgctttggagacattgctcttgctatcggtgaaaatttcgagaaatacttgccgtatgctatgccaatgcttcaaggagctgctgagctccttggtgttttggaccaaaatgacgaggatatggttgattatggtaatcagctcaggcggggaatatttgaggcatactctggcatactacagggtataaagggcgaaaaggctcagctgatgatcccttatgcaggccatctgttgcagttcactgaagctgtgtacaaagaccagagcagggatgagagcgtgacaaaggctgcagtagctgtactgggggatctcgcggacacacttggcccgatgtcaaaggatctgttcaagggccacctcttccatgtcgagttcctgagggagtgccttgatgtggacgatgaagtcagggagacggcgtcatgggctcagggaatgataagccaagcaattgtttcttagcgtgagatgaaacgggaggagggcacagatgaacaacgggaggagggcaccaacatatatgtcgtaaaaactctgtcgtaggcttctttttctgtgttctattttcagtctgtcaagtcagtcagtcagtcagttgcgtgtcacatttgatggcagtggatgattgtggcaatggacgccttgaacagccaaatttattgatgtattattctactcgtctatgctgctgatgttgctttcgtggtatatctgccagtttaatcatttgtgtcgttagggcatgtacaatttttgataagactgtcttatctttagac

SEQ ID NO: 2664 - DNA, 3189 bp, Brachypodium distachyon
accccacctaaaccccgccggaatcccgcctccaaaaccctagccgccgactcccctcctccggctcgaccgccgccgccctccaaggagacacccgccgcggcgccacccggcctcccttcgcgctgttgcattcgctcgcctccgcgcctcccctcgccgtgcaggccctgaaggagacgcccgccggctgctgccccgcctcccctggcagttgtgacagccatggatatcactcagattttgctagctgcccaatctcctgatggcaatcttcgcgcagtagccgaaggcaacattaagcagttccaggagcagaatcttcccaacttcctcctgtccttatcagtcgagttatcgagtgatgaaagaccaccagagtctagaagacttgctggtattatccttaagaattcattggatgccaaggattctgcaaagaaggagctacttacccaacagtgggttagccttgatccattgatcaaatcgaggattaaggactcactactgattacactaggatcttcggtggctgatgcaaggcagacctcatcacaagtcattgcaaaggttgcatccattgagatacctcgtaaggagtggcaagacctcattgctaaattactgaataacatgacacagccgggggcatctgctgcagtaaagcaagcaactctagaagctttggggtatgtctgtgaggagatccctcctgagcacttggagcaggaacaagtgaatgcagttctcactgctgtggtccagggtatgaaccagacagagctaagctctgaagtccgtcttgcagcagttaaagctctatacaacgctcttgattttgctgagagcaactttgcgaatgaaatggagaggaattttataatgaaggtcatatgtgatactgctgtatctaatgaagtggagatcaggcaagcagcctatgaatgccttgttgcaattgcatccacatattatgtgcacttggatccttatatgcaaaccatattcaaccttaccgccaacgctgtgaaaggagacgaggaaccagttgcacttcaagctgttgagttttggagcactatttgtgaggaagagattgaactccaagaagaatatgtgggatctgatgatgctaactcaactgtaaattatcgcttcattgaaaaggccctcccttcacttgttccgatgctgctagaaactctcttgaagcaagaggaagatcaagaacaagatgataatgcttggaacatttccatgagtggtgggacgtgccttggactcattgccagaactgttggcgatgcaattgtccctcttgtgatgccatttgtggaggctaacatcacaaagccggattggcattgtcgtgaggcagccacttttgcttttggttctatccttgacggcccctctcttgagaaacttgctcctctggtacaggctggacttgatttcttgctcaacacgatgaaagatccgaacagccaggtcaaggacaccactgcatggactcttggccgggtatttgagcttttgcattctccatgcagttcaaatccaatcatatcaaacgcaaaccttccgcgtatcatgaccgtattgctggatagtagtaaagatgtcccaaatgttgctgagaaagtctgtggagccatatactttcttgcccaaggttatgaagatgcagagctggtctcatcttcgcttacaccttatcttcctaatgttatcgctgctctcctttctgctgcggatcgtgccgacaccacccatttcaggcttcgtgcatctgcttatgaagcactgaatgagattgtgagagtcagcaacataccagaaacttcaagcattataggccagttattgcaggagatcatgagaagattgaacctgacatttgatcaccaaatattttcatctggcgacaaggaaaagcaaagcgatctgcaggctttgctatgtggtgtactgcaggtcattatccagaaactaagcaactcggatgcaaagtccatcattgcccagactgctgatcagttgatgtttctgttcctccgtgtatttgcttgccacagttctactgtccacgaagaagcaatgcttgccattggtgctcttgcgtatgccactggtccagattttgtgaaatacatgcctgagtttttcaagtacctcgaagcaggcttgcagaatcatgaagaataccaagtatgctctatctctgttggggtggtgggtgatatttgccgtgccttggaagataaagttttgcccttctgtgatggaattatgactgttcttctcaaggatctctcaaacccagtgctgaaccggtctgtcaaacctccaatcttctcatgctttggagacattgctcttgctatcggtgaaaatttcgagaaatacttgccgtatgctatgccaatgcttcaaggagctgctgagctccttggtgttttggaccaaaatgacgaggatatggttgattatggtaatcagctcaggcggggaatatttgaggcatactctggcatactacagggtataaagggcgaaaaggctcagctgatgatcccttatgcaggccatctgttgcagttcactgaagctgtgtacaaagaccagagcagggatgagagcgtgacaaaggctgcagtagctgtactgggggatctcgcggacacacttggcccgatgtcaaaggatctgttcaagggccacctcttccatgtcgagttcctgagggagtgccttgatgtggacgatgaagtcagggagacggcgtcatgggctcagggaatgataagccaagcaattgtttcttagcgtgagatgaaacgggaggagggcacagatgaacaacgggaggagggcaccaacatatatgtcgtaaaaactctgtcgtaggcttctttttctgtgttctattttcagtctgtcaagtcagtcagtcagtcagttgcgtgtcacatttgatggcagtggatgattgtggcaatggacgccttgaacagccaaatttattgatgtattattctactcgtctatgctgctgatgttgctttcgtggtatatctgccagtttaatcatttgtgtcgttagggcatgtacaatttttgataagactgtcttatctttagacatttcacgtcaattagaaaagacaacaaaacatgttgtac

SEQ ID NO: 2665 - DNA, 3190 bp, Secale cereale
gactaaacccagtctcccgcctctaaaccctagccgccggcgctgcctatattcccctccctcccttcctcctccgcagtcctcttccatttgtctgggagaggcgggcgagcgagcaagcgagcgagcgcggaagcatcccccggcagattcgttcttctgggcaggtgcaacagtcatggatatcactcagattctgctagctgctcagtctccagatggcaaccttcgctcagcagcagaagtcaacatcaagcaattccaggagcagaatcttcccaacttcctcctatccttgtcagtggagttatcgaatgatgaaagaccaccagagtctagaagacttgctggtattatccttaagaattcactggacgcaaaggattctgcaaagaaggagcagctgactcagcaatgggtcagcttggatcactcgatcaaattgcagattaaggagtcattgctgataacactaggatcttcggtgggtgatgcacgtcagacgtcatcacaagtcattgcaaagatcgcatccattgagataccccgtcgggaatggcaagacctcattgccaaattactgagcaacatgacacagcctggggcctctgcgccactaaagcaagcaactctagaagcattggggtatgtctgtgaggagattcctcctgagcacttggagcaggatcaagtgaatgctgttctgactgctgtggttcaggggatgaaccagacagagctaagctctgaagtccgtcttgcagcagttaaagctctatataatgctcttgactttgctgagagcaactttgcaaatgagatggagaggacctttataatgaaggtaatatgtgatactgctgtgtctaaagaggtggagatcagacaggcagcctttgaatgccttgttgcaattgcatccacatattatgtgcacttagatccttacatgcaaaccatattcaacctgacagctaatgctgtcaaaggagatgaggaaccagttgcactgcaagctgttgagttctggagtactatttgtgaggaagagattgaactccaagaggaatatgagggatctgatgatgctaactcaactgtaaattatcgattcattgaaaaggccctcccttcacttgttccaatgctgctagaaactctgttgaagcaagaggaagatcaagagcaagatgataatgcttggaacatttccatgagtggtggaacatgccttggactcattgctagaactgtcggtgatgcaattgtccctcttgtgatgccatttgtggaagctaacatcacaaagccggattggcgttgtcgtgaggcagccacttttgcatttggttctatccttgatggcccatcccttgagaaacttgctcccctggtacaggctggtcttgatttcttgctcaatacaatgaatgatccaaacagccaggtaaaagacaccactgcatggactcttggacgggtatttgagcttttgcattctccatgcagtgctaatccaatcatatcaaatgcaaaccttcctcgtatcatgtctgtgttgctagagagtagcaaagatgttccaaatgtggctgagaaagtctgtggagccatatatttccttgcccaaggttatgaagatgcagaggcagtctcatctttgcttacaccttatcttcctaatgttatcgctgcactccttactgctgcggatcgtggtgatatgacccatgtaaggcttcgtgcatctgcttatgaagcgctgaatgaggttgttagagtcagcaatatacccgaaacttcaagcattataggccagttattgcaggagatcatgagaagattgaacctgacttttgatcaccaaatattttcatcaggcgacaaggagaagcaaagcgatctgcaggcgttgctgtgtggtgtactgcaggttattatccagaaattgagcagctcagatgcaaagtccatcattgcacagactgctgatcagttgatgcttctgttccttcgtgtctttgcttgccacagtgctactgtacatgaagaagcaatgcttgccattggtgctcttgcttatgccaccggtccagattttgtgaaatacatgcctgagttttccaagtaccttgaggcaggattgcagaattatgaagaataccaagtatgctccatctctgtagggtgtggccgaataccttgtcgtgccttggaagataaaattttgcccttctgtgatgggatcatgactgtgcttctcaaggatctctcaaactcacagctcaacaggtctgtcaagccccccattttctcatgctttggagacattgctcttgccattggtgataattttgagaaatacctgccgtatgctatgccgatgcttcaaggggcggctgagcttcttgttgttttggatcaaaatgatgaggatatggttgattatggtaaccagctcagacggggaatatttgaggcatactctggcatactacagggcataaagggtgcaaaagctcagctgatgataccttatgcaggccatctattgcagttcaccgaagctgtctacaaagatcggagcagggatgagagcgtgacgaaggctgcggttgctgtcctgggggatctggcggacacacttgggccaatctcgaaggatctgttcaagagccacctcttccatgttgagttcctgagggagtgccaagatctggatgatgaagtgagggagacggcgtcatggacccaggggatgataaaccaagcgatagtttcctaggcgagaaattatcttgcatcgtctgttatggtgatgtttggttttgttgctgcgccatacctccgtttggctcagatgaacagaagggtaccaaagtatagcgtcagtcagtcgtaggaaaccttgtcgtagatgtcttctgtggtttattattttcagtctgtcaagtcgttatgcgtcacattcgacggcaatggggtttatgggcattggacgtcttgaacagctaaacttattattgtattctactcgtctgtgttgcgtacttgcattccatccatgctatgctgccgctgatgtctcttctgcagggtgctgtgccagtctgcagtatgcactcaggtagtctggttacaaaatctggacaaactacaaggtctgtagtgaagcgaaaatacaagcaca

SEQ ID NO: 2666 - DNA, 3177 bp, Hordeum vulgare
ggcctacccccaaaacccagaatcccgcctctaaaccctagccgccggcgctgcccctattcccctccccctcctcctccgcagtcttcttccatttgtctgggaggcgggcaggcgagcgagcgagcgcggaagcatcccccggcagattcgttcttctgggcaggtgcaacagtcatggatatcactcagattctgctagctgctcagtctccagatggtaaccttcgctcagcagcagaagccaacatcaagcagttccaggagcagaatcttcccaacttcctcctatccttgtcggtggagttatcgaatgatgaaaggccaccagagtctagaagacttgctggtattatccttaagaattcactggacgcaaaagattctgcaaggaaggagctgctgattcagcaatgggtcagcttggatcactcgatcaaatcgcagattaaggagtcattgctgataacactaggatcttcggtgggtgatgcccggcagacgtcatcacaagtcattgcaaagattgcatccattgagataccccgtcgggaatggcaagacctcattgccaaattgctgagcaacatgactcagcctggggcctctgcgccactaaagcaagcaactctagaagcattggggtatgtctgtgaggagattcctcctgagcacttggagcaggatcaagtgaatgctgttctgactgctgtggttcaggggatgaaccagacagagctaagctctgaagtccgtcttgcagcagtcaaagctctatataatgctcttgactttgctgagagcaactttgcaaatgagatggagaggacctttataatgaaggtaatttgtgatactgctgtatctaaagaagtggagatcagacaggcagcctttgaatgccttgtggcaattgcatccacatattatgtgcacttagatccttatatgcaaaccatattcaacctgacagctaatgctgtaaaaggagacgaggaaccagttgcactgcaagctgttgagttctggagtactatttgtgaggaggagattgaactccaagaggaatatgagggatctgatgatgctaactcgactgtaaattatcgcttcattgaaaaggccctcccttcacttgttccaatgctgctagaaaccctgttgaagcaagaggaagatcaagagcaagatgataatgcttggaacatttccatgagtggtggaacatgccttggactcattgctagaactgtcggtgatgcaattgtccctcttgtgatgccatttgtggaagctaacatcacaaagccggattggcgttgtcgtgaggcagcaacttttgcatttggttctatccttgatggcccatcccttgagaaacttgctcccttggtgcaggctggactagatttcttgctcaatacaatgaatgatccaaacagccaggtaaaagacaccactgcttggactcttggacgggtatttgagcttttgcattctccatgcagtactaatccaatcatatcaaatgcaaaccttcctcgtatcatggctgtgttgctagagagtagcaaagatgttccaaatgtggctgagaaagtctgtggagccatatattttcttgcccaaggttatgaagatgcagagccggtgtcatctttgcttacaccttatcttcctaatgttatcgctgcactccttactgctgcggatcgtagtgatatgacccatgtgaggcttcgtgcatctgcttatgaagcgctgaatgagattgtaagagtcagcaacatacctgaaacttcaagcatcataggccagttattgcaggagatcatgagaagattgaatctgacatttgaccaccaaatattttcatcaggcgacaaggagaagcaaagcgatctgcaggctttgctgtgtggtgtactgcaggttattatccagaaactgaacagctcggatgcaaagtccataattgcacagactgctgaccagttgatgcttctgttcctccgtgtctttgcttgccacagtgctactgtacatgaagaagcaatgctggccattggtgctcttgcttatgccactggcccagattttgagaaatacatgcctgagtttttgaagtaccttgaggcaggattgcagaattatgaagaataccaagtatgctccatctctgtaggggtggtgggtgatatttgccgtgccttggaagataaaatcttgcccttctgtgatgggattatgactgtgcttctcaaggatctctcaaactcacaactcaacaggtctgtcaagcccccaattttctcatgctttggagacattgctcttgccattggtgaaaattttgagaaatacctgccgtatgctatgccgatgcttcaaggggcggctgagcttcttgttgttttggatcaaaatgacgaggatatggttgattatggtaaccagctcagacggggaatttttgaggcatactctggcatactacagggtctaaagggcgcaaaagctcagctgatgataccttatgcaggccatctattgcaattcactgaagctgtctacaaagatgggagcagggatgagagcgtgacaaaagccgccgttgctgtcctgggggatcttgcggacacacttgggccaatctctaaggatctgttcaagagccacctcttccatgttgagttcttgagggagtgcctcgatctggatgatgaagtgagggagacggcgtcatggacccaggggatgataaaccaagcgatagtttcttagacgagaaactatcttaccttgtcttgttatggtggatgtttggttttattgatgcaccaaacggaatttgggtttggctcatatgaacagaagggtaccaaagtatatgtagcgtcagtcagtcagtaggaaccttgtcgtagatgtcttgggtggttttattattttcagtctgtcaagtcgttgtgcgtcacattcgacggcagtggggtttacgtcttgaacagctaaactcattattattgtattctactcggtttgtgttgcatgcttgcactcatgctatgctgcggatgtctcttctgcagggtgttgtgcgtgctgcagtatgcagtagctgcactcaggttacaaaatccggacaaactacaaggtttttttagtgaagcaaat

SEQ ID NO: 2667 - DNA, 2832 bp, Secale cereale
ctgccggggagcagtgaagcccccgccacagcccccaaaagactcgctacacaccaacacagaaataggaatacagccatggatatcactcagattctcctagctgcgcaatctccggacggtaaccttcggtcggtagcagaaggcagcctcaagctgttccaggagcagaatcttcccaggttcctgctctccttgtcagtggagctctcgagtgaccaaaggccgccagagtgtagaagacttgctggcattatccttaagaattcgttggatgctaaggattgttcaaggaaggagctacttggtcagcaatgggtcagcctggacttgctgatcaaatctaggattaaggaatccttgctgctaacgctaggatcttcggtgcctgatgcaaggcaggcctcatcacaggttatcgcaaaggttgcgtccattgagatgccccgtcgtgaatggccagacctcattgccaagttattgggaaacatgacgcagcagggtgcatctgcgccactgaagcaagcaactctagaggcattggggtatgtctgtgaggagatttctcctgagcacttggagcaggatcaagtcaatgctgttctgactgctgtggtccagggaatgaaccaggcagagctaagtgttgaagtccgtcttgcagcagttaaagctctatataacgcttctttattttgcttgatagcaactttgcaaatgatatggagaggaactatataatgaaggtaatttgtgagactgctgtatctaatgaagtggagatcagacaggcagcttttgaatgccttgttgcaattgcatccatatattatatgcacttggaaccttatatgcaaaccgtatttaacctgacgtcgaacactgtcaaaggagatgaggaatcagttgcacttcaagctattgagttctggagcacaatttgtgatgaagagattcaactccaagaagaatatgagggatatgatgatgccgactctagtgcaaattttcgcttcatagaaaaggcactcccttcacttgttccaatgctgctcgaaactctgttgaagcaagaggaagatcaagagcaagatgataatgtgtggaacatttccatgagtggtgggacgtgccttagactcatcgctaaagctgttggtgatgcgattgtccctcttgtcatgccatttgttgaggctaacatcacaaatccagattggcattgtcgtgaggcagctacttttgcatttggttctatcctcgacggtccttctcttccgaaacttgctccactggtacatgctggacttgatttcttgctcaatgcaatgaaagatcccaacagccaggtaaaagacaccactgcatggactcttgggcgtgtgtttgaatttttgcattctccaaccagcgtgaatccgattgtaacaagtggaaaccttacgcgtatcatgacagtgttgctggagagtagtaaggatgttccaaatgtggctgagaaagtctgtggagctatatactttcttgcccaaggttatgaaaatgcagcagattcaatctcttctgtgcttacaccttatcttcctagtgtcatcactgctctcctttctgctacggaccgtgttgacacgacccattttaggcttcgttcatctgcttatgaagcattgaatgagattgtgagagtcagcaacatagatgaaaccgcaagcattataggccagttattgcaggaggtcatgagaagattgaacttaacatttgatcttgaagtattttcatcaggcgacaaggagaaccagagtgacctgcaggctttgctatgcggtgtactgcaggtgatcgtcccgaaactgagcaactcagatgtggagtccattatcaccgagaatgctgatcagttgatgtttctgtttctccgtgtctttgcttgccatggttctactgtacatgaagaagcaatgcttgctattggtgttcttgcggatgctatcggtccagattttgtaaaatacatgccggagtttttcaagtaccttgaagcaggcttgcagaatcatgaagaataccaagtatgctccatttctgttggagtggtgggtgacatttgccgtaccctagaagataaagtgttgccattctgtgatggaattatgactgttctcctcaaggatctttcaaatccaatgctcaaccggtctgtcaaacctcccattttctcatgctttggagacattgctcttgctattggcgagaattttgagaaatacctgccatatgccatgccaatgcttcaaggagcagctgagcttgttgttgttttagatcaaagtgacgatgatatggttcactatggtaaccagctccgacggggaatatttgaggcttactctggcatattacagggtataaaaggtccaaaagctcagctgatggtaccttatgcaacccacctattgcagttcactgaagctgtctacaaggatgggagcagggatgagagcgtgacaaaggctgcagttgcagtccttggtgatctcgcggatacacttggcccaatatcaaaagatctgttcaggaaccacctcttccatgtcgaattctttagggagtgccttgattcggacgaagaagtcagggagactgcatcgtgggcgcagggaatgataaaccaagcagtggttgcttaatatgcgaaatcattttctgttgttggttgtgctggaggtttcttcttgtgcatctgtaaagtccatttgccacggatgaatggaagaattccaatatgtatgtagtgtcggtagtaggggacccttcagtgatgtgttcgac

SEQ ID NO: 2668 - DNA, 3167 bp, Hordeum vulgare
cgcccaaaatccccaaaccctaaccgccccaccacccgacccggcggagcagcagctccccagccgaccggcggcaaccggacccagcgacgaaagctgcagggacggcagcggcgacctgcggaatatcggggcaggcggcacacggtcgctgaaaagcgagtgcgcgagcggccgaggagcagtgaacgcggcccccaaagagactcgcgacgcaccggtacagttaagggaattggaatacagccatggatatcactcagattctcctagccgcgcaatctccggacggtaaccttcggtcggtagcagaaggcagccttaagctgttccaggagcagaatcttcccaggttcctgctctccttatcagtggagctctcgaatgacgaaaggccgccagaatctagaagacttgctggcatcatccttaagaatttgttggatgccaaggattgttcaaggaaggagctacttgctcagcaatgggtcagcctggacttgtcgatcaaatcaagaattaaggaatcgttgctgctaacactaggatcttcggtgcctgatgcaaggcaggcctcatcacaggttattgcaaaggttgcctccattgagatgccccgtcgtgaatggcaagacctcattgccaagttattgggaaatatgacacagcagggtgcatctgcgccactgaagcaagcaactctagaggcgctggggtatgtctgcgaggagatttctcctgagcacttggagcaggatcaagtcaatgctgttctgactgctgtggtccagggaatgaaccagacagagctaagtgttgaagtccgtctttcagcagttaaagctctatataacgctctttattttgctgatagcaactttgcaaatgagatggagaggaactatatattgaaggtaatatgtgagactgctgtatctaatgaagtggagatcagacaggcagcttttgaatgccttgttgcaattgcatccatatattatatgcacttggaaccttatatgcaaactgtatttaacctgacgtctaacactgtcaaaggagatgaggaatcagttgcacttcaagctattgaattctggagcacaatttgtgatgaagagattcaactccaagaagaatatgagggatatgacgatgccaactctagtgcaaattttcgctttatagaaaaggcactctcttcacttgttccaatgctgctcgaaactctgttgaagcaagaggaagatgaagagcaagatgacaatgtgtggaacatttccatgagtggtgggacgtgccttggactcatcgctaaagccgtcggtgacgcgattgtccctcttgtcatgccatttgttgaggctaacatcacaaatccagattggcattgtcgtgaggcagctacttttgcatttggttctatccttgatggtccttctcttccgaaacttgctccactggtacatgctggacttaatttcctgctcaatgcaatgaaagatcccaacagccaggtaaaaggcaccactgcatggactcttgggcgtgtgtttgaatttttgcattctccaaccagtgggaatccgattgtaacaagtggaaaccttacgcgtatcatgacagtattgctggagagtagtaaggatgttccaaatgtggctgagaaagtctgtggagctatatattttcttgctcaaggttatgaaaatacagtagattcagtctcttctgtgcttacaccttatcttcctagtgtcatcaccgctctcctttctgcttcagactgtgctgacacggcccattttaggcttcgttcatctgcttatgaagcgttgaatgagattgtgagagtcaccaacatagatgaaacttcaagcattataggccagttattgcaggaggtcatgagaagattgaacttgacatttgatcttgaaatattttcatcaggcgacaaggagaaccagagtgacctgcaggctttgctgtgtggtgtactgcaggtcatcgtcccgaaactgagcaactcagatgcggagtccattatcacccagaatgctgatcagttgatgtttctatttctccgtgtttttgcttgccacagttctactgtacatgaagaagcaatgcttgccattggtgttctggctgatgccattggtccagattttgttaaatatatgccggagtttttcaagtaccttgaagcaggcttgcacaatcatgaagaataccaagtatgctccatttctgttggagtggtgggtgacatttgccgtaccctagaagataaagtgttgccattctgtgatggaattatgactgttctcctcaaggatctttcaaatccaacgctcaaccggtctgtcaaacctcccattttctcatgctttggagacattgctcttgccattggcgggaattttgagaaatacctgccatatgccataccaatgcttcaaggagctgctgagcttgttgctgttttggatcaaagtgatgatgatatggttcactatggtaatcagctcagaaggggaatatttgaggcttactctggcatattacagggtataaaaggcccaaaagctcagctgatggtaccttgtgcaacccacctattgcagttcacggaagctgtctacaaggatgggagcagggatgagagtgtgacaaaggctgcagtggcagtccttggtgatcttgcggatacacttggcccggtatcaaaagatttgttcaggagccacctcttccatgtcgagttcttcagggagtgccttgattcagacgaagaagtcagggagactgcatcgtgggcgcagggaatgataaaccaagcagtggtcgcgtgacatgagaaatcattttctaccgttggttgtggtggaggtttcttcttgtggatctgtaaagtccatttgccacagatgaatggaagaactccaatatgttgtagtgttagcagtaggggatccttgccatgtgttccttttgtgatgtgttcgacttgaactgctaaatttattaacatgttctgacttgttgcttatccatgcgatgctgcctatgttactgagtacttgtcttttttttttgtcaaatcgtttcatgttagtacctgattaatcctttttgttgatatatgttatattgcaaagtac

SEQ ID NO: 2669 - DNA, 2575 bp, Brachypodium distachyon
cccaaagctcccctttgcgagagaaataagccagcccccggcccggccgtctcccccaaaacctccacccctccctcttcccctccactactccccccttgcgcgcgatccggttctcccgcgccgtgtcgcggatcccgttctcaattccgcccccacgccattgttcttccgcggcggagctcgtgcccttttgttcgtcttattcttctaccccccatacccccgccggcggccggtgttgggggttttgttttttgatgcggccggattcgggccctggcttgtgaatcggagggtgtcggtggtgcgcgcgcgcggcggctgtctgctactgtcatcatgaggcggcgctccgtcctgccgtcgcaccacgacgacctggacaagggcggcgggaagccgccgcagtcgcgcctctgcctcctcgccacgctctgcgtcatgttctgggtcctcatcttctacttccacttctccgtcctccccagcgacgccgacgcctccacgacgcacccggtctccgtcgccaccgaggcccgcattgcccgcgccgaccccgcgccggacggccgcgtctccgaacccgacgaccctctcctcgccccgcccgccgtcgtctcggagccgcctcctgccaccctccccaaggaggaggagatggagcaggaggcgcccacggccgtcgtcgtcgcccaggaggaggcgccccgcagagagtacccgttccagcgggcactcaagacggcggagaacgagagcgacccgtgcggcggccggtacatctacgtgcacgagctgccgccgcggttcaacgaggacatgctccgggagtgccagaggctcagcctctggaccaacatgtgcaagttcatgagcaacgacgggcttggcccgcccttgggcaacgaggaaggggtcttctccaacaccggctggtacgccaccaaccagttcgccgtcgacgtcatcttcggcaaccggatgaagcagtacgagtgcctcaccaaggactcgtccatcgccgccgcggtgttcgtgcccttctatgccgggttcgacgtcgcgaggtatctctgggggtataacacttcgatgagggatgccgcgtcgcatgacttggtcgattggttgaggcagaggcctgagtggaatgtgatgggtggccgtgaccatttcttggttgggggcaggatcgcatgggatttcaggcggttgacggaccaagaatctgattggggcaacaagctgctattcatgccagctgcgaagaatatgtcaatgctggtggtggagtcaagcccatggaatgccaatgattttgcagttccatatcctacttacttccaccctgccaaagacgccgacgttttcctttggcaagacaggatgaggagccttgaacggccgtggttgttctcgttcgcaggggctcctcgtcctggtgatccaatgtctattagagggcagctcattgatcagtgcaggacatccagtttttgtaaattgttggagtgtgaccttggagagagcaagtgccactccccaagcgccatcatgaagatgttccagagctctttattctgcttgcagccccaaggtgattcctataccagaagatctgccttcgactcgatgttggctggctgcatacctgttttcttccatcccggttcagcatatgtccaatatacatggcatcttccaaagaactatacgaggtactctgtctttatccctgaagacagcatccggaaaggaaatgtcagtatcgaggagatactaaaaagtatccatccagatgttgccaagcagatgagggaagaggttatcaatctcataccaagggtgatatatgctgatccaaggtcgaaactggaagccctgaaggatgccttcgatgtttcggtagaggccatcattaacaaagtgacacagttgagaagagatataatctcaaacagcgaaggtaaagattttgtagaagagaatagctggaagtatgatctgttagaagaaggacagaggacaattggacctcatgaatgggatcctttcttctctaagcccaaggacaaaggtggagattctactaattcatctgaggaagctgccaagggtgcttggaaaattgaacaaagaggtcagaattaggccacaagtagcttctcttagagatgagatcaagagagcgcaagagctatccttgctgaaggtgctctgatgcaaatacgcggttaaaagtcccatagatgctgtagttttggtgatcatgtatgtccttgatgatccagcccctacaggtgtaagtagccgtgccaccgaaaatgtgtgtgggaaaattgacagtcagcctttgctttgtccctatagataccttcatactataattttgatttgttttctctcctcaataatgctctgtaagtccttgcaggattttagaggtataacaattttggtttgcgctttttgtttgttttactctagctgtatgacttagaaattatgtatactatcgtttgataagctccatgagcaaataatcaaaagtgacttgcaggcttactgcttt

SEQ ID NO: 2670 - DNA, 2579 bp, Brachypodium distachyon
cccaaagctcccctttgcgagagaaataagccagcccccggcccggccgtctcccccaaaacctccacccctccctcttcccctccactactccccccttgcgcgcgatccggttctcccgcgccgtgtcgcggatcccgttctcaattccgcccccacgccattgttcttccgcggcggagctcgtgcccttttgttcgtcttattcttctaccccccatacccccgccggcggccggtgttgggggttttgttttttgatgcggccggattcgggccctggcttgtgaatcggagggtgtcggtggtgcgcgcgcgcggcggctgtctgctactgtcatcatgaggcggcgctccgtcctgccgtcgcaccacgacgacctggacaagggcggcgggaagccgccgcagtcgcgcctctgcctcctcgccacgctctgcgtcatgttctgggtcctcatcttctacttccacttctccgtcctccccagcgacgccgacgcctccacgacgcacccggtctccgtcgccaccgaggcccgcattgcccgcgccgaccccgcgccggacggccgcgtctccgaacccgacgaccctctcctcgccccgcccgccgtcgtctcggagccgcctcctgccaccctccccaaggaggaggagatggagcaggaggcgcccacggccgtcgtcgtcgcccaggaggaggcgccccgcagagagtacccgttccagcgggcactcaagacggcggagaacgagagcgacccgtgcggcggccggtacatctacgtgcacgagctgccgccgcggttcaacgaggacatgctccgggagtgccagaggctcagcctctggaccaacatgtgcaagttcatgagcaacgacgggcttggcccgcccttgggcaacgaggaaggggtcttctccaacaccggctggtacgccaccaaccagttcgccgtcgacgtcatcttcggcaaccggatgaagcagtacgagtgcctcaccaaggactcgtccatcgccgccgcggtgttcgtgcccttctatgccgggttcgacgtcgcgaggtatctctgggggtataacacttcgatgagggatgccgcgtcgcatgacttggtcgattggttgaggcagaggcctgagtggaatgtgatgggtggccgtgaccatttcttggttgggggcaggatcgcatgggatttcaggcggttgacggaccaagaatctgattggggcaacaagctgctattcatgccagctgcgaagaatatgtcaatgctggtggtggagtcaagcccatggaatgccaatgattttgcagttccatatcctacttacttccaccctgccaaagacgccgacgttttcctttggcaagacaggatgaggagccttgaacggccgtggttgttctcgttcgcaggggctcctcgtcctggtgatccaatgtctattagagggcagctcattgatcagtgcaggacatccagtttttgtaaattgttggagtgtgaccttggagagagcaagtgccactccccaagcgccatcatgaagatgttccagagctctttattctgcttgcagccccaaggtgattcctataccagaagatctgccttcgactcgatgttggctggctgcatacctgttttcttccatcccggttcagcatatgtccaatatacatggcatcttccaaagaactatacgaggtactctgtctttatccctgaagacagcatccggaaaggaaatgtcagtatcgaggagatactaaaaagtatccatccagatgttgccaagcagatgagggaagaggttatcaatctcataccaagggtgatatatgctgatccaaggtcgaaactggaagccctgaaggatgccttcgatgtttcggtagaggccatcattaacaaagtgacacagttgagaagagatataatctcaaacagcgaaggtaaagattttgtagaagagaatagctggaagtatgatctgttagaagaaggacagaggacaattggacctcatgaatgggatcctttcttctctaagcccaaggacaaaggtggagattctactaattcatctgaggaagctgccaagggtgcttggaaaattgaacaaagaggtcagaattaggccacaagtagcttctcttagagatgagatcaagagagcgcaagagctatccttgctgaaggtgctctgatgcaaatacgcggttaaaagtcccatagatgctgtagttttggtgatcatgtatgtccttgatgatccagcccctacaggtgtaagtagccgtgccaccgaaaatgtgtgtgggaaaattgacagtcagcctttgctttgtccctatagataccttcatactataattttgatttgttttctctcctcaataatgctctgtaagtccttgcaggattttagaggtataacaattttggtttgcgctttttgtttgttttactctagctgtatgacttagaaattatgtatactatcgtttgataagctccatgagcaaataatcaaaagtgacttgcaggcttactgctttttcg

SEQ ID NO: 2671 - DNA, 2757 bp, Panicum virgatum
cggctggcaataataaacgccccccgtgttcttccaaaacccgagaaaattacaaaatcccccgccggacgctaacgaacgaaagccttgcgagctcgtcataaagcctccgtcaggacggacccccccgtaaagccaacccaaaacctcccttttcccctccgttccgctccgctcccctcctcctcggtcgctcgatccgccgatccggtttctccgcgcccggtcgcgaaccccgtccggattccgccgtctgttctgcgcaatcggcgtcgttgatgcggcgcggttcgggccccgggctgtgattgggaggtgtcggtgcggcggtgttggcgcgggcgcggcgggcctccatgaggcggcggccggtcctgccgtcccaccacgacgacatggacaagggcggcgggaagccggcgtcctcgcgcctctgcttcctcgccacgctctgcgccatgttctgggtcctcatcttctacttccacttcgccgtcgtctccaacgagcccgacgcctccgcggcgcaggctggcggggtgcgcattgcccgcgcccgcctccagctccccgaacctgacggcgccgtccgccacgacatgcccctagtgccccccgcccgcgcatcggagccgccgccttctgtcgcgcgccccaaggaggtggtggtggaggagaagcctgccgccggagcccgccaggaggaggcgcagcccaaggtggcggcgccgtacccgttcgagcgggcgctcaagacggccgagaacaagagcgacccgtgcggcggccggtacatctacgtgcacgagctgccgccgcggttcaacgaggacatgctccgggactgcgagaagctcagcgtgtggaccaacatgtgcaggttcatgagcaacgacgggcttggcccgccgttgagcgacgaggagggtgtcttctccagcaccgggtggtatggcaccaaccaattctccgtggatgttattttcggcaacaggatgaagcagtacgagtgcctgaccaatgactcgtccattgccgcagccgtctttgtgccattctatgccgggtttgatattgcaagatatctctggggttataatatctcaacaagggacgccgcatcgcttgatttggtggattggttgatgaagaagcctgagtggaatgtgatgggcggccgtgaccatttcttagttgcagggaggatcacttgggatttcagaaggttgacggaggaagagtcggattggggaagcaagctgctcttcttgccggctgcaaagaacatgtcaatgcttgtggtggagtcaagcccgtggaattcaaatgattttggaataccatatcctacatacttccaccctgcaaaggatgctgatgttttcctctggcaagatagaatgaggagcttggagcgcccatggctcttctcgtttgcaggtgctccacgtcctggtgatccaatgtccatcagagggcaactcatagatcaatgcaggagctcaagtgtttgtaagttgttggagtgtgaccttggggagagcaagtgccactccccgagcacaatcatgaaaatgtttcagagttctttgttctgcttgcagcctcagggtgactcctacacaagaagatctgcctttgactccatgttggctggttgcatacctgttttcttccatcctgggtcagcttacgtccaatatacatggcatcttccaaagaactatacaaggtactccgtcttcatccctgaagatgacatccgagcaaaaaatgccagcattgaggagaggctaaaaagtattcacccagatgtggtcaagaacatgagagaagaggtcatcaatctaataccaagggtgatatatgctgatccaagatcgaaactggaaaccttgaaagatgcatttgatgtttccatagaggcaatcattaacaaagtgacaaagttgagaagagatatcatcgcaggccgagaagataaagattttattgaagagaatagctggaagtatagtctattagaagatggacagcgaacaattggacctcacgaatgggatccattcttctcgaaacccaaagaaaaaggtggagatcctagtagctcagctgctgaagctgccaagaattcttggaaaagtgaacaaagaggacagaattaaaccacaaggtacatcaccttggagatgtgatcaagggagcagagttagctacactctctgaagatgttctaatgcaaatacattgcacataggtcaagatccagtagctatgatgatcatgaacatcattgatgatctagttcaccctacagttgtacaaagccattccaccaaaaatgctttggggaaatttggcacacagcgtttgcttacccctataaatatcattttctacactaatttttgtttgatgtttttggtcaataatcctttgtaagcccttacaggatttagaggtatatcgattttgttattgtaccaccttgtttgttttgttgtgtttagagctatactgttttagacctgtggatactattaccatctgttcatatgttcaagttagtatgtaatcaatcaaagagggacacatggagactaatttcctcatacaagttactctgatatccagtcagaatgaagtgttttacaaatatgagatttgagataactctgcctactttacaaaatggcagctcatttctttcattctttttgtagtaacttatatcactatttatcttataaccttgcc

SEQ ID NO: 2672 - DNA, 2357 bp, Panicum virgatum
cggtttctccgcgcccggtcgcgaaccccgtcccgatccgccgtttgttcgggtaatcggcgtcgttgatgcggcgcggttcgggccccgggctgtgattcggagctgtcggtgcggggggtggcggcggcggtgttggcgcgggcgcggcgggcctccatgaggcggcggtcggtcctgccgtcccaccacgacgacatggagaagggcggcgggaagccggcgtcctcccgcctctgcttcctcgccacgctctgcgccatgttctgggtcctcatcttctacttccacttcgccgtcgtctccaacgagcccgacgcgcaggctggcggggtgcgcattgcccgcgcccgccttcagctccccgaacctgacggcgccgcccgccacgacatgcccctagagccgcccgcccgcgcgtcggagcggccgcctcctgtcacgcgccccaaggaggaggaggaggaggaggaggagaaggaggagaatcctgccgccgcagcccgccaggaggaggcgccgcccaaggtggcagcgtcgtacccgttcgagcgggcgctcaagacggccgagaacaagagcgacccgtgcggcggccggtacatctacgtgcacgagctgccgccgcggttcaacgaggacatgctccgggactgcgagaagctcagcgtgtggaccaacatgtgcaggttcatgaacaacgacgggcttggcccgccgttgagcgacgaggagggtgtcttctccagcaccgggtggtatggcaccaaccaattctccgtggatgttatttttggcaacaggatgaagcagtacgagtgcctgaccaaggactcgtcaattgccgcagcggtatttgtgccattctatgctgggtttgatattgcaagatatctctggggtcataatatctcgaccagggatgccgcctcgcttgatttggtggactggttgatgaagaagcctgagtggaatgtgatgggcgggcgtgaccatttcttagttgcagggaggatcacttgggatttcagaaggttgacggaggaagagtcggattggggaagcaagctgctcttcttgccggctgcaaagaacatgtcaatgcttgtggtggagtcaagcccgtggaattcaaatgattttggaataccatatcctacatacttccaccctgcaaaggatgctgatgttttcctctggcaagatagaatgaggagcttggagcgcccatggctcttctcgtttgcaggtgctccacgtcctggtgatccaatgtccatcagagagcaactcatagatcaatgcaggagctcaagtgtttgtaagttgttggagtgtgaccttggggagagcaagtgccactccccgagcacaatcatgaaaatgttccagagttctttgttctgcttgcagcctcagggtgactcctacacaagaagatctgcctttgactccatgttggctggctgcatacctgttttcttccatcctggttcagcttacgtccaatatacatggcatcttccaaagaactatacaaggtactccgtcttcatccctgaagatgacatccgtacaagaaatgccagcatcgaggagcggctaaaaagtattcacccagatgtggtcaagaacatgagagaagaggtcatcaatctaataccaagggtgatatatgctgatccaagatcaaaactggaaaccttgaaagatgcatttgatgtttccatagaggcaatcattaacaaagtgacaaagttgagaagagatatcatggcaggccgagaagataaagattttattgaagagaatagctggaagtatagtctattagaagatggacagcggacaattggacctcaccaatgggatccattcttctcgaaacccaaagaaaaaggtggagatcctaatagctcatctgctgaagctgccaagaattcttggaaaagtgaacaaagaggacagaattaaaccacaaggtatatcatcttggagatgtgatcaagggagcacagttagatacactctctgaagatgctctgatgcaaatacattgcacataggtcaagacccagtagttatgatgatcatgaacatcattgatggtctagttcaccctacagttgtaagaagccattccaccaaaaatgctttggggaaatttggcacacagtgtttgcttacccctataaatatcattttctacactaatttttgtttgatgtttttggtcaataatcctttgtaagcccttacaggatttagaggtatatcgattttgttattgtattaccttgtttgttttgttgtgtttagagctatatctatatgttttagtatctgtggatactagt

SEQ ID NO: 2673 - DNA, 1976 bp, Panicum virgatum
ggcaggctttgccacaacgcccctataaaagcctggccagcctgcatacatgacacaccacaccaaacttgatcagccctatctatctatcacccccggcccccctgaacctttttgcggcagttcttcactagcttcaagctcttgttgcaaagagcaagctaggagaaggggagctgcagccggaggaggtcactttctgcaaagagatgggggagaacggtgtgcccaagcactgctacccggcggcggccatggaggtgacctccgtggagctcggccacacggcggcctccaagtgctacgacgacgacggccgcctcaagcgcaccgggacgatgtggacggcgagcgcgcacatcatcacggcggtgatcgggtccggggtgctgtcgctggcgtgggccatcgcgcagctcggctgggtggccggccccgccgtcatgctgctcttctccttcgtcacctactacacctccgcgctgctcgccgactgctaccgctccggcgacccgtgcaccggcaagcgaaactacacctacatggacgccgtcaacgccaacctcagtggcgtcaaggtccagatctgcggcttcctgcagtacgccaacatcgtcggcgtcgccatcggctacaccatcgccgcctccattagcatgctggcgatcaagaaggccaactgcttccacgtggaggggcacggcgtcccgtgcagtatctccagcacgccgtacatgatcatcttcggcgtggcggagatcttcttctcgcagatcccggacttcgaccagatatcgtggctctccatcctggccgccgtcatgtccttcacctactccaccatcggcctgggcctcggcatcgtccaggtggtcgccaacaagggcgtccagggcagcctcacgggcatcagcgtcggcgtggtcgcccccgtcgacaaggtgtggcgcagcctgcaggcgttcggcgacatcgccttcgcctactcctactccctcatcctcatcgagatccaggacaccatccgggcgccgccgccgtccgagtccaaggtcatgcgccgcgccaccatcgtcagcgtcgccgtcaccacgctcttctacatgctctgcggctgcatgggctacgccgcgttcggcgacgccgcccccgggaaccttctcacgggcttcgggttctacgagcccttctggctcctcgacgtcgccaacgccgccatcgtcgtgcacctcgtcggcgcctaccaggtctactgccagccgctgttcgccttcgtcgagaagtgggcgcagcagaggtggcccaagtccaggtacatcaccggcgaggtcgacgtgccgctctccctcgccggctccgccggccggtgctacaagatgaacctgttccgcctgacgtggcggacggcgttcgtggtggcgacgacggtggtctccatgctcctgcccttcttcaacgacgtggtcgggctcctcggcgcgctggggttctggccgctcaccgtctacttccccgtcgagatgtacatcgtgcagaagaaggtgccccggtggagcacgcggtgggtgtgcctgcagctgctcagcctcgcctgcctcatcatcaccgtggcctccgccgccggctccgtcgccgggatcatctccgacctcaaggtgtacaggccgttcgtcaccacctactgaccgatcgttcgtcgcactgaacatatgcacagattgatggacagacagatgattggcgcctagtatatatgtgcagtctttaattaagttagtcattaattaattaccacacggtaaaaagaaaaaggaaaaaaagaagaaaattggtgtccttgtgacgatgcatagcttgcatcgccgatgtaccgtgtccttgctaatttccattgtttgtgatctggttgactgaaaaaggtagtgaattttaagagaaatcaaatagtgtgtttccaagtcaaatgcttgttgtgt

SEQ ID NO: 2674 - DNA, 3355 bp, Panicum virgatum
aagaacatgttgccgccccgaaaccctgtgaaatggccacgggccacccgcgccttccaggcagccccggctataaattgccgtggccgccctctccttcctcctcagtcctcgcggtcacttcaccagccaaccacgagccggtggagtggcaggcaggcaggcaggctagctcagtagtgagtgcccgagtcgtagccgcctttgaattccacgcggaggggaggcgtcctcgcgctccccggctagacggctagtcccgtcgtttgtcgctcaccacctgatcgagtagcagcagcttcgtcttgtcgaccgccggcggctatataaactgccgcgtaagtcaccgtgctgagcactccagctagagcacgaaccattgtctgactgtcttctgcagttctatgttaccgagctctgctgtgctgtactaaagctagctgcgagtctcactgttggtggtgttgtgcaactggtctgcagagatgggggagaacggtaagcactgctacccggcggcggccatggaggtgacctccgcggagctcggccacacggcggcctccaagtgctacgacgacgacggccgcctcaagcgcaccgggacgatgtggacggcgagcgcgcacatcatcacggcggtcatcgggtccggcgtgctgtcgctggcgtgggccatcgcgcagctcggctgggtggccggccccgccgtcatgctgctcttctccttcgtcacctactacacctccgggctgctcgccgactgctaccgctccggcgacgcgtgcaccggcaagcgcaactacacctacatggacgccgtcaacgccaacctcagtggcgtcaaggtccagatctgcggcttcctgcagtacgccaacatcgtcggcgtcgccatcggctacaccatcgccgcctccattagcatgctggcgatcaagaaggccaactgcttccacgtggaggggcacggcgacccgtgcagcatctccagcacgccctacatgatcatcttcggcgtggcggagatcttcttctcgcagatcccggacttcgaccagatatcgtggctctccatcctggccgccgtcatgtccttcacctactccgccatcggcctgggcctcggcatcgtccaggtggtcgccaacaagggcgtccagggcagcctcaccggcatcagcgtcggcgccgtcacccccgtcgacaaggtgtggcgcagcctgcaggcgttcggcgacatcgccttcgcctactcctactccctcatcctcatcgagatccaggacaccatccgcgcgccgccaccgtccgagtccaaggtcatgcgccgcgccaccatcgtcagcgtcgccgtcaccacgctcttctacatgctctgcggctgcacgggctacgccgcgttcggcgacgccgcccccgggaacctcctcaccggcttcggcttctacgagcccttctggctcctcgacgtcgccaacgccgccatcgtcgtgcacctcgtcggcgcctaccaggtctactgccagccgctcttcgccttcgtcgagaagtgggcgcagcagaggtggcccgagtccaggtacatcaccggcgaggtcggcgtcccgctctccctctccggctccgccggccgctgctacaagatgaacctgttccgcctgacgtggcggacggcgttcgtggtggcgaccacggtggtctccatgctcctgcccttcttcaacgacgtggtcgggctgctcggcgcgctggggttctggccgctcaccgtctacttccccgtggagatgtacatcgtgcagaagaaggtgcccaggtggagcacgcggtgggtgtgcctgcagctgctcagcctcggctgcctcatcatcaccgtggcctccgccgctggctccgtcgccgggatcatctccgacctcaaggtgtacaagccgttcgtcaccacctactgatggatcgatggttcgtcgcactgaacatatgcacagattgatggacagacagatgatttggcgcctagtatgtgcagtctttaattaaattagtcattaattaattaccaaacggtaaaaagaaaagggaaaaaaaagaaaattggtgtccttgtgatgcatagcttgcatcgccgatgtaccgtgtcctggataatttccattgtttgtgatctggttaactgaaaaaggcagtgaattaagagaaatcaaatagtgtgtttcctagtcaaatgcttgttgtgtgggctctgttcagcagaccagtattgaaattattccgtacataagtccagtaaaatgcatgatgtgtcctcaacttgtaatcaagaaatatgtccataagaaattagatacatgtacctagctactacgagactctacgacaacttccatgacaacttgtaatcaagtttgctcactggagcgaagcacaagggttggctcacagagtgacaccagcatgtaccacagtaccagtacgcatctctacgccgactttactttgctctccaagtaaacgtaccctataagtcctaagatcctccattacataactgtttgtgaccaaacaagataaggctgcgacgaggggagctagcgtacagccgaccaggcccagaaggctgtcacctgacgcccctcccgtcgaatcaggtctgcgagcacgtgccatgggagctcagctggcgagacccggcccggagacatccacgattccaggaaggtgagcacaagagccggccgcgggatcagtggaaatccgcgccatgtcggcgtcggagggatctccgatcctgggagggacgccatcgacgtggcctcaacaaccaaccgcactccatgggatttagttagtaaagtgtgtgtgagagagccccgcctgcgccaccacggccggtcagatcgaccagctgatcatcaggcggcctccgccgctgcttttgctgtggcgattggacaaagcaaagtacggacgccgcattacggccgatcgtgctttgccgcggctgctaatggggtggcgccaaaaggaaaggaaggatcccggaagaatctccctgaccacgatgatgatttcaatcaagacaagacaagacgctccaaaatccccctctcggctccaccgccgatccaccgcgcactgcccgtacgtacaggagtgagctttttcatcagtgcggccggcggcgtaccaccgtggcccccccgcggcccgctccgctcctctcctctgccgtcgcggcgaccggggctaggagggagggagcagccggaataccctcgccgtcgtctccagcttgtccgctccccggaaagggcggccgccgtgcgctccatcggggaatgttcgcgcgcgt

SEQ ID NO: 2675 - DNA, 2116 bp, Setaria italica
cggccagcctgcatacatgacacaccacaccaagcttgatcaaccctgatctatcaccccctgaacctttgcagctcttctccatcttcaagctctgtttgcaagagcaaggagaaggggagctgccggaggagagacttctgcaaagagagatgggggagaacgtcgtgcccaagcactgctacccggccgccgcagcggcggccatggaggtgacctccgtggagctcggccacacagcggcctccaagtgctacgacgacgacggccgcctcaagcgcaccgggacgatgtggacggcgagcgcgcacattatcacggcggtgatcgggtccggggtgctgtcgctggcgtgggccatcgcgcagctcggctgggtggccggccccaccgtcatgctgctcttctccttcgtcacctactacacctcggccctactcgccgactgctaccgctccggcgacccgtgcaccggcaagcgcaactacacctacatggacgccgtcaacgccaacctgagtggcatcaaggtccagatctgcggcttcctgcagtacgccaacatcgtcggcgtcgccatcggctacaccatcgccgcctccattagcatgctggcgatcaagaaggcgaactgcttccacgtggaggggcacggcgatccgtgcagcatctcgagcacgccgtacatgatcatcttcggcgtggcagagatcttcttctcgcagatcccagacttcgaccaaatatcatggctctccatcctcgccgccgtcatgtccttcacctactccaccatcggcctgggcctgggcatcgtccaggtggtcgccaacaagggcgtccagggtagcctcacgggcatcagcatcggcgcggtgacacccatcgacaaggtgtggcgcagcctgcaggcatttggcgatatcgccttcgcctactcctactccctcatcctcatcgagatccaggacaccatccgagcgccgccgccatccgagtccaaggtcatgcgccgcgccaccgtcgtcagcgtcgccgtcaccacgctcttctacatgctctgcggctgcatgggctacgccgccttcggcgacaacgcccccgggaacctcctcacgggtttcggattctacgagcccttctggctcctcgacgtcgccaacgccgccatcgtcgtgcaccttgtcggcgcctatcaggtgtactgccagccgctgttcgccttcgtggagaagtgggcgaagcagaagtggcccaaatccaagtacatcaccggggaggtcgacgtgccgctctccctctccggctccgccggccggtgctacaagttgaacctgttccggctgacgtggcggacggcattcgtggtagcgacgacggtgatctccatgctcctgccgttcttcaacgacgtggtcgggctgctgggcgcgctggggttctggccgctcaccgtctacttccccgtagagatgtacatcgtgcagaagaaggtgcccaggtggagcacgcggtgggtgtgcctgcagatgctcagcctcgcctgcctcatcatcaccgtggcctccgccgcgggctccgtcgccgggatcatctccgacctcaaggtctacaagccgttcgtcaccacctactgaacgatcgttccatgcactgaacatatgcacagattgatggacagatgatgggcgcctagtatgtgcagtctttaattaaaattagttattaatttattacaacacggtaaagaaagaaaaaggaaaagaaaagaaaagtggtgttcttggtgatgcgtatagcttgcattcgccaatgtaccgtgtccttgctaatttccattgtttgtgatctggttaactgaaaaaggtagtgaattaagagaaatcaaaaggtgtatttccaagtcaaatgcttgtgtgggatctgttcgatcagagcattattggaatgagccgtacaaagttcacggaaataagagcatcagcagtgtagcgaggcttggaactgtcatttcgtactgcaggcagcgacgatgcttcaactcgtttttcagcgcagagtgtggtgtcgatgccgaaacaactgtgggccctaaccatggataaaatactccctc

SEQ ID NO: 2676 - DNA, 2109 bp, Setaria italica
cacaccacaccaagcttgatcaaccctgatctatcaccccctgaacctttgcagctcttctccatcttcaagctctgtttgcaagagcaaggagaaggggagctgccggaggagagacttctgcaaagagagatgggggagaacgtcgtgcccaagcactgctacccggccgccgcagcggcggccatggaggtgacctccgtggagctcggccacacagcggcctccaagtgctacgacgacgacggccgcctcaagcgcaccgggacgatgtggacggcgagcgcgcacattatcacggcggtgatcgggtccggggtgctgtcgctggcgtgggccatcgcgcagctcggctgggtggccggccccaccgtcatgctgctcttctccttcgtcacctactacacctcggccctactcgccgactgctaccgctccggcgacccgtgcaccggcaagcgcaactacacctacatggacgccgtcaacgccaacctgagtggcatcaaggtccagatctgcggcttcctgcagtacgccaacatcgtcggcgtcgccatcggctacaccatcgccgcctccattagcatgctggcgatcaagaaggcgaactgcttccacgtggaggggcacggcgatccgtgcagcatctcgagcacgccgtacatgatcatcttcggcgtggcagagatcttcttctcgcagatcccagacttcgaccaaatatcatggctctccatcctcgccgccgtcatgtccttcacctactccaccatcggcctgggcctgggcatcgtccaggtggtcgccaacaagggcgtccagggtagcctcacgggcatcagcatcggcgcggtgacacccatcgacaaggtgtggcgcagcctgcaggcatttggcgatatcgccttcgcctactcctactccctcatcctcatcgagatccaggacaccatccgagcgccgccgccatccgagtccaaggtcatgcgccgcgccaccgtcgtcagcgtcgccgtcaccacgctcttctacatgctctgcggctgcatgggctacgccgccttcggcgacaacgcccccgggaacctcctcacgggtttcggattctacgagcccttctggctcctcgacgtcgccaacgccgccatcgtcgtgcaccttgtcggcgcctatcaggtgtactgccagccgctgttcgccttcgtggagaagtgggcgaagcagaagtggcccaaatccaagtacatcaccggggaggtcgacgtgccgctctccctctccggctccgccggccggtgctacaagttgaacctgttccggctgacgtggcggacggcattcgtggtagcgacgacggtgatctccatgctcctgccgttcttcaacgacgtggtcgggctgctgggcgcgctggggttctggccgctcaccgtctacttccccgtagagatgtacatcgtgcagaagaaggtgcccaggtggagcacgcggtgggtgtgcctgcagatgctcagcctcgcctgcctcatcatcaccgtggcctccgccgcgggctccgtcgccgggatcatctccgacctcaaggtctacaagccgttcgtcaccacctactgaacgatcgttccatgcactgaacatatgcacagattgatggacagatgatgggcgcctagtatgtgcagtctttaattaaaattagttattaatttattacaacacggtaaagaaagaaaaaggaaaagaaaagaaaagtggtgttcttggtgatgcgtatagcttgcattcgccaatgtaccgtgtccttgctaatttccattgtttgtgatctggttaactgaaaaaggtagtgaattaagagaaatcaaaaggtgtatttccaagtcaaatgcttgtgtgggatctgttcgatcagagcattattggaatgagccgtacaaagttcacggaaataagagcatcagcagtgtagcgaggcttggaactgtcatttcgtactgcaggcagcgacgatgcttcaactcgtttttcagcgcagagtgtggtgtcgatgccgaaacaactgtgggccctaaccatggataaaatactccctctcatctcaaccac

SEQ ID NO: 2677 - DNA, 2885 bp, Sorghum bicolor
gcctcagcgccctccgtccctagcttctccgtcgttcactgatcctacacgtacaacgcagaaatccctgccctggcactaggccttttgattgattaacaggccggcctgccaccgcaccctctataaaaacctggccagcctgcatacatggcacagcacagcaacatatctacccttgaagttgtagcagctcgctttctctcttcaagctaccaaaagctcttcttgcattgttgcaagaggatcgcaggagaaggaggtgacttctgcgaaggtaattcttcgtcaaagcacgcatggcatgtggtgcttgaacgtgcaccgctgttgcaatcttatcctatatctcttgcattggtgtgaacaatgcggtcttcttgcaaggtcttgttctgtgtcagtcagtggacactgtccccaccactccgcgtgagagacgacagatctctgatcgggatggtgcatccaagcaagttgttatataccgtagatagccagcaaaaatacccagcagtacaacagtgtaacactatttcccatatacatcaagttcacccccaaagatagccggcaggaacaggatgcccccggaagctgaaaaaaaagcatggttgcgtgcaactgtgcaagtgcaagatcccctggccgtggtcacccacacaaggacacggtcgccgcaccttccaggcaacaacaggctataaaattgccgcaatcacccacaactcacttcaaccagctagccaaccacgagccagtggagtggaaggctacagcctatagagctcagtgagtgcagtcgtcgtcgcccagccgcctctgactctgaaattccacgccgagtcgtcttcctgcgcgcttcgatcgtttctacgtctaattccgtgtgtttcagcacgttccagcagcttgatcgtcttgtcgatcgagatgggggagcactgctacccggcgaccatggaggagagctccatagagctcggccacacggcggcctctaagtgctacgacgacgacggtcgcctcaagcgcaccggcacgatgtggacggcgagcgcgcacattatcaccgccgtgataggttccggcgtgctgtcgctggcgtgggccatcgcgcagctcggctgggtggccggccccgccgtcatgctgctcttctccttcgtcacctactacacgtcggcgctgctcgccgactgctaccgctccggcgacccctgcaccggcaagcgcaactacacctacatggacgcggttaacgccaacctcagtggcatcaaggtccagctctgtgggttcctgcagtacgcgaacatcgtcggagtcgccatcggctacaccattgccgcctccattagcatgctggcgatcaagagggccaactgcttccacgtggagggacacggggacccgtgcaacatctccagcacgccgtacatgatcatcttcggcgtggccgagatcttcttctcgcagatccccgacttcgaccagatctcctggctgtcgatcctcgctgccgtcatgtccttcacctactccaccatcggcctgggcctgggcatcgtccaggtggtggccaacaagggcgtccagggcagcctgacggggatcagcgtcggcgcggtcaccccgctcgacaaggtgtggcggagcctgcaggcgttcggcgacatcgccttcgcctactcctactcgctcatcctcatcgagatccaggacacgatccgggcgccgccgccgtccgagtccaaggtcatgcggcgcgccaccatcgtcagcgtcgccgtcaccacgctcttctacatgctgtgcgggtgcatgggctacgccgccttcggcgacaacgcgccggggaacctcctcacgggcttcggattctacgagcccttctggctcctcgacgtcgccaacgccgccatcgtcgtccacctcgtcggcgcctaccaggtctactgccagccgctgttcgccttcgtcgagaagtgggcgcagcagaggtggcccaagtcgagctacatcaccggcgaggtcgacgtcccgctctccctcgccggggccgccggccggtgctacaagctcaacctgttcaggctcacgtggcggacggcgttcgtggtggccacgacggtggtgtccatgctgctgccattcttcaacgacgtggtggggctcctgggcgcgctgggattctggccgctcaccgtctacttccccgtggagatgtacatcgtgcagaagaaggtgcccaggtggagcacgctgtgggtgtgcctgcagctgctcagcctcggctgcctcatcatcaccgtcgcctccgccgcgggctccgtcgccggaatcatctctgacctcaaagtgtacaaacccttcgtcaccacctactgaagtgtactgatgactgatcgatcgtcgttcggtgcagacaaaacacatactgaagtatgcatgcacagatgactaattaattggcgcctagtatgtgcagtctttaattaaactaggcattaattaattatactatcacacggtaagaaaaggaaaagaaaaagatgatgattggtacggtgttctagtgatgcgtagcttgcatcgctgatttaccgtgtccttgctaattcccattgtttgtgatgatctggttaactgaaaaggctactgaatcaagagatatcaaatagcagtagtagtgtgtgttgccaagtcaaatgcaaagttgtcggtacaaagctcatgtaaaatttctgtgcaagaattgtgttcataaggaaaaacacgtgcttgttcctatatgagactctacaacaatttcttacatggcatggttacagaatttcagactttgagctattttcttcatgatatttatgagatgttttgga

SEQ ID NO: 2678 - DNA, 1698 bp, Saccharum officinarum
agcctactagcctcggactgtgtctcctacgatatccagctcgctgtgtgctctagctgcagtctcactgttcgggtgttgtatttgtaactggtgcagataggggagaacggtaccggtgtgcccgccaagcactactaccctgcggcggccatggaggtgacctcggtggagctcggccacacggcggcctccaagtgctacgacgacgacggtcgcctcaagcgcaccgggacgatgtggacggcgagcgcgcacattatcacggccgtgatagggtccggggtgctgtcgctggcgtgggccatcgcgcagctcggttgggtggcaggccccgccgtcatgctgctcttctccttcgtcacctactacacgtcggcgctgctcgccgactgctaccgctccggcgacgcgtgcaccggcaagcgcaactacacctacatggacgcggttaacgccaatctcagtggcatcaaggtccagctctgcggcttcctgcagtacgccaacatcgtcggagtcgccatcggctacaccattgccgcctccattagcatgctggcgatcaagagggccaactgcttccacgtggaggggcacggggacccgtgcaacatctccagcacgccgtacatgatcatcttcggcgtggccgagatcttcttctcgcagatcccggacttcgaccagatatcgtggctctcgatcctcgccgccgtcatgtccttcacctactccaccatcggcctgggcctgggcatcgtccaggtggtggccaacaagggcgtccaggggagcctcacggggatcagcgtcggcacggtcaccccgctcgacaaggtgtggcgcagcctgcaggcgttcggcgacatcgccttcgcctactcctactccctcatcctcatcgagatccaggacaccatccgggcgccgccgccgtccgagtccaaggtcatgcgccgcgccaccatcgtcagcgtcgccgtcaccacgctcttctacatgctgtgcgggtgcatgggctacgccgcgttcggcgacaacgcgcccgggaacctcctcacgggcttcggcttctacgagcccttctggctcctcgacgtcgccaacgccgccatcgtcgtccacctcgtcggcgcctaccaggtctactgccagcccctcttcgccttcgtcgagaagtgggcgcagcagcggtggcccaagtcccgctacgtcacgggcgaggtcgacgtcccgctctccctcgccggggccgccggccggtgctacaagctcaacctgttccggctgacgtggcggacggcgttcgtggtggccacgacggtggtgtccatgctgctgcccttcttcaacgacgtggtcgggctcctgggcgcgctgggcttctggccgctcaccgtctacttccccgtggagatgtacatcgtgcagaagaaggtgcccaggtggagcacgcggtgggtgtgcctgcagctgctcagcctctcctgcctcaccatcaccgttgcctgcgacgcgggctccgtcgccggaatcatctctgacctcaaagtgtacaaaccgttcgtcaccacctactgatgactgatcgatcgtcggtcggtgcagtcaaaacatttgcatgcacagatgattaattggcgcctaatatgtgcagtccttaattaaactaggcattaattaattacaacacgg

SEQ ID NO: 2679 - DNA, 1884 bp, Brachypodium distachyon
cccatctcttgacatacattatagccttcgacttgtcttcgaactctctcccaagaggagaggccggagatcaagaagaggagacttttgcacacagagatgggggagaacggtgtgggcaggcagccgtactacccggccatggaggtatccggcgtggagaacggccacacggccggctccaagtgctacgacgacgacggccgcctcaagcgcaccgggacgatgtggacggcgagcgcgcacatcatcacggcggtgatcgggtccggggtgctgtcgctgggctgggccatcgcgcagctgggctgggtggccggcccggccgtcatgctgctcttctccctcgtcacctactacacctccgcgctgctctccgactgctaccgctccggcgacgagaccaccggcaagcgcaactacacctacatggacgccgtcaacgccaacctcagtggcatcaaggtccagatctgcggtttcctgcagtacgcgaacatcgtcggcgtcgccatcggctacaccatcgccgcctccatcagcatgctagctatcaagagggccaactgtttccacgccaagggtcacgtgaacccgtgccacatctcgagcacgccctacatgatcatcttcggggcagcgcagatcttcttctcccaaatcccagacttcgaccagatctcctggctatccatcgtcgccgccatcatgtccttcacctactccacaatcgggctaggcctgggcatcgtccaggtggtggccaacaggggcgtcaagggcagccttaccgggatcagcatcggggtcgtgacacccatggacaaagtctggagaagcctccaggccttcggcgacatcgccttcgcctactcctactccctcatcctcatcgagatccaggacaccatccgggcgccgcccccgtccgagtccaaagtcatgcgccgggcaaccgtggtcagcgtggcgaccaccacgctcttctacatgctgtgcggctgcatggggtacgcggccttcggggacgaggcgccagggaacctcctcacggggttcggcttctacgagcccttctggctcctggacgtcgccaacgccgccatcgtggttcacctcgtgggagcctaccaggtttactgccagccgttattcgcgttcgtggagaagtgggcgcagcagagatggcccaagtcgagcttcatcgttggggagatcgaggtctcctttgggttcaaggtgaacctcttcaggctgacttggcggtcggcgttcgtggtggccacgacggtcgtgtccatgcttctgcccttcttcaacgacgtcgtcggcttcctcggcgcgctcgggttctggccgctcacggtatacttccccgtggagatgtacatcgtgcagaagaagatacccaggtggggatcgcagtgggtttgcctgcagctgcttagcctcgcctgcctcgtcatcaccgtcgcctccgccgccggatccgtcgccggaatcatgtccgatctcaaggtctacaaaccgttctccaccagtgactgactgactgaccgatagatctaccggtggccggccgtcacaaatgaatgcacagaagagacgatgcctggctacctgcatgctctaattaattaatcaatccgttatcacacgttcgctcgaaaaaagaaaaggagaaaagtgtgcttgttctgtatacaacgcgctgctgctaattttcattgtttgcgattcactacgttaactgaaaaggagaaagaatgttgtactcccgttccaaaataagtgacgcgacgtggatacaaatacacgtcacttattttgggacgggggagtacttaatttcaagtcaagtgttgtgcttgtaactacgtgatg

SEQ ID NO: 2680 - DNA, 1924 bp, Brachypodium distachyon
gtttaaccccatctcttgacatacattatagccttcgacttgtcttcgaactctctcccaagaggagaggccggagatcaagaagaggagacttttgcacacagagatgggggagaacggtgtgggcaggcagccgtactacccggccatggaggtatccggcgtggagaacggccacacggccggctccaagtgctacgacgacgacggccgcctcaagcgcaccgggacgatgtggacggcgagcgcgcacatcatcacggcggtgatcgggtccggggtgctgtcgctgggctgggccatcgcgcagctgggctgggtggccggcccggccgtcatgctgctcttctccctcgtcacctactacacctccgcgctgctctccgactgctaccgctccggcgacgagaccaccggcaagcgcaactacacctacatggacgccgtcaacgccaacctcagtggcatcaaggtccagatctgcggtttcctgcagtacgcgaacatcgtcggcgtcgccatcggctacaccatcgccgcctccatcagcatgctagctatcaagagggccaactgtttccacgccaagggtcacgtgaacccgtgccacatctcgagcacgccctacatgatcatcttcggggcagcgcagatcttcttctcccaaatcccagacttcgaccagatctcctggctatccatcgtcgccgccatcatgtccttcacctactccacaatcgggctaggcctgggcatcgtccaggtggtggccaacaggggcgtcaagggcagccttaccgggatcagcatcggggtcgtgacacccatggacaaagtctggagaagcctccaggccttcggcgacatcgccttcgcctactcctactccctcatcctcatcgagatccaggacaccatccgggcgccgcccccgtccgagtccaaagtcatgcgccgggcaaccgtggtcagcgtggcgaccaccacgctcttctacatgctgtgcggctgcatggggtacgcggccttcggggacgaggcgccagggaacctcctcacggggttcggcttctacgagcccttctggctcctggacgtcgccaacgccgccatcgtggttcacctcgtgggagcctaccaggtttactgccagccgttattcgcgttcgtggagaagtgggcgcagcagagatggcccaagtcgagcttcatcgttggggagatcgaggtctcctttgggttcaaggtgaacctcttcaggctgacttggcggtcggcgttcgtggtggccacgacggtcgtgtccatgcttctgcccttcttcaacgacgtcgtcggcttcctcggcgcgctcgggttctggccgctcacggtatacttccccgtggagatgtacatcgtgcagaagaagatacccaggtggggatcgcagtgggtttgcctgcagctgcttagcctcgcctgcctcgtcatcaccgtcgcctccgccgccggatccgtcgccggaatcatgtccgatctcaaggtctacaaaccgttctccaccagtgactgactgactgaccgatagatctaccggtggccggccgtcacaaatgaatgcacagaagagacgatgcctggctacctgcatgctctaattaattaatcaatccgttatcacacgttcgctcgaaaaaagaaaaggagaaaagtgtgcttgttctgtatacaacgcgctgctgctaattttcattgtttgcgattcactacgttaactgaaaaggagaaagaatgttgtactcccgttccaaaataagtgacgcgacgtggatacaaatacacgtcacttattttgggacgggggagtacttaatttcaagtcaagtgttgtgcttgtaactacgtgatgagaaatgcaagttcatatgataattttcttcgc

SEQ ID NO: 2681 - DNA, 1991 bp, Hordeum vulgare
aacacaccatcacagcaagtttaaccccatctcttgacacaacactttgatagccctgaactttcctcgtgacactctcttgcaaggagagaggtggtcaaggagaggatactttttgcaaaggagtgagatggggcagaacggcgtgggcaagaactactatcaggggacggcggcggcggccatggaggtgtcctccgtggagcacggccaggcggcggcctccaagtgctacgacgacgacggccgcctcaagcgcaccgggacgatgtggacggcgagcgcccacatcatcacggcggtgatcgggtccggggtgctgtcgctggcctgggccatcgggcagctcggctgggtggccggccccgccgtcatgctgctcttctccctcgtcacctactacacctcctcgctgctctccgactgctaccgctccggcgacgaaaccaccggcaagcgtaactacacctacatggacgccgtcaacgccaacctcagtggcatcaaggtccagctctgcgggttcctgcagtacgccaacatcgtcggcgtcgccatcggatacaccatcgccgcctccattagcatgcttgcgatcaagaaggccaactgcttccacgtcaaggggcacgtgaacccgtgccacatctcgagcacgccctacatgatcatcttcggcgtggcggagatcttcttctcccagatcccggacttcgaccagatctcctggctctccatcctggctgccatcatgtccttcacttactccatcatcggcctcagcctcggcatcgtccaggtggtcgccaacaagggcgtcaagggcagcctcaccggcatcagcatcggcgtcgtcacgcccatggacaaggtgtggcggagcctccaggcgttcggtgacatcgccttcgcttactcctactccctcatcctcatcgagatccaggacaccatcagggcgccaccgccgtccgagtccaaggtcatgcgccgcgccaccgtcgtcagcgtcgccaccaccacgctcttctacatgctctgcggctgcatgggctacgccgccttcggcgacaacgcccccgggaacctcctcacaggcttcggcttctacgagcccttctggctcctcgacatcgccaacgccgccatcgtcgtccacctcgtcggcgcctaccaggtttactgccagcccctgttcgccttcgtggagaagtgggcgcagcagaggtggcccaagtcccggttcatcaccggagagatccaggtcccgctcatctcctccggcttcaagatcaacctcttccgcctgacgtggcggtccgcgttcgtggtggccacgacggtggtgtcgatgctgctgccattcttcaacgacgtcgtggggttcctcggcgccatcgggttctggccactcaccgtctacttccccgtggagatgtacattgtgcagaagaagatacccaagtggagctcacagtgggtgtgcctccagctgctcagcctcgcctgcctaatcatcaccattgctgccgccgccggatccatcgccgggataatgtccgatctaaaggtctacaagcctttctccacgactgactgatcgatgcctggccgtcgcatgaatgcacagatcctcgatggacagaatatgcctaaaagttctaattaattaatcaaccaattatcacacgttcgctgaaaattgcaagttcaagtaattgttgcttccaaacagccggtgtaacaccggtgctgatgatttcattttcctttgtttgcaatccattgtgttaactgaaaaatggtagagaggaaccaaatagtgtacttccaaagtggtgtgattgtaagtacgttatgagaaacgaatgttcttatgataattactccttcagtagtactctctctacttaaatactagcttgtagttgagaaaattagactatttttttccaacaagtttttaggtacaaagtgagtattaaagatca

SEQ ID NO: 2682 - DNA, 2250 bp, Zea mays
accggtccaacaatacaacgcagaaagaaaagaaaaaaaatccatggcgttaattagggcttttggttaaatggttaccaggccagcctgcactgcagctgcagtgccgccgcaccgcacccctataaaaaccaaggcatgcagcctgcatacagaagacacacagcagcacacaccaagctagtttgatctatacgacgacgctttagaagcagcagtagcaccttgatcacttactctcttcgagctagcaagctcttgctgcattattgcaagaggaacaacgaaggagaagagctagggggaccaagctactgcgggagggagaagggtgtgtgccggcccgccgccaagcactgctacccggccggcggccatggaggtgagctccgtggagttcggtcatcacgcggcggccgcctcaaagtgctttgacgacgacggtcgcctcaagcgcacagggacgatgtggacggcgagcgcgcacattatcacggccgtgatagggtccggggtgctgtcgctcgcgtgggccatcgcgcagctcggctgggtggcaggccccaccgtcatgctgctcttctccttcgtcacctactacacatcggccctactcgccgactgctaccgctccggcgacgcctgcaccggcaagcgcaactacacgtacatggacgcggttaacgccaatctcagtggcgtcaaggtctggttctgcgggttcctgcagtacgccaacatcgtcggagtcgccataggctacaccattgccgcctctattagcatgctggcgatccagagggcgaactgcttccacgtggaggggcacggggacccctgcaacatctccagcacgccctacatgatcatcttcggcgtcgtgcagattttcttctcgcagatcccggacttcgaccagatatcgtggctctccatcctcgccgccgtcatgtcgttcacctactccaccatcggcctgggcctgggcatcgcgcaggtggtgtccaacaagggcgtgcagggcagcctgacggggatcagcgtcggcttggtcaccccggtcgacaagatgtggcgcagcctgcaggcgttcggcgacatcgccttcgcctactcctactcgctcatcctcatcgagatccaggacaccatccgcgcgccgccgccgtccgagtccaaggtcatgcggcgcgccaccgtcgtcagcgtggccgtcaccacgttcttctacatgctgtgcgggtgcatggggtacgccgcgttcggggacaacgcccccgggaacctcctcacgggcttcggcttctacgagcccttctggctcctcgacgtcgccaacgccgccatcgccgtgcacctcgtcggcgcctaccaggtctactgccagcccctgttcgccttcgtcgagaagtgggcgcgccagaggtggcccaagtcccgctacatcacgggcgaggtcgacgtcccgctcccgctcgggaccgccggcggccggtgctacaagctcagcctgttccggctgacgtggcggacggcgttcgtggtggccacgacggtggtgtccatgctgctgcccttcttcaacgacgtggtcgggctcctgggcgcgctggggttctggccgctcaccgtctacttccccgtggagatgtacatcgtgcagaagaaggtgcccaggtggagcacgcggtgggtgtgcctgcagctgctcagcgtcgcctgcctcgtcatcaccgtcgcctccgccgcaggctccgttgccgggatcgtctctgacctcaaagtgtacaaaccgttcgtcaccacctcctgatcgaccgtacgtcctagcttccgtgcagttcaaaacacatacgcacgaacagatcattaattggcgcctagtatatatgtgcagtctttaattaaattaactaggcattaatcgatcgattaccactacgtcgttctagtgatgcgcgtagcttgcatcatcgctcgctgatttaatttccattgtttttctttgatgatctggttagccgaaatggctagtgaattaagagaaaacaaatagtagcagtactgtgtgagtaatcccaagtcaaatacgttattgaagttgtcggcggtacaaaacgcttgtaaaatgtttgtgtttcaattaatcaagaagaattgtacgtgtttcatatatgaggaaaagaaaaaaggacatatgtttgtttctacaacttctaaataaacaacttgatcgagatgttttcttca

SEQ ID NO: 2683 - DNA, 1847 bp, Zea mays
aacacaccactgaactgaactcccagctgtaatctatctccttgcagtaagcaagggcagcgagagtacgacgacgacggcccagcaacttcctcgaacagagaaaaaaaaaagaacagcacctaacctagggaagattgacatggcggagaacaacgtcgtggccacgtactactacccgacggcagcgccggcggccatggaggtctgcggcgcggagctcggccagggcaagcccgacaagtgcttcgacgacgatggccgccccaagcgcaatgggacgatgtggacggcgagcgcgcacatcatcacggcggtgatcggctccggggtgctctcgctggggtgggccatcgcgcagctcggctgggtggccggacccgtcgtcatgctgctcttctcgctcgtcacctactacacctcgtcgctgctcgcagactgctaccgctccggcgaccccagcaccggcaagcggaactacacctacatggacgccgtcaacgcgaacctcagtggcatcaaggtccagatctgcgggttcctgcagtacgccaacatcgtgggcgtggccatcggctacaccatcgctgcctccattagcatgctcgcgatcaggagggccaactgcttccaccagaagggacacggcaacccctgcaagatctccagcacgccctacatgatcatcttcggcgtggcggagatcttcttctcgcagatcccggacttcgaccagatctcctggctctccatcctcgccgccgtcatgtccttcacctactcctccattgggctcggcctgggcgtcgtccaagtcatcgcgaacagaggcgtgcagggcagcctgaccggcatcaccatcggcgtggtgaccccgatggacaaggtgtggcgcagcctccaggcgttcggcgacgtcgccttcgcctactcctactccctcatcctgatcgagatccaggacaccatccgggcgccgccgccgtcggagtcgacggtgatgaagcgcgccacggtggtgagcgtggcggtcaccacgctcttctacatgctgtgcggctgcatggggtacgcggcgttcggcgacggcgcgcccgggaacctcctcacgggcttcggcttctacgagcccttctggctcctggacgtggccaacgccgccatcgtggtccacctggtcggcgcctaccaggtctactgccagccgctgttcgccttcgtggagaagtgggccgcgcagcggtggccggactcggcgtacatcaccggggaggtcgaggtcccgctcccgctcccggcgagccggcggcggtgctgcaaggtgaacctgttccgggcgacgtggcggacggcgttcgtcgtggccacgacggtcgtgtccatgctgctgcccttcttcaacgacgtggtgggcttcctgggcgcgctcggcttctggccgctcaccgtctacttccccgtcgagatgtacgtggtgcagaagaaggtgccgcggtggagctcccggtgggtgtgcctgcagatgctcagcctcggctgcctcgtcatctccatcgccgccgcagccgggtccatcgccggcatcgcgtccgacctcaaagtctaccgcccgttcaagtcctactgatcagattcacggcctacgggagacgcagcagcatgtggtatataggcatatactagcaaccatgttcgtgagttgcaactcataagtacttaaatcagactctgcatcattgctaaacgcgagtttttttaacttgtatacgcatgattcatgagtcccaattacatatgaaaaggatgcaacacaatatatattgaaatataaaagatctcgtaccgat

SEQ ID NO: 2684 - DNA, 2190 bp, Sorghum bicolor
gcatctgcctgcataatgcagggagagcctggatgcagcagcagcctataaataaaacccatccgatgcaactaataacacaccaagtacaccattaattaacttactcaatctccttgcaacttaacaagcaagagcagcgagaggagtacgacgaccctgcaacttcgtcctcgatcagaaaaaagagcagattgagatggcagagaacgtggtggccacgtactactacccgacggcggcgccggcggccatggaggtctgcggcgcggagctcggcaagggcgcgagcgacaagtgcttcgacgacgacggccgccctaagcgtaacgggacgatgtggacggcgagctcgcacatcatcacggcggtgatcggctccggggtgctgtcgctggggtgggccatcgcgcagctcggctgggtggccggccccgccgcgatgctgctcttctcgctcgtcacctactacacctcctcgctgctcgccgactgctaccgctccggcgaccccagcaccggcaagcgaaactacacctacatggacgccgtcaacgccaacctcagtggcatcaaggtccagatctgcgggttcctgcagtacgccaacatcgtgggcgtggccatcgggtacaccatcgccgcctccatcagcatgctcgcgatcaggagggccaactgcttccaccagaaggggcacggcaacccctgcaaggtctccagcacgccctacatgatcatcttcggcgtagcggagatcttcttctcgcagatccccgacttcgaccagatatcgtggctctccatcctcgccgccgtcatgtccttcacctactcctccatcggtctcggcctgggcatcgtccaagtcatcgcgaacagaggcgtgcaggggagtctgacggggatcagcatcggcgtggtgaccccgatggacaaagtgtggcgcagcctgcaggcgttcggcgacatcgccttcgcctactcctactccctgatcctgatcgagatccaggacacgatccgggcgccgccgccgtcggagtcgacggtgatgaagcgcgccacggtggtgagcgtggcggtgaccacgctcttctacatgctgtgcggatgcatggggtacgcggcgttcggcgacggcgcgcccggaaacctcctcacgggcttcggcttctacgagcccttctggctcctggacgtggccaacgccgccatcgtcgtccacctcgtcggcgcctaccaggtctactgccagccgctgttcgccttcgtcgagaagtgggccgcgcagcggtggccggactcggcgttcgtcaccggggaggtcgaggtcccgctcccggcgacgcggcggcggagctgcaaggtgaacctgttccgggcgacgtggcggacggcgttcgtggtggcgacgacggtcgtgtccatgctgctgcccttcttcaacgacgtggtggggttcctgggcgcgctcggcttctggccgctcaccgtctacttccccgtggagatgtacgtggtgcagaagaaggtgccgcggtggagcccccggtgggtgtgcctgcagatgctcagcctcggctgcctcgtcatctccgtcgccgccgccgccgggtccatcgccggcatcgcgtccgacctcaaggtctaccgcccgttcaagtcctactgatcagattcacgggagacgcagcatgtggtatataggcacatatatatagcggtgtccaagaagtacacatcggaatccaaaatgcacacggcggtagtatcaaaaccgagaggggaaaaagtttgcagtactgaacggtgacacgctcgagaaagtttcagtgtgtcgcgctgttcttatgctgtactacgccaatcttacaaaattacctatcttgatcaattgtcaaaatttggggagagatacagagagctctgtcacgctggctgagaacaacagcctcacagctaataactttgtcgcgaaatttcacgtcctcgtccgacttgtcatatattaggcccaactacagccctgttaagtcacaaaatgaagatacttgcccatgaacgtccttaaaaacattttaacacatgagtctcactagagatgcctcctcatgtcttgacttcaaaaaagtatgccggactgaagcgtgaaggcccatttacagccctaaataaatggtttataaa

SEQ ID NO: 2685 - DNA, 1919 bp, Panicum virgatum
gactgttccgtagcatgcgtatgttgtgagggtggcatcaaaaggggtcggcacgtagtgtgcaatttaggtacacgctgttcccgttgacggcgagcgtcgtcgtcctgctctcgtgcccaattcaagcgttcgacgacggcagcctcgacgttccccggcccgcctccgtacagggagcagcacctttcgccgtccctgtctgtccctggctcctcacctgcagccgtcaggcagtagtagctcctcaatggcgactggtcgggggcaccaaccaacctgctgctgctggtggtggttggcgcctataaatcgcgccccccacaccaccccgtactggccaccccgcagcagctgccacctcgtcttaccagctgggttctctttggcctccttgggcatcgttccagagatcgtagtcggcccggagatggcggcggagaacgtcgtggccacgtactactacccgacggcggcgccgggggccatggaggtgtgcggcgcggagttcggccgcggcgcgggggacaagtgcttcgacgacgacggccgccccaagcgctccgggacggtgtggacggcgagcgcgcacatcatcacggcggtgatcggctccggggtgctgtcgctggggtgggccaccgcgcagctcggctgggtggccggccccgccgtcatgctgctcttctcgctcgtcacctactacacctccgcgctgctcgccgactgctaccgctccggcgaccccaccaccggcaagcgcaactacacctacatggacgccgtcaacgccaacctcagtggcgtcaaggtccagatctgcgggttcctgcagtacgccaacatcgtcggggtggccatcgggtacaccatcgccgcctccatcagcatgctcgccatcaggagagccaactgcttccaccagaaggggcacggcaacccctgcgccatctccagcacgccctacatgatcatcttcggcgtggccgagatcttcttctcgcagatcccggacttcgaccagatctcctggctctccatcctcgccgccgtcatgtccttcacctactccaccatcgggctcggcctcggcatcgtccaagtcatcgcgaacaaaggcgtgcagggcagcctgacgggcatcagcatcggcgcggtgaccccgatggacaaggtgtggcgcagcctgcaggcgttcggcgacatcgccttcgcctactcctactcgctcatcctcatcgagatccaggacaccatccgggcgccgccgccgtcggagtccacggtgatgaagcgcgccacggtggtcagcgtcgcggtgaccacgctcttctacatgctctgcggctgcatggggtacgcggccttcggcgacggcgcgccggggaacctcctcacgggcttcggcttctacgagcccttctggctcctcgacgtcgccaacgccgccatcgtcgtccacctcgtcggcgcctaccaggtctactgccagccgctgttcgccttcgtcgagaagtgggccgcgcggcggtggcccggctcggccttcgtcgccggggaggtcgaggtgccgctcctcccgcggtacaaggtgaacccgttccgggcgacgtggcggacggcgttcgtggcggcgacgacggcggtgtccatgctgctgcccttcttcaacgacgtggtggggttcctgggcgcgctgggcttctggccgctcaccgtctacttccccgtggagatgtacgtggtgcagaagaaggtgccgcggtggagcacgcggtgggtgtgcctgcagatgctcaacctcggctgcctcgtcatctccgtcgccgccgccgccgggtccatcgccggcatcgcgtcggatctcaaggtctaccgcccgttcaagtcctagtgatctcatcatcagattattcatg

SEQ ID NO: 2686 - DNA, 1862 bp, Oryza sativa
acacaccacaccaagctctcaccaagctggacatatatatcttgccattttgctgatccattttctgcttaattgctcggttaatccctgcaaggggagtagaactgaagcaggagatcgagcagctatcttcttcagagaaagctgatcagctgagaccatgggggagaacgtggttggcacgtactactacccgccttcggcggccgccatggacggcgtggagctcggccacgccgccgccggctccaagctcttcgacgacgacggccgccccaggcgcaacgggacgatgtggacggcgagcgcgcacatcatcacggcggtgatcggctccggcgtgctgtcgctggggtgggccatcgcgcagctcggctgggtggccgggccggcggtcatggtgctcttctccctcgtcacctactacacctcatccctcctctccgattgctaccgctccggcgaccccgtcaccggcaagcggaactacacctacatggacgccgtgaacgccaacctgagcgggttcaaggtgaagatctgcgggttcttgcagtacgccaacatcgtcggcgtcgccatcggctacaccatcgcggcgtccatcagcatgctggcgatcgggagggccaactgcttccacaggaaggggcacggcgacccgtgcaacgtctccagcgtgccctacatgatcgtcttcggcgtcgccgaggtcttcttctcgcagatccccgacttcgatcagatctcctggctctccatgctcgccgccgtcatgtccttcacctactccgtcatcggcctcagcctcggcatcgtccaagtcgtcgcgaacggagggttgaagggaagcctgaccgggatcagcatcggcgtggtgacgccgatggacaaggtgtggaggagcctgcaggcgttcggcgacatcgcgttcgcctactcctactcgctgatcctcatcgagatccaggacaccatccgggcgccgccgccgtcggagtcggcggtgatgaagcgcgccacggtggtgagcgtggcggtgaccacggtgttctacatgctctgcggcagcatggggtacgcggcgttcggcgacgacgcgccggggaacctcctcaccgggttcggcttctacgagcccttctggctcctcgacatcgccaacgccgccatcgtcgtccacctcgtcggcgcctaccaggtgttctgccagccgctcttcgccttcgtcgagaagtgggcggcgcagcggtggccggagtcgccgtacatcaccggggaggtggagctccgcctctcgccgtcgtcgaggcggtgcagggtgaacctgttccggtcgacgtggcgcacggcgttcgtcgtcgccaccacggtggtgtccatgctgctgcccttcttcaacgacgtggtcggcttcctcggcgcgctcggattctggccgctcaccgtctacttccccgtggagatgtacgtggtgcagaagaaggtgccacggtggagcacacggtgggtgtgcctgcagatgctcagcgtcggctgcctcgtcatctccatcgccgccgccgcgggctccatcgccggcgtcatgtcggatctcaaggtttaccgcccgttcaagggttactgataactgatcggatcacgtacgcacccagaacgacacgtcaaaaaaatcaaaattgcccttctcgtagaaggaaaaccaaattcacttcacacgattaaacccaaaacgaaaaaaaaggagcagtgatcagacgctaagggaaaaaaaagtgtaagtgcgtgtcactgttgatgtactgtaaaagataatttatgaaggaaaaagataaggaaatggaagtgcctctctgtactat

SEQ ID NO: 2687 - DNA, 1984 bp, Triticum aestivum
gcgcagcaccactcacagtagacatttactcgctctctgcagatcacgctgcgcaagatcgcatctctagcgagcccgcagagtgcactgcactgactgtggtctggcctcctctttatcagttctcacccgcacgcctactctctcttctgttggcagcaattaagcctaaagagaggccgatcgggatggcggacaaggtcgtggccacctactactacccaccgatggaggtagccgccgccgagctcggccacaccgccgggtccaagctcgacgacgatggccgcaacaagcgcaccggcacgatgtggacggcgagctcgcacattatcacggcggtgatcgggtccggggtgctgtcgctgggctgggccatcgcgcagctcggctgggtggccggacccgccgtcatgctgctcttctcgctcgtcacctacttcacctcctcactgctcgccgactgctaccgctccggcgatcagagcaccggcaagcgcaactacacctacatggacgccgtcaacgccaacctcagcggcatcaaggtgcagatctgcgggggtgctgcagtacgcaaacatcgtcgggggtggccattggctacaccatagccgcctccaccagcatgctggcgattaagagggccaattgtttccacggcaacgggccacgccgacccctgcaagctctccagcgtgccgtacatgatcatcttcggcgtggcccaggtcttcttctcccagatccccgacttcgaccagatctcctggctctccatgctcgccgccgccatgtccttcacctactcttccatcggcctcggcctcggcatcgtacaaggtatagcaaacggaggcgtgaagggcagtctgaccggcatcagcatcggcacggtgacgccgatgcagaaggtgtggcgcagcacgcaggcgtttggggacattgcgttcgcctactcctactcgctcatcctcatcgagatccaggacaccatccgggcgccaccgccgtcggagtccacggtcatgaagcgcgccaccatggtcagcgtcgcggtgaccacggtcttctacatgctctgcggctgcatgggctacgcggctttcggcgacgccgcgccggggaacctcctgacggggttcggcttctacgagcccttctggctcctcgacgtggccaacgccgccatcgtcgtccacctggtcggcgcgtaccaggtgtactgccagcccctgtttgccttcgtcgagaaatgggcggcgaagaggtggccggagtccacgttcgtcaccggcgaggtcgaggtcccgctcttcaggacgtacaaggtgaatatgttccgggcgacgtggaggacggcgttcgtggtggcgacgacggtggtgtccatgatgctgccattcttcaacgacgtggtggggttcctgggcgcgctggggttctggccgctcaccgtctactttcccgtggagatgtacgtggtgcagaagaaggtgcccaagtggagcacgcagtgggtgtgcctccagatgctcagcctcggatgcctcgccatctccctcgccgccgccgcggggtccatcgccggcatcaagtccgacctcaaggtgtaccacccgttcaagtcataatcgacgcttgacgatcatgcacgcaccgaagaacattctaagatagcgtccggttactccggtaaagttcactttggcagtgtgaaaagccaaaaagaaaaggaaaaagaacagcgacaaggtaccagagtgtcaaaaaaattgtttaggctggctaatgaccgccgtagttgcctcaaagaaaacatacctaagtgtcaacagtgtgagtgtcaccaactaatgttcttgttttgtgtggtagtagaagttaatttaatacagtcttgctaagtcttagtccactaagacttgacgaagtctcagttgatgctatatccataagatggtacattaagatccgtgcaaaa

SEQ ID NO: 2688 - DNA, 1830 bp, Triticum aestivum
cgcgctctcgctccctagcagtaatttactatcacgctgcacaggatcgcatctctaacgcgcagagtgcactacacttactgtggtctggcctcatcttaaatagttctcacctgcacgcctactctctctgttccgttggcagcagttaagcctacggagaggtcgatcgggatggcagacaaggtcgtggccacctactactacccgccgatggaggtagccgccgccgagctcggccacaccgccggctccaagctcgacgacgatggccgcaacaagcgcaccggcacgatgtggacggcgagctcgcacatcatcacggcggtgatcgggtcaggggtgctgtcgctgggctgggcaatcgcgcagctcggctgggtggccggccctgctgtcatgctcctcttttcgctcgtcacctacttcacctcctcgctgctcgccgactgctaccgctccggcgaccagagcaccggcaagcgcaactacacctacatggacgccgtcaacgccaacctcagcggcatcaaggtgcagatttgcggggtcctgcagtatgctaacatcgtcggggtgtctatcggctacaccatcgccgcctccatcagtatgctggccatcaagagggctaactgcttccacggcaacggccacgccgacccctgcaaggtctccagcgcgccctacatgatcatcttcggcgtggctcaggtcttcttctcccagatccccgacttcgaccagatctcctggctctccatgctcgcgcagccatgtccttcacctactcctccatcggcctcggcctcggcatcgtccaagtcatagcaaacggaggcgtaaagggcagcctgaccggcatcagcatcggcacggtgacgccgatgcagaaggtgtggcggagcacgcaggcgttcggggacattgcgttcgcctactcctactcgctcatcctcatcgagatccaggacaccatccgggcgccgccaccgtcggagtccacggtcatgaagcgcgccaccatggtcagcgtcgcggtgaccacggtcttctacatgctctgcggctgcatgggctacgcggccttcggcgacgccgccccgggaaacctcctcacggggttcggcttctacgagcccttctggctcctcgacatcgccaacgccgccatcgtcatccacctcgtcggcgcctaccaggtgtactgccagccccctgttcgccttcgtggagaagtgggcggcgaagaggtggccggagtctacatacgtcaccggcgaggtcgaggtgccgctcttcaggacgtacaaggtgaacatgttccgggcgacgtggcggacagcgttcgtgacggcgacgacggtggtgtccatgatgctgcccttcttcaacgacgtggtggggttcctgggcgcgctggggttctggccgctcaccgtctactttcccgtggagatgtacgtggtgcagaagaaggtgcccaagtggagcacgcagtgggtgtgcctccagatgctcagcctcggatgcctcgctatctccctcgccgcagccgcggggtccatcgccggcatcaaatccgacctcaaggtgtaccacccattcaagacataattgacgttgacgatcgtgcacgcacaaaaacaatacatcaaggattcaaggtgtaggattcaagacaaagaagttcttggccttcaaacaattcaaagaagatagatcctggatggagttgtactacttcatgtagtcatgcatgagatccacagggaaaaaaaaaactaaatgatgtttctttatagcagtgattttaaaatgtatgataag

SEQ ID NO: 2689 - DNA, 1839 bp, Avena sativa
cctaacgtccaaggtccaaggggaccccgttcggctaacggcttccgtggttacggttcggggtccggaccgtttaacggacttcggtgccccttcggtaaaggaccaagaccggattacgggccgttcgttgtccgagagtaaaggacctagctagcgagttaaagtctagtcgacggagaggccgaatcgagatggtacgagctagacggctgacaacgtggtggccgacgttctactacccgccgcgggggccggatggaggtgtccgccgccgaggctcggagacaccgcgctctccaagtgcttcgacgacgacggccgcaacaagcgcaccggcacgatgtggacggcgagctcgcacatcatcacggcggtgatcgggtcgggggtgctgtctctgggctgggcgatcgcgcagctgggctgggtggccggcccggccgtcatgatcctcttctccctcgtcacctacttcacctcctcgctgctcgccgactgctaccgctccggcgaccagagcacgggcaagcgcaactacacctacatggacgccgtcaacgccaacctcagcggggtcaaggtcaagatctgcggggtgctgcagtacgccaacatcgtcggggtggccatcggctacaccatcgcggcgtccatcagcatgctggccatcaagagggcaaactgcttccacggcaagggacacgccgacccctgcaagatctccagcacgccatacatggtcatattcggcgtcgcgcaggtcttcttctcgcagatcccagactttgaccagatctcgtggctatccatgctcgccgccgccatgtcattcacctactcatccatcggactcggactcggcatcgtccaagtcatagcgaacggcggcgtgaagggcagcatgaccggcatcagcatcggcgcggtgacgccgatgcagaaggtgtggcggagcacgcaggcgttcggggacatcgccttcgcctactcctactcgctcatcctcatcgagatccaggacactatccgcgcgccgcctccgtccgagtccacggtcatgaagcgcgccacgggggtcagcgtcgcggtgaccacggtcttctacatgctctgcggctgcatgggctacgcggccttcggcgacgccgcgccggggaacctcctcacgggcttcggcttctacgagcccttctggctcctcgacgtggccaacgccgccatcgtcgtccacctcgtcggcgcctaccaggtctactgccagcccttattcgccttcgtcgagaagtgggcggcgcagaggtggccggactccagcttcgtcaccggggaggtggaggtcccgctgctccggacgtcctacaaggtgaacatgttccgggcaacgtggcggacggcgttcgtggtggcgacgacggtggtgtccatgatgctgccattcttcaacgacgtggtggggttcctgggcgcgctcggcttctggccgctcaccgtctacttccccgtggagatgtacgtggtgcagaagaaggtgcccaagtggagcaccaagtgggtgtgcctgcagatcctcagcctcggatgcctcgccatctccctcgccgccgccgcgggctccatcgccggcatcaagtctgacctcaaggtgtaccacccgttcaagacatgattcatccacacctacgtacgtacgggagaacaacaactaagacgatgacgtccgatcaaatccagttgataggatgaattaatagcaagcaaaatgcatgggaatgaagagtgacaacaagtgtgtgtcaccactcaccagttaatgttatcgtgctgtatgtataaact

SEQ ID NO: 2690 - DNA, 1766 bp, Triticum aestivum
gggatggcggacaaggtcgtggccacctactactacccgccgatggaggtagccgccgccgagctcggccagaccgccggctccaagctcgacgacgatggccgcaacaagcgcaccggcacgatgtggacggcgagctcgcacatcatcacggcggtgatcggctccggggtgctgtcgctggggtgggcaatcgcgcagctcggctgggtggccggccccgccgtcatgctgctcttctccctcgtcacctacttcacctcctcgctgctcgccgactgctaccgctccggcgaccagagcaccggcaagcgcaactacacccacatggacgccgtcaacgccaacctcagcggcatcaaggtgcagatttgcggggtgctgcagtatgctaacatcgtcggggtttctatcggctacaccatcgccgcctccatcagtatgctggccatcaagagggctaactgcttccacggcaacggccacgccgacccctgcaaggtctccagcgtgccctacatgatcatcttcggcgtcgcccaggtcttcttctcccagatccccgacttcgatcagatctcctggctctccatgctcgccgccgccatgtccttcacctactcctccatcggcctcggcctcggcatcgtccaagtcatagctaacggaggcatcaagggcagcctgaccggcatcagcatcggcacggtgacgccgatgcagaaggtgtggcgcagcacccaggcgtttggagacatcgcattcgcctactcctactcgctcatcctcatcgagatccaggacacaatccgggcgccaccgccgtcggagtccacggtcatgaagcgcgccaccatggtcagcgtcgcggtgaccacggtcttctacatgctctgcggttgcatgggctacgcggccttcggcgacgccgccccggggaacctcctcacagggttcggcttctacgagcccttctggctcctcgacatcgccaacgccgccatcgtcatccacctcgtcggcgcctaccaggtgtactgccagcccctgttcgccttcgtggagaagtgggcggcgaagaggtggccggagtcaacgtatgttaccggcgaggtcgaggtcccgctcttcaggacgtacaaggtgaacatgttccgggcggcgtggcggacggcgttcgtggtggcgacgacggtggtgtccatgatgctgcccttcttcaacgacgtcgtggggttcctgggtgctctggggttctggccgctcaccgtctactttcccgtggagatgtacgtggtgcagaagaaggtgcccaagtggagcacgcagtgggtgtgcctacagatgctcagcctcggatgcctagccatctcccttgccgccgccgcggggtccatcgccggcatcaagtccgacctcaaggtgtaccacccgttcaagtcataatcgacgtctgaccatcatgcacgcaccgaagaacattctacgatagcgtccggtaaagttcactttggctggagtgtgaaagccaaactgggtcaaaaagaagagcgacaagctaccgaagtgtcaaaaaattgtttaggctggctaatgaccgccgtagtcgcctcaaagaaaagatactactacctaagtgtcaagagtgtgtgtcaccaactaatgttcttgttttgcgtggtggtagaagctaatttaataatagtacagaatttgaaaagaatattgaagtgtgtctgtcgtttgttgtcaccctgagactaaac

SEQ ID NO: 2691 - DNA, 1696 bp, Secale cereale
gacaaagtcgtggccacctactactacccgccgatggaggtagccgccgccgagctcggccacaccgccggctccaagctcgacgacgatggccgcaacaagcgcaccggtacgatgtggacggcgagctcgcacatcatcacggcagtgatcgggtccggggtgctgtcgctgggctgggccatcgcgcagctcggctgggtggccggccccgccgtcatgctcctcttctccctcgtcacctacttcacctcctcgctgctcgccgactgctaccgctccggtgaccagagcaccggcaagcgcaactacacctacatggacgccgtcaacgccaacctgagtggcatcaaggtaaaaatctgcggggtgctgcagtacgccaacatcatcggggtggccatcggctacaccatcgccgcctccatcagcatgctggcgattaagagggccaattgtttccacggcaacggccacgccgacccctgcaaggtctccagcgtgccctacatgatcatcttcggcgtcgcccaggtcttcttctcccagatccccgacttcgaccagatctcctggctctccatgctcgccgccgctatgtccttcacctactcctccatcggcctcggcctcggcatcgtccaagtcatagctaacggaggcatgaagggtagcatgaccggcatcagcatcggcaccgtgacgccgatgcagaaggtgtggcgcagcctgcaggcgttcggggacatcgcgttcgcctactcctactccctcatcctcatcgagatccaggacaccatccgggcgccgccgccgtcggagtccacggtcatgaagcgcgccaccatggtcagcgtcgcggtgaccacggtcttctacatgctctgcggctgcatgggctacgcggccttcggcgacgccgcgccggggaacctcctcacggggttcggcttctacgagcccttctggctcctcgacgtggcaaacgccgccatcgtcatccacctcgtcggcgcgtaccaggtgtactgccagcccctgttcgcctttgtggagaagtgggcggcgaagaggtggccggagtcgacgttcataaccggggaggtggaggtcccgctcttccggacgtacaaggtgaacctgttccgggcgacgtggcggacggcgttcgtggtggcgacgacggtggtgtcgatgatgctgccgtcttcaacgacgtggtggggttcctgggagcgctggggttctggccgctcaccgtcttctttcccatcgagatgtacgtggtgcagaagaaggtgcccaagtggagcacgcggtgggtgtgcctgcagatgctcagcgtcggatgcctcgccatctcccttgccgccgccgccgggtccatcgccggcatcaagtccgacctcaaggtgtaccacccgttcaagtcataatcgacgcttgaccatcatgaacaaatcaagattgcgtccggtaatgttcactctggcagggtaaaagccaaacagaaaatgaaaagaacagcgacaagataccaaagtgtttaggctggctaatgaccgccgtagttacctaagaaaatgtcaccgaaagtgccagcagtgtgtcaacaattgatttccttgtgtggtagtagaagctgatttaatatagtagtagtacgagtacaaaattcggaaagaatattgaagtg

SEQ ID NO: 2692 - DNA, 1721 bp, Avena sativa
cagcgatcggcttctgcaaagaaagcagcagcggttaagctagcgagagaggccgatcaagatgggacagcagacggctgacaacgtcgtggccacgttctactacccgccggcgggggccatggaggtgtccgccgccgagctcggcgacaccgcgctctccaagtgcttcgacgacgacggccgcaacaagcgcaccggcacgatgtggacggcgagctcgcacatcatcacggcggtgatcgggtcgggggtgctatctctcggctgggccatcgcgcagctcggctgggtggccggtccggccgtcatgatcctcttctccctcgtcacctacttcacctcctcgctgctcgccgactgctaccgctccggcgaccagagcacgggcaagcgcaactacacctacatggacgccgtcaacgccaacctcagcggggtcaaggtcaagatctgcggggtgctgcagtacgccaacatcgtcggggtggccatcggctacaccatcgcggcgtccatcagcatgctggccatcaagagggcaaactgcttccacggcaagggacacgccgacccctgcaagatctccagcacgccatacatggtcatattcggcgtcgcgcaggtcttcttctcgcagataccagactttgaccagatctcgtggctctccatgctcgccgccgccatgtcattcacctactcatccatcggactcggactcggcatcgtccaagtcatagcgaacggcggcgtgaagggcagcatgaccggcatcagcatcggcgcggtgacgccgatgcagaaggtgtggcggagcacgcaggcgttcggggacatcgccttcgcctactcctactcgctcatcctcatcgagatccaggacaccatccgcgcgccgcctccctccgagtccacggtcatgaagcgcgccacgggggtcagcgtcgcggtgaccacggtcttctacatgctctgcggctgcatgggctacgcggccttcggcgacgccgcgccggggaacctcctcacgggcttcggcttctacgagcccttctggctcctcgacgtggccaacgccgccatcgtcgtccacctcgtcggcgcctaccaggtctactgccagcccttattcgccttcgtcgagaagtgggcggcgcagaggtggccggactccaagttcgtcaccggggaggtggaggtcccgctgctccggacgtcctacaaggtgaacatgttccgggcaacgtggcggacggcgttcgtggtggcgacgacggtggtgtccatgatgctgccattcttcaacgacgtggtggggttcctgggcgcgctcggcttctggccgctcaccgtctacttccccgtggagatgtacgtggtgcagaagaaggtgcccaagtggagcaccaagtgggtgtgcctgcagatcctcagcctcggatgcctcgccatctccctcgccgccgccgcgggctccatcgccggcatcaagtctgacctcaaggtgtaccacccgttcaagacatgattcatccacacgtacctaaggaagaacaacaacaactaagacgatgccgtccgatcaaatccagttgattgataggatgaatagcaagcacaatgggaatgaagagtgcacaagaagtatagtgtgtcaccaccagttaatgttatcgtgctgtatgtataaactaatttaatactactagtactactac

SEQ ID NO: 2693 - DNA, 1605 bp, Triticum aestivum
cgccgccgagctcggccacaccgctgggtccaaggtggacgacgatggccgcaacaagcgcaccggcacgatgtggacggcgagctcgcacatcatcacggcggtgatcgggtccggggtgctgtcgctgggctgggccatcgcgcagctcggctgggtggccggccccgccgtcatgctcctcttctcgctcgtcacctacttcacctcctcgctgctcgccgactgctaccgctccggcgatcagagcaccggcaagcgcaactacacctacatggacgccgtcaacgccaacctcagcggcgtcaaggtgcagatttgcggggtgctgcagtatgctaacatcgttggggtgtctatcggctacaccatcgccgcctccatcagtatgctggccatcaagagggcaaactgcttccacggcaacggccacgcagacccctgcaaggtctccagcgtgccctacatgatcatcttcggcgtggcccaggtcttcttctcccagatccccgacttcgaccagatctcctggctctccatgctcgccgcagccatgtccttcacctactcctccatcggcctcggcctcggcatcgtccaagtcatagcaaacggaggcgtgaagggtagcctgaccggcatcagcatcggcacggtgacgccgatgcagaaggtgtggcgcagcacgcaggcgttcggggacattgcattcgcctactcctactccctcatcctcatcgagatccaggacaccatccgggcgccgccgccgtcggagtccacggtcatgaagcgcgccaccatggtcagcgtcgcggtgaccacggtcttctacatgctctgcggctgcatgggctacgcggctttcggcgacgccgcgccggggaacctcctgacggggttcggcttctacgagcccttctggctcctcgacgtggccaacgccgccatcgtcgtccacctcgtcggcgcgtaccaggtgtactgccagcccctgtttgccttcgtcgagaaatgggcggcgaagaggtggccggagtccacgttcgtcaccggcgaggtcgaggtcccgctcttcaggacgtacaaggtgaacatgttccgggctacgtggcggacggcgttcgtggtggcgacgacggtggtgtccatgatgctgcccttcttcaacgacgtggtggggttcctgggcgcgctggggttctggccgctcaccgtctactttccggtggagatgtacgtggtgcagaagaaggtgcccaagtggagcacacagtgggtgtgcctccagatgctcagcctcggatgcctcgccatctcccttgccgccgccgcggggtccatcgccggcatcaagtccgacctcaaggtgtaccacccattcaagacataattgacgttgacgatcgtgcacgcacaaacaatacatcaaggtgtaggattcaagacaaagaagttcttggccttcaaacaattcaaagaagatacatcctggatggagttgtactacttcatgaagtcatgcatgagatccatagaaaaaactaatgatgtttctttatagtagtgattttaaaatgcatgataagattaagtggtaacttt

SEQ ID NO: 2694 - DNA, 2010 bp, Brachypodium distachyon
gttacagtactaaccccattgtcaagtactgagacatcgccattctccaaccttcttcatccaccgatcggccgggcgactgttccgcggaaaggaatcaaggcagctaagaggttgatcgaagaaactgagatgggggagagcgtcgtggccacgtactactacccgtcggcggcaatggaggtgtccgccgccgagctcggccagagcaaacagcccggctccaagggtggctgcgacgacgacgatcgccccagccgcaccggcacgatgtggacggcgagctcgcacatcatcacggcggtgatcgggtccggggtgctgtcgctgggctgggccatcgcgcagctgggctgggtggccggcccggcggtgatgctgctcttctccctcgtcacctacttcacctcgtccctgctcgccgactgctaccgctcgggcgaccagagcacgggcaagcgcaactacacctacatggacgccgtgaacgccaacctgagcggcttcaaggtgaaggtctgtggcctgctgcagtacgccaacatcgtgggcgtggccatcgggtacaccatcgccgcctccatcagcatgctggccatcagcagggccaactgcttccaccgcaagggccacgccgacccgtgcaagatctccagcgtgccttacatgctcgtcttcggcgtcgcccaggtcttcttctcccagatccccgactttgatcagatctcctggctctccatgctcgccgccgccatgtccttcacctactcctccatcggcctcggcctcggcgtcgcccaagtcatcgcgaacggaggcgtgcagggaagcatgacggggatcagcatcggggcgggggtgacgccgatgcagaaggtgtggcggagcacgcaggcgttcggggacatcgccttcgcatactcctactccctcatcctcatcgagatccaggacacgatccgggcgccgcccaagtcgacggagtccaaggtcatgaagcgtgccacgctcgtcagcgtggccgtgacaaccgtcttctacatgctctgcggctgcatggggtacgcggccttcggcgaccgggcgcccgggaacctcctcaccgggttcggcttctacgagcccttctggctcctggacgtggccaacgccgccatcgtcgtccacctcgtcggggcctaccaggtctactgccagcccctcttcgccttcgtcgagaagtacgcggggcagcggtggcccgagtcgcggtacgtcaccagggagatcgagctctccgttggtgggttcagggtgaacatgttccggctcacgtggaggacggcgttcgtggtggcgaccaccgtggtgtccatgatgctgccattcttcaacgacgtggtggggttcctgggcgcgctcgggttctggccgctcaccgtctacttccccgtggagatgtatatcgtgcagaggaaagtgcccaggtggagcacaaggtgggtgtgcctgcagatgctcagcggcggatgcctcgtcatctccctggccgccgccgccggatccatcgccggcatcaagtccgacctcaaggtgtaccacccgttcaagtcatgatcatcaacgatcatacatgcatgcgcaccccagggaaaagatagcatatatatgatggcggtcagtcaagtttccttcttcttcttcagactgaaaaccaaacaaaataggttaaggaaatggacagtgacaagctacggaactgtcagtgtatcagcgttgttcttgtgatgtccagaagggaagttattactactccctccgtctaacaaaaaatgtctcaaatttatcaaaatttgaatgtatctagacatgacttagtatatagatgcattcaaatttgaacaaaattgagacattttttgttggatagagagttcaagattttttaatcgcagaaaaaaaatagatatatatatatatatatatatgctactccttacaagattttttaaagggaatacaagtgcctcc

SEQ ID NO: 2695 - DNA, 1690 bp, Avena sativa
gccctgaaagcagcgatcggcttctgcaaagaaagcagcagcggttaagctagcgagagaggccgatcaagatgggacagcagacggctgacaacgtcgtggccacgttctactacccgccggcgggggccatggaggtgtccgccgccgagctcggcgacaccgcgctctccaagtgcttcgacgacgacggccgcaacaagcgcaccggcacgatgtggacggcgagctcgcacatcatcacggcggtgatcgggtcgggggtgctatctctcggctgggccatcgcgcagctcggctgggtggccggcccggccgtcatgatcctcttctcgctcgtcacctacttcacctcctcgctgctcgccgactgctaccgctccggcgaccagagcacgggcaagcgcaactacacctacatggacgccgtcaacgccaacctcagcggagtcaaggtcaagatctgcggggtgctgcagtacgccaacatcgtcggggtggccatcggctacaccatcgcggcgtccatcagcatgctggccataaagagggcaaactgcttccacggcaagggacatgccaacccctgcaagatctccagcacgccctacatggtcatattcggcgtcgcgcaggtcttcttctcgcagataccagactttgaccagatctcgtggctctccatgctcgccgccgccatgtccttcacctactcatccatcggactcggactcggcatcgtccaagtcatagcgaacggcggcgtgaagggcagcatgaccggcatcagcatcggcgcggtgacgccgatgcagaaggtgtggcggagcacgcaggcgttcggggacatcgccttcgcctactcctactcgctcatcctcatcgagatccaggacaccatccgcgcgccgcctccctccgagtccacggtcatgaagcgcgccacgggggtcagcgtcgcggtcaccacggtcttctacatgctctgcggctgcatgggctacgcggccttcggcgacgccgcgccggggaacctcctcacgggcttcggcttctacgagcccttctggctcctcgacgtggccaacgccgccatcgtcgtccacctcgtcggcgcctaccaggtctactgccagcccttattcgccttcgtcgagaagtgggcggcgcagaggtggccggactccagcttcgtcaccggggaggtggaggtcccgctgctccggacgtcctacaaggtgaacatgttccgggcgacgtggcggacggcgttcgtggtggctaccacggtggtgtccatgatgctgcccttcttcaacgacgtggtggggttcctgggcgcgctcggcttttggccgctcaccgtctacttccccgtggagatgtacgtggtgcagaagaaggtgcccaagtggagcaccaagtgggtgtgcctgcagatcctcagcctcggatgcctcgccatctccctcgccgccgccgcgggctccatcgccggcatcaagtctgacctcaaggtgtaccaccccttcaagacatgattgatcgatccacacgtacgtacggaagaacaacaactaagacgatgacgtcccgatcaaatccagttgattgataggatgaattaatagcaagcaaaatgggtaatgaagagtgcacaagaagtatagtgtgtcaccaccagttaatg

SEQ ID NO: 2696 - DNA, 1776 bp, Avena sativa
gaccaccacagcaagtgagcccctctctccatcatccatcagcagggccctgcagctgtgtggtcgggccacctagctagctgtgtgccctgaaagcagcgatcggcctctgcagagaaagcagcagcagcagttaagctagcgagcgagagaggtcgatcgagatgggacagcagacggctgacaacgtggtggccacgttctactacccgccggcgggggccatggaggtgtccgccgccgagctcggcgacaccgcgctctccaagtgcttcgacgacgacggccgcaacaagcgcaccggcacgatgtggacggcgagctcgcacatcatcacggcggtgatcgggtcgggggtgctatctctcggctgggccatcgcgcagctcggctgggtggccggtccggccgtcatgatcctcttctccctggtcacctacttcacctcctcgctgctcgccgactgctaccgctccggcgaccagagcacgggcaagcgcaactacacctacatggacgccgtcaacgccaacctcagcggggtcaaggtcaagatctgcggggtgctgcagtacgccaacatcgtcggggtggccatcggctacaccatcgcggcgtccatcagcatgctggccatcaagagggcaaactgcttccacggcaagggacatgccaacccctgcaagatctccagcacgccatacatggtcatattcggcgtcgcgcaggtcttcttctcgcagataccagactttgaccagatctcgtggctctccatgctcgccgccgccatgtcattcacctactcatccatcggactcggactcggcatcgtccaagtcatagcgaacggcggcgtgaagggcagcatgaccggcatcagcatcggcgcggtgacgccgatgcagaaggtgtggcggagcacgcaggcgttcggggacatcgccttcgcctactcctactcgctcatcctcatcgagatccaggacaccatccgcgcgccgcctccctccgagtccacggtcatgaagcgcgccacgggggtcagcgtcgcggtcaccacggtcttctacatgctctgcggctgcatgggctacgcggccttcggcgacgccgcgccggggaacctcctcacgggcttcggcttctacgagcccttctggctcctcgacgtggccaacgccgccatcgtcgtccacctcgtcggcgcctaccaggtctactgccagcccttattcgccttcgtcgagaagtgggcggcgcagaggtggccggactccaagttcgtcaccggggaggtggaggtcccgctgttccggacgtcgtgcaaggtcaacatgttccgggccacgtggcggacggcgttcgtggtggcgaccacggtggtgtccatgatgctgcccttcttcaacgacgtggtggggttcctgggcgcgctcggcttttggccgctcaccgtctacttccccgtcgagatgtacgtggtgcagaagaaggtgcccaagtggagcaccaagtgggtgtgcctgcagatcctcagcctcggatgcctcgccatctccctcgccgccgccgcgggctccatcgccggcatcaagtctgacctcaaggtgtaccacccgttcaagacatgattcatccacacgtacctaaggaagaacaacaacaactaagacgatgccgtccgatcaaatccagttgattgataggatgaatagcaagcacaatgggaatgaagagtgcacaagaagtatagtgtgtcaccaccagttaatg

SEQ ID NO: 2697 - DNA, 4719 bp, Brachypodium distachyon
ccatggccgaggactccttcagtctgcacttagccggcgctggctcctggtcgtcggactcccatccgatcccggagcgcatgccgttgcactttactgttcccatcgaccccgtgagaggagcgctcctaatctccgtcgatggcgatgggaaccgcacgcagatccatactcctcccataccggtaatccacggcggaagattgatggccactacccccgtcggctcagggccgctgatcttcgtcgataaaaccgatgagtttttcacaggagactaccctgttcccgccgggaacttcacggcctccagccgtctcatcgccgcaacctgtgctgccttgcgacgcccctgcccccacttcgctctgtctgaggatgaggatgagggaggcgagcatatcgctgctgagcttcaaccaccagctcaacagccaggaagtgattggatgaaaccagatggtggctcgtcctcgaagggcttgctaaaaactccgtcatgcaaggtcacttccccaacctgtccgcaggcaccgacattaagtcctgggtcatcatccatttttgccaagctacgaagtgattggggtacggagttctacatcagggttgatcgggagggcttattccacacatatcctgatgtgggtggcccatttcagagcactgaacaagctgagaatgctattgatcgctaccttcatggccgtcgggatccctcaatgtgcgaggagacagctggtgtttccgaagatgagatggttataagacaatgtgttttctggcccgatggcacgtggaagaggcgtacaaaatcatatgtgcttcagaaagtccgtgatcaaatgcgcgaattagtccacgctgtcgttgaccagtataataaggatcacaatcttacgggggattatacatatgaactcaaagatattatgcagcacgaacacttccgtgagaacaatatggggtaccgtcatctgaatttcattgcaaagactaaagtagattatgatgatgatggtggtcaagatgattatgttgttgatcctgttgctgttgttgctgctgttgttgctcttgatggtgatgatgacttcgatgacgattatgatttggattgctggatcgacaaaatattcattgttgaactcaggcaaaccaaacaagaaggaataaatgggagtggatagtccgttgtttctgcatgcttggacgactagataatggtccatgctatgcttgtctggaagacgtgaagcaccccaacaaagctgatgcatacactggtggtcatgtgcccccagacgtgctaggtggacttccggcaatgtggagcgattccgatgaagatgaggacgctaatgagcgttggataagacgtagttatgaggacgaggaacggcgaccttttgtcgtcccttggtatgccacgcctaagtgaagtctacatgaggactttggagtctaaatataaggaggtcgccagagtggagcactgccgctccttgcaatctctgctttgtgactggatgtatattttgcccgcggaccttttaatgttaatttacccatttgttagacctgagtagctatcctatttcctgtttgtaagctagagaccaagaggaacctaagctttgtgattggatgcatgttatgccagcggcagatcttttaatgttaatttcgccaagtggtaaatctaagtagcatagctatttcctgtttctaagctagacaccaacaaaaggcatcttggcactgagtgttgtcttttggtttaagatgaactaaagacgtgctttctggattacactgtccttttaaaagttcggttgtgaactgcttctgctggttcttggaaaaagtcatttaagaaacttgtctaatatttctgaagatgacacataagttcaacttttaagaccagctcttgtatagtattccagctttactagttatgtactcctagtttaatagatttttcaagtgttggcgttactggtgagctcacggtcacggagcactggtacctcaaactcaaaaaaaaaagtaactaagggtgttttcggaagtccgccggcttccaggttccctaaaattcataacggagcactgccaaacacacaaacttcagaaagtcagatctcagaaggtagtccaatttgttatacaaaacacagaatacctcttctgaagattcgcggagtgacaaaatgcggaacaccacaaaattacggccgtcttgccaccgccgtgtgaaaaaaacttttcgtcttcccgatcccttctgtcccggcctcttcctcccgatccccatctgcaccccacccacctccgagctgacccgccagtggcggatctaaggggtggccatggaccaccctgtgattttggacgccttcgaatagcactcacaaaatagaaaaataataattttgatgattaatacttcctcctccgttccgtacatttctattacatgtatctagacgctttttagacatacatacgttcatatttcgtcaaatttgaatcatttaatatgggacggaaggagcattactgttggaccgccttggatttcttggctaggtccggcactgtgacccgccggtgttcttctcctcctcctcctccccagttccccggcagcttcctctcctcagttttggtgcaggcggaaactccacccctgcttcgaccctgtccggtccagatcgaagcgtgagccggctctccggcggactcctccacctcctccctcgttctccggcagccgcctcctcccctgttctccggcgcaggcagcggctccaacgagatctcagtccccttcctcgactccgtccggccgcctctgccgcacggcatatcccgaatcaaggcagctaagaggttgatcgaagaaactgagatgggggagagcgtcgtggccacgtactactacccgtcggcggcaatggaggtgtccgccgccgagctcggccagagcaaacagcccggctccaagggtggctgcgacgacgacgatcgccccagccgcaccggcacgatgtggacggcgagctcgcacatcatcacggcggtgatcgggtccggggtgctgtcgctgggctgggccatcgcgcagctgggctgggtggccggcccggcggtgatgctgctcttctccctcgtcacctacttcacctcgtccctgctcgccgactgctaccgctcgggcgaccagagcacgggcaagcgcaactacacctacatggacgccgtgaacgccaacctgagcggcttcaaggtgaaggtctgtggcctgctgcagtacgccaacatcgtgggcgtggccatcgggtacaccatcgccgcctccatcagcatgctggccatcagcagggccaactgcttccaccgcaagggccacgccgacccgtgcaagatctccagcgtgccttacatgctcgtcttcggcgtcgcccaggtcttcttctcccagatccccgactttgatcagatctcctggctctccatgctcgccgccgccatgtccttcacctactcctccatcggcctcggcctcggcgtcgcccaagtcatcgcgaacggaggcgtgcagggaagcatgacggggatcagcatcggggcgggggtgacgccgatgcagaaggtgtggcggagcacgcaggcgttcggggacatcgccttcgcatactcctactccctcatcctcatcgagatccaggacacgatccgggcgccgcccaagtcgacggagtccaaggtcatgaagcgtgccacgctcgtcagcgtggccgtgacaaccgtcttctacatgctctgcggctgcatggggtacgcggccttcggcgaccgggcgcccgggaacctcctcaccgggttcggcttctacgagcccttctggctcctggacgtggccaacgccgccatcgtcgtccacctcgtcggggcctaccaggtctactgccagcccctcttcgccttcgtcgagaagtacgcggggcagcggtggcccgagtcgcggtacgtcaccagggagatcgagctctccgttggtgggttcagggtgaacatgttccggctcacgtggaggacggcgttcgtggtggcgaccaccgtggtgtccatgatgctgccattcttcaacgacgtggtggggttcctgggcgcgctcgggttctggccgctcaccgtctacttccccgtggagatgtatatcgtgcagaggaaagtgcccaggtggagcacaaggtgggtgtgcctgcagatgctcagcggcggatgcctcgtcatctccctggccgccgccgccggatccatcgccggcatcaagtccgacctcaaggtgtaccacccgttcaagtcatgatcatcaacgatcatacatgcatgcgcaccccagggaaaagatagcatatatatgatggcggtcagtcaagtttccttcttcttcttcagactgaaaaccaaacaaaataggttaaggaaatggacagtgacaagctacggaactgtcagtgtatcagcgttgttcttgtgatgtccagaagggaagttattactactccctccgtctaacaaaaaatgtctcaaatttatcaaaatttgaatgtatctagacatgacttagtatatagatgcattcaaatttgaacaaaattgagacattttttgttggatagagagttcaagattttttaatcgcag

SEQ ID NO: 2698 - DNA, 4463 bp, Brachypodium distachyon
ccgggagctccgcccgtggccatggccgaggactccttcagtctgcacttagccggcgctggctcctggtcgtcggactcccatccgatcccggagcgcatgccgttgcactttactgttcccatcgaccccgtgagaggagcgctcctaatctccgtcgatggcgatgggaaccgcacgcagatccatactcctcccataccggtaatccacggcggaagattgatggccactacccccgtcggctcagggccgctgatcttcgtcgataaaaccgatgagtttttcacaggagactaccctgttcccgccgggaacttcacggcctccagccgtctcatcgccgcaacctgtgctgccttgcgacgcccctgcccccacttcgctctgtctgaggatgaggatgagggaggcgagcatatcgctgctgagcttcaaccaccagctcaacagccaggaagtgattggatgaaaccagatggtggctcgtcctcgaagggcttgctaaaaactccgtcatgcaaggtcacttccccaacctgtccgcaggcaccgacattaagtcctgggtcatcatccatttttgccaagctacgaagtgattggggtacggagttctacatcagggttgatcgggagggcttattccacacatatcctgatgtgggtggcccatttcagagcactgaacaagctgagaatgctattgatcgctaccttcatggccgtcgggatccctcaatgtgcgaggagacagctggtgtttccgaagatgagatggttataagacaatgtgttttctggcccgatggcacgtggaagaggcgtacaaaatcatatgtgcttcagaaagtccgtgatcaaatgcgcgaattagtccacgctgtcgttgaccagtataataaggatcacaatcttacgggggattatacatatgaactcaaagatattatgcagcacgaacacttccgtgagaacaatatggggtaccgtcatctgaatttcattgcaaagactaaagtagattatgatgatgatggtggtcaagatgattatgttgttgatcctgttgctgttgttgctgctgttgttgctcttgatggtgatgatgacttcgatgacgattatgatttggattgctggatcgacaaaatattcattgttgaactcaggcaaaccaaacaagaaggaataaatgggagtggatagtccgttgtttctgcatgcttggacgactagataatggtccatgctatgcttgtctggaagacgtgaagcaccccaacaaagctgatgcatacactggtggtcatgtgcccccagacgtgctaggtggacttccggcaatgtggagcgattccgatgaagatgaggacgctaatgagcgttggataagacgtagttatgaggacgaggaacggcgaccttttgtcgtcccttggtatgccacgcctaagtgaagtctacatgaggactttggagtctaaatataaggaggtcgccagagtggagcactgccgctccttgcaatctctgctttgtgactggatgtatattttgcccgcggaccttttaatgttaatttacccatttgttagacctgagtagctatcctatttcctgtttgtaagctagagaccaagaggaacctaagctttgtgattggatgcatgttatgccagcggcagatcttttaatgttaatttcgccaagtggtaaatctaagtagcatagctatttcctgtttctaagctagacaccaacaaaaggcatcttggcactgagtgttgtcttttggtttaagatgaactaaagacgtgctttctggattacactgtccttttaaaagttcggttgtgaactgcttctgctggttcttggaaaaagtcatttaagaaacttgtctaatatttctgaagatgacacataagttcaacttttaagaccagctcttgtatagtattccagctttactagttatgtactcctagtttaatagatttttcaagtgttggcgttactggtgagctcacggtcacggagcactggtacctcaaactcaaaaaaaaaagtaactaagggtgttttcggaagtccgccggcttccaggttccctaaaattcataacggagcactgccaaacacacaaacttcagaaagtcagatctcagaaggtagtccaatttgttatacaaaacacagaatacctcttctgaagattcgcggagtgacaaaatgcggaacaccacaaaattacggccgtcttgccaccgccgtgtgaaaaaaacttttcgtcttcccgatcccttctgtcccggcctcttcctcccgatccccatctgcaccccacccacctccgagctgacccgccagtggcggatctaaggggtggccatggaccaccctgtgattttggacgccttcgaatagcactcacaaaatagaaaaataataattttgatgattaatacttcctcctccgttccgtacatttctattacatgtatctagacgctttttagacatacatacgttcatatttcgtcaaatttgaatcatttaatatgggacggaaggagcattactgttggaccgccttggatttcttggctaggtccggcactgtgacccgccggtgttcttctcctcctcctcctccccagttccccggcagcttcctctcctcagttttggtgcaggcggaaactccacccctgcttcgaccctgtccggtccagatcgaagcgtgagccggctctccggcggactcctccacctcctccctcgttctccggcagccgcctcctcccctgttctccggcgcaggcagcggctccaacgagatctcagtccccttcctcgactccgtccggccgcctctgccgcacggcatatcccgaatcaaggcagctaagaggttgatcgaagaaactgagatgggggagagcgtcgtggccacgtactactacccgtcggcggcaatggaggtgtccgccgccgagctcggccagagcaaacagcccggctccaagggtggctgcgacgacgacgatcgccccagccgcaccggcacgatgtggacggcgagctcgcacatcatcacggcggtgatcgggtccggggtgctgtcgctgggctgggccatcgcgcagctgggctgggtggccggcccggcggtgatgctgctcttctccctcgtcacctacttcacctcgtccctgctcgccgactgctaccgctcgggcgaccagagcacgggcaagcgcaactacacctacatggacgccgtgaacgccaacctgagcggcttcaaggtgaaggtctgtggcctgctgcagtacgccaacatcgtgggcgtggccatcgggtacaccatcgccgcctccatcagcatgctggccatcagcagggccaactgcttccaccgcaagggccacgccgacccgtgcaagatctccagcgtgccttacatgctcgtcttcggcgtcgcccaggtcttcttctcccagatccccgactttgatcagatctcctggctctccatgctcgccgccgccatgtccttcacctactcctccatcggcctcggcctcggcgtcgcccaagtcatcgcgaacggaggcgtgcagggaagcatgacggggatcagcatcggggcgggggtgacgccgatgcagaaggtgtggcggagcacgcaggcgttcggggacatcgccttcgcatactcctactccctcatcctcatcgagatccaggacacgatccgggcgccgcccaagtcgacggagtccaaggtcatgaagcgtgccacgctcgtcagcgtggccgtgacaaccgtcttctacatgctctgcggctgcatggggtacgcggccttcggcgaccgggcgcccgggaacctcctcaccgggttcggcttctacgagcccttctggctcctggacgtggccaacgccgccatcgtcgtccacctcgtcggggcctaccaggtctactgccagcccctcttcgccttcgtcgagaagtacgcggggcagcggtggcccgagtcgcggtacgtcaccagggagatcgagctctccgttggtgggttcagggtgaacatgttccggctcacgtggaggacggcgttcgtggtggcgaccaccgtggtgtccatgatgctgccattcttcaacgacgtggtggggttcctgggcgcgctcgggttctggccgctcaccgtctacttccccgtggagatgtatatcgtgcagaggaaagtgcccaggtggagcacaaggtgggtgtgcctgcagatgctcagcggcggatgcctcgtcatctccctggccgccgccgccggatccatcgccggcatcaagtccgacctcaaggtgtaccacccgttcaagtcatgatcatcaacgatcatacatgcatgcgcaccccagggaaaagatagcatatatatgatggcggtc

SEQ ID NO: 2699 - DNA, 1594 bp, Secale cereale
gacaaggtcgtggctacctactactatccacccatggaggtagccgccgccgagctcggccacaccgccgggtccaagctcgacgacgatggccgcaacaagcgcaccggcacaatgtggacggcgagctcgcacatcatcacggcggtgatcggctccggggtgctatcgctggggtgggcaatcgcgcagctcggctgggtcgccggtcccgccgtcatgttgctattctcgctcgtcacctacttcacctcctcgctgctcgccgactgctaccgctccggcgaccagagcaccggcaaacgcaactatacctacatggacgccgtcaacgccaacctcagcggcatcaaggtgcagatctgcggggtgctccagtatgctaacatcgtcggggtggccatcggctacaccatcgccgcctccatcagcatgctcgcgattaaaaggccaatgtttccacggcaacggccacgccgacccctgcaaggtctccagcgtcccctacatgatcatcttcggcgtcgctcaggtcttcttctcccagatccccgacttcgatcagatctcctggctctccatgctcgccgccgccatgtccttcacctactcctccatcggcctcggcctcggcatcgtccaagtcatagctaacggaggcatgaagggcagcctgaccggcatcagcatcggcacggtgacgccgatgcaaaaggtgtggcgcagcctgcaggcgttcggggacatcgcattcgcttactcctactccctcatcctcatcgagatccaggacaccatccgggcgccaccaccgtcagagtccacggtcatgaagcgcgccaccatggtcagcgtcgcggtgaccacagtcttctacatgctctgcggctgcatgggctacgcggccttcgcgacgccgcgccagggaacctcctcacagggttcgggttctacgagcccttctggctcctcgacgtggcaaacgccgccatcgtcatccacctcgtcggcgcgtaccaggtgtactgccagcccttgttcgccttcgtggagaagtgggcagcaaagaggtggccggagtcgacgttcatcaccggggaggtcgaggtcccgctcttccggacgtacaaggtgaacctgttccgggcgacgtggcggacggcgttcgtggtggcgacgacggtggtgtccatgatgctgcccttcttcaacgacgtggtggggttcctgggcgcgctggggttctggccgctcaccatcttctttcccatcgagatgtacgtggtgcagaagaaggtgcccaagtggagcacgcggtgggtgtgcctccagatgctcagcctcggatgcctcgccatctcccttgccgccgccgccgggtccatcgccggcatcaagtccgacctcaaggtgtaccacccgttcaagtcataatcgacgcttgaccatcatgcatacacacaccaaaaaacaaatcaagatagcatccaataaagttcactctggcaaggtaaaaaccaaacagaaaatgaaaagaacagcgacaagataccgaagtgtttaggctggctaatgaccgccgtagttacctaag

SEQ ID NO: 2700 - DNA, 979 bp, Brachypodium distachyon
ccaaaagtgctcgtccttcgcttgtcttgtctccacacgtacggagccgaggaggagatggacgccatggccgcgcttgcgagaacgagccctaccctcgccgccacgggtcgccggagctccgcgcggctccgtccatctgcgtccctctccttcgccgccgcttcctcgaggccccgcggccgcgtcgggctgagcatgccggagcggagcgggagagcgaccagggtagctcgtgccagcccccgccgcatcgtcgcgtcctcggatgttgagcagagctacattatgatcaaacctgacggtgttcaacgtggtctggttggggagattatttctcgtttcgagaagaagggctttttgctgaagggactaaagcttttccagtgccccaaggacttggctcaggaacactacaaggatctgaaggaaagacctttctttcccaagctgatcgactatataacttctggtcctgtcgtttgcatggcttgggagggtgatggtgttgttgcatccgctcgcaaattgataggatccactaacccccttcaagctgaaccagggaccataaggggtgatcttgcagttcaaactggaaggaatgttgtccacggaagtgacagtcctgataatggcaagcgtgaaattgctctatggttcaaagaaggcgagcttgctcaatgggaatcagttcaaacaccctggcttgtagagtgatcttcgcagatcactgcaagaacctgaccaatgcttatttgctcaacttgattcgaggggccatgtatgagttacttctgccgagtaggtgccttaacaaggccccaaaattttcagcacttcccacctgtatgttctttctttctttgtaccaatattgaacagctctgaactttaaccttggtcagttaatgcctcctgagaattttcttttattcacatcatcacatgtcaaagtcttgacaaaatcaaggcaaca

SEQ ID NO: 2701 - DNA, 991 bp, Brachypodium distachyon
aatccaaaagtgctcgtccttcgcttgtcttgtctccacacgtacggagccgaggaggagatggacgccatggccgcgcttgcgagaacgagccctaccctcgccgccacgggtcgccggagctccgcgcggctccgtccatctgcgtccctctccttcgccgccgcttcctcgaggccccgcggccgcgtcgggctgagcatgccggagcggagcgggagagcgaccagggtagctcgtgccagcccccgccgcatcgtcgcgtcctcggatgttgagcagagctacattatgatcaaacctgacggtgttcaacgtggtctggttggggagattatttctcgtttcgagaagaagggctttttgctgaagggactaaagcttttccagtgccccaaggacttggctcaggaacactacaaggatctgaaggaaagacctttctttcccaagctgatcgactatataacttctggtcctgtcgtttgcatggcttgggagggtgatggtgttgttgcatccgctcgcaaattgataggatccactaacccccttcaagctgaaccagggaccataaggggtgatcttgcagttcaaactggaaggaatgttgtccacggaagtgacagtcctgataatggcaagcgtgaaattgctctatggttcaaagaaggcgagcttgctcaatgggaatcagttcaaacaccctggcttgtagagtgatcttcgcagatcactgcaagaacctgaccaatgcttatttgctcaacttgattcgaggggccatgtatgagttacttctgccgagtaggtgccttaacaaggccccaaaattttcagcacttcccacctgtatgttctttctttctttgtaccaatattgaacagctctgaactttaaccttggtcagttaatgcctcctgagaattttcttttattcacatcatcacatgtcaaagtcttgacaaaatcaaggcaacaaagttctat

SEQ ID NO: 2702 - DNA, 1475 bp, Brachypodium distachyon
cggattgaggctagctcgattgactacacaatgacgccgtctgccatgaacatgaccaaggagcagaaggagcagcaggacatcgacgactggctccccatcacctcttccaggaaggccaagtggtggtactccgccttccacaatgtcaccgccttggtcggcgccggcgtcctcagcctcccctacgccatgtccgagctcggctgggggccaggggtggcggcgatgatcctgtcatgggtgataaccctgtacacgctatggcagatggtggagatgcacgagtgcgtccccgggaagcgtttcgaccggtaccacgagctggggcagcacgccttcgggcagaagctgggcctgtggatcgtcgtcccgcagcagctcatcgtggaagtcggcgtctgcatcgtgtacatggtgacgggcggcaagtcgctgaagaagttccacgacgtggtggcgccggcggacgccgccccgatccggaccagctacttcatcgtcatcttcgggtccgcccacctgctgctctcccagctgcccaactttaactccatcaccgtcgtctccctcgccgccgccgtcatgtcgctctcctactccaccatcgcctgggtcgcctccctcgagcaccgccgccacggtggcagcagccacgtcgtcgattacagcatgacagcgtccacgtcggccgggaggacgttcaacttcctcagcgcgctgggtgacgtggcattcgcctacgcgggccataacgtggtgttggagatccaggccacgataccgtcgactcccggcaagccgtcgaagaagcccatgtggctcggcgtcatggtggcctaccttgtcgtcgccgtctgttatctccccgtggcgtttgtggggtactacgtgtttgggaacgccgtggatgataatatcctcatcacgctggagaagccacgctggctcatcgccgccgccaacatgttcgtcgtcgtccacgtcatcggcagctaccagatctacgccatgcccgtcttcgacatgcttgagacgttcctcgtcaagaagctccggttccaccctggctggcctctccgtctcatcgctcgctccctctacgttgtgttcaccatgattgttggcatcgccatccccttcttcggtggattgctagggttcttcggtggctttgcctttgccccaacgacctacttcctgccctgcatcatgtggctgatcatcatgaagcccaagaagttcggcttctcatggtgcaccaactggatctgcataataatcggcgtgctcctgtcgttgttggcgcccatcggaggactccggtctatcatcatcaatgccaaaacctacaagttcttctcatgatcgatagatctgatggaagcctgcaggaacaagcctatatagctagtagagtatgattagatgcagagtttatttacttccaaagtgatgaacattatgagtttgtg

SEQ ID NO: 2703 - DNA, 1801 bp, Hordeum vulgare
cgggtacccgttcagcaacagaatcccttgatacggggaggaaggaagccaggtcgttacgtacggggctaacgggatcccctcccatatatatatatatatgcccgctgcgtgtggtggctggctaggttccgtcgggaatatacggcggcagcagtagctagtatctatccatccacctgcagaaatacagagatcccatctagctatctgagatcggatcgggccggtcgccatggccatgaacacgagcaaggcggcgccgacggagaaggagctgcaggacatcgacgactggctgcccatcacctcctcccgcagcgccaagtggtggtactcggccttccacaatgtcaccgccatggtcggcgccggcgtcctcagcctgccctacgccatgtccgagctcggatggggtcctggcgtggcggcgatgatcctctcatgggtgatcaccctgtacacgctgtggcagatggttgagatgcacgagtgcgtgcccggcaagcgcttcgaccggtaccacgagctggggcagcacgccttcggcgagaagctgggcctctggatcgtcgtcccgcagcagctcgtcgtggaggtgggcgtctgcatcgtctacatggtcaccggcggcaagtcgctgaagaaggtccacgacctgctccggcccgagcacagccacccgatccgcaccagctacttcatctgcatcttcgggtcggcccacttcctgctgtcccagctgcccaacttcaactccatcaccggcgtctccctcgccgccgccgtcatgtcgctcagctactccaccatcgcctgggcggcgtcgctgcaccacgccggcaaggccgggcctgaccacgcggtcgactacagcatgacggcgtccacgtccaccggaaggaccttcaacttcctcagcgcgctcggggacgtggccttcgcctacgccggccacaacgtggtgctggagatccaggccaccatcccgtccacgcccgagaagccgtccaagaagcccatgtggcggggcgtcgttttggcctacatcgtcgtcgccatctgctacctccccgtcgccttcctcggctactacgtcttcggcaacgccgtcgacgacaacatcctcatcaccctcgagaagccccgctggctcatcgccgccgccaacttgttcgtcgtcgtccacgtcatcggcagctaccagatctacgccatgccggtcttcgacatgctcgagaccttcctggtgaagaagctgaggttcaagcccggctggcctcttcgtctcatcgcacgatcgctctacgttgccttcaccatgctcgtcggcatcgccatccccttcttcggtgggctgctaggcttctttggcggctttgcttttgccccaacgacctacttccttccctgcattatgtggctggcaatcaagaagccagcgaggtttagcatgtcgtggtgcatcaactgggtttgcataatcattggagtgcttctctcaatattggcgcccatcggaggcctccgttccatcatcgtcaactacaagacctaccagttcttctcatgatctgctggaaacatagatgcatgcagcattccagctacttagatacagagtattagatgcatagtgtgtagttttgtcatgttcaaattaggccaaacaaatattcgtgcgtttatggatgttgctcgataggtttgtgatattgaaattaatgcttgaatggggcattctcttagatatttgtgaaatgtcagttcgttcttatgttagcaatcacttttattgttc

SEQ ID NO: 2704 - DNA, 1630 bp, Zea mays
ccgggctactccaaaatatccagctttttcctgcggcaaactacctggccgccatctcctccgatccctcggcatacgtctccatcggccgggcgaccgagatggcgacgccctccagcatgacgtcgacggagaaggagaaagccatcgacgactggctgcccatcacctcgtccaggaacgccaaatggtggtactccgccttccacaacgtcacggccatggtcggcgccggcgtcctcagcctgccctacgcaatgtccgagctcggctggggtcccggcgtggtcgccatggtcctgtcttgggtgatcaccctgtacacgctgtggcagatggtcgagatgcacgagtgcgtccccgggaagcgtttcgaccgctaccacgagctgggccagcacgcgttcggcgacaagctgggcctctggatcgtcgtcccgcagcagctcatcgtcgagatcggcgtctgcatcgtctacatggtcaccggcggcaagtcgttcgagaagtgctacaccgtcgcctgcccggactgcaagccgctccgcaccagctcgtggatcatgatcttcgccgccatccacctgctgctctcgcagctgcccaacttcaactccatcacgctcgtctccctcgccgccgcagtcatgtcgctcacctactcgacgattgcatgggcggcgtcggcgcacaaggggcggcactcggccgtggactacagcatgaaggcgtcgacgacgacggggcagacattcaacttcctgagcgcgctgggggacgtggcgttcgcgtacgcggggcacaacgtggtgctggagatccaggccaccatcccgtccacgccagacaagccgtccaagaagcccatgtggcagggcgtcgtcctcgcctacctcgtcgtcgccatctgctacctcccggtggcgttcgtcggctactacgtcttcggcaacgccgtcgacgacaacatcctcatcaccctcgagaagccacgctggctcatcgccgccgccaacatcttcgtcgtcgtgcacgtcatcggcagctaccagatctacgccatgcccgtgttcgacatgctcgagacgttcctggtgaagaaactccggttcaagccaggcatgcctctccgtttgatagcgcgctcgctctatgttgtgctgacagctctggttggcatcgccgtgccgttcttcggggggctgctagggttctttggtggcttcgcatttgcgccgacaacctactaccttccgtgcattctgtggttgaagattaagaagccaaagaagttcagcctctcttggttcatcaactggttctgcatcatagtcggcgtgctcctgacggtgcttgcgcccattggtggcctccggtcgatcgtcgtcaacgcctccacctacaagttcttctcgtgatcgggttatcccctcgcgccccatgcattgcggcgcccctagggatattagttagctagctagcaagataaacattagcaggtagctaggtttaaacttttttatgccatatatatatggtgtgtgtgagtgtgtttggaacttggtttaatttgtgctatcgctaagtcgtcgtcgttcactttctaaagggatgtgatagtgttaatttg

SEQ ID NO: 2705 - DNA, 1371 bp, Brachypodium distachyon
tcgatcgactccacaatggcgccgtccgccatgaacatgaccaaggagcagaaggaccagcaggacatcgacgactggctccccatcacctcgtccaggaaggccaagtggtgttactccgccttccacaatgtcaccgccatggtcggcgccggcgtcctcagcctcccctacgccatgtccgagctcggctggggtggcggcgatgatcctgtcatgggtgataaccctgtacacgctatggcagatggtggagatgcacgagtgcgtccccgggaagcggttcgactggtaccacgagctggggcagcacaccttcgggcagaagctgggcctgtggatcgtcgtcccgcagcagctcattgtggaagtcggcgtctgcatcatgtgcatggtgacgggcggcaagtcgctgaagaagttccacgacgtggtggcgccggcagacgccgccccgatccggaccagctacttcatcgtcatcttcgggtccgcccacctgctgctctcccagcttcccaacttcaactccatcaccgtcgtctccctcgccgccgccgtcatgtcgctctcctactccaccatcgcctggcctgggtcgcctccctcgagcaccgccaccacggtggcggtagcagccacgtggtcgattacagcatgacggcgtccacgtcggccgggaggatgttcaacttcctcagcgcgctgggtgacgtggcgtttgcctacgccggccataacgtggtgctggagatccaagccatgattccgtcgacccccgacaagccgtcgaagaagcccatgtggctcggcgtcatggtgacctaccttgtcgtcgccgtctgttatctccccgtggcgtttgtgggttactacgtgttcgggaacgctgtggatgataatatcctcatcacgctggagaagccacgctggctcatcgccgccgccaacatgttcgtcgtcgtccacgtcatcggcagctaccagatctacgccatgcccgtcttcgacatgctcgagacgttcctcgtcaagaagctccggttccccctggctggcctctccgtctcatcgcccgctccctctacgttggtcatgttcaccatgattgttggcatcgccatccccttcttcggtggattgctagggttcttcggtggctttgccttttccccaacgacctacttcctgccctgcatcatgtggctgatcatcatgaagcccaagaagttcggattctcatggtgcaccaactggatctgcataacaatcggcgtgctcctgtccgtgatggcgcccatcggaggactccggtctatcattatcaatgccaagacctacaagttcttctcatgatcgctagatctgctg

SEQ ID NO: 2706 - DNA, 1359 bp, Brachypodium distachyon
cggattgaggctccatcgatcgactccacaatggcgccgtccgccatgaacatgaccaaggagcagaaggaccagcaggacatcgacgactggctccccatcacctcgtccaggaaggccaagtggtgttactccgccttccacaatgtcaccgccatggtcggcgccggcgtcctcagcctcccctacgccatgtccgagctcggctggtacgggccaggggtggcggcgatgatcctgtcatgggtgataaccctgtacacgctatggcagatggtggagatgcacgagtgcgtccccgggaagcggttcgactggtaccacgagctggggcagcacaccttcgggcagaagctgggcctgtggatcgtcgtcccgcagcagctcattgtggaagtcggcgtctgcatcatgtgcatggtgacgggcggcaagtcgctgaagaagttccacgacgtggtggcgccggcagacgccgccccgatccggaccagctacttcatcgtcatcttcgggtccgcccacctgctgctctcccagcttcccaacttcaactccatcaccgtcgtctccctcgccgccgccgtcatgtcgctctcctactccaccatcgcctggcctggcagccacgtggtcgattacagcatgacggcgtccacgtcggccgggaggatgttcaacttcctcagcgcgctgggtgacgtggcgtttgcctacgccggccataacgtggtgctggagatccaagccatgattccgtcgacccccgacaagccgtcgaagaagcccatgtggctcggcgtcatggtgacctaccttgtcgtcgccgtctgttatctccccgtggcgtttgtgggttactacgtgttcgggaacgctgtggatgataatatcctcatcacgctggagaagccacgctggctcatcgccgccgccaacatgttcgtcgtcgtccacgtcatcggcagctaccagatctacgccatgcccgtcttcgacatgctcgagacgttcctcgtcaagaagctccggttccccctggctggcctctccgtctcatcgcccgctccctctacgttggtcatgttcaccatgattgttggcatcgccatccccttcttcggtggattgctagggttcttcggtggctttgccttttccccaacgacctacttcctgccctgcatcatgtggctgatcatcatgaagcccaagaagttcggattctcatggtgcaccaactggatctgcataacaatcggcgtgctcctgtccgtgatggcgcccatcggaggactccggtctatcattatcaatgccaagacctacaagttcttctcatgatcgctagatctgctg

SEQ ID NO: 2707 - DNA, 1812 bp, Panicum virgatum
gcgggccacacgcgtctccttcttgcaactgcatccctctccctccggccctcagatcccgtcggatttgactagtccggcctagtgcgcggctgctgcgcgatctcgtgggggttcgccgccgtcaggccgtggtctagcttggagaccgatcgatggcggcgccctcggccatgtcgtcgacggcggcggggagtaaggagcagcagaagcaggacatcgacgattggctgcccatcacctcgtccaggaacgccaagtggtggtactcggcgttccacaacgtcacggccatggtcggcgccggcgtgctcagcctgccctacgccatgtccgagctcggatggggccccggcgtggtggcgatgctcctgtcgtgggtgatcacgctgtacacgctgtggcagatggtggagatgcacgagtgcgtcccgggcaagcgcttcgaccgctaccacgagctcggccagcacgccttcggcgacaagctcggcctctggatcgtcgtcccgcagcagctcatcgtcgaggtcggcgtctgcatcgtctacatggtcaccggcggcaagtcgctggagaagtgctacaccgtcgcgtgccccgactgcgacccgctccggaccagctcctggatcatgatcttcgccgccgtccacttgctcctctcgcagctccccaacttcaactccatcacgctcgtctccctcgccgccgcggtcatgtcgctcagctactcgacgattgcctgggcggcgtcggcgcacaagggccggcagccggacgtggactacagcaagacggcgtcgacggcgacggggcagacgttcaacttcctcagcgcgctgggcgacgtggccttcgcctacgccggccacaacgtggtgctggagatccaggccaccatcccgtcgacgccggagaagccctccaagaagcccatgtggcagggcgtcgtcctcgcctacatcgtcgtcgccatctgctacctccccgtcgccttcgtcggctactacgtcttcggcaacgccgtcgacgacaacatcctcatcaccctcgagaagccacgctggctcatcgccatggccaacatcttcgtcgtcgtccacgtcatcggcagctaccagatctacgccatgccggtgttcgacatgctggagacgttcctggtgaagaagctccggttcaggccagggctgcctctccgtctgattgcgcgttcactctacgttgtgttcacagctctggttggcatcgccgtgccgttctttggtggattgctagggttcttcggtggctttgcatttgcgccaacgacctactatcttccctgcattctgtggttgaagatcaaaaagccaaagacgtttagcttctcctggttcgccaactggttttgcatcatcatcggcgtgctcctgacggtgtttgcacccattggaggtctccggtcgatcatcgtcaacgcctccacctacaagttcttctcgtgatcgaccgattatccgccgctccagatatttgttagctatctagataaagacgaacaattagctaggtgtaatcaatctatttatttaattgaaagggcaaggacatgctgtgcatgtgtctatgtgttctggctatatggctgctggtggcgctaagtttaatttgtgccactgcaagtcattggtgttcctaagggatgatgcagcaatttggctccatttgtcatacggtactgtttaatgtcaggggtttggtttaagtaatcaactcatctagaatgggattcataattccatgagctttgatgagatgaaagttact

SEQ ID NO: 2708 - DNA, 2044 bp, Panicum virgatum
ccaggggagggagggaggcggcgccgcggcggcggtggacgatggcgagaggaggagcgtgcggcggccgggacggcgaacggagtgagttggggaggctagtggagcccctgggctgggctcggttgagacagagcccctgggctgggccggcgtaggtagcgggccgtattcaaagcccaacaaagaaacaggcccatttccgccgcccccaaccagtctaccaccaacagtccaggaaaatagggaggagaggaacgaggcaggtcgttggcgagatcccgccgcctgccgccgccgtatctatataacactacgcggcacacgcatctccttcttgcaactgccccctccctcagatcccgtccggccgttttgactagcgcgcgcccgctagctgctcgatcgtcgggttcgccgccgtccggccgtggtcggagctgagacgaccgacgatggcgcaatcggccatgtcgtcggcgacggggaaggagcagcaggagcaggccatcgacgactggctgcccataacctcctccaggaacgccaagtggtggtactcggcgttccacaacgtcaccgccatggtcggcgccggcgtgctcagcctgccctacgccatgtccgagctcggatggggccccggcgtggcggcgatgctcctgtcgtgggtgatcacgctctacacgctgtggcagatggtggagatgcacgagtgcgtcccgggcaagcgcttcgaccgctaccacgagctcggccagcacgccttcggcgacaagctcggcctctggatcgtcgtcccgcagcagctcatcgtcgaggtcggcgtctgcatcgtctacatggtcaccggcggcaagtcattcgagaagtgctacaccgtcgcgtgcccggactgccagccgctccggactagctcctggatcatgatcttcgccgccatccacctgctcctctcgcagctccccaacttcaactccatcacgctcgtctccctcgccgccgcggtcatgtcgctcagctactcgaccatcgcctgggcggcgtcggcgcacaagggccggcagccggacgtggactacagcaagacggcgtcgacggcgacggggcagacgttcaacttcctcagcgcgctgggcgacgtggcgttcgcctacgccggccacaacgtggtgctggagatccaggccaccatcccgtccaccccggacaagccctccagcaagcccatgtggcagggcgtcatcctcgcctacctcgtcgtcgccatctgctacctccccgtcgccttcgtcggctactacgtcttcggcaacgccgtcgacgacaacatcctcatcaccctcgagaagccacgctggctcatcgccatggccaacatcttcgtcgtcgtccacgtcatcggcagctaccagatctacgccatgccggtgttcgacatgctggagacgttcctggtgaagaagctccggttcaggccagggctgcctctccgtttgattgcgcgttcactctacgttgtgttcacagctctggttggcatcgccgtgccgttctttggtgggttgctagggttcttcggtggctttgcatttgcgccaacgacctactatcttccctgcattctgtggttgaagatcaaaaagccaaagacgtttagcatatcctggttcgccaactggttttgcatcatcatcggcgtgctcctgacggtgtttgcccccattggaggtctccggtcgatcatcgtcaacgcctccacctacaagttcttctcgtgatcgaccgattatccgctgttcaagacattagttagctatctagataaagacgaacaattagctaggcataatcaaatggctgcaggtggcgctcagtttaatttgtgctactgcgagtcattggtgttctaaagggatgatgcagcaatttggctccatttgtcatatgtactgtttattgttaggggtttggtttaagtaatcaactcatctagaatgggattcataattccatgagctttgatgagataaaataagttact

SEQ ID NO: 2709 - DNA, 1596 bp, Zea mays
gcgcaggctctgcctctgccccccagactaccccctgcctgcaggctcctgcaactgcaatgtcggcgctcgggacgctctccggcggcgccgccggtgtctccggcctcctccgcctccgccgtcgggtcgcccccgcgctcgcggcgccgtcgcaccacgccgctgggacgttgaactgcgccgccttgcccgatgccgccccgctcgtctggggacgccagctccgcccgtcgctcctcctccccgccacactgctcccgtcgtcgtcgcagggcgccaggaggcacacgccacggcggcccgccgcagccgcaggggaggccaagtctgtgggtttcctggagaagtacccggccctggtcactggcttcttcttcttcatgtggtacttcctcaacgtcatattcaacatcctcaacaagaagatctacaactacttcccctatccatactttgtgtccttgatccatctagtagtgggtgtcgtatactgcctcatcagctggagtgtcggtctccccaagcgagcgcctatcaatggcacgctcctgaagcttctctttccagtcgccctgtgccatggtattggtcacatcactagcaatgtgtccttcgctgctgttgcagtctcatttgcccacactatcaaagctctggagcccttcttcagcgcagctgctactcagtttatccttggacagcaagttcccttctctctgtggctttctcttgcccctgttgtcatcggtgtttcaatggcatcccttactgagctctcattcaactggactggcttcatcaatgccatgatatcaaacatctcattcacctacaggagcatttattccaagaaagccatgactgacatggatagcaccaacgtgtatgcttacatttcaataattgctctcattgtttgcattccgcctgcagtgatctttgaagggccccggctaatgcagcatggattcagtgatgccattgcaaaagtaggcttgacaaagtttgttagtgacctattcttggttggactgttctaccatctgtacaaccagattgctacgaacaccttggagcgagtggctcctctgacacatgctgtgggcaatgtgttgaagcgtgtgtttgtcattggcttctcaatcgttgtttttggcaacaaaattagcacacaaactggaattggcacgtccattgccatagctggtgttgctatgtactcttacattaaggctaagattgaagaggagaaaaggaaaaagagcgcatgatgagctgactgctgtgaatattttaccttctgcgtctgggacacaacaacaacatcgtcgacaatcaagattatgccttgttttgtagtattcgtcttgagtcgctttgtttattaccaatctattatctggtgttgaacagcagcacattgcagaacagatgatcgtcgagtgaccttcatatacgcctgtaactctctctctctccctctctctcagctcagcagtttagatcgactatactcattggacatggacctatctatatatcttctttgtaaacaggacagagtcggactcctgctgcagtattatcaactca

SEQ ID NO: 2710 - DNA, 1991 bp, Panicum virgatum
tggccgtcgcctcccctcgccgccccgccgctggttggtctatcctccagctccagcgtccatccatgatccatccgccccgcgcgcgcctcggccacccaaatccctcccctcccctcttcttatcctccaaatcccagcgcccgcccgcccgcctccccactgcacgctccagctcagtttcccaggtaagcaaagcctcccccagccatgtcggcgctcggcgcgctctccggcggcgccgccggtgtcgccggcctcctcagcctccgccgccgcgccgcgccaccaccctctgggctcgcaaccccggcgcacctcccgcctctcaagtgcgccgtcctgcccgatgccggccagctcgtctggggccgccagctccgcccggcgctccttcccgctgccctgctcccgccgcagcccgccaggaggcacgccctgtgcccgcccgccgcagccgcaggggaggccaagcccgcgggtttcctcgacaagtaccctgccctggtcaccggcttcttcttcttcatgtggtacttcctcaacgtcatattcaacatcctcaacaagaagatctacaactacttcccctacccatactttgtgtcgctcatccatctggtagttggtgtcgtatactgcctcatcagctggtctgtcggtctccccaagcgtgcgcctatcaattccaatctcctgaagctgctctttccagtggcgctgtgccatgctcttggtcatgtcactagcaacgtctccttcgctgctgttgcagtctcatttgcccacactatcaaagctctggagcccttcttcaacgcagcggctactcagtttgtccttggacagcaggttcccttgtctctgtggttgtcccttgcccctgttgtcattggtgtttcgatggcatccctcactgagctctcattcaactggactggcttcatcaatgccatgatctctaacatctcattcacttacaggagtatttattccaagaaagctatgactgacatggatagcaccaacgtgtatgcttacatctcgataatttcgctccttgtttgcattccacctgcactgatttttgaaggacctcaactgatgcagcacggatttagcgacgctattgcaaaagtaggtctgcaaaagtttgttactgaccttttcttggttggactgttctaccatctgtacaaccagcttgctacaaatactttggagcgagtggctcctctgacacacgctgttggcaacgtgttgaaacgtgtgtttgtcattggtttttcaatcattgtttttggcaacagaattacgacacaaactggaattggaacttgcattgccatagctggtgtggccatgtactcttacatcaaggctaggattgaagaggagaaaaggaaaaagagcgcatgatgaggtgactactgtgaatatgtgtcgggtggctgagttgtgcttcctgagacaacatcgtcgacaatcatgacttccttctctgcctttgttttttttcccaccttgagtcatttggtcaattgtttgttcccaaactggtgttgaacagcagcacattgcagatggcaagtatattgctcttcttaccatcagaacagataatcgttgcgtgcgcatgaatgtgtagaaaataaacgctcatacttgaaaggctttttggtttgtactatgtggtaactctgtaagactgtaaattctgtttgtggaactatcagggatgcagatttgggttcttaaataagataagattggtcccaggtacaccacgggtttcgcacttgtcaaacgcagatccttcattacttctacaagtttcgctcggatgcttactacctttacaacgtacatctaccatgcctccaatgcaaatctgcacatgatttggtcatcaacgagagtctaaaatagtcccacgagtagtttccccaacaaaagcaaggagcagtgcaaaatcggcatcttactctctt

SEQ ID NO: 2711 - DNA, 1692 bp, Echinochloa colona
ccccttgccggcgccaccgccacccataacctccatcttcttatccccccaacaccctcgatctcaaaggagagagccgggagggaattgaaggtccagccaccacctgcagcaaagccaagcctccaaccatagcataggcgcatagccaccatgtcggcgctcggcacgctctccggcggcgccgccggtctcgccggcctcctccgcctccgccaccacgcatccaaaccagccccctctgcgctcgcctcctcctcgccccacctcccgccgctcaagtgcgccgccgtgcccgatgccggccagctcgtctggggccgccagctccgcccggcgctcctccccgccgcccttcaccacccggcgcagctcgccaggaagcgggccgacacgctgcgcccgccagcagcagccgccggctctgcagaagaggccaagcccgtgggtttcctgcagaagtaccctgccctcgtcaccggcttcttcttcttcatgtggtacttcctcaacgtcatattcaacatcctcaacaagaagatctacaactacttcccttacccatacttcgtgtcggtgatccatctgttagtgggaagtgtatactgcctcatcggctggagtgttggtttccccaagcgtgcgcctatcaacggtacgctcctgaagctgctctttccagtggcgctgtgccatggtattggtcatatcactagcaacgtctccttcgctgctgttgcagtctcatttgcccacactattaaagctctggagcccttcttcaacgcagcggctactcagtttatccttggacagcaggttccctttgctctgtggatgtcccttgcccctgttgtcattggtgtttcgatggcatccctcactgagctctcattcaactggactggcttcatcaatgccatgatagctaacctctcattcacttacaggagcatttattccaagaaagctatgactgacatggatagcaccaacgtgtatgcttacatctcaataatttctctcattgtttgcattccacctgcactgattatggaagggcctcaactaatgcagcacggatttagtgatgctattgcaaaagtaggtctgcaaaagtttgttagtgaccttctcttagttggactattctaccatctgtataaccagattgctacaaatactttggagagagtggctcctctaacacatgctgttggcaatgtgttgaaacgtgtgtttgtgattggtttttcaatcattgtttttggcaacagaatttcgacacaaactggaattggcacttccattgccataggtggtgtggccatctactcttacatcaaggctaagattgaagaggagaaaaggaaaaagagcgcatgatggggtgactgctgtgaatctggtccggtggctgagttgtacttcctcagagacaacattgtcgacacgacactcatgacttccttctctgccttgttttgttttcatcttgagtcagtttggtcaattgtttttcccaacctggtgttgaacagagcacactgcagatggtaccatcacaaagaacagatgatcgtggagtgagcatgagtgtgtagaaaataaccgctcatacttgacaggctattcgatttgtattatgtcatataaatgtgtaattccgtttgtggaactgtcattcttaaa

SEQ ID NO: 2712 - DNA, 1627 bp, Echinochloa colona
aaggcaaggtccagccaccagcagcaaatcacccaccatagcatagtctccaattagcaagcaagcaatgtcggcgctcggctcgctctccggcggcgccgccggtctcgccggccttctccgcctccgccaccactcatcctcaccagccccctctgcgctcgcctcctcctcgccccacctcccgccgctcaagtgcgccgccgtgcccgatgccggccagctcgtctggggccgccagctccgcccggcgctgctccccgccgcccttcaccacccgacgcagctcgccaggaagcgggacacgctgcgcccgccagccgcagcctccgcaggagaggccaagcccgcgggtttcctgcagaagtaccctgccctcgtcaccggcttcttcttcttcacgtggtacttcctcaacgtcatattcaacatcctcaacaagaagatctacaactacttcccttacccatacttcgtgtcggtggtccatctgttagtgggaagcgtatactgcctcatcggctggagtgtcggtttccccaagcgtgcgcctatcaacggtacgctcctgaagctgctctttccagtggcgctgtgccatggtattggtcatatcactagcaacgtctccttcgctgctgttgcagtctcatttgcccacactattaaagctctggagcccttcttcaacgcagcggctactcagtttatccttggacagcaggttccctttgctctgtggatgtcccttgcccctgttgtcattggtgtttcgatggcatccctcactgagctctcattcaactggactggcttcatcaatgccatgatagctaacctctcattcacttacaggagcatttattccaagaaagctatgactgacatggatagcaccaacgtgtatgcttacatctcaataatttctctcattgtttgcattccacctgcactgattatggaagggcctcaactaatgcagcacggatttagtgatgctattgcaaaagtaggtctgcaaaagtttgttagtgaccttctcttagttggactattctaccatctgtataaccagattgctacaaatactttggagagagtggctcctctaacacatgctgttggcaatgtgttgaaacgtgtgtttgtgattggtttttcaatcattgtttttggcaacagaatttcgacacaaactggaattggcacttccattgccataggtggtgtggccatctactcttacatcaaggctaagattgaagaggagaaaaggaaaaagagcgcatgatggggtgactgctgtgaatctggtccggtggctgagttgtacttcctcagagacaacattgtcgacacgacactcatgacttccttctctgccttgttttgttttcatcttgagtcagtttggtcaattgtttttcccaacctggtgttgaacagagcacactgcagatggtaccatcacaaagaacagatgatcgtggagtgagcatgagtgtgtagaaaataaccgctcatacttgacaggcttttcgatttgtattatgtgatataaatgtgtaattccgtttgtggaactgtcattcttaaataagtttgggtagaccgcagtattcgcctg

SEQ ID NO: 2713 - DNA, 1694 bp, Setaria italica
cccctcaccggcaacctcttcttatcccatcccaagggagcccgccgtcctccccaccagccactccttcccaccacttcccagcctccccaccccagcatagcaaaggactagcaatgtcggcgctcggcgccctctccggcggcgccgccggtgtcgctggcctcctcagcctccgccgccgtgcagccgcgccaccaccaccctctgcgctcgcctcctcgtcgcacctcccgccgcttaagtgcgccgccgttcccgatgccggccacctcgtctggggccgccagctccgcccggcgctcgccctcctcccgttcccgtcgcaggccgccaggaagcagaccccacgcccgcccgccgccgcctccgcaggggaggccaagcccgctggtttcctcagcaagtaccctgccctggtcaccggcttcttcttcttcatgtggtacttcctcaacgtcatattcaacatcctcaacaagaagatctacaactacttcccctacccatactttgtgtcggcgatccatcttttagtgggtgtcgtatactgcctcatcagctggagtctcggtctccctaagcgtgcgcctgtcaatgcgaatctcctaaagctgctctttccagtggcgctgtgccatgctcttggtcatgtcacaagcaacgtctccttcgctgctgttgcagtctcatttgcccacactattaaagctctggagcccttcttcaacgcagccgctactcagtttatccttggacagcaggttcccttgtctctgtggctgtcccttgcccctgttgtcattggtgtttcaatggcatccctcactgagctctcattcaactggactggcttcatcaatgccatgatatctaacatctccttcacttacaggagcatttactccaagaaagctatgactgacatggatagcaccaacgtgtatgcttacatctcaataatttctctcattgtttgcattccacctgcactgatgtttgaagggcctaaactgatgcagcacggatttaatgatgctattgcaaaagtaggtctgcaaaagtttgttacggaccttttcttagttggactgttctaccatctgtataaccaggttgctacaaatactttggagcgagtggctcctctgacacacgctgttggcaatgtgttgaaacgtgtgtttgtcattggtttttcaatcattgtttttggcaacagaatcacgacacaaactggtattggcacatccattgccatagctggtgtggccatgtactcttacatcaaggctaagattgaagaggagaaaaggaaaaagaagagcgcgtgatgaggtgaatactgttaatatggtctcgggtggctgagttgtacttcctgagacaacatcgtcgacaatcatgacttccttgttttgttttcaccttgagtcatttggtcaattgtttgttcccaacctggtgttgaacaacagcgcattgcaagatggtaagaagagcaatctacttcttaccatcagaacagatgatcgtggcgtgagcatgaatatgtagaaaataaacgctcatacttgaaaggcttttcgttttgtatgtgataactgtgtaaattctgtttgtggaactagcagggatatatatttgggttcttaaataaaattggtcccgggtagactacgggtttcgcctct

SEQ ID NO: 2714 - DNA, 1782 bp, Setaria italica
tccccaccccagcatagcaaaggactagcaatgtcggcgctcggcgccctctccggcggcgccgccggtgtcgctggcctcctcagcctccgccgccgtgcagccgcgccaccaccaccctctgcgctcgcctcctcgtcgcacctcccgccgcttaagtgcgccgccgttcccgatgccggccacctcgtctggggccgccagctccgcccggcgctcgccctcctcccgttcccgtcgcaggccgccaggaagcagaccccacgcccgcccgccgccgcctccgcaggggaggccaagcccgctggtttcctcagcaagtaccctgccctggtcaccggcttcttcttcttcatgtggtacttcctcaacgtcatattcaacatcctcaacaagaagatctacaactacttcccctacccatactttgtgtcggcgatccatcttttagtgggtgtcgtatactgcctcatcagctggagtctcggtctccctaagcgtgcgcctgtcaatgcgaatctcctaaagctgctctttccagtggcgctgtgccatgctcttggtcatgtcacaagcaacgtctccttcgctgctgttgcagtctcatttgcccacactattaaagctctggagcccttcttcaacgcagccgctactcagtttatccttggacagcaggttcccttgtctctgtggctgtcccttgcccctgttgtcattggtgtttcaatggcatccctcactgagctctcattcaactggactggcttcatcaatgccatgatatctaacatctccttcacttacaggagcatttactccaagaaagctatgactgacatggatagcaccaacgtgtatgcttacatctcaataatttctctcattgtttgcattccacctgcactgatgtttgaagggcctaaactgatgcagcacggatttaatgatgctattgcaaaagtaggtctgcaaaagtttgttacggaccttttcttagttggactgttctaccatctgtataaccaggttgctacaaatactttggagcgagtggctcctctgacacacgctgttggcaatgtgttgaaacgtgtgtttgtcattggtttttcaatcattgtttttggcaacagaatcacgacacaaactggtattggcacatccattgccatagctggtgtggccatgtactcttacatcaaggctaagattgaagaggagaaaaggaaaaagaagagcgcgtgatgaggtgaatactgttaatatggtctcgggtggctgagttgtacttcctgagacaacatcgtcgacaatcatgacttccttgttttgttttcaccttgagtcatttggtcaattgtttgttcccaacctggtgttgaacaacagcgcattgcaagatggtaagaagagcaatctacttcttaccatcagaacagatgatcgtggcgtgagcatgaatatgtagaaaataaacgctcatacttgaaaggcttttcgttttgtatgtgataactgtgtaaattctgtttgtggaactagcagggatatatatttgggttcttaaataaaattggtcccgggtagactacgggtttcgcctctgatccgatggatgctggttatgattgcacttgtcaaacgcatatcctgcattcctgctacacgtttcgtttcagctgcttactaccttgagaacgcacgtcaacctgctacaaatctacacatggtttggtcatctataagaacctgaaatagttccgcgaatagtttagccaa

SEQ ID NO: 2715 - DNA, 1867 bp, Oryza sativa
taaccacaaaaacccctttccgctcgcctcgcctcgccttgcctcgctgcgccaccaaccttgacggcgacgtgctcccttccccttccgctcgcggcgcactgcgaggcggggaggtccactctatccgccccgagctcgcctccgccacccaaatccctccccctccaccccccaacgccgcgcgcctcccactcccacccataaacttatccgcaaaccctcctctccatctccacctccacagcctccccacgctaccctcccaatgccggcgctcgggacgctctccggcggcgccgccggcgtggccggcctcctccgcctccgccgcgccacgccttcccccgccgtcgctactcccttccccgccgcggccgccgccaggtgcgcagccgcagccgccgccgtcgtccccgatggaggccagctcgtgtggggcaggcagctccgccctgcgctgctcctccccgccgctggaggccttctgcagccgccgacgtcgccgtcgtcgtcgcaggccggcaggaggcaggcgctccgcccgcccgccgccgccacctcaggggaagcgaagccagcggggttcctggagaagtaccctgccttgatcaccggcttcttcttcttcatgtggtacttcttgaacgttatattcaacatcctcaataagaagatatacaactacttcccctatccatactttgtgtcggtgatccatctgcttgttggtgtcgtgtactgcctcgtgagctggaccgtcgggctcccaaagcgtgcgcctatcaattcgacactcttgaagctgctctttccagttgcgttgtgccatgctcttggtcatgtcactagcaatgtatcgtttgctactgttgcagtttcatttgcccacaccattaaagctctggagcccttcttcaatgcagcggctacccagtttgtccttggacagcaagttcccctgcctctttggttgtctcttgcccctgtcgtgcttggtgtttcaatggcatcactgactgaactttcatttaactggacgggcttcatcaatgctatgatctctaacatctcattcacttaccggagcatttattccaagaaagctatgactgatatggatagcaccaatgtgtatgcttatatctcaataatcgcccttattgtgtgcattccaccagcagtgatcatcgagggacctcaactattgcagcatggttttaacgatgcaattgcaaaagtaggcttgacaaagttcgtttctgaccttttcttcgtgggactgttctaccacctctataaccaggttgctacaaacactctggagcgagtggcccctctgacgcatgccgttggcaatgtgttgaaaagggttttcgtcattggattctccatcattgtttttggcaacagaattaccacacagactggaattggtacttgcattgccatagctggtgttgccatctactcgtacatcaaggctaagatcgaagaggagaaaagggcgaagagtgcatgatgaggtggtttctgtgaatatggcaaggtggctgcggtgcgtgcgttcgttttactcgcctcagggacaacatgggcgaggatcatggcgtcttcttcttgcgtatcttgtttttgcttttggggttatttggtcaaattgttcctagtctggtgttgaacagcatattgcggtggtaagattggttatcatcagttgattgtcgagagagcccaaatgtgtagaaataaacgctcatacttggaaaagcttttcattttgtatgtaataaccgagaatgttattcgtgtctgtgaccttgtctttgttggctctgaggaagtgaggatgttgtgtttttggaaa

SEQ ID NO: 2716 - DNA, 1713 bp, Triticum aestivum
ctctcctctcgtctccttccccaaactctatcatcagcaatcgcagcggcctatcctcccccgcgcgcgtctccgccacccaaatccctccgctcccacccataaacttatccaaaaccgcccgccccatcccgctccagcccagccccgcgcccaacgcgatcgccccaggctccccgcgctgctgcagcaatgccggccctcgggacgctctccgccggcggcgccgccgccggcgtcgccggcctgctccgcctccgccgcggccccgccctcgcctcgcccctgccggccgccgcccgagccggcgcggtgcacgacggcgcccagctcgtctggggccgccagctccgcccggccctcgtcctccccgccggcctgctcccgctccaggcctccaagaggctcacgctccgcccgcccgccgcctccgccgagcccgccggggaggccaagtcgccagggttgctggagaagtaccctgcaatcaccaccggcttcttcttcttcatgtggtacttcctgaacgtcatattcaacatcctcaacaagaagatctacaactacttcccctacccatactttgtttcggtgatccatctacttgtgggagttgtgtactgcctcctcagctgggccgttggtctcccgaagcgtgcgcctatcaatgcaacgctcctgaagctgctctttccggtggcattgtgccatgctcttggtcatgtcacaagcaacgtgtcctttgctactgttgcagtctcgtttgcccacactattaaagctttggagcccttcttcaatgcagctgctacccagtttgtccttggacagacagttcccttgtctctgtggttgtctcttgcccctgttgtgcttggtgtttcaatggcatccctcactgaactgtcgtttagctggaagggtttcatcaatgctatgatctctaacatctcgttcacttaccggagtatttattccaagaaagccatgactgacatggatagcaccaacgtgtatgcttacatctcaataattgctctagttgtctgcataccacctgcacttattattgaaggaccacagctaatgcagtatggattaaacgatgcaattgcaaaagtaggaatgacaaaatttgtatcagatcttttcctggtgggattgttctaccatctctataatcagattgctacaaacactttggaacgggtggcccctctgacacatgctgttggcaatgtgttgaaaagggttttcgtcattggtttctcgatcatcatttttggcaacaaaattaccacacagactggaatcgggacttgcgttgcaatagctggtgttgccctctactcgtacatcaaagctaagatcgaggaggagaaaagggcgaaggccgcgtgatgaggtgactgctgtgaatatggtctgatggtttccggcgctcgagttgcattgcctcggagacgacatggacggatctcttcttcgttatttgttatttgtttttcagttatctgctaaagtgttcccttgtgaggtcgaacagctacattgcagatggtaagactggttgtttccatcagatgagagagctcagatgtgcagtaataaacgctcgtacttgtaaaggcttttcgttttgtgtgtgaggactgagttatcttctttgtacccttcctttcgttagttcttgtgctatgcaatgttggactc

SEQ ID NO: 2717 - DNA, 1619 bp, Avena sativa
agcgcgaccctccctccgaaccttccaaggctgctgcagcaccaatgccggcgctcgggacgctctccaccggcggcgccgccgccggcgtcgcgggccttctccgcctccgccgcggcccggccgtcgcgtcgcccctgccggccgccgcgcgcgccggcgcggtccacgacggcggccagctcgtctggggccggcagctccgcccggtcctcctcctccccgccggcctgctcccgtcccaggcctccaagaggctgccgctccgcccgcccgccgcatccgcttcctccgagcccgcaggggatgcaaaggcgccggggatcctggagaagtaccctgcaatcaccaccggcttcttcttcttcatgtggtacttcctgaatgtgatcttcaacatcctcaacaagaagatctacaactactttccctacccatactttgtgtcggtgatccatctactcgtgggtgtcgtgtactgcctcatcagctgggccgtcggtctcccaaagcgtgcgcctatcaactctacgctcctgaagctcctcttccctgtggctttgtgccatgctcttggtcatgtcacaagcaacgtgtcctttgctactgttgcggtctcatttgcccacaccatcaaagctttggagcccttcttcaatgcagctgctacccagtttgtccttgggcagacagttcccttgtctctgtggctatctcttgcccccgtcgtgcttggtgtttcaatggcatccctcacggaactttcatttaactggaagggtttcatcaatgccatgatctcaaacatctccttcacctacaggagcatttactccaagaaagccatgacggacatggatagcaccaacgtgtatgcttacatctcaataattgctcttatcgtctgcataccaccagcaattattattgaaggaccccaacttatgcagtctggattaaatgatgcaattgcaaaagtaggtctgacaaaatttatttcagaccttttcctggtaggactgttctaccatctctataaccagcttgctacaaacacattggagcgggtggcccctctgacacatgctgttgggaatgtgttgaaaagggtgttcgtcattggtttctcgatcatcatttttggcaacagaatcaccacacagactggtatcgggacgtgcgttgcaatagctggtgttgccatctactcatacatcaaggctaagatcgaggaggagaaaagggcgaagagcgcttgatgtggttgctgtgaatatgaccgggatggttctggtgctcgccttgcactgacggagacaacggagtctcctcttcgttattttgtttttgttttttctgttatctgctcaactgttcccggtatgtggttgaacagcaacattgcagatggtaagagtggtatccgtcgtattgtcaccgagagagctcagatgtgcagaaataaacgctagtactcgtaaaggccttttgttgtgtgtgacaaaaccaagcatatgtattcctttcgttggttcttctgaattctgacgtgtagactctcggtgaaataaatcaccaccagtcttttgtgctgtgaatctgtgactagcctttaactc

SEQ ID NO: 2718 - DNA, 1576 bp, Festuca arundinacea
gcacgagggctgctgcagcaatgccggcgctcgggacgctctccgccggcggcgcgtccgccggcgtcgcgggcctgctccgcctccgccgcggccccgccgtcgcctcgccgctgccggccgccgcgcgcgccggcgcggtgcacgacggcggccagctcgtctggggccggcagctccgccccaacctcctcctccccgccggcctgctcccgtgccaggcctccaagaggctgccgctccgcccgcccgccgcctccgtccgagcccgccggggaggcgaagtcagtggggctcctggagaagtaccctgcaatcaccaccggattcttcttcttcatgtggtacttcctcaacgtcatcttcaacatcctcaacaagaagatctacaactacttcccctacccatacttcgtgtcagtgatccatctgctcgtgggtgtcgtgtactgcctcatcagctgggccgtcggtctcccaaagcgtgcgcctatcaattctacgctcctgaagctgctcttccctgtggctttgtgccatgctcttggtcatgtcacaagcaacgtgtcctttgctacagttgcagtctcatttgcccacactattaaagctttggagcccttcttcaatgcagctgctacccagtttgtccttgggcagacagttcccttgtctctctggctatctcttgcccccgttgtgcttggtgtttcaatggcatccctcaccgaactttcatttaactggaagggtttcatcaatgccatgatctctaacatctccttcacttaccgaagcatttattccaagaaagccatgaccgacatggatagcaccaatgtgtatgcttacatctcaataattgctcttatcgtctgcataccaccagcagttattattgaaggaccccaacttatgcagtatggattaaatgatgcaattgcaaaagtaggtctgacaaaattcgtttcggaccttttcctggtcggactgttctaccatctctacaaccagcttgctacaaacacattggagcgggtggcccctctgacgcatgctgtcggtaatgtgttgaaaagggtgttcgtcattggtttctcgatcatcatctttggcaacaaaattaccacacagactggtatcgggacggtcgttgcaatagctggtgttgccacctactcatacatcaaggctaagatcgaggaggagaaaagggcgaagagcgcttgatgtggttgctgtgaatatggtcggatggttctggtgctcgacttgcactgtgcattggagacatggaggagaaccgtagagtctcctcttcgttattttgtttttgtttttgtttttatctgtgcaactgttcccggtctgaggttgagcagcaacaatgcagatggtatccttcatattgtcaccgagagagctcaaatgtgcaggaataaacgctcgtacttgtaaaggctttttgttgtgtgtgtgtgataaccgagcatctatattcttccttttggttcttctgttgtgcacgttggaggaaagaaatcaaaaaaaaaaaaaaaaaaaaaaaaaaaaaaaa

SEQ ID NO: 2719 - DNA, 3255 bp, Lolium multiflorum
cacccataaacttatccaaaaccacccaccccgatcctcctccccactccgcgcgcgtccagcttccaagcttcccaggcaatgccggcgctcgggacgctctccgccggcggcgccaccgccggcgtcgcgggcctgctccgcctccgccgcggcccggccgtcgcctcgccgctgccggccgccgcgcgcgccggcgccgtgcacgacggcggccagctcgtctggggccgccagctccgccccaacctcctcctccccgccggcctgcgcccgtcccacgtctccaagaggctgccgctccgcccgcccgccgcctccgcctccgaccccgccggggacaccaagtcagtggggctcctggagaagtaccctgcaatcaccaccggattcttcttcttcatgtggtacttcctcaacgtcatcttcaacatcctcaacaagaagatctacaactacttcccctacccatacttcgtatcagtgatccatctgctcgtgggtgtcgtgtactgcctcatcagctgggccgtcggtctcccaaagcgtgcgcctatcaattctacgctcctgaagctgctcttccctgtggctttgtgccatgctcttggtcatgtcacaagcaacgtgtcctttgctacagttgcagtctcatttgcccacactattaaagctttggagcccttcttcaatgcagctgctacccagtttgtccttgggcagacagttcccttgtctctctggctatctcttgcccccgttgtgcttggtgtttcaatggcatccctcaccgaactttcatttaactggaagggtttcatcaatgccatgatctctaacatctccttcacttaccgaagcatttattccaagaaagccatgaccgacatggatagcaccaacgtgtatgcttacatctcaataattgctcttatcgtctgcataccaccagcagttattattgaaggaccccaacttatgcagtatggattaaatgatgcaattgcaaaagtaggaatgacaaaatttgtttcagaccttttcctggtcggactgttctaccatctctacaaccagcttgctacaaacacattggagcgggtagcccctctgacgcatgctgtcggcaatgtgttgaaaagggtgttcgtcattggtttctcgatcatcatctttggcaacaaaattaccacacagactggtatcgggacggtcgttgcaatagctggtgttgccacctactcatacatcaaggctaagatcgaggaggagaaaagggcgaagagcgcttgatgtggttgctgtgaatatggccggatggttctggtgctcgacttgcactgtgcattggagacatggaggagaaccgtagagtctcctcttcgttattttgtttttgtttttatctgcgcaactgttcccggtctgaggttgagcagcaacattgcagatggtatccttcatattgccaccgagagagctcaaatgtgcaggaataaacgctcgtacttgtaaaggctttttgttgtgtatgtgataacgagcatctatattcttccttttggtttttctgttgtgcacgttggagaaaataaatcaaccagtctcctttgtgctgtgaaccctgctgtgaacccttcgtcggtaggccatttgtgcacataatgtggcaacgatgaagtctaatacggcggaaaatgaatagccaaagctactctaattctggaaacatccgtccgagccatcctaacaagagttaatgattagctgaagatagggcagtgttactctaagcttctggaaacttctgtctgtgccatcgtaacatgggctccaatactagcaaccatgacagtgagtcactgacaatgtagacattgcccattccctaacattcttgctcaaaattgttctagtccctgtgctattcgtacaggataatagttccaatataactaattttgaacaaaagcaaaaactcccatacacagacacggtgtaaaatctctacctcaaacctacatggggcttgttgccagcaaccatcctggctgcatatgtaaaaagactcaagcaaattatggagataaaaacaacaacatatcaatataatttttacaggcatgttatgggataccctcatttaaccaattccactcattggcctcttcaggcaaacagaatctacctagccacacggtggcaatattcacaaccacttttgctagtctatagaatgccattttaatctaagaacccaaaagccttttgatcccagccttttgatcagacgttagcctggaagggaacttgatactgaacttaacccgcaggtttcccttcttattcggctccttgggtattggcatgccctctccagggatcacctcttcatagctaggatggatcactgagctaacgggtacagacagaatacgcccatcaagagtagcaacacgcacagtatatccagtcagtgcttcaaccaaagagatcttctctgtcacgacgagatcatttccttccctagtgaaaacgtcatggggcttctcttcaatgatgaaaacaatatcagcaggtatcatgtttggagcttcatttcccttctcaggaaaggtgatctttgtccccttcttccaaccgggctttacatctatagtcagaatttcttctacttgtgagactctcccggtggcatctatgacctctcttgatattttcatctttttggctacacccttgtacaaatcagcaagggtaactggaagccgattctcaatggatgcaggcttgtgtgatgggcgcggcatattacttgcagaactctgcgcgccaaattgcgaggagaggaactcattgccaaacattgacccgtaggatctagggtcccctctcatgccgccagtgccacccgacatgccacccatgccacccataccacccatgcttgaaaatggcccagagaatccgaagaactcggcaaatatatcatctgcactccttggattgaagtgaaacgaggtggagtgggcaccacctgggtaaaagggagatgcaccaggacctcccgcgcctgggggaggctgtcccttcaacccttcttcaccaagctggtcatataatgtgcgtttctgggaatcgctaaggacctcgtatgcctcggagatctgcttgaactttgcctccgcgtccttcttgttggtggggttcttgtccgggtgccagcgcatggcgagcttccggtatgccttcttg

SEQ ID NO: 2720 - DNA, 2070 bp, Setaria italica
ggcaggcatctatctcactcactcactcacttgacttccaccgacgagagtgactgcctgtgagcgtgaggggaaggagacggagacggaggcgagacgcttgagctgagctgcggcggctgcttggcgttggcgctcgctgggatgggcgccgcggggtgtgcggttccgctggcggcatcgcattgccgccggctgcagctgctgatgctggccctggcgctggtgccgctcggtggccgcgggttccgcgtccgtgccgtgggggcggacaccggcgggctgagcagagacgcgttccccaaggggttcgtcttcgggacggcgacgtcggcgttccaggtcgagggcgcggcgtccaccaacggccgggggccctccatctgggaccccttcgtccacacccccggaaagattgctggagacgcgaacgcggatgttacaactgatgaatatcaccgctacaaggaagatgttgatctcatgaaaagcctgaattttgatgcatatcggttttcaatctcctggtccaggatcttcccagatggcgaagggaaagttaatgaagaaggtgtacagtattacaacaatcttatagaccacatgcttaagcaagggcttactccttacgccaaccttaaccactatgatcttccacttgcgcttcagaagaagtacaaaggctggttaggcccaaaaattgtggacatattcgctgactatgccgatttttgtttcaagacttttggcgatcgggtcaagaactggttcacattaaatgagccaaggatagtatcattccttggctatgataaggggcttaacccccctaaccgatgcacccaatgtgctgccggtggcaactcagcaacagaaccttacattgttgttcataacattctcttatctcatgctactgcagttgcaagataccgcaataaataccaggcaactcagaaaggcaaggttgggatagttctagacttcaactggtatgaacctcttaccaactcaacagcagatcaagcagcagcacaaagggccagggacttccatgttggttggtttatggatccattaataaatggacaatatccaaagacaatgcaggacattgtgaaagatcggttaccaagtttcacacctgaacaggctaagctagtgaagggctcatcagattgtttcgggatcaatcaatatactacatactatatttcagacgaacaaactcctcagcaagcaacaccaagctactcgtctgattggggcgttcaatataactttgaaagaaatggcctacctattggacagctggcaaactccgtctggctctacatcgtcccaacgggcatgtatggagttgtgaactacctaaaggaaaagtaccagaatccaaccatcattatatctgaaaacggaatggatcaatctggaaacctcacgcgcgatgagtacctgcacgacaccgtgagggtcgagttctataagaactatctcacggagctgaagaaagggatcgacgagggcgccaacgtggtcgcctacttcgcctggtccctccttgacaacttcgagtggctgtcgggctacacgtccaagttcggcatcgtctacgtcgacttcacgacgctcaagcggtaccccaaggactcggcctactggttcagggacatgctctcaggggcaggctcaaaggccgccacccctcagactggctcacaaagttcagctggcagtccggctggttcggctccggccgcctcgagtggccctgcgctcctggtttctctgctggtctccttgtgcttgcttgttccatccgtcttcatggtttcctccgcttagaaatgatttggtctagtgtcaaagtacttgattatttgtagcagacgccagcggcatgttcattttagagacatgttgcaaggcagagggaccatggttcagggcttttttggccccggttttgctatgattcagagccagctttgtactgatatcatgtttatggataagtaatgttttttggtgtacctccaagattttgttctgttttcgttgtcattgtgc

SEQ ID NO: 2721 - DNA, 2008 bp, Setaria italica
ttgacttccaccgacgagagtgactgcctgtgagcgtgaggggaaggagacggagacggaggcgagacgcttgagctgagctgcggcggctgcttggcgttggcgctcgctgggatgggcgccgcggggtgtgcggttccgctggcggcatcgcattgccgccggctgcagctgctgatgctggccctggcgctggtgccgctcggtggccgcgggttccgcgtccgtgccgtgggggcggacaccggcgggctgagcagagacgcgttccccaaggggttcgtcttcgggacggcgacgtcggcgttccaggtcgagggcgcggcgtccaccaacggccgggggccctccatctgggaccccttcgtccacacccccggaaagattgctggagacgcgaacgcggatgttacaactgatgaatatcaccgctacaaggaagatgttgatctcatgaaaagcctgaattttgatgcatatcggttttcaatctcctggtccaggatcttcccagatggcgaagggaaagttaatgaagaaggtgtacagtattacaacaatcttatagaccacatgcttaagcaagggcttactccttacgccaaccttaaccactatgatcttccacttgcgcttcagaagaagtacaaaggctggttaggcccaaaaattgtggacatattcgctgactatgccgatttttgtttcaagacttttggcgatcgggtcaagaactggttcacattaaatgagccaaggatagtatcattccttggctatgataaggggcttaacccccctaaccgatgcacccaatgtgctgccggtggcaactcagcaacagaaccttacattgttgttcataacattctcttatctcatgctactgcagttgcaagataccgcaataaataccaggcaactcagaaaggcaaggttgggatagttctagacttcaactggtatgaacctcttaccaactcaacagcagatcaagcagcagcacaaagggccagggacttccatgttggttggtttatggatccattaataaatggacaatatccaaagacaatgcaggacattgtgaaagatcggttaccaagtttcacacctgaacaggctaagctagtgaagggctcatcagattgtttcgggatcaatcaatatactacatactatatttcagacgaacaaactcctcagcaagcaacaccaagctactcgtctgattggggcgttcaatataactttgaaagaaatggcctacctattggacagctggcaaactccgtctggctctacatcgtcccaacgggcatgtatggagttgtgaactacctaaaggaaaagtaccagaatccaaccatcattatatctgaaaacggaatggatcaatctggaaacctcacgcgcgatgagtacctgcacgacaccgtgagggtcgagttctataagaactatctcacggagctgaagaaagggatcgacgagggcgccaacgtggtcgcctacttcgcctggtccctccttgacaacttcgagtggctgtcgggctacacgtccaagttcggcatcgtctacgtcgacttcacgacgctcaagcggtaccccaaggactcggcctactggttcagggacatgctctcaggggcaggctcaaaggccgccacccctcagactggctcacaaagttcagctggcagtccggctggttcggctccggccgcctcgagtggccctgcgctcctggtttctctgctggtctccttgtgcttgcttgttccatccgtcttcatggtttcctccgcttagaaatgatttggtctagtgtcaaagtacttgattatttgtagcagacgccagcggcatgttcattttagagacatgttgcaaggcagagggaccatggttcagggcttttttggccccggttttgctatgattcagagccagctttgtactgatatcatgtttatggataagtaatgttttttggtgtacctcc

SEQ ID NO: 2722 - DNA, 2275 bp, Panicum virgatum
ccgctgcaaccatcagtagcgcgccgagccgccgtcccggcgaggcggatcacctgaccgagcccgcgacccgagaggccggggcgaaaagaaatgacccgtcacgtgcccggggtgagcgagacctgcaggcatccgagtcgcacgctgccaaaaggcggctgcagctcacctgacttcgaccgacgagagcgtgactgtgcctgactgccagtgagtggaaggaggagacgcttgagctgagctgcggcggcgctgggatgggcgccgcggggtctgcggctccgccggcggcggcagcgcattgccgccgggtgctgctggccctcgccctcgtgtcgctctgcggccgcgggcttcgcgtgcgtgccgctggggcggacacgggcggcctgagcagggacgcgttccccaaggggttcgtcttcggcacggcgacgtccgcgttccaggtcgagggcgcggcggcgtccggcggccggggggccagcatctgggaccccttcgtccacacccccggaaatattgctggagacgcgaacgcagatgtcgcaactgatgaatatcatcgctacaaggaagatgttgatctcatgaaaagcctgaattttgacgcatatcggttttcaatctcttggtccaggatcttcccagatggtgaaggaaaagttaatgaagaaggtgtacaatattacaacaatcttatagactatatgattaagcaagggcttactccttacgtcaaccttaaccattatgatctcccactcgcgcttcagaagaagtacaaaggctggttaggcccaaaaattgtggacatatttgctgactatgccgatttttgtttcaagacttttggagatcgagtcaagaattggttcacattaaatgagccaaggatagtagcatttcttggctatgatactggagctgacccccctaaccggtgcacccaatgcgctgccggtgggaactcggcaacagaaccttacattgttgctcataatattatcttatctcatgctactgcagttgcaagataccgaaacaaataccaggcaactcagaaaggcaaggtcgggatagttctagacttcaattggtacgaacctcttaccaactcaacggaagatcaagcagcagctcaaagagccagggacttccatgttggttggtttcttgatccattaataaatggacaatatccaaagacaatgcaggacattgtaaaagatcggttaccaagtttcacacctgagcaagctaagctagtcaagggctcatcagattattttgggatcaatcaatatactacatactacatttcagacaaacaaactcctcagcaagcagcaacaagctactcatctgattggagcgttcaatataactttcaaagaaatggtgtgccaattggacagctggcacactctgtttggctttacatcgtcccaacaggcatgtctggagttgtgaactacctaaaggaaaagtaccagaatccaaccatcattatatctgaaaatggaatggatcaacctggaaacctgacgcgcgaggagtacctgcacgacaccgtgagggtcgatttctacaggaactacctcacggagctgaaaaaagggattgacgggggtgcgaacgtggtcgcctacttcgcctggtctctcctggacaacttcgagtggctgtcgggctacacgtccaagttcggcatcgtctatgtcgacttcacgacgctcaagcggtaccccaaggactcagcgtactggttcagggacatgctctcaggggcgggctcaaagtccgccacccctcagactggttcagatacttcagctggcagtccagctggttcggctccagctgcctcgagtggccctgccctcctggtttctctgctggtctccttgttcgtgcttgttccttccgccttcatcgtttcttccgcttagaaattatttggtctagtgtagcagcacttgatttgtagcggacgccagcagcatgttcattttcaagacatgttgcaacaaagagaaacctgttgtgcgaattcagggcttatttttgcccccttttgccatgattaagagccagtttggtactgatatcgtgtttactggataaatatatattatgctggttcatgtatctgcagttctgcactgattgagctgagctgcctctctgactgcctaacctccaagagttatgccgtcgagttcgttgtcatggtgggtaccggctgtctagtggatgtgttcttttcttt

SEQ ID NO: 2723 - DNA, 2165 bp, Panicum virgatum
cggcaggtatcctagtcgcacaatgccaaaaggtgggtgcagctcacttgacttcgaccgacgagagtgactgtgccttactgcctatgagtggaaggaggagacgcttgagctgagctgcggcggcgctgggatgggcgccgcggggtctgcggcgccgccgccggcggcagcgcattgccaccgggcactgctggccctggcgctcgtgtcgctctgcggccgcgggcttcgcgtccgtgccgcgggggcggacacgggcagcctgagcagggacgcgttccccaaggggttcgtcttcgggacggcgacgtccgcgttccaggtcgagggcgcggcggcgtccggcggccgggggcccagcatctgggaccccctcgtccacacccccggaaatattgctggagacgcgaacgcagatgttacaactgatgaatatcatcgctacaaggaagatgttgatctcatgaaaagcctgaatttcgacgcatatcggttttcaatctcttggtccaggatcttcccagatggtgaaggaaaagttaatgaagaaggtgtacaatattacaacaatcttatagactacatgattaagcaagggcttactccttacgccaaccttaaccactatgatcttccacttgcgcttcagaagaagtacaagggctggttaggcccaaaaattgtgggcatattcgctgactatgctgatttttgtttcaagacttttggagatcgagtcaagaactggttcacattaaatgagccgaggatagtagcatttcttggctatgatactggagttaacccccctaaccggtgcacccaatgcgctgccggtgggaactcagcaacagaaccttacattgttgttcataacattatattatctcatgctactgcagttgcaagataccgaaacaaataccaggcaactcagaaaggcaaggttgggatagttctagacttcaattggtacgaacctcttaccaactcaacggaagatcaagcagcagctcaaagagccagggacttccatgttggttggtttcttgatccattaataaacggaaactatccaaagacaatgcaggacattgtaaaagatcggttaccaagtttcacacctgagcaagctaagctagtcaagggctcatcagattattacgggatcaatcaatatactacatactacatttcagacaaacaaactcctcaacaagcagcaacaagctactcgtctgattggagcgttcaatataactttcaaagaaatggcgtgccgattggacagctggcacactccgtttggctttacatcgtcccaacaggcatgtatggagttgtgaactacctaaaggaaaagtaccagaatccaaccatcattatatctgaaaatggaatggatcaaccaggaaacctgacgcgcgaggagtacctgcacgacaccgtgagggttgatttctacaagaactacctcacggagctgaagaaagggattgatgagggcgcgaacgtggtcgcctacttcgcctggtccctcctcgacaacttcgagtggctgtcgggctacacgtccaagtttggcatcgtctacgtcgacttcacgacgctcaagcggtaccccaaggactcagcgtactggttcagggacatgctctctggggctggctcaaagtctgccacccctcagactggttcacatacttcagccggcagtccagctggttcgactccagctgcctcgtgtggcccggccctgctggtttctctgctggtctccttgtgcttgcttgttccatccgtcttcatcgtttcttcttagaaattatttggtctagtgtagcagcacttgatttgtagcgggcgccagcagcatgttcattttaaagacatgttgcaacaaagagaaacctgttgtgcgaacgggactatgattcagggctcattttttgcccccttttgccatgattaagaaccagtttggtactgatattgtgtttactggatatatgttatgctgattcgtgtatctgcagttcttgcactgattgagctgagctacctctctgactacctaacctccaagagctatgccgtcgagttccttgtcatggtgggtaccggctggctatgtgttcttttcttttgtttggcgactgagt

SEQ ID NO: 2724 - DNA, 1891 bp, Pennisetum glaucum
cgccgcggggtgagcgtctcgactggcggcagcgcatcgccgccggctgcagctgctgctggtggccctggcgctggtgccgctcggaggccgcgggttccgcgtccgcgccgtcggggcggacacgggcgggctgagcagggacgccttccccaaggggttcgtcttcgggacggcgacgtcggcgttccaggtcgagggcgcggcgaccaccaacggccgggggccctccatctgggaccccttcgtccacacccccggaaaaatcgctggagacgcgaacgccgatgttacaactgatgaatatcatcgctacaaggaagatattgatctcctgaaaagcctgaattttgatgcatatcggttttcaatctcctggtccaggatcttcccagatggcgaagggaaagttaatgaagaaggcgtccagtattacaacaatcttatagactacatggttaagcaagggcttactccgtatgccaaccttaaccattatgatcttccacttgcgcttgagaagaagtacaaaggctggttaggaccaaaaattgtggacaaattcgctgactatgccgatttttgtttcaagacttttggcgatcgggtcaagaactggttcacattaaatgagccaaggatagtatcattccttggctacgataaagggcttaacccccctaaccggtgcacccaatgtgctgccggtggcaactcagcaacagaaccttacactgttgttcataacattctcttatctcatgctactgcagttgcaagataccgtaataaataccaggcaactcagaaaggcaaggtcgggatagttctagacttcaactggtacgaacctcttaccaactcaacagcagatcaagcagcagcacaaagggccagggacttccatgttggttggtttatggatccattaataaatggacaatatccaaagacaatgcaggacattgtgaaagatcgtttaccaagtttcacacctgaacaggctaagctagtgaaaggctcatcagattgtttcgggatcaatcaatatactacatactatatttcagaccaacaaactcctcagcaaggaacaccaagctactcatctgattggggcgttcaatataactttgaaagaaatggccaacctattggacagctggcaaactccggttggctctacatcgtccccacaggcatgtatggagttgtgaactacctaaaggaaaagtaccagaatccaaccatcattatatctgaaaatggaatggatcaatctggaaacctcacacgtgatgagtacttgcacgacaccgtgagggtcgagttctacaagaactacctgacggagctgaagaaaggtatcgatgatggtgcgaacgtggtcgcctacttcgcctggtccctccttgacaacttcgagtggctgtcgggttacacgtccaagtttggcatcgtctacgtcgacttcacgacgctcaagcggtaccccaaggactcagcctactggttcagggacatgctctcaggggcaggctcaaaggcggccacccctcagactggttcacagagttcagccgccagcccggctggttcggctccggccgcctcgagtggcgctgccctgctggtttctctgttggtctccttgtgcttgcttgttccacccgtcttcatggtttccttagcttagatgatttggtcttgtgtaaaagtacttgattttgtagtgaacgccagcagcatgttcgttttaaagacatgtttgcaaggaagagggaccatgattcgatcagggatttttccttaactcctttttagtatgtttcagagccagatttgtactgatatcatgtttatggataagtgatgctttttggtgaaaaaa

SEQ ID NO: 2725 - DNA, 2028 bp, Echinochloa colona
cacgcacactcccacagacttccaccgacgagagtgactggcctgaggggaaggaaggaggcgcttgagctgagccgcggcggcaaccgtcgctcgctgggatgggcgccgcggggtgtgcggcgcattgccgccggctgcggcagctggtgctggccctggcgctcgtggcgcttggcgtcggcggcggccacggtgttcgcgtccgtgccgcgggggtggacacgggcgggctgagcagggacgcgttccccaaggggttcgtcttcggcacggcgacgtcggcgttccaggtcgagggcgcggcggcgtccggcggccggggaccctccatctgggaccccttcgtccacacccccggaaaaattgctggagacgcgaacgccgatgttacaactgatgaatatcatcggtacaaggaagatgttgatctcatgaaaagcctgaatttcgatgcatatcggttttcaatctcctggtccaggatcttcccagatggcgaagggaaagttaatgaagaaggtgtacagtattacaacaatcttatagactacatgattaagcaagggcttactccttacgccaaccttaaccactatgatattccacttgcacttcagaagaagtacaaaggctggttaggcccaaaaattgtggacatattcgctgactatgctgatttttgtttcaaaacttttggcgatcgggtcaagaactggttcacattaaatgagccaaggatagtatcattccttggctatgataaggggattaacccccctaacggtgcacccaatgtgctgctggtgcgactcagcaacagaaccttcattgttgttcataatattctcttatctcatgctactgcagttgcaagataccgcaataaataccaggcaactcagaaaggaaaggttgggatagttctagacttcaactggtatgaacctcttaccaactcaacagaagatcaagcagcagctcaaagggccagggacttccatgttggttggtttatggatccattagtaaatggacaatatccaaagacaatgcaggacattgtgaaagatcggctaccaagtttcacacctgaacaatctaagctagtcaagggctcatcagattgttttgggatcaatcaatatactacatactacatttccgaccagcaaactcctcagcaagcaggaacaagctactcgtctgattggggcgttcaatatatctttcaaagaaacggcgtacctattggacagctggcaaactccgtttggctttacatcgtcccaacaggcatgtatggagttgtgaactacctaaaggaaaagtaccagaacccaaccatcattatatctgaaaacggaatggatcaatctggaaacctcacgcgtgatgagtacgtgcacgacaccgtgagggtcgagttctacaagaactacctcacggaactgaagaaagggatcgacgatggcgcgaacgtggtcgcctacttcgcctggtccctcctggacaacttcgagtggctatcgggctacacgtccaagttcggcatcgtctacgtcgacttcacgacgctcaagcggtaccccaaggactcggcgtactggttcagagacatgctttcaggtgcgggctctaaggccgccacccctctgtcccctgcgtctggttcactaacttcggctccgacagcctcgagtgccccggtcctgctggtttctctgctggtttccttgtggtttcttgttccatccgtcttcatggtttcctctccttagaaataatttcagctagtgtgatagtacttggtttgtagcggacgccagcaccagcagcatgttcattttagagacatgttggcatgttgccgcgaagagggaccctgttgtgcgaatgggaccatgattcaggcctcattttttgccccctttttgctatgattcagagccagctttgtactgatatcatgtttatggataagtgatgctttttggtgtatctgcattgattgagctgaggtgcccc

SEQ ID NO: 2726 - DNA, 1318 bp, Saccharum officinarum
ttcgcggccgctcaccactgggtagaaagctagctagccgatccaagtgccagcagggagcgagggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccggactcgcgcagctcattggactcgccggagagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctacgtgggaagtactgtgtttgctttgatcccctcgacggttcctccaacatcgactgtggcgtctccatcggaacgatctttgggatttacatgatcaaggacaaggacaatgtcactctgtccgacgtactgcaacctggcaaggacatgcttgccgctggatactgcatgtatggcagttcctgcacgcttgttctgagcactggaactggtgtcaatggcttcacacttgatccttcacttggcgagttcatactaactcatccagacatcaagatacctaagaaggggaagatttattcagtcaatgaagggaacgccaaaaattgggacgtgcctgttgcaaagtttgtggagaagtgcaaataccccaaagatggttcgccaccaaaatctttgagatacattggaagtatggttgctgatgtgcaccgtaccttgctatatggaggtgtatttttgtaccctgctgaccagaagagcccaaatggaaagctccgtgtcctttatgaagttttccccatgtcattcctaatggagcaggctggaggtcagtccttcacaggcaaagaacgggctcttgatctggtcccaaccaagatccacgagagatccccgatattcctcggcagctacgacgatgtggaggaaatcaaagcattgtacgccgagcaggcaaagtcaagctcagcttgatcggggaacccaaatgaggttcctggctctgctgtgacctgattcagagtttcagacatttctttccttggtgtcgtcgtaagtttgtaacattcagtgtaatatatagtagggaggcccagaacagcttcacaagcaactaagggcctccgtaaaagttacatactcatatacatgcatgcacatatgcatctctagcacctaaaaaaaaaaaaa

SEQ ID NO: 2727 - DNA, 1288 bp, Zea mays
gtgcccgcgcgctcactgcactccgtgatcaccaccacaccgctatcctgctagctaggtagctgaattcggagccaggctcgagcgaggggagggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggctcttgatctgatcccaaccaagatccacgacaggtccccgatattcctcggaagctacgacgacgtggaggagatcaaagcgttgtacgccgagcaggcgaagtcgagctcggcttcatcctaagtgagggtgtaaatcgacttttcctggcttaatttgttgcttacctgattcagacattcgtttccgtttcccttggtgtcgtcgtaagtgtgacattcagtgcaatatgtatagcaactaagggactccgtaaaagttacatgc

SEQ ID NO: 2728 - DNA, 1712 bp, Pennisetum glaucum
gaggggataggcctccccgccgattccgttggatctccgcggcccatggctcccagcctcactttccgccccccacctccacgcgctactgcctactactactccaccccgcagagaggaaaacaaccgcgcgcgcgcgacacgtcacgtcacgcccaggccagccagccagccagccagccagttcgcggccggcgcgggagctagcctagctagatataccccgcgcgcggggagcactcgtggcccgcgcgtttctgcactgcgcgatcacctgctagctagctagccgaccgaagaggaggagggcgcggcggcggcggcgaagaggaggaggggggacgagatggatcacgcggcggacgcgcaccggacggacctgatgaccatcacgcggcacgtgctgaacgagcagagccggtaccccgagtcccgcggcgacttcaccatcctgctctcccacatcgtcctcggctgcaagttcgtcgcctccgccgtcaacaaggccgggctcgccaagctcatcggcctcgccggcgagaccaacgtccagggagaggagcagaagaagctggacgtgctgtcgaacgaggtgttcgtcaaggccctcgtcagcagcggccgcacctgcgtccttgtgtccgaggaggacgaggaggcaacgttcgtggaccctcagctgcgtgggaagtactgtgtctgctttgatccactcgatggctcctccaacatcgactgtggcgtctccatcggaacgatctttggaatttacatgatcaaggacaaggacaatgtgactctggaggacgtactgcagcctggcaaggatatgcttgccgccggatactgcatgtatggcagttcctgcacgcttgttctgagcaccggaagtggtgtcaatggcttcacacttgacccttcacttggggagttcatactgactcatccagatatcaagatgcctaagaaggggaagatttattcagtcaacgaagggaatgccagaaactgggacgcacctacggcgaagtttgtggagaagtgcaaataccccaaagatggttcgtcacctaaatctttgagatacattggaagtatggttgctgatgtgcaccgcaccttgctatatggaggtgtatttctgtaccctgctgacgagaagaacccaaatggaaagctccgtgtcctgtatgaagttttccccatgtcattcctcatagagcaggctggaggccagtccttcacaggcaaagaacgggctcttgatctggtcccaaccaagatccacgacagatcccccatattcctcggcagctacgacgatgtcgaggagatcaaagcattgtacgcccaacaggcaaagtcgagctcggcttgatcatggcagcatcgaagttcaaaggtgtaaatcgacttactggtcttgctgtaactcgattcagagatttctttctcctgtgtcgttgtaagtttgtaacattcagtgtaatagtatggaggcctggaacagcttcacaagcaactaaaagggcctccttataagtaactacaacataatgctaatacatacatatatgtacacacacatctctagcagcaaaagctttctgttcctttcatcccttgccgagcatactgaatattagtggtgaaccaagtgtcgtcaagattactgtcgcaagctctgcaaaatgtactgcgcgtagagatcc

SEQ ID NO: 2729 - DNA, 2319 bp, Panicum virgatum
tttttgcgaggaaaatattttttcattaaccatgattaggtcacattacaatcttgcagcacatgttcaatacaactaggaacacttcctaaccaaacagccgagctgcaaacacccatgctgatttacttccaaaaaaaaaatcctccatgctgatagtcaccctcgcccgagcttgtggcgtgctggcattatcaggctcacaacctcccttgtgctgccaatctcaagttctcaaccagtcaccggacctgcgaaggcaattgtaaagcaactcccggaatggaccggcacctccgcacctgcctagcgtaaaggcgaaccgtccaatcggcatggtatcctagcggccgccatggcgctctcacttttgatttttgaagccggaccaggcatattccacgcgtaaccgccaggccatcagggcggcggtaaccctgcatcatggtcatggactcatgggagctgtgagctcccatttgccagtgacgagagccgtctcgctatcgcgtcggattcaggccgtgctgccgtggctacagcctagttgcctactgccctgcttggtcctaatcccccctgcccgcgttgccgccttcccccgccgtttcgtcggcaggcgccacgacgggacaacgcctcgctctcgtcccctaccatcgcaacgtcctgccgcgcgccacggacgccgccgcacccaccaccacaagccgcagcggatagatggataggcctccgcgccgattccgttggagctccgcggcccttggctcccagcctcactttccgctcgcccgccgcgccgcgctaccccacccggcaccgccagaggaaaaccaccgcgcgacacgtcacgccgatgccagccacccacccagctcccggccgcgccggtaagctcgtgtcccgctcgctctgcactgcgcgatcactagctacttcagctagctagctagccagccagccgaacgaagagggagggtgggcagcgagcgcggcggcggcggcggcggcgagatggaccacacggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcgaagctcatcggactcgccggcgagaccaacgtccagggagaggagcagaagaagctggacgtgctgtccaacgaggtgttcgtcaaggccctcgtcagcagcggccgcacctgcatacttgtgtcggaggaggacgaggaggcaaccttcgtggatcctgcgctgcgtgggaagtactgcgtctgctttgatccgcttgatggctcctccaacatcgactgtggcgtttcaatcggaacgatctttgggatttacatgatcaaggacaaggacaatgtgacgctggaggacgtgctccagcctggaacgaacatgcttgctgcgggatactgcatgtatggcagttcttgcacgcttgttctgagcactgggagtggtgtcaatggcttcacacttgacccatcacttggcgagttcatactgactcatccagacatcaagatacctaagaagggaaagatttattcagtcaatgaagggaatgccaaaaattgggatgcggctgttgcgaagtttgtggagaagtgtaaataccccaaagatggttcgccacctaaatctttgagatacattggaagtatggttgctgatgttcaccgtaccttgctctatgggggtgtatttttgtaccctgctgacaagaagagcccgaatggaaagctccgtgttctgtacgaagttttccccatgtcattcctcatggagcaggctggaggtcagtccttcacaggcaaagaacgggctcttgatctggtcccaaccaagatccacgagagatccccggtattcctcggcagctacgacgacgtggaagagatcaaagcattgtacgccgaactggcaaagacaagctcggcttgatcagggcatcatacgaggtgtaaatcgacttcctggccttgctgtaacttgattcagacatttcttacctttgtgtcgtcttaagcttgtaagattcagtataatagtatggaggccttgaacatcttcacaagcaactaaaaaggcctccttacaagttacaacatgacgctaatacatacatgtatacatctctagcagctaagtcttgtgttctctggctaagcacactcatagttcattcaattcgacttttcgacacacgccaag

SEQ ID NO: 2730 - DNA, 1755 bp, Panicum virgatum
tcgatcgctctcccctaccatcccgtcgccctgcgttgccgcgcgccacggacgccgccgcacccaccaccacaagccgcagcggatagagggataggcctccgcgccgattccgttggatctccgcggcccttggctcccagcctcactttccgttcgcccgccgcgccgggccgcgctaccccacccggcagaggaaaggaaaaccaccgcgcgacacgtcacgccgatgccagccacccacccagctcccggccgcgccggcatataccctgcgcccgggagcagccggtgagctcgtgccccgcgcgctctccgcactgcgcgatcactagctagccagccagccagccgaacgaacgaagagggagcgaggaagggcgtgcgagcgcggcggcgtcgtcggcggcgagatggaccacacggcggaggcgcaccagacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgccaagctcatcggcctcgccggcgagaccaacgtccagggagaggagcagaagaagctggacgtgctgtccaacgaggtgttcgtcaaggccctcgtcagcagcggccgcacctgcgtccttgtgtcggaggaggacgaggaggcaacgttcgtggatcctgcgctgcgtgggaagtactgcgtctgctttgatccgctcgacggctcctccaacatcgactgtggcgtctcaatcggaacgatctttgggatttacatgatcaaggacaaggataatgtgactctggaggacgtgctgcagcctggcacgaacatgcttgctgcgggatactgcatgtatggcagttcctgcacgcttgttctgagcactgggagtggtgtcaatggcttcacacttgacccatcacttggcgagttcatactgactcatccagacatcaagatacctaagaagggaaagatttattcagtcaatgaagggaatgccaaaaattgggatgcggctgttgcgaagtttgtggagaagtgtaaataccccaaagatggttcgccacctaaatctttgagatacattggaagtatggttgctgatgttcaccgcaccttgctctatgggggtgtatttttgtaccctgctgacaagaagagtccgaatggaaagctccgtgtcctgtatgaagttttccccatgtcattcctcatggagcaggctggaggtcagtccttcacaggcaaagaacgggctcttgatctggtcccaaccacgatccacgagaggtccccggtattcctcggcagctacgacgacgtggaagagatcaaagcattgtacgccgaactggcaaagacaagctccgcttgatcagggcatcatacgaggtgtaaatcgacttctggccttgctgtaacttgattcagacatttcttacttttgtgtcgccttaagcttgtacggggtaagattcagtataatagtatggaggccttgaacagtttcacaagcaactaaaaaggcctccttacaagttacaccatgaccctaataatacatacatgtatagtacatctctagcagccaaggcttgtgttctctggctaagcatactcatagttcaattcgacttctcgacacatggcaagtactggactactggtggagaaccaagtgccca

SEQ ID NO: 2731 - DNA, 1458 bp, Echinochloa colona
ttgccccttgcgagatcacactatctagctcattagctacctagccggagagcgagagggaggccggcgcggcggcgaagcggaggggaaaaggctggcaagatggactacgcggcggacgcgcaccagacggacctgatgaccctcacgcggcacgtgctgaacgagcagagccggtaccccgagtcccgcggcgacttcaccatcctgctctcccacatcgtcctcggctgcaagttcgtcgcctccgccgtcaacaaggccggactcgcgaagcttattggacttgccggcgagaccaacgtgcagggagaggagcagaagaagctggacgtgctgtccaacgaggtgttcgtcaaggccctcgtcagcagcggccgcacctgcgtccttgtgtccgaggaggacgaggaagcaacgttcgtggaccctaagctacgtggaaagtactgcgtctgctttgatccactcgacggctcctccaacatcgactgcggcgtctcaatcggaacgatctttgggatttacatgatcaaggacaaggacaatgtgactctggaggacgtactgcagcctggcaaggacatgcttgctgccggatactgcatgtatggcagttcctgcacgcttgttctgagcagtggaagtggtgtcaatggcttcacacttgacccatcacttggcgagttcatactgactcatccagacatcaagatacctaagaaggggaagatttattcagtcaatgaagggaatgccaaaaattgggacgcgcctactgcgaagtttgtggagaagtgcaaataccccgaagatggttcatcacccaaatctttgagatacattggaagtatggttgctgatgtacaccgtaccttgctctatgggggtgtatttttgtaccctgctgacgagaagaacccaaatggaaagctgcgtgtactgtatgaagttttccccatgtcattccttatggagcaggctggaggtcaggcattcacaggcaaagaacgggctcttgatctggtcccaaccaagatccacgaaagatccccgatattcctcggcagctacgacgacgtggaggagatcaaaacattgtacgctaaactggcaaagtcaggctccgcctgacgggcgcatcataccaggtgtacatcgacttcctggccttgccgtggcccgattcagacatttcttttctcggtgttgtcctaagcttgtaacattcagtgtaatactattatggaggcctggaacagcttcacaaggccttcctacaagttacaagatactacatatacatgtatacatctctagcagcaaaagctttgtattccctggccaactcaaagagttggactcgtgagttggactcaactcttccacttccacgcagtacagtactagcgaaccaagtattaagactactgtcgcaagctatgcgaaatgtattgt

SEQ ID NO: 2732 - DNA, 1922 bp, Setaria italica
ccgctttcgcgtcggactcaggccgccgctactcccatacttggtcctaatccccccttcccgcgttggcgccttcccccggcggggcggtttcttccgcacgcgccacgacgtgacaaacccctcgctctccgtcccctgctaccatcctaacgtcctgcgcggctacgtacgccaccgcgccaccacaagcgcccagccagccgcagcggatagaggggataggcctccccgccgattccgttggagctccgcggcccttggctcccagcctcactttccgctgccctccacgcgctacgaccccacctcgcagaggaaacccaccgcgcgacacgtcacgccgaggccagccagccagttcccggccggcgcgggagctagatataccctgcgcgctggaagagccggtaagctcgtgccccgcgcgatcacctgctagccggccgaagaggaggaagaggagggcgcggcggcggcgaagaggagggggacgagatggaccacgaggcggacgcgcaccggacggacctgatgaccatcacgcggcacgtgctgaacgagcagagccggtaccccgagtcccgcggcgacttcaccatcctgctctcccacatcgtcctcggctgcaagttcgtcgcctccgccgtcagcaaggccggactcgcgcatctcattggacttgccggcgagaccaacgtccagggagaggagcagaagaagctggacgtgctgtcgaacgaggtgttcgtcaaggccctcgtcagcagcggccgcacctgcgtccttgtgtccgaggaggacgaggaagcaacgttcgtggaccctaagctgcgtggaaagtactgtgtttgctttgatccactcgatggctcctccaacatcgactgtggcgtatccatcggaacgatctttggaatttacatgatcaaggacaaggacaatgtgactctggaggacgtactgcagcctggcaaggacatgcttgccgccggatactgcatgtatggcagttcctgcatgcttgttctgagcactggaagtggtatcaatggcttcacacttgacccttcacttggggagttcatactgactcatccagatatcaagatgcctaagaaggggaagatttattcagtcaatgaagggaatgccagaaactgggacgcacctacggcgaagtttgtggagaagtgcaaataccccacagatggttcgtcacctagatctttgagatacattggaagtatggttgctgatgttcaccgtaccttactatatggaggtgtatttttgtaccctgctgacgagaagaacccaaatggaaagctccgtgtcctgtatgaagttttccccatgtcattcctcatggagcaggctggaggccagtccttcacaggcaaagaacgggctcttgatctggtcccgaccaagatccacgagagatccccagtattcctcggcagctacgacgacgtggaggagatcaaagcactgtacgccgaacaggcaaagtcaagctcggcttgatcatggcagcatcaaagttcaaaggtgtaaatcgacttcctggccttgctgtaactcgattcagacatttctttctcctgtgtcgtcgtaagtttgtaacattcagtgtaatagtatggaggcctggaacagcttcacaagcaactaaaagggcctccttataagttacaacataacgctaataaatacatatatagtacatctctagcaagagtagtggtgaagcaagcgtcaagactactgtcgcaagctctgtaaaatgtactgcgcatagagatccctgcaaaagagtgatcgtgtcacaaaatattcgttatcggaagacgaaaattcatcctctggtctgaaatgctcgatgacactaacatggagtacttgatggcatcacgggc

SEQ ID NO: 2733 - DNA, 2279 bp, Setaria italica
ctcacttgaagctggaccagggaaccaccactccaccaggcatattccacgcgtaacggccaggccatcagtcagttaaccctcctgcatcatcatcacgtggagcacccatcccgccagggaggccgtctcgccgctttcgcgtcggactcaggccgccgctactcccatacttggtcctaatccccccttcccgcgttggcgccttcccccggcggggcggtttcttccgcacgcgccacgacgtgacaaacccctcgctctccgtcccctgctaccatcctaacgtcctgcgcggctacgtacgccaccgcgccaccacaagcgcccagccagccgcagcggatagaggggataggcctccccgccgattccgttggagctccgcggcccttggctcccagcctcactttccgctgccctccacgcgctacgaccccacctcgcagaggaaacccaccgcgcgacacgtcacgccgaggccagccagccagttcccggccggcgcgggagctagatataccctgcgcgctggaagagccggtaagctcgtgccccgcgcgatcacctgctagccggccgaagaggaggaagaggagggcgcggcggcggcgaagaggagggggacgagatggaccacgaggcggacgcgcaccggacggacctgatgaccatcacgcggcacgtgctgaacgagcagagccggtaccccgagtcccgcggcgacttcaccatcctgctctcccacatcgtcctcggctgcaagttcgtcgcctccgccgtcagcaaggccggactcgcgcatctcattggacttgccggcgagaccaacgtccagggagaggagcagaagaagctggacgtgctgtcgaacgaggtgttcgtcaaggccctcgtcagcagcggccgcacctgcgtccttgtgtccgaggaggacgaggaagcaacgttcgtggaccctaagctgcgtggaaagtactgtgtttgctttgatccactcgatggctcctccaacatcgactgtggcgtatccatcggaacgatctttggaatttacatgatcaaggacaaggacaatgtgactctggaggacgtactgcagcctggcaaggacatgcttgccgccggatactgcatgtatggcagttcctgcatgcttgttctgagcactggaagtggtatcaatggcttcacacttgacccttcacttggggagttcatactgactcatccagatatcaagatgcctaagaaggggaagatttattcagtcaatgaagggaatgccagaaactgggacgcacctacggcgaagtttgtggagaagtgcaaataccccacagatggttcgtcacctagatctttgagatacattggaagtatggttgctgatgttcaccgtaccttactatatggaggtgtatttttgtaccctgctgacgagaagaacccaaatggaaagctccgtgtcctgtatgaagttttccccatgtcattcctcatggagcaggctggaggccagtccttcacaggcaaagaacgggctcttgatctggtcccgaccaagatccacgagagatccccagtattcctcggcagctacgacgacgtggaggagatcaaagcactgtacgccgaacaggcaaagtcaagctcggcttgatcatggcagcatcaaagttcaaaggtgtaaatcgacttcctggccttgctgtaactcgattcagacatttctttctcctgtgtcgtcgtaagtttgtaacattcagtgtaatagtatggaggcctggaacagcttcacaagcaactaaaagggcctccttataagttacaacataacgctaataaatacatatatagtacatctctagcaagagtagtggtgaagcaagcgtcaagactactgtcgcaagctctgtaaaatgtactgcgcatagagatccctgcaaaagagtgatcgtgtcacaaaatattcgttatcggaagacgaaaattcatcctctggtctgaaatgctcgatgacactaacatggagtacttgatggcatcacgggcagtgctcgctggctgaacctcgtccacggcaacctccttgttctcgttcttcttatctgaacatttcggtggatagttacatggtgcagcagaaatggaatggatatgaaagaagagatggcacgctgaggactttggaagcttacaatcttcgaagaatcgtcggatttcctggacacggtggggtgacagttcgctgaggtcattgtagtggcggtactcgg

SEQ ID NO: 2734 - DNA, 1330 bp, Eragrostis curvula
gcacgaggcaccctgccgtcgttgcactaagccaaagcgagtgaggagaggcgccggcggcggagcggggcgagatggaccacgcggcggaggcgcaccagacggacctgatgaccctcacgcggcacgtgctgaacgagcagagccggaaccccgagtcccgcggcgacttcaccatcctcatctcccacatcgtcctcggctgcaagttcgtcgcctcggccgtcaacaaggccggactcgcgaagctcatcggacttgccggcgagaccaacatccagggagaggagcagaagaagctggacgtcctgtccaacgagctgttcctccaggccctcgtcagcagcggccgcacctgcattcttgtgtccgaggaggacgacgaagccaccttcgtggaccccgcgctacgaggaaactactgtgtttgctttgacccccttgatggctcctccaacatcgactgcggtgtctccatcggaaccatctttgggatttacatggtcaaggacaaggacaatgtgactctgaatgacgtgttgcagcctgggaaaaacatgcttgctgctggctactgcatgtatggcagttcctgcacgcttgttcttagcactgggaacggtgtcaatggcttcacacttgatccgtctcttggggagttcatactgactcatccaaacatcaagatacctaagaagggaaagatatattctgttaatgaagggaatgccaaaaattgggacgagcctacggcgaagtttgtggagaagtgcaaataccccaaggatggttcgccacctagatctttgagatacattggaagtatggttgctgatattcaccgtaccttgttatatggaggtgtatttttgtaccctgcagaccagaagagcccaaatgggaagctccgtgtcctatatgaggttttccccatgtcattccttatggaggaagctggaggccagtctttcaccggaaaagaacgggctcttgacctcgtccccaccaagattcacgagagatctccgattgtcctgggcagctacgacgacgtggaggagatcaaagcattgtacgccgaacaggcaaagtcgagctcgggctgatcagagcatcataagaggtgtaaatcgacttgttcccggccttgttgcgacatgaatcagacatttgtttcgttggtcttattgtaaaattgtaacatcaagtgtatggaggcctggaactgcttcacaagcaacaaaaggcttctatttcttacaaccgttcactacatacaaaagtacatgtcttgcagctaagacaaatttacgctccctggcaaaatcta

SEQ ID NO: 2735 - DNA, 1444 bp, Oryza sativa
gtgaccaatactcaacacttaaaccgcgcgctttttagccgacccgagcagccggagagtgaggcgaggcgaagcgaagggaagagcgcgaggcagagtaagcagacgagaagaacagcgcgcggcgcggtagctgaggagagtggtgcggagatggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggccgggctcgccaagctcatcgggctggccggcgagaccaacgttcagggagaggagcagaagaagctagacgtgctgtccaacgaggtgttcgtcaaggctctcgtcagcagcggccgcacctgcgttcttgtctccgaggaggacgaggaagcgacgttcgtggaccctgcgctgcgtgggaagtattgcgtgtgctttgatccactcgacggctcctccaacatcgactgtggcgtctccatcggaacgatctttgggatctacatgatcaaagataaggagaatgtgactcttgaggacgtgttacagcctggaaaaaacatggttgctgctggatactgcatgtacggcagttcctgcacgcttgttctgagtactggaaatggtgtcaatggcttcacacttgatccatctctcggggagttcatattaactcatccagacatcaagataccaaagaaagggaagatttattcagtgaatgaagggaatgcgaaaaattgggacgagcctaccgcaaagtttgtggagaagtgcaagttccctaaggatggttcatcacctaaatccttgagatacattggaagtatggttgctgatgtccaccgtacgttgctatatggaggagtatttttgtaccctgcagacaagaagagcccaaatggaaaactccgtgttctgtatgaagttttccccatgtcattcctgatggagcaggctggaggccagtctttcacaggcaaagaacgggctcttgacctcgttcctaccaagattcacgagagatccccaatatttcttggaagcttcgaagatgtggaggagatcaaagggttgtacgctgcacaggcgaagtaagctcggtttgatcgatctggcaccatcaaggcgtgcgaatggactccctggccttactgtaacatgcatgattcgtcaggcacttcttttattcgtcttactgtacgtttgtaaaattcagtgtaatagtgttgaggcctggaacagcttcatgagcaactaaggccttttctactattatttacaaaatacatacaccgtgcatctctagcagctaaagcactaatacaacaagtcactaaggcaaacctgtgcttcctgtcttcctggc

SEQ ID NO: 2736 - DNA, 2402 bp, Sorghum bicolor
gccccatggtgtggcctcgtcaacacaacactccggcatcacagggaggctacagctagcgaatcatccatccagtccagccgggaatccggtcatttccaccccccgtgccctgctttctcgggcacgcagcagatgagcacgcttgcttccttgacccgcaccaacaagtcacagccgtcagcttcctgagcatatcgcggtcgcgcggtagatatccgcgcccatgcggcacagacgtggaacccgcatccccatcgcattcccccgcccggcaccgacgcgccggcgcctatttcaagccaccacggaccgtagcctacggctgtcagatgcctctcaacttttaaccatccgcagctcgccgccagtccgcaccacgtcccaacaacttgccaatttgcaccgcgagaaacggcgccgtcctgccgctccgctccgcggctccggccgtgacacgacacgagcgcacacgccctccgccccgtcgcgcgcgccacaggacaaaggcgtccccaaccgccgccccatctcctatcgtcatctgcctgccgatcgatcgatccctcccctcagctagctagcctcactcaccacccctcccccaacacagtccaagaacccgtatagtccgggcgagctagagctagaggggaccgaaccgggcgggcaggcgagcggaggaggcgaaggaagacatggaccacgcggcggaggcgcagcggacggacctgatgacgatcacgcggcacgtgctgaacgagcagagccgccacccggagtcccgcggcgacttcaccatcctcctctcccacatcgtcctcggctgcaagttcgtcgcctccgccgtcaacaaggccggcctcgccaagctcatcggcctcgctggcgagaccaacgtccagggtgaggagcaaaagaagctggatgtcctgtccaacgaagtctttgtcaaggcgctcgtcagcagcggccgcacctgtgttcttgtgtctgaagagaacgaggaggccatcttcgtcgacccggccctccgcggaaagtactgcgtttgtttcgatccgctggatggctcctccaacatcgactgcggtgtctccatcggaacaatctttgggatttacatgatcaaagataaggacaacgtgactttggaggatgtacttcagcctggaacaaacatgcttgctgctggctattgcatgtatgggagttcctgcacgcttgtgttgagcacgggaaatggagtcaatggtttcactcttgatccttcccttggggagttcattttgacccatccaaatatcaagataccaaagaaagggaagatttattcagtcaacgaagggaatgccaaaaactgggatgggcctacagcaaaatttgtggagaaatgcaaatatcctcaggatggttcaccgcctaaatccttgagatatattggaagtatggttgctgatgtccatcgtaccttactatatgggggcatatttttgtacccagcagaccagaagagtccaaacggaaaactacgtgttctgtatgaagtcttcccgatgtcattcctgatggaacaagctggaggccagtctttcacaggaaaacaacgggcccttcaacttgctcccgctaaacttcacgacagatccccaatattcctcgggagctacgatgacgtggaggagatcaaagcactgtacgcttcagagtcaaacaatgcttgatctttctgtctgaggacactcgcggtcgcagagatcaaagcactgtatgcttcagagtcaactgcttgatctttaaattaaattataataaaaaagttgtaaaaacagcactgcttgatctttctgcccgaggacaagcgcatcagacaagcgcatcatccacattgtaattgtattcatcagatatttattgtgttcttgccatctacgtaaaaatccattctacggccggttacggtacaactgaatagtacaggcttatgtttttttttacaaatttaacatgctttcgtgattccttgatacaaatttggattcatgtataaggaggaactttttatgaagacatattacttgtgcagtttatctcaaaaaaaaaaatgtactgatacaaatttggattcatgtaaggagggagttatgcttggcccctggttttggatgtcctgttcatcatcagatttgtgatgcgccaaccgtcctttacattgacctatgcatagcagttagccagttagactgttcctgtgcacatttttttttcccgaacacaagggccttgtttagttccaaaaaattttgcaaaatttttcagattccccgtcacatcgaatctttagacacatgcatgaagtactaaatatagacaaaaataaaaactaattgcacagtttggtc

SEQ ID NO: 2737 - DNA, 1459 bp, Echinochloa colona
ccgctcccaacaatttgccaatccgcgccgctcgccacgtcgtgacgcgcgcgcacccgcccgcccgtccccgtcgcgccacagccacaggacaaggcgcccccaaccgccgcccatctcatatcgtcacctgcctgccgatccctcctccctcggctcctcccacctctccgcacaccaaattccaaaaagccgtagagcgcgggtgatccggcctgatcagccgagagcgagcgggcgaggggaacacagccggcgggcagggaagggatcggagcgcgaagaggagcagctaggatggaccacgcggcggaggcgcagcggacggacctgatgacgatcacgcggcacgtgctgaacgagcagagccgccacccggagtcccgcggcgacttcaccatcctcctctcccacatcgtcctcggctgcaagttcgtcgcctcggcggtcaacaaggccgggctcgccaagctcatcggcctcgccggcgagaccaacgtccagggtgaggagcagaagaaactggatgtgctgtccaatgaggtctttgtcaaggcgcttgtcagcagcggccgcacctgcgttcttgtgtctgaagagaacgaggaggccatattcgtcgacccagccctccgtggaaagtactgcgtttgtttcgatccgctagacggctcctccaatatcgattgtggtgtctccatcggaacaatctttgggatttacatgatcaaagataaggacaatgtgactttggatgatgtactacaacctggaacagacatgcttgctgctggctactgcatgtacggaagttcctgcacgcttgggttgagcactgggaatggagtcaatggtttcactcttgatccttcccttggggagttcatactaactcatccgaacatcaagatgccaaagaaagggaaaatttattctgtcaatgaagggaatgccaaaaactgggatgtgcctacagcgaagtacgtggagaaatgcaagtttccccaggatggttcatcgcctaaatcattgagatatattggaagtatggttgctgatgtccaccgtaccttgctatatggtggcatatttttgtacccagcagaccagaagagcccgaatggaaaactccgtgttctgtatgaagtctttccgatgtcattcctgatggaacaagctggaggtcaggctttcacaggcaaacaacgggcccttgaacttgctcctactaagattcatgacagatccccaatattcctggggagctacgatgatgttgaggagatcaaagcattgtacgcttcagagtcaagcacagtttgatctgtcaactgtattcatcagatatttatgttctgttcttgccttgttggcctttaacgtaaaatatccatactgtacggatacggatacagtacaactcaataaggctatccgcactcgtcctgcttcaacacat

SEQ ID NO: 2738 - DNA, 1225 bp, Brachypodium distachyon
cggaacaacgatcagggcggcgccggcgagatggatcacgcggcggacgcgcaccggacggacctgatgaccatcacgcggcacgtgctgaacgagcagagcaagtacccggagtcccgcggcgacctcaccatcctcctctcccacatcgtcctcggctgcaagttcgtcgcctccgccgtcaacaaggccgggctcgccaagctcaccggcctggccggcgagaccaacgtccagggagaggagcagaagaagctggacgtgctgtccaacgaggtgttcgtcaatgcgctcgtcagcagcggccgcacctgtgttcttgtgtccgaggaggacgaggaggctacgttcgtggcccctgcgctccgtgggaagtactgtgtctgcttcgatcccctggatggctcctccaacatcgactgtggcgtctccatcggaaccatctttggaatttacatgatcaagaaccaagacaccgtgactctggaggaagtgctgcaacctgggaaggacatgattgctgctggatactgcatgtatggaagttcctgcacgcttgttcttagcactggaaatggtgtcaatggcttcacgcttgatccttctcttggagagttcatcatgactcatccagacatcaagatacctccaaaaggaaagatttattcggtgaatgaagggaatgcgaagaattgggacacacctactgcaaagtatgtggagaagtgcaagttccctacggatggttcatcacccaagtccttgagatacattggcagcatggttgctgatgtccaccgcaccttgctatacggaggtatatttctgtaccctgcagacaagaagagcccaaacggaaaactccgtgtcatgtatgaagtcttccccatgtcattcctgatggagcaagctggaggccagtctttcacaggcaaagaacgggctctcgatctgatcccaacaaagatccacgagagatcccccatatttctcggcagcagcgacgacgtggaggagatcaaggcgctgtacgcggaacaggcgaaagcaacctcggcatgatcggtcatccgaaaggcggtgtgaatcgacacaactccctggccttactgtaatgtgatcttcatcaggcgtttcttttaatcatgcggcattcagtatttcagtgtaatatagtgtggaggcctcgaacagcttcctgagcggctatggcctctgctcgtgt

SEQ ID NO: 2739 - DNA, 1266 bp, Brachypodium distachyon
ggaacaacgatcagggcggcgccggcgagatggatcacgcggcggacgcgcaccggacggacctgatgaccatcacgcggcacgtgctgaacgagcagagcaagtacccggagtcccgcggcgacctcaccatcctcctctcccacatcgtcctcggctgcaagttcgtcgcctccgccgtcaacaaggccgggctcgccaagctcaccggcctggccggcgagaccaacgtccagggagaggagcagaagaagctggacgtgctgtccaacgaggtgttcgtcaatgcgctcgtcagcagcggccgcacctgtgttcttgtgtccgaggaggacgaggaggctacgttcgtggcccctgcgctccgtgggaagtactgtgtctgcttcgatcccctggatggctcctccaacatcgactgtggcgtctccatcggaaccatctttggaatttacatgatcaagaaccaagacaccgtgactctggaggaagtgctgcaacctgggaaggacatgattgctgctggatactgcatgtatggaagttcctgcacgcttgttcttagcactggaaatggtgtcaatggcttcacgcttgatccttctcttggagagttcatcatgactcatccagacatcaagatacctccaaaaggaaagatttattcggtgaatgaagggaatgcgaagaattgggacacacctactgcaaagtatgtggagaagtgcaagttccctacggatggttcatcacccaagtccttgagatacattggcagcatggttgctgatgtccaccgcaccttgctatacggaggtatatttctgtaccctgcagacaagaagagcccaaacggaaaactccgtgtcatgtatgaagtcttccccatgtcattcctgatggagcaagctggaggccagtctttcacaggcaaagaacgggctctcgatctgatcccaacaaagatccacgagagatcccccatatttctcggcagcagcgacgacgtggaggagatcaaggcgctgtacgcggaacaggcgaaagcaacctcggcatgatcggtcatccgaaaggcggtgtgaatcgacacaactccctggccttactgtaatgtgatcttcatcaggcgtttcttttaatcatgcggcattcagtatttcagtgtaatatagtgtggaggcctcgaacagcttcctgagcggctatggcctctgctcgtgttacaacgattaatcactgatatacggtcgtaatatttccgtc

SEQ ID NO: 2740 - DNA, 1798 bp, Panicum virgatum
ttttatgttttgcgtatgtataattagtgctaataatgatctattcgtatgcttagttccaacaaaggtgattaacacccggggtgttacaacgcttccttcctctgcttcgcttcgcttgaccgcgcggcgcggtggcacaagtcagcttccgttgccgagcataccacggcaggcgtccgcacccatgcggatcagaatcagatcagacgtggagcctcatctcctcgtcctccggccgccccctatttcatccaccgagtccgtgcgtccccgttccgccgtcgcgccacaggacaaggcgccccaaccgccgcccatcttctgcagtcatccaccgatcccgcggctcctcctcttcctcccagtcccagctaggtagccccgccttcaccacttcacctcccggctccctcctccccccaccagagctgaaaacccgttggaggagagcggagagggaaggcgatggaccacgcggcggaggcgcagcggacggacctgatgacgatcacgcggcacgtgctcaacgagcagggccgccacccggagtcccgcggcgacttcaccatcctcctctcccacatcgtcctcggctgcaagttcgtcgcctccgccgtcaacaaggccgggctcgccaagctcgtcggcctcgccggggagaccaacgtccagggtgaggagcagaagaagctcgatgtgctgtccaacgaggtctttgtcaaggcgctcgtcagcagcggccgcacctgcgttcttgtgtctgaagagaacgaggaggccatattcgtcgacccggcactccgtgggaagtactgcgtttgtttcgatccgctggatggctcctccaacatcgactgtggtgtctccatcggaacaatcttcgggatttacatgatcaaagataaggataatgtgactttgggtgatgtgctgcaacctggaacaaacatgcttgctgctggctactgcatgtacgggagttcctgcacgcttgtgttgagcactgggaatggagtcaatggtttcactcttgatccttcccttggggagttcattctgactcatccgaatatcaagatacccaagaaagggaagatctattctgtcaatgaagggaatgctaaaaattgggatgtgcctacagaaaagtatgtggagaaatgcaagtttccccaggatggttcatcgcctaaatcattgagatatattggaagcatggttgctgatgtccaccgtaccttgctatatggaggcatatttttgtacccagcagaccagaagagcccaaacggaaaactccgtgttctgtatgaagtcttcccaatgtcattcctgatggaacaagctggaggtcaagctttcacaggaaaacagcgggcccttgaacttgctcctactaagcttcatgacagatccccaatattccttgggagctacgatgatgttgaggagatcaaagcattgtacgcttcagagtcaagcactgcttgatctgtctgtctgagtgcatcattctcctgggagaaaattgtaactgtattgatcagttatttatgttctgttcttgccttcttggccttataatgtaaaatatccatactatacggacacagtataggtcaataagcaaccgaggcttatgtttcacatacattttacttgctatatatgtgattccttgctaaatcaaatctgaactggaaacatatgaagacatgtttcgaaaggtggcaggtgagctgccgactgtattaaaaagatgaagacatgtgcgattgtccttggttgctacttc

SEQ ID NO: 2741 - DNA, 1859 bp, Panicum virgatum
aattgcctgcggaatcgggtttccattcgattccagcatgatccatccatccaaccaggaacccagtcacccgcccagccgcccagttggccggactccccctcgtttctcggccacgcttcctctactccgcttcgcttgaccgcgcgcggcgcggtggcacaagtcagcaggttccgttgccgagcatatcacggtaggcgtccgcgcccatgcggatcagcatcagatcagacgtggagcgagtccgcagcctcatctcctcgccctccggccggccggccccctatttcaagccacggatcctccgttgccgctcacttgtaaaagttgtaaccgcccgccgctcccaagtcccgtcaacttgcgagaaacggcgccgcccagcaccgcgacgtcgcgacgcgcgcgcacccgcccgagtccgtccgcccccgtcgcgccacaggacaaggcgccccaaccgccgcccatctcctgtagccatccgccgatccattcaccctcggctcctcctcccagctagagctaggtagccccggctcccttcccttcccccaccagagctcgctcagaggccgttggaggagagcgcgcgtagggggcgagacgacgatggaccacgcggcggaggcgcagcggacggacctgatgacgatcacgcggcacgtgctcaacgagcagggccgccacccggagtcccgcggcgacttcaccatcctcctctcccacatcgtcctcggctgcaaattcgtcgcctccgccgtcaacaaggccgggctcgccaagctcgtcggcctcgccggggagaccaacgtccagggtgaggagcagaagaagctggatgtgctgtccaacgaggtctttgtcaaggcgctcgtcagcagcggccgcacctgcgttcttgtgtctgaagagaacgaggaggccattttcgtcgacccgcaactccgtgggaagtactgcgtttgtttcgatccgctggatggctcctcaaacatcgactgtggtgtctccatcggaacaatcttcgggatttacatgatcaaagataaggataatgtgactttgggtgatgttctgcaacctggaacaaacatgcttgctgctggctactgcatgtacgggagttcctgcacgcttgtgttgagcacggggaatggagtcaatggtttcactcttgatccttcccttggggagttcattttgactcatccgaacatcaagatacccaagaaagggaagatctattctgtcaatgaagggaatgccaaaaactgggatgtacctacagcaaagtatgtggagaaatgcaagtttccccaggatggttcatcgcctaaatcattgagatatattggaagcatggttgctgatgtccaccgtaccttgctatatggaggcatatttttgtacccagcggaccaaaagagtccaaacggaaaactccgtgttctgtatgaagtcttcccaatgtcattccttatggaacaagctggaggtcaggctttcacaggaaaacagcgggcccttgaacttgctcctactaagcttcatgacagatccccaatattcctggggagctatgatgaggttgaggagatcaaagcattgtacgcttcagaatcaagcgccgtttgatctgtctgcctgaatgcatcattctcctgggagaaaattgtaactgtattgatcagttatttatgttctgttcttgccttcttggccttataatgtaaaatattcactatacggacacagtacaagtcaataagcaaccgaggcttatgtttcacacacattttacttgctattgtgattccttgctaaatcaaatctgaaatcgaaacatatgaaga

SEQ ID NO: 2742 - DNA, 1659 bp, Echinochloa colona
tcctatttcaagccacgggccccctagcctcctccgggcacatcagacgccgcaccgcgcacacacgcatcctcctccgttgcccgcttgtaaccatatccgccgctcccaacaatttgccaatcgcgccacaggacaaggcgccccaaccgccgcccatctcctatcgtcatcggccttccgatccctcggctctcctcccaccacccagctagcctcgcctccccggctccccacaacaccaaagtccaaaaagcccgtagagcgcgcgggaagggggtgatccggtccggcctgatcagccgagagcgggcgaggggatcgagccgacgagccggcgggcaggatcggagcagggcgaagaggaggatggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgcctcggcggtcaacaaggcggggctcgccaagctcatcggcctcgccggcgagaccaacgtccagggtgaggagcagaagaaactggatgtgctgtccaatgaggtctttgtcaaggcgctcgtcagtagcggccgcacctgcgttcttgtgtctgaagagaacgaggaggccatattcgtcgacccggccctccgtggaaagtactgcgtttgtttcgatcccctggatggctcctccaatatcgattgtggtgtctccatcggaacaatctttgggatttacatgatcaaagataaggacaatgtgactttggatgatgtactacaacctggaacaaacatgcttgctgctggctactgcatgtacggaagttcctgcacgcttgtgttgagcactgggaatggagtcaatggtttcactcttgatccttcccttggggagttcatactgactcatccgaacatcaagatgccaaagaaagggaaaatttattctgtcaatgaagggaatgccaaaaactgggatgcgcctacagcgaagtacgtggagaaatgcaagtttccccaggatggttcatcgcctaaatcattgagatatattggaagtatggttgctgatgtccaccgtaccttgctatatggtggcatatttttgtacccagcagaccagaagagcccaaatggaaaactccgtgttctgtatgaagtctttccgatgtcatttctgatggaacaagctggaggtcaggctttcacaggcaaacaacgggcccttgaacttgctcctactaagcttcatgacagatccccaatattcctggggagctacgatgatgttgaggagatcaaagcattgtacgcttcagagtcaagcacagtttgatctgtcaattgtattcatcagatatttatgttctgttcttgccttgttggccttaatgtaaaatatccatactgtacggatacagtataactcaataaggctatccgcactcatcctacttcaaacacatcatctaaaagaaatattccgtcccggtcatcaagattagaaatattccgcccagtcgtcaagatcttacggtaccttttacttttctccgcacttttgttattctccgtatctcatgcttgatacgattttatt

SEQ ID NO: 2743 - DNA, 1477 bp, Zea mays
cgccgtcttgttgctccgctccggccgtgacacgagcgcaccagccaccgccagcccctcccccgtcgactcgagccacaggacaaggcatcccaaccgccgcccatctcctatcgtcatctgccgatccctcctcggttcctcacagtcacagagcctcacgtcacgtgtacctcccccaacccaacccagcccaacccagcccaaaacctagcgggcgaggggccggggaaccgaccgccggacgcggagatggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgccgccgcggtcaacaaggccggcctcgccaagctcatcggcctcgccggagagaccaacgtccagggcgaggagcaaaagaagctggatgtactgtccaacgaggtcttcgtgaaggcgctcgtcagcagcggccgcacctgtgtcctcgtgtctgaagagaacgaggaggccatcttcgtcgacccggccctccgcgggaagtactgcgtctgtttcgacccgctggatggctcctccaacatcgactgtggtgtctcaatcggaacgatctttgggatttacatggtcaaagacaaggacaacgtgaccttggaggatgtgctgcagcctggaacaaacatgcttgctgctggctactgcatgtacgggagttcatgcacgcttgtgctgagcactgggaacggagtcaatggcttcactctcgatccttcccttggagagttcattttgactcatccaaatatcaagataccaaggaaagggaagatctattcagtcaacgaagggaacgccaaaaactgggatgggcctacagccaaattcgtggagaaatgcaagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcgcttgaacttgctcccgctaaacttcacgacagatccccagtgttcctcgggagctacgatgacgttgaggagatcaaagcactgtacgcttcaatgtcaaacagcggttgacctttctgcctgaggaaacgagcgagatcaaaagcaccgtacgcttcagagtcaactgcttgatctttatagattgtaataaaataataaaagagtttgtaaaaaaaaacaacaacactgcttgatctttctgcatgaggataaaaagcgcatagtttccccggttggatatatccatcagatatttattatgttgttg

SEQ ID NO: 2744 - DNA, 2057 bp, Setaria italica
catgcggatcagatcagacgtggagtccgcagcccccatccaaccgccggccagcaccaccacaccgaggcccgagcccctccggcccctatttcaagccacggaccctagcctagcctcctccggcagatcagatacctcaccggcgtcaccgcacagacgcacacgcatcctccgttgctttgctcacttgttgcgttgttgtaaccatccaccgctcccgagtcccgagccccaacaatttgccagttcattccgcgccgcgataatcggcaccggaccctggcctctactccggcagatcagacgccgcaccaggcaccgcacacgcatcctccgttgctggtcagttgtaattgtaaccatccgcctctcccaagtcccaacaaattgccaatcctcaccgcgagaaacggcgccgctcaaagatgtcgtgacgcgcgcgcaccgtccgtcccgcccgcccgtccgtccccgtcgcgccacaggacaaggcatcccaaccgccgcccatctcctatcgtcatcaggcatctgccgatcatccctggggccttaactcctcccagctagcctcaccgtccccaaccagagtccaaaactcgtagacgcgcgggcagcgcgaaggcgggcggtgatccggcctgatcaaccgagagcgggcgaggggggaaccggccggcggggcagcaggagagcggagaagatggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgcatcggcggtcaacaaggcagggctcgccaagctcatcggcctcgccggggagacaaacgtccagggtgaggagcagaagaagcttgatgtgctctccaacgaagtctttgtcaaggcgctcgtcagcagcggccgcacctgcgttcttgtatctgaagagaacgaggaggccatattcgtcgacccggcactccgtggaaagtactgcgtttgtttcgatccactggatggttcctccaatattgactgtggtgtctccatcggaacaatctttgggatttacatgatcaaagataaagacaatgtgactttggatgatgtgatacaacctggaacaaacatgcttgctgctggctactgcatgtatgggagttcctgcacgcttgtgttgagcactgggaatggagtcaacggtttcactcttgatccttcccttggggagttcatactgactcatccgaatatcaagatacccaagaaagggaagatctattctgtcaatgaagggaatgccaaaaactgggatgcgccgacagcaaagtatgtggagaaatgcaagtttccccaggatggttcgtcgcctaaatcattgagatatattggaagtatggttgctgatgtccaccgtaccttgctatatggaggcatatttttgtacccagctgaccagaagagcccaaatggaaaactccgtgttctgtatgaagtcttcccaatgtcattcctgatggaacaagctggaggtcaggctttcacaggcaaacaacgggcccttgaacttgctcctactaagcttcatgagagatccccaatattcctggggagctacgatgatgttgaggagatcaaagcattgtacgcttcagagtcaagcaccgtttgattgtcctcctgacttcctgagtgtatcattctccggagggggacactgtaactgtattgatcagatatttatgttctgatcttgccttcctggcctcaatgtaaaatattcacactatacagacacagtacaactcaataagctatcaaggcttatgtttcatactcattttacttgctatcgtgattccttaataaaatttggattcaaaacatatgaagacatgttttgaaacgaacgtggcaggagatctaccgattgtactaaaaagatgaaggcatgttacttgtgagattttacttggttgctggttctggatgtttat

SEQ ID NO: 2745 - DNA, 1850 bp, Setaria italica
cagatacctcaccggcgtcaccgcacagacgcacacgcatcctccgttgctttgctcacttgttgcgttgttgtaaccatccaccgctcccgagtcccgagccccaacaatttgccagttcattccgcgccgcgataatcggcaccggaccctggcctctactccggcagatcagacgccgcaccaggcaccgcacacgcatcctccgttgctggtcagttgtaattgtaaccatccgcctctcccaagtcccaacaaattgccaatcctcaccgcgagaaacggcgccgctcaaagatgtcgtgacgcgcgcgcaccgtccgtcccgcccgcccgtccgtccccgtcgcgccacaggacaaggcatcccaaccgccgcccatctcctatcgtcatcaggcatctgccgatcatccctggggccttaactcctcccagctagcctcaccgtccccaaccagagtccaaaactcgtagacgcgcgggcagcgcgaaggcgggcggtgatccggcctgatcaaccgagagcggagaagatggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgcatcggcggtcaacaaggcagggctcgccaagctcatcggcctcgccggggagacaaacgtccagggtgaggagcagaagaagcttgatgtgctctccaacgaagtctttgtcaaggcgctcgtcagcagcggccgcacctgcgttcttgtatctgaagagaacgaggaggccatattcgtcgacccggcactccgtggaaagtactgcgtttgtttcgatccactggatggttcctccaatattgactgtggtgtctccatcggaacaatctttgggatttacatgatcaaagataaagacaatgtgactttggatgatgtgatacaacctggaacaaacatgcttgctgctggctactgcatgtatgggagttcctgcacgcttgtgttgagcactgggaatggagtcaacggtttcactcttgatccttcccttggggagttcatactgactcatccgaatatcaagatacccaagaaagggaagatctattctgtcaatgaagggaatgccaaaaactgggatgcgccgacagcaaagtatgtggagaaatgcaagtttccccaggatggttcgtcgcctaaatcattgagatatattggaagtatggttgctgatgtccaccgtaccttgctatatggaggcatatttttgtacccagctgaccagaagagcccaaatggaaaactccgtgttctgtatgaagtcttcccaatgtcattcctgatggaacaagctggaggtcaggctttcacaggcaaacaacgggcccttgaacttgctcctactaagcttcatgagagatccccaatattcctggggagctacgatgatgttgaggagatcaaagcattgtacgcttcagagtcaagcaccgtttgattgtcctcctgacttcctgagtgtatcattctccggagggggacactgtaactgtattgatcagatatttatgttctgatcttgccttcctggcctcaatgtaaaatattcacactatacagacacagtacaactcaataagctatcaaggcttatgtttcatactcattttacttgctatcgtgattccttaataaaatttggattcaaaacatatgaagacatgttttgaaacgaacgtggcaggagatctaccgattgtactaaaaagatgaaggcatgttactt

SEQ ID NO: 2746 - DNA, 1176 bp, Echinochloa colona
ctcctcccaccacccagctagccctcggctcccccaaacaccaaagtcccaaaagctcgcagagcacgcgggaaggcggtgatccggcctgatcagccgagagcgcgcgggcgaggggatcgagccgaccagccggcgggcaggatcggagcagaatcgcgaggaggatggaccacgcggcggaggcgcagcggacggacctgatgacgatcacgcggcacgtgctgaacgagcagagccgccacccggagtcccgcggcgacttcaccatcctcctctcccacatcgtcctcggctgcaagttcgtcgcctcggcggtcaacaaggccgggctcgccaagctcatcggcctcgccggcgagaccaacgtccagggtgaggagcagagaaactggatgtgctgtccaatgaggtctttgtcaaggcgcttgtcagcagcggccgcacctgcattcttgtgtctgaagagaacgaggaggccatattcgtcgacccagccctccgtggaaagtactgcgtttgtttcgatccgctagacggctcctccaatatcgattgtggtgtctccatcggaacaatctttgggatttacatgatcaaagataaggacaatgtgactttggatgatgtactacaacctggaacagacatgcttgctgctggctactgcatgtacggaagttcctgcacgcttgtgttgagcactggggaatggagtcaatggtttcactcttgatccttcccttggggagttcatactaactcatccgaacatcaagatgccaaaagaaaggaaaatttatctgtcaatgaagggaatgccaaaaactgggatgtgcctacagcgaagtacgtggagaaatgcaagtttccccaggatggttcatcgcctaaatcattgagatatattggaagtatggttgctgatgtccaccgtaccttgctatatggtggcatatttttgtacccagcagaccagaagagcccagaatggaaaactccgtgttctgtatgaagtctttccgatgtcattcctgatggaacaagctggaggtcaggttttcacaggcaaacaacgggcccttgaacttgctcctactaagattcatgacagatccccaatattcctggggagctacgatgatgttgaggagatcaaagcattgtacgcttcag

SEQ ID NO: 2747 - DNA, 1400 bp, Avena sativa
agccagcagcagcatagatagatcgctcactcgcttcttccacggcctgtctgcgctccaagcaaaccgagccgagctaagcgagagagtgagcgggaacgtcgccgaccgaccggcttgggaagatggatcacgcggcggacacgtaccggacggacctgatgaccatcacgcgctacgtgctcaacgagcagagcaggttcccggagtcgcgcggcgacctcaccatcctcctctcccacatcgtcctcggatgcaagttcgtcgcatccgccgtcaacaaggcaggcctcgcaaagctcaccggactcgccggagagacaaacgtccagggggaggagcagaagaagctcgacatcctctccaacgaggtcttcgtcaatgccctcgtcagcagcggccgcacctgtgttcttgtgtccgaggaggacgagctggccaccttcgtggaccctaagctccgcggaaagtactgtgtctgcttcgatccactggatggctcctccaacatcgactgcggcgtctccatcggaacgatcttcgggatttacatgatcaagaactatgacaccgtgactctggaggaggtactgctgcctgggaaggacatgatcgctgctgggtactgcatgtacgggagttcatgcacgcttgttctgagcactgggagtggcgtcaacggcttcacgcttgacccttctcttggggagttcatcatgacgcacccagaaatcaagataccgcctaaaggaaagatttactcggtgaacgaggggaacgccaagaactgggacacgcctactgcaaagtacgttgagaagtgcaagtaccccacggatggttcatcgcctaaatcattgagatacatcggcagtatggttgccgatgtccaccgcacgttactatacggaggtatattcttgtaccccgcagacaagaagagcccaaatggcaagctccgtgtgatgtatgaagtcttccccatgtcattcctgatggagcaagctggaggccagtcattcacaggcaaaggacggtccctcgacctgatccccaccaatatccacgagagatccccgatcttcctgggcagctacgacgacgtggaggagatcaaggcgctgtacgcggaagaagcgaaggcaggatcggcgtgaccgacgatcgtcgtcgtacgcaaggcgtgaaaatccgtcgacgactgccctgccggcctgatcgtgatgtgatgattcatagatcaatcgggcatttcttttcttggtcttcattaccctgtgacattcagtgtaatatagtggtggaggcccgggacggtttcattcgtgagcagctagggcctctgcttcttgcatcagttcactgatgacacctaatatacatccatatacataatcgga

SEQ ID NO: 2748 - DNA, 1523 bp, Avena sativa
cgctcgctcgctccttccacggtctgtctgcgctccaagcaaaccgagtctccgagctaagcgagagagtgtgcaggcgaggagcggggaagatggatcacgcggcggacacgtaccggacggacctgatgaccatcacgcgctacgtgctcaacgagcagagcaggttcccggagtcgcgcggcgacctcaccatcctcctctcccacatcgtcctcggctgcaagttcgtagcctccgccgtcaacaaggcaggcctcgcaaagctcacaggactcgccggcgagaccaacgtccagggggaggagcagaagaagctggacatcctctccaacgaggtcttcgtcaatgccctcgtcagcagcggccgcacctgtgttcttgtgtccgaggaagacgagctggccaccttcgtggaccctaagctccgcgggaagtactgcgtctgctttgatcccctggatggatcctccaacatcgactgcggcgtctccatcgggacgatcttcgggatttacatgatcaagaactatgacaccgtgactctggaggaggtgctgctgcctgggaaggacatgatcgctgctgggtactgcatgtatgggagttcatgcacgctcgttctgagcactgggagcggtgtcaatggcttcacgcttgacccttctcttggggagttcatcatgacgcaccctgaaatcaagatacctcctaaaggaaagatctactcggtgaatgaagggaacgccaagaactgggacacgcctactgcaaagtatgttgagaagtgcaagtaccccacggatggttcatcacctaaatcattgagatacattggcagcatggttgctgatgtccaccgcaccttgctatatggaggtatattcttgtaccccgcagacaagaagagcccaaatggcaagctccgtgtcatgtatgaagtcttccccatgtcgttcctgatggagcaagctggaggccagtctttcacaggcaaaggacggtccctcgacctgatccccaccaatatccacgagagatccccgatcttcctcggcagctacgacgacgtggaggagatcaaggcgctgtacgcggaagaagcgaaggcaggatctgcgtgatcgacgatcgtcgcacgcaaggcgtgaaaatccgtcgacgactgccctgccggcctgaccgcgatgtgatgattcatagatcaatcgggcatttcttttcttggtctttattactctgtgacattcagtgtaatatagtggtggaggcctgggacggtttcattcgtgagcagctagggcctctgcttcttgcatcagttcactgatgacacctaatatacatccatatacataatcggattcagatgaaggtggtttgtgccgaaagctctgcagaatgtattgcattgcaacctttgattgcacatacacacatagatccgtgcaccatgtcgataacttgtgaacatcgtcaactatttcagcactgatgaaagatgagtagtataaacatgtgcc

SEQ ID NO: 2749 - DNA, 1418 bp, Oryza sativa
gcccactccgctcgcttaacacacctgcccgaattcgtccaatccatctgcacccgcgcccgtgtccctctcgcgccacaggacaaggcctcccgaccgccgctacctcctcatctcctctccgagtcctcgcacggtcgtcacagtcacccccagaactcagctaagctcgcgttcgttttcgcaaggagcagaggaggaggggagagatggatcacgcggcggaggcgcagaggacggacctgatgacgatcacgcggcacgtgctgaacgagcagggccggcacccggagtcgcggggggacttcaccatcctactctcccacatcgtcctcggctgcaagttcgtcgcctccgccgtcaacaaggccggcctcgccaagctcatcggcctcgccggcgacaccaacgtccagggtgaggagcagaagaagcttgacgtgctctccaacgaagtcttcgtcaaggcgctcgtcagcagcggccgcacgtgtgttcttgtgtctgaagagaacgaggaggccattatcgtcgacgctcccctccgcggaaagtattgcgtttgttttgatccactggatggctcctcaaatatcgattgtggtgtctccatcgggacgatctttgggatttacatgattaaagacaaggacaacgtgactttggacgatgtactgcaacctggaacagacatgcttgctgctggctactgcatgtacgggagttcatgcacgcttgtgttgagcactggaaatggagtaaacggtttcacccttgatccttcccttggggagttcattctgactcatccaaacatcaagataccaaatagaggaaagatctattcagtgaacgaagggaatgcgaaaaattgggatgctcctacagcgaagtttgtggagaaatgtaaatttccccaggatggttcgccttctaaatccttgagatacatcggaagtatggttgctgatgtccaccgtactttgctatatggaggcatatttttgtaccctgcggatcagaagagcccaaacggaaaacttcgtgttctgtacgaagtgttcccaatgtcattcttgatggagcaagctggaggacaagctttcacaggcaaacaacgggcccttgaacttgttcccagaaagattcatgatagatctccaatattcctggggagctatgatgacgtggaggatatcaaagcattgtacgcttcagagtctatcatcggttgaccggtgttactgaagagtaaaaggacacatgaatcaccctctaccttgtgaacatagacatttttttttgctttaatgtaaaaaaatcagcctatactgacacggtacggcttcaccaatatgaaagaataaaggaatatgattcttacataatttgattggaacataagtgccttttcagct

SEQ ID NO: 2750 - DNA, 1296 bp, Flaveria ramosissima
cacctcgatctgtgtgattccatcatccaatgatattcaatcccctttaattgatcccttcaatctcacgcaatcacataacatcaatcgatagtttcatacatcagttgcatcgtcggaggaagatggatcatgctgctgatgctttccgtacggatttgatgacgatcacgcgctttgtgctgaatgaacagtcgaagcatccggagtcgcgtggggatttcagtattttgctcagtcatattgttcttggatgcaagtttgtttgtgctgctgttaataaggcaggtttggcaaaactcattgggcttgctggagagactaatgtgcagggagaagagcagaagaaactggatgttttgtcaaatgaagtttttgtgaaggctttggtcagcagtggcagaacatgcatacttgtttctgaagaagatgaggaagcgataatcgtagaaccatccaagcgtgggaagtattgtgttgttttcgatccgttggatggatcttccaacattgactgtggtgtttccataggaactatttttgggatttacatgataaaagatagtgatgcggcccgtttggaagatgttcttcagcctggaaagaatatgctggctgctggatactgcatgtatggtagctcttgcacgcttgtgttaagcactggatctggtgtgaatggatttactcttgatccatctttaggggagtttatactcacccaccctgacattaagattccaaagaaaggaaagatttattctgtgaatgaaggaaatgctaagaactgggatggtcctactgcaaagtttgtggaaaaatgcaagtttcccaaggatggttcacctgcaaaatctctaagatatatcggaagtatggttgctgatgttcaccgcaccttactttacgggggtgtgttcttgtaccccgctgataagaaaagcccaaatggaaaactaagggttctctatgaagtctttccaatgtcattcttgatggaacaagccggaggacaggcgtttaccggcaaagaacgggctctggacttggtccccaagaagatccatgatcgatctccgatattcttgggaagctatgatgacgtggaagagatcaaggcattgtatgcagctgaagaaaaggcataaacaaaggttgttcttgtgcagttgtatttcccttatattcagctcttatatatgttaaattttattactatttgatgaaaataatgtgtttaatatgtgtttatttaactattcattgtcccaacattggtgtacattttcagatatt

SEQ ID NO: 2751 - DNA, 1259 bp, Flaveria ramosissima
aatccatcctcgacctgtgtgattttatcatccaatgaatttcaatcccctttgatacaaaacaacagttcattgtttcatatttcatacatctgacgtacttcaatttcaatttcaatttcaatttcaacgatggatcatgctgctgatgccttccgtacggatttgatgacgatcacgcgctttgtgctgaatgaacagtcgaagcatccggagtcgcgtggggatttcagtattttgctcagtcatattgttcttggatgcaagtttgtttgtgctgctgttaataaggcaggtttggcaaaactcattggacttgctggagagactaatgtgcagggagaagaacagaagaaactggatgttttgtcaaatgaagtctttgtgaaggctttggtcagcagtggcagaacatgcatacttgtttctgaagaggatgaggaagcgataatcgtagaaccatccaagcgtggaaagtattgtgttgttttcgatccgttggatggatcttccaacattgactgtggtgtttccataggaactatttttgggatttacatgataaaagatagtgatgcggcccgtttggaagatgttcttcagcctggaaagaatatgctggctgctggatactgcatgtatggcagctcttgcacgcttgtgttaagcactggatctggtgtgaatggatttactcttgatccatctttaggggagtttatactcacccaccctgacattaagattccaaagaaaggaaagatttattctgtgaatgaaggaaatgctaagaactgggatggtcctactgcaaagtttgtggaaaaatgcaagtttcccaaggatggttcacctgcaaaatctctaagatatatcggaagtatggttgctgatgttcaccgcaccttactttacgggggcgtgttcttgtaccccgctgataagaaaagcccaaatggaaaactaagggttctctatgaagtctttccaatgtcattcttgatggaacaagccggaggacaggcgtttaccggcaaagaacgggctctagacttggtccccaagaagatccatgatcgatctccgatattcttgggaagctatgatgacgtggaagagatcaaggcattgtatgcagctgaagaaaaggcataaacaaaggttgttcttgtgcagttgtatttcccttatattcagctcttatatatgttaaattttattactatttgatgaaaataatgtgtttaatatatgtttaa

SEQ ID NO: 2752 - DNA, 1704 bp, Leymus cinereus x Leymus triticoides
gtgccttccgcccgccgtgggagagagagataggagagatggaggagcacagcggcggtgctggccgatcccgtgtgttccacttgttcccgatccattctcctcgtctggtgccatcgcaatcgtcccgctgcctccccttcctctctacctcccctcctccaatcactctccccgaacagcggggctgaagtctgcggcaccggatgggtggaacgcagtggagacatagatgaggcaggaaccatcgcagctcccaggggagcagtggcgtcggaggcgagatttctccctcgagccgccggaggcggtgggatgggaaccagggagaggtagaggagggtggtctgtgctacaagcaacacgaactctccgtccgagctaagcgaacggagagcgagcgagggtcgtccccggccggtcggagaagacgagatggatcacgcggcggacactttccggacggacctgatgaccatcacgcggcacgtgctgaacgagcagagcaagcacccggagtcgcgcggcgacctcaccatcctcctctcccacatcgtcctcggctgcaagttcgtcgcctccgccgtcaacaaggccggcctcgccaagctcatcggcctcgccggcgagaccaacgtccagggggaggagcagaagaagctggacgtgctctccaacgaggtgttcgtcaatgccctcgtcagcagcggtcgcacctgtgttcttgtgtccgaggaggacgaggaggctacgttcgtcgacccaaagctccgtggaaagtactgtgtctgctttgatcccctggatggctcctccaacatcgactgcggcgtctccatcggaacgatctttgggatctacatgatcaagaaccaagacaccgtgactctggaggaagtactgcagcctgggaaggacatgattgctgctggatactgcatgtatgggagttcctgcacgcttgtcctgagcactggaaatggtgtcaacggcttcacgcttgacccttctctcggggagttcataatgactcatccagatatcaagataccgccgaaaggaaagatctattcggttaatgaagggaacgccaagaactgggacacgcctactgcaaagtacgtggagaagtgcaagtatcccacggatggttcatcacctaaatccctgagatacatcggcagcatggttgccgatgtccaccgcaccttgctatacggcggcatatttctgtaccccgcggacaagaagagcccaaacggaaagctccgtgtgatgtatgaagtgttccccatgtcattcctgatggaggaagctggaggccagtctttcacaggcaaaggacggtcgctcgacctgatccccaccaacatccacgagagatccccgatattcctcggtagcagcgacgacgtggaggagatcaaggcgctgtacgcggaggaagccaagaaggcaggatctgcatgatgatcgacagtcatcgcccgcaaggcgatgtaaatcgatgacgactcctgggcctcaccgcaatgtgattcatataccaggcatttcttttctatacgtctgtggcactcagtgtaatatagcgtggaggcctcgaacagcttcatacatgagcagccaaggcttctgcttctttccacaattcgttcactgatgatacgtaatatacatccatgtatacatatattcagctca

SEQ ID NO: 2753 - DNA, 1820 bp, Hordeum vulgare
tacgtgcgtgcgcaggacaaagccctcctctgtcctctcgctccatcaccctcaccacgcgacggccacagacgcgcccggccaccgtgctaccagccatcgcggatagacgggataggcctgggcgtccattccgttggagccccgcccccctccgctcccagcctcacttcctccccgcgctacccaccgaaacacaccacgccgcgcgtcacgtcacgtctcggctcacagccggccagttcccgcgccgcgcctacttcttggggcatagatagatcatacatcgctcgctcgctcgctcgctcactcactccctcccggggcctgtgctctgcaaccgcaagcaaagcaacacgtacgctaagcgagcgggagggggagggcggggttggtcggagccggagaagatggatcacgcggcggacacgttccggacggacctgatgaccatcacgcggcacgtgctcaacgagcagagcaggcacccggagtcgcgcggcgacctcaccatcctcctctcccacatcgtcctcggctgcaagttcgtcgcctccgccgtcaacaaggccggcctcgccaagctcaccggcctcgcaggcgagaccaacgtccagggggaggagcagaagaagctggacgtgctctccaacgaggtgttcgtcaatgccctcgtcagcagcggccgcacctgtgttcttgtgtccgaggaggacgaggaggctacgttcgtcgacccaaagctccgtggaaagtactgtgtctgctttgatcccctggatggctcctccaacatcgactgtggcgtctccattggaacgatctttgggatctacatgatcaagaaccaagacaccgtgactctggaggaagtgctgcagcctgggaaggacatgattgctgctggatactgcatgtatgggagttcctgcacgcttgtcctgagcactggaaatggtgtcaacggcttcacgcttgacccttctcttggggagttcataatgactcatccagacatcaagataccgccaaaaggaaagatctattcggttaatgaagggaatgccaagaactgggacacgcctactgcaaagtacgttgagaagtgcaagtatcccacggatggttcatcacctaaatccttgagatacattggcagcatggttgctgatgtccaccgcaccttgctatacggcggcatatttctgtaccccgcagacaagaagagcccgaacggaaagctccgtgtgatgtatgaggtgttccccatgtcattcctgatggaggaagctggaggccagtctttcacaggcaaaggacggtcgctcgatctgatccccaccgacatccacgagagatccccgatattcctcggcagcagcgacgacgtggaggagatcaaggcgctgtacgcggaggaagccaagaaggcaggatctgcatgaagatccacggtcatgtcgcgcaaggcgtgtaaatcgacgacgactcatgggccttgctggcaaatgtgattcatatatcaggcatttcttttctatacgtctgtgtcattcagtgtaatatactagcgtggaggcctcgaacagcttcatacatgagctgccagggtttctgcttctttccacaattcgttcactgatgatacgaaatatacatccatgtatacatatattcagctcaggaatggctgtgtgcatcgttgaggccgggggacagaaccagtgcctcgagctgtgcagaatgcattgcatatacatacaaattgctacatcatgtgattaaacatgttgactactcccttagttcctaaatataag

SEQ ID NO: 2754 - DNA, 1392 bp, Triphysaria pusilla
gaacgtatttctgcgtcagattttcgcttatttatcccatttcctcgatttatggctcaagatttcacattttttttaatctgtgtaaagggttttggggcgatggatcacgcggcggatgctcaccggacggacttgatgacgataacgcgccacgtgttgaacgagcagtcaaagcacccagagtcgcgtggggatttcaccattttgctcagtcatattgttcttggctgcaagttcgtttgctctgctgttaacaaggccggtttggctaaacttatcggacttgccggagagacaaatgtgcagggtgaagagcagaagaaattagatgtgctgtcgaacgaagttttcatcaaggcattagtcagtagcggccgaacgtgtattcttgtctcggaagaagatgaagaggctacattcgtggaaccctctcaccgtggaaagtattgtgttgtgttcgacccgttggatggatcttccaacatcgactgtggtgtttcaattggaactatatttggtatttatgcgatttatgatgggcacgacccgaaactggaagacgtgttgcagcctggaaagaacatgttagccgcaggctattgcatgtacggaagctcgtgcacgttcgttttgagtactggatcgggagttaacgggttcacactcgacccatctcttggagaattcatattgactcatccggatattaagattccgaaaaaaggcaaaatttattctgttaatgaaggaaatgccaagaactgggatggcccaactgcaaagtatgtggagaaatgcaagtatccgacagatgggtcaccggcaaaatctctgagatacatcggaagtatggtagccgatgtgcatcgcacgttgctttatggaggcgtgtttttgtacccagctgataagaaaagcccgaacggaaaactgagggtcctttatgaagtttttccgatgtcgtttttgatggaacaagcaggaggacaagcgtttactgggaaagagcgggcacttgatttggttcctaagaatatacacgaccgctcaccgatattccttggtagctatgacgatgtcgaggagattaagacactatatgctgctgaggagcagaaataatggacttgtcaatttctttcgagtttcgattttaataaaaacataaacattcttttagaatatatagtttcgtttctgatgaaagggccgatggaaaaataaatgtaaagaatcgaagttctggggtcgctatagaatttctgagaaaaaatattgtaagaacaccaacatgggcctttcatattcgggaaattcaactttagcgactggctaccaatcacattttataatagtttattcggactgtttattgaagtctcgataaaa

SEQ ID NO: 2755 - DNA, 1446 bp, Avena sativa
acacgcaccgcgtcacgtcacgctacgtttcccgcgccgtacgtacagccagcagcatagatagatcgctcactccctccacggtctgcgctccaagcaaaccacggccgagctaagcgagagaaggaccgaccggcctgggaagatggatcacgcggcggacacgtaccggacggacctgatgaccatcacgcgctacgtgctcaacgagcagagcaggttcccggagtcgcgcggcgacctcaccatcctcctctcccacatcgtcctcggatgcaagttcgtcgcatccgccgtcaacaaggcaggcctcgcaaagctcacaggactcgccggagagaccaacgtccagggggaggagcagaagaagctggacatcctctccaacgaggtcttcgtcaatgccctcgtcagcagcggccgcacctgtgtccttgtgtccgaggaggacgagctggccaccttcgtggaccccaagctccgcgggaagtactgcgtctgctttgatcccctggatggctcctccaacatcgactgcggcgtctccatcggaacgatcttcgggatttacatggtcaagaactatgacaccgtgactctggaggaggtgctcctgcctgggaaggacatgatcgccgctgggtactgcatgtatgggagttcatgcacgctcgttctaagcactgggagtggtgtcaacggcttcacgcttgacccttctcttggggagttcatcatgacgcacccggaaatcaagataccgcctaagggaaagatttactcggtgaacgaggggaacgccaagaactgggacacgcctactgcaaagtacgttgagaagtgcaagtaccccacggatggttcctcacctaagtccttgagatacatcggcagcatggttgctgatgtccaccgcaccttgctatacggaggtatattcttgtaccccgcagacaagaagagcccaaatggcaagctccgtgtgatgtatgaagtcttccccatgtcattcctgatggagcaagctggaggccagtctttcacaggcaaaggacggtctctcgacctgatccccaccaatatccacgagagatccccgatcttcctcggcagctacgacgacgtggaggagatcaaggcgctgtacgcggaagaagcgaaggcaggatcggcgtgaccgacgatcgtcgcgcgcaaggcgtgaaaaccgtcgacgaatgccccgggccggcctgaccgtgatgtgacgattcatatatcaatcaggcatttcttttcttggtctttattaccctgtgacattcagtgtaatatagtggtggaggccttggacggtttcattcgtgagcagctagggcctctgcttcttgcaacagttcactgatgacacctaatatacatccatatacataatcggattcagatgaaggtggtctgtgccgatag

SEQ ID NO: 2756 - DNA, 1628 bp, Avena sativa
agtctttcacaggcaaaggacggtctctcgacctgatccccaccaatacccacacgcaccgcgtcacgtcacgctacgtttcccgcgccgtacgtacagccagcagcatagatagatcgctcactccctccacggtctgcgctccaagcaaaccacggccgagctaagcgagagaaggaccgaccggcctgggaagatggatcacgcggcggacacgtaccggacggacctgatgaccatcacgcgctacgtgctcaacgagcagagcaggttcccggagtcgcgcggcgacctcaccatcctcctctcccacatcgtcctcggatgcaagttcgtcgcatccgccgtcaacaaggcaggcctcgcaaagctcacaggactcgccggagagaccaacgtccagggggaggagcagaagaagctggacatcctctccaacgaggtcttcgtcaatgccctcgtcagcagcggccgcacctgtgtccttgtgtccgaggaggacgagctggccaccttcgtggaccccaagctccgcgggaagtactgcgtctgctttgatcccctggatggctcctccaacatcgactgcggcgtctccatcggaacgatcttcgggatttacatggtcaagaactatgacaccgtgactctggaggaggtgctcctgcctgggaaggacatgatcgccgctgggtactgcatgtatgggagttcatgcacgctcgttctaagcactgggagtggtgtcaacggcttcacgcttgacccttctcttggggagttcatcatgacgcacccggaaatcaagataccgcctaagggaaagatttactcggtgaacgaggggaacgccaagaactgggacacgcctactgcaaagtacgttgagaagtgcaagtaccccacggatggttcctcacctaagtccttgagatacatcggcagcatggttgctgatgtccaccgcaccttgctatacggaggtatattcttgtaccccgcagacaagaagagcccaaatggcaagctccgtgtcatgtatgaagtcttccccatgtcattcctgatggagcaagctggaggccagtctttcacaggcaaaggacggtccctcgacctgatccccaccaatatccacgagagatccccgatcttcctcggcagctacgacgacgtggaggagatcaaggcgctgtacgcggaagaagcgaaggcaggatcggcgtgaccgacgatcgtcgcgcgcaaggcgtgaaaaccgtcgacgaatgccccgggccggcctgaccgtgatgtgatgattcatatatcaatcaggcatttcttttcttggtctttattaccctgtgacattcagtgtaatatagtggtggaggccttggacggtttcattcgtgagcagctagggcctctgcttcttgcaacagttcactgatgacacctaatatacatccatatacataatcggattcagatgaaggtggtttgtgccgaaagctctgcagaatgtattgcattgcaacctttgattgcacatacacacatagatccgtgcaccatgtcgataacttgtgaacatcgtcaactatttcagcactgatgaaagatgagtagtataaacatgtgcc

SEQ ID NO: 2757 - DNA, 1549 bp, Avena sativa
cccacgcccctcgccccccagcctcacttcctcatcaccaccccgctacctaccaaaacccccaagagagatcacccacacgcacctcgtcacgtcacggttcgtggcccgctagttcccgcgccgtacgaagcccagccagcagcatagatagatcgcccactcgcttcttccacggtctgtctgcgctccaagcaaaccgagtctccgagctaagcgagagtgtgcgggaaggaccgaccgaccgaccggggaagatggatcacgcggcggacacgtaccggacggacctgatgaccatcacgcgctacgtgctcaacgagcagagcaggttcccggagtcgcgcggcgacctcaccatcctcctctcccacatcgtcctcggctgcaagttcgtcgcatccgccgtcaacaaggctgggctcgccaagctcaccggactcgccggcgagacaaacgtccagggggaggagcagaagaagctcgacatcctctccaacgaggtcttcgtcaatgccctcgtcagcagcggccgcacctgtgttcttgtgtccgaggaggacgagctggccaccttcgtggaccctaagctccgcgggaagtactgcgtctgctttgatcccctggatggctcctccaacatcgactgcggcgtctccatcgggacgatcttcgggatttacatggtcaagaactatgacaccgtgactctggaggaggtactgctgcctgggaaggacatgatcgccgctgggtactgcatgtatgggagttcatgcacgctcgttctgagcactgggagtggtgtcaacggcttcacgcttgacccttctcttggggagttcatcatgacgcaccctgaaatcaagatacctcctaaaggaaagatttactcggtgaacgaggggaacgccaagaactgggacacgcctactgcaaagtacgttgagaagtgcaagtaccccacggatggttcatcgcctaaatcattgagatacatcggcagtatggttgccgatgtccaccgcacgttactatacggaggtatattcttgtaccccgcagacaagaagagcccaaatggcaagctccgtgtgatgtatgaagtcttccccatgtcattcctgatggagcaagctggaggccagtcattcacaggcaaaggacggtccctcgacctgatccccaccaatatccacgagagatccccgatcttcctcggcagctacgacgacgtggaggagatcaaggcgctgtacgcggaagaagcgaaggcaggatcggcgtgaccgacgatcgtcgcacgcaaggcgtgaaaaccgtcgacgactgccccggccggcctgaccgtgaagtgatgattcatatatcaggcatttcttttcttggtctttattaccctgtgacattcagtgtaatatagtggtggaggcctgggacggtttcattcgtgagcagctagggcctctgcttcttgcaacagttcactgatgacacctaatatacatccatatacataatcggattcagatgaaggtggtttgtgccg

SEQ ID NO: 2758 - DNA, 1856 bp, Musa acuminata
agacgacaaaaaggggcagtccgataaccgtccgtcggatcgtcactattggttcgttcctccgcacgcaaacagttcaaactattgagcgagagggagagatcggcaggggagaagagcgttatccgcacgccaaccacgagagtcgccgacgcgctcgcaggtggaggaaagattgaggagaagcatcggctgggcggagagagagactggtggttgcgatggatcacgaggcggaggcgcatcggacggacctgatgacgatcacgaggtacgtgctgaacgagcagtcgaggcaccaggaatcacgcggcgacttcaccatcctgctttcccacatcgtcctcggctgcaagttcgtctgttccgccgtcaacaaggctgggctggctaagctcataggacttgctggagagacgaatgttcagggagaggagcaaaagaagcttgatgtgctttcgaatgaagtctttgtcaaagctttgataagcagtggccggacttgcatcctggtgtcggaggaggatgaagaggcaacttttgtggatccatcgctacgtggaaaatattgtgttgtctttgatcctctggatggttcttcgaacattgattgcggtgtctctattggaacgatatttggcgtttacatggttaaagataaggacaatgtaaccctagacgaggtactgcaaccagggaagaatatgctagcagctggctattgcatgtatggaagttcttgcacgcttgtactgagcaccgggagtggtgtcaatggtttcactctagatccatctcttggggaattcatactgacccatccagatattaagataccgaagaagggcaaaatatattcagtgaatgaaggaaatgccaagaattgggatgggcctacaacaaagtatgtggagaaatgcaagttccccaaggatggagactcaccaaaatctctgagatatattggaagcatggttgccgatgtacatcgtacactgctttatggaggcatctttttataccctgcggataagaagagtccaaatgggaaactacgtgttctatatgaagtatttccaatgtcattcctgatggaacaagcagggggtcaagcttttactggcaagcaacgggctctcgatttggttcccacgaagatacatcagaggtcgcccatctttcttggcagctatgatgaggttgaggaaatcaaagcactgtatgctgctgaggagaacactgcttaatttaaagatgcttctgtggagtcgaactaatcatgtaacctgtcattataataaatcttctcacctgtaaagcacggagtaaaacttgcttcaagtaatgtaagcacaaggcattgagaatacctttttccttctattttagactgttgcagctaatcctttgttatgggtttgatcttcatcgagcaccagccccttgacctcctcttcatcataacaaaggctttctccatcgcctttggtttgaaggatgactttggttatgtaacactacgaatgcgaggttgtatgcagaatagtagagatcaggaaggacaaatccagaaaaaactcgaagcagaaggatggaatgaaagcgatgacagtacctgtgaagggacgcgatgcttgtcaggatgccatttcaaagtagatgatgcttgtcagtatctggaacgggatcagaacttcatgaagcacttcatgaagaggaattctggacaatttataagcttcagacatcatctaacttcaattcactccatactctgctttgaatattttctcatctggattcctccttcgtgatctctgctaaaatatgatcatatttcagatacgatcatccac

SEQ ID NO: 2759 - DNA, 1261 bp, Musa acuminata
ccgataaccgcccgtcggatcgtcactattggttcgttcctccgcacgcaaacagttcaaactattgagcgagagggagagatcggcaggggagaagagcgttatccgcacgccaaccacgagagtcgccgacgcgctcgcaggtggaggaaagattgaggagaagcatcggctgggcggagagagagactggtggttgcgatggatcacgaggcggaggcgcatcggacggacctgatgacgatcacgaggtacgtgctgaacgagcagtcgaggcaccaggaatcacgcggcgacttcaccatcctgctttcccacatcgtcctcggctgcaagttcgtctgttccgccgtcaacaaggctgggctggctaagctcataggacttgctggagagacgaatgttcagggagaggagcaaaagaagcttgatgtgctttcgaatgaagtctttgtcaaagctttgataagcagtggccggacttgcatcctggtgtcggaggaggatgaagaggcaacttttgtggatccatcgctacgtggaaaatattgtgttgtctttgatcctctggatggttcttcgaacattgattgcggtgtctctattggaacgatatttggcgtttacatggttaaagataaggacaatgtgaccctagacgaggtactgcaaccagggaagaatatgctagcagctggctattgcatgtatggaagttcttgcacgcttgtactgagcaccgggagtggtgtcaatggtttcactctagatccatctcttggggaattcatactgacccatccagatattaagataccgaagaagggcaaaatatattcagtgaatgaaggaaatgccaagaattgggatgggcctacaacaaagtatgtggagaaatgcaagttccccaaggatggagactcaccaaaatctctgagatatattggaagcatggttgccgatgtacatcgtacactgctttatggaggcatctttttataccctgcggataagaagagtccaaatgggaaactacgtgttctatatgaagtatttccaatgtcattcctgatggaacaagcagggggtcaagcttttactggcaagcaacgggctctcgatttggttcccacgaagatacatcagaggtcgcccatctttcttggcagctatgatgaggtcgaggaaatcaaagcactgtatgctgctgaggagaacactgcttaatttaaagatgcttctgtggagtcgaactaatcat

SEQ ID NO: 2760 - DNA, 1278 bp, Festuca arundinacea
ggaagatggatcacgcggcggacacgtaccggacggacctcatgaccatcacgcggtacgtgctcaacgagcagagcaggttcccggagtcgcgcggcgacctcaccatcctcctctcccacatcgtcctcggctgcaagttcgtcgcctccgccgtcaacaaggcagggctcgccaagctcaccggactcgccggcgagaccaacgtccagggggaggagcagaagaagctggacatcctgtccaacgaggtgttcgtcaatgccctcgtcagcagcggtcgcacatgtgttcttgtgtccgaggaggacgagctggccacgttcgtggaccctaagctccggggaaagtactgtgtctgctttgatcccctggatggctcctccaacatcgactgcggcgtctccatcggaacgatctttgggatttacatgatcaagaactttgacaccgtgacccttgaggaggtgctgctgcctgggaaggacatgattgctgctggatactgcatgtatggaagttcatgcacgcttgttctgagcactgggagtggtgtcaacggcttcacgcttgacccttctcttggggagttcatcatgacgcatccagaaatcaagatacctcctaaaggaaagatctactctgtgaatgaaggaaatgccaagaactgggacactcctactgcaaagtatgttgagaagtgcaagtaccccacggatggttcatcacctaaatccttgagatacattggcagcatggttgctgatgtccaccgcacgttgctatacggtggtatattcttgtaccctgccgacaagaagagcccaaatggcaagctccgtgtgatgtatgaagtgttccccatgtcgttcctgatggagcaagctggaggccagtctttcacaggcaaaggacggtcacttgatctgatccctaccaatatccacgagagatccccgatattcctcggcagctacgacgacgtggaggagatcaaggcgctgtatgcggaagaagccaaggcaggagcggcatgaccgacgatcgtcgtatgcaagcaaatcgtcgacgactgctccgaccggccttaccgtgatgtgattcatatatcaggcatttcttttcttggtcttcattaccctgtgacattcagtgtaatatagtggtggaggccttgggcagtttcattcatgtgaagctaaggcttctgcttcttgcaacagttcactgatgacacgtaatatacatccatacataaaaaaaaaaaaaaaaaaaaaa

SEQ ID NO: 2761 - DNA, 1327 bp, Flaveria ramosissima
tctcacctcgatctgtgtgattccatcatccagtgatattcaatcccctttaattgatcccttgattctcacgcaatcacataacatcaatcgatagttgcatcgtcggagaaagatggatcatgctgctgatgctttccgtacggatttgatgacgatcacacgctttgtgctgaatgaacaatcgaagcatccggagtcgcgtggggatttcagtattctgcttagtcatattgttcttggatgcaagtttgtttgtgctgctgttaataaggctggtttggcaaaactcattgggcttgctggagagactaatgtgcagggagaagagcagaagaaactggatgttttgtccaatgaagtttttgtgaaggctttggtcagcagtggcagaacatgcatacttgtttctgaagaagacgaggaagcgataatcgtagaaccatccaagcgtgggaagtattgtgttgttttcgatccgttggatggatcttccaacattgactgtggtgtttccataggaactatttttgggatttacatgataaaagatagtggtgcggcccgtttggaagatgttcttcagcctggaaagaatatgctggctgctggatactgcatgtatggtagctcttgcacgcttgtgttaagcactggatctggtgtgaatggatttactcttgatccatctttaggggagtttatactcacccaccctgacattaagatcccaaagaaaggaaagatttattctgtgaatgaaggaaatgctaagaactgggatggtcctactgcaaagtttgtggaaaaatgcaagtttcccacggatggttcacctgcaaaatctcttagatatatcggaagtatggttgctgatgttcaccgcaccttactttacgggggcgtgttcttgtaccccgctgataagaaaagcccaaatggaaaactaagggttctctatgaagtctttccaatgtcattcttgatggaacaagctggaggacaggcgtttaccggcaaagaacgggctcttgacttggtccccaagaagatccatgatcgatctccgatattcttgggaagctatgatgatgtggaagagatcaaggcattgtatgcagctgaaggaaaggcataaacaaaggttgttcttgtgcagttgtatttcccttttattcagctcttatataagttcaattttattacaatttgatgaaaataatgtgttttatatatgtttattaaactactcattgtcccaggctttcagcatttgtgttcattttcattagatggtatctagtgactcctacaaatgaaaatatgt

SEQ ID NO: 2762 - DNA, 1214 bp, Flaveria ramosissima
atctccgatctgcgtgcacgtataaaaccctacgtattatcctcttcaatctcacctcgaactgtgtgattttatcaaccgatgaaattcaatcccctttgatttcgtcaatttctcgcaatcacataacaacaattcatagtttcatacatcaattgcatcggagaacgatggatcatgccgctgatgctttccgtacggatttgatgacgataacgcggtttgtgctgaatgaacagtcgaagcatccggagtcgcgtggggatttcagtattttgctcagtcatattgttcttggatgcaagtttgtttgtgctgctgttaataaggcaggtttggcaaaactcattggacttgctggggagactaatgtgcagggagaagagcagaagaaattggatgttttgtcaaatgaagtttttgtgaaggctttggtcagcagtggcagaacatgcatacttgtttctgaagaggatgaggaagcgataatcgtagaaccatccaagcgtggaaagtattgtgttgttttcgatccgttggatggatcttccaacattgactgtggtgtttccataggaactatttttgggatttacatgataaaagatagtggtgaggcccgtttggaagatgttcttcagcctggaaagaatatgctggctgctggatactgcatgtatggtagctcttgcacgcttgtgttaagcactggatctggtgtgaatggatttactcttgatccatctttaggggagtttatactcacccaccctgacattaagattccaaagaaaggaaagatttattctgttaatgaaggaaatgctaagaactgggatggtcctactgcaaagtttgtggaaaaatgcaagtttcccaaggatggttcccctgtgaaatctctaagatatatcggaagtatggttgctgacgtccatcgtaccttactttacggtggcgtgttcttgtaccccgctgataagaaaagcccaaatggaaaactaagggttctctatgaagtctttccaatgtcattcttgatggaacaagctggaggacagtcgtttacaggaaaagaacgggctcttgacttggtccccaagaagatccatgaacgatctccgatattcttgggaagctatgatgacgtggaagaaatcaaggcactgtatgcagctgaagaaaaggcgtaaaagaagggttcttgtgcagtt

SEQ ID NO: 2763 - DNA, 1407 bp, Plantago ovata
gatcccatcttcatccacacactacccaacacacacatacgtcaatccaacggtggaattcgtttcttagcctcatcgattcgcgtcccattcgtccagtatatctcactcacgtcactggataagttcgataatcccaaacaagtcgctccaattaggagtgtacgtgcaatagtgagagtgtgttcaacggaaggtggtggcgaaatggatcacgcggcggatgctcaccggaccgatttgatgacgattactcgtcacgtgctgaacgagcaatcgaagcaccctgaatctcgtggagatttcaccatcttgctcagccatattgttctcggctgcaagtttgtctgttccgctgtcaataaggctggtttggccaagcttatagggcttgctggggagacgaatgtccagggtgaagagcagaagaaactagatgttctctcgaatgaagtttttgtcaaggcattggtcagcagcggccgaacttgtatccttgtttctgaagaggatgaagaggctacatttgttgagggacctaagcgtgggaaatactgtgttgtgttcgacccattggatggatcgtccaatattgactgtggagtttctatcggaacaatctttgggatttacctgataggggaaggaattgagccaaagttggaggacgtgttgcagcccgggaagaatatggtagctgcaggctattgcatgtatggaagctcctgcacgtttgtactgagcactggaagcggagtgaatggtttcacactggatccgtctcttggagagttcatattgactcatccagatattaagattccaaagaaaggaaagatttactctgtgaatgaaggaaatgccaaaaactgggatggtcctacagcgaagtatgtcgaaaaatgcaagtttcctacagatggctcgcctgcaaaatctctaagatacattggaagcatggtagctgatgttcaccgcaccttactttatggaggcatctttttgtacccagcagataagaaaagcccaagtggaaaattgagggtcctctatgaggttttccctatgtcattcttgatggagcaagctggagggcaatcattcactgggaaggaaagggcacttgatttggtccctacgaagatccacgagcgctcaccaatattcctgggtagctatgatgatgttgaggagataaaagcactgtatgctgctgaagagaagaaataaacaaaattgtacaattcttttccaactttgctgtctctcaatttcttcgtttataatgtattcacagcgtactggctgttattgtattacttgttacatctgtcaattcaaaataatgcatccttgtacataaattcatgtaaaaactctgcaattcacatgaagcgatgcattact

SEQ ID NO: 2764 - DNA, 1221 bp, Flaveria ramosissima
tcgatctgtgtgattccatcatccagtgatattcaatcccctttaattgatcccttgattctcacgcaatcacataacatcaatcgatagttgcatcgtcggagaaagatggatcatgctgctgatgctttccgtacggatttgatgacgatcacacgctttgtgctgaatgaacaatcgaagcatccggagtcgcgtggggatttcagtattctgcttagtcatattgttcttggatgcaagtttgtttgtgctgctgttaataaggctggtttggcaaaactcattgggcttgctggagagactaatgtgcagggagaagagcagaagaaactggatgttttgtccaatgaagtttttgtgaaggctttggtcagcagtggcagaacatgcatacttgtttctgaagaagacgaggaagcgataatcgtagaaccatccaagcgtgggaagtattgtgttgttttcgatccgttggatggatcttccaacattgactgtggtgtttccataggaactatttttgggatttacatgataaaagatagtggtgcggcccgttggaagatgttcttcagcctggaaagaatatgctggctgctggatactgcatgtatggtagctcttgcacgcttgtgttaagcactggatctggtgtgaatggatttactcttgatccatctttaggggagtttatacttacccaccctgacattaagattccaaagaaaggaaagatttattctgtgaatgaaggaaatgctaagaactgggatggtcctactgcaaagtttgtggaaaaatgcaagtttcccaaggatggctcacctgcaaaatctctaagatatattggaagtatggttgctgatgttcaccgcaccttactttacgggggcgtgttcttgtaccccgctgataagaaaagcccaaatggaaaactaagggttctctatgaagtctttccaatgtcattcttgatggaacaagctggaggacaggcgtttaccggcaaagaacgggctcttgacttggtccccaagaagatccatgatcgatctccgatattcttggaagctatgatgatgtggaagagatcaaggcattgtatgcagctgaaggaaaggcataaacaaggttgttcttgtgcagttgtatttccctttatcagtctcttatataagttctatttattacaattgatgaaatatagtagtttatata

SEQ ID NO: 2765 - DNA, 1141 bp, Cocos nucifera
atggatcacgcggcggatgcgcagcggacggatctgatgacgataacgcggtacgtgctgaacgagcagacgaagcacccagagtcgcggggggatttcaccatccttctcagccacatcgtcctcggctgcaagttcgtctgctccgccgtcaacaaggctggcctcgccaagctccttggacttgctggagataagaatgtccagggtgaagagcaaaagaagcttgatgtgctttcaaatgaagtctttatcaaagctttgataagtagcggtcgtacatgtattcttgtttcagaagaggatgaggaggcaacatttgtggatccagcactgcgtggaaaatattgtgttgtctttgatccactggatggctcctctaacatcgactgtggtgtttcaattggaacgatttttgggatttacatggtaaaggataagaatgaagtgactttaaatgatgtattgcaaccagggaagaatatgctggcagctggttattgcatgtatggaagttcttgcacgcttgtattgagcactggaagtggtgtcaatggtttcacactagatccatctcttggagagttcatactgacttatccaaacataaagataccaaagaaaggcaaaatatattctgtgaatgaaggaaatgccaaaaactgggatggacctacagcaaagtttattgagaaatgcaaatttcctaaggatggttcctcaccaaaatctctgagatatattggaagcatggttgctgatgttcatcgtacccttctttatggaggcatctttttgtatcctgcagataagaagagtccaaatggaaaactacgtgttctctatgaggtgttccctatgtcattcttgatggaacaagctggtggtcaagcttttactggaaagcagcgggcccttgacttggttccgaccaagattcatcagaggtctcctatatttcttggcagctacgatgatgttgaggaaattaaagcactttatgctgctgaagagagccatgcctgatctacagatgcttccttgcttacatataaaattccaacaatctttcgtattgttattataaccagttcttttgtggggcaaggcacgatacttttcgaagcctttcatagcaagc

SEQ ID NO: 2766 - DNA, 1369 bp, Cichorium intybus
tgagtgattttgtcaaccgatgaaattcaatcttgtttgattttcaacacacattcaaaacctccataacgttgtcagagatcaactctatcgccggagaaacatggatcatgccgccgatgccttccggacggatttgatgaccataactcggtttgtgcttaatgagcaatcgaagcatccggagtcgcgtggtgatttcagtattttgctcagtcacattgttctaggttgcaagttcgtctgttccgctgttaataaggcaggtttggcgaaactcatcggacttgccggagaaacaaatgttcagggagaagaacagaagaaattggatgttctctcgaatgaagtttttgtgaaggctttggtcagcagtgggaggacatgcatacttgtttctgaagaagatgaagaagcaataatggtggaaccatccaagcgtggaaagtattgtgttgttttcgatccgctggatggatcttccaacattgactgtggtgtttccattggaactatttttgggatttacatgattaaagatggtgacgaggcacgtttagaagatgtattgcagcctggaaagaatatgctggctgctggatactgcatgtatggtagttcttgcacgcttgtgttaagcactggatctggtgtgaatggatttactcttgatccatctctgggggagtttatacttacccacccagacattaagatcccaaagaaaggcaagatttattcagttaatgaaggaaatgccaagaactgggatggtcccactgcaaaatttgtggaaaaatgcaagttccccacagacggttcatccgcaaaatcattaagatatattggaagtatggttgctgatgtccaccgaaccttactttacgggggtatatttttgtaccctgctgataagaagagcccgagcgggaaattaagggttctctatgaagtgttcccgatgtctttcttaatggaacaagctggcggacagtcatttaccggaaaggaacgggcacttgacttggtaccaaagaagatacatgaacggtctccgatattccttggaagctatgatgacgtggaagaaatcaaggcactttacgcagctgaagagaaggcaaattaaacttatttacatgttgttgttgttgttgatgtgcagttactttcctttaatatttgtaatgaaaaaagctacattttatttcatgtaacctgtcttaaatgataaagagtaaagtaatatattatgatttacccgccaaaaataccactgtacaaaaaagttacgaattgtgtttatcagtttatgtattcccatactcatattaactacattatatttatgttttttattcaattgcat

SEQ ID NO: 2767 - DNA, 1630 bp, Lactuca sativa
gtttttaagaactatggtgtaatatttgtaaagtaaaaggactaaaatgaaaatgttgaaaggaccaaaatgaaaatagtatgattgtacttgccaaaaagtccaaatatagtatttgtctggaactcccgctaccttccatagccgaagaagaagcaaccaccagccctctttacagttatcctcctgacaaccgctagcgtcaccgtcacgccgttctccgccacgtgtcatctgaacttccactggcctcagataacctcatcttcgattcctgtgcacatataagaacgctattatcttccagcctctccttgaattgcgtgattttgtcaaccgatgaaattcaatcttgtctgatttcgatacagattgaagcaaacaacaatttagagttgttagagatcaactctatcgccggagaaagatggatcatgccgctgatgcgttccggaccgatttgatgaccataactcggtttgtgctgaatgaacagtcgaagcatccggaatcacgcggtgatttcagtatcctgctcagtcacattgttctaggttgcaagttcgtctgctccgccgttaacaaggcaggtttggcaaaactcattggacttgctggggagacgaatgtacagggagaagagcagaagaaattggatgttctgtcgaatgaggtttttgtgaaagctttggtcagcagtggtagaacttgcatacttgtttctgaagaagatgaagatgcaataattgtggaaccatctaaacgtggaaggtattgtgttgttttcgatcccctggatggatcttccaacattgactgtggtgtttccataggaactatttttgggatttacatgataaaagatggtgatgaggcaactttagaagatgtattgcagcctggaaagaatatggtggctgctggatactgcatgtatggtagctcttgcacgcttgtgttaagcactggatcaggtgtcaatggatttactcttgatccatctctaggggagtttatactcacccatgcagacattaagatcccaaagaaaggaaagatttattcagtcaatgaaggaaatgcaaagaactgggatggtcccactgcgaaatttgtggaaaaatgcaagtaccccacagatggttcatccgcaaaatccttaagatatatcggaagtatggttgctgatgttcatcggaccttactttatgggggtgtctttttgtaccctgctgataagaagagccctaatgggaaattaagggttctctatgaagtgttcccgatgtcgttcttgatggaacaagctggtggacagtcatttaccggaaaggagcgggcgcttgacttggtaccaaagaagatacatgaaaggtctccgatattcttgggaagctatgatgacgtggaagaaatcaaggcattgtatgcagctgaagaaaaggcaaattaaactgattaattatcttatccatgttgttcttttgtttataaaatcatgctacttttcttcttatttgtaataataattaaaaaaaaaaagctaccttttatgtaattgcctttatatgtattacggtttagacaatcttctaaataacatgaggcagcgtgatggcaaattggcaat

SEQ ID NO: 2768 - DNA, 1461 bp, Echinacea purpurea
cctaacttcaactaaacgccagtaccatagccgaagaagaaacagccacccagctttgtttcacaattatcctctgcagttaacggcctctagcgtcaccgtcacgccgtcctccgccacgtgtcatctaaccttccactgacctcagataatcctcatccttgatccccatacacacatatatatacaccaccttgaattgcgtgattttgtcaccgatcaaattcaatctcctctaattcgtaattacaaacaataaacaatcaattgtaggttcagctgtatagccggcgaacgatggatcatgctgctgatgctttccggacggatttgatgacgataactcgcttcgtgttgaacgagcagtcgaagcatcctgagtcgcgtggtgatttcagtattttgctcagtcacattgttcttggctgcaagttcgtttgtgctgctgttaataaggcaggtttggcaaaactcattggacttgctggggagaccaatgtgcagggagaagaacagaagaaattggatgttttgtcaaatgaagttttcgtgaaggctttggtcagcagtggcagaacatgcatacttgtttcggaagaggacgaggaagcgataattgtagaaccatccaagcgtggaaagtattgtgttgttttcgacccgttggatggatcttccaacattgactgtggtgtttccataggaactatttttgggatttacatgataaaagatggcggtgaggcccgtttagaagatgttcttcagcctggaaagaatatgctggctgctggatactgcatgtacggtagctcttgcacgtttgtgttaagcactggatctggtgtgaatggatttactcttgatccatctttaggggagtttatactcacccaccctgacattaagatcccaaagaaaggaaagatttattctgttaatgaaggaaatgctaagaactgggatgctcctactgcaaagtttgttgaaaaatgcaagttccccaaggatggttcacctgcaaaatctctaagatatattggaagtatggttgctgatgttcatcgcaccttactttatgggggcgtgtttttataccctgctgataagaaaagcccgaatggaaaactgagggttctctatgaagtcttccctatgtcattcttgatggaacaagctggaggacagtctttcactgggaaagaacgggctcttgacttggttcccaagaagatacatgaacgctctccaatattcttgggaagctatgatgacgtggaagaaatcaaggcactgtatgctgctgaagagaaggcataataaaagaggtggttattgtgcagctgtattccccttttatctttgttctaaatccaggttttttataacttaattttgttgtaattgatgtatttgatatgtgtttatcaaattgttatgtaatattgtgattttttactt

SEQ ID NO: 2769 - DNA, 1160 bp, Flaveria ramosissima
cacctcgaactgtgtgattttgtcatccaatgaaattcaatcccctttgattgatcctctcaatttcacgcaatcacaaaacacaagagttcaatctcgttcaatttcgccgccggagaacgatggatcatgctgctgatgccttccgtacggatttgatgaccatcacgcggtttgtgctgaacgaacagtcgaaacatccggagtcgcgtggggatttcagtattctgctcagtcatattgttcttggatgcaagtttgtttgtgctgctgttaataaggcaggtttggcaaaactcattggacttgcaggggagactaatgtgcagggagaagagcagaagaaactggatgttttgtcgaatgaagtttttgtgaaggctttggtcagcagtggcagaacatgcatacttgtttctgaagaggatgaagaagcgataatcgtagaaccatccaagcgtggaaagtattgtgttgttttcgatccgttggatggatcttccaacattgactgtggtgtttccataggaactatttttgggatttacatgataaaagatagtggtgaggcccgtttggaagatgttcttcagcctggaaagaatatgctggctgctggatactgcatgtatggtagctcttgcacgcttgtgttaagcactggatctggtgtgaatggatttactcttgatccatctttaggggagtttatactcacccaccctgacattaagattccaaagaaaggaaagatttattctgttaatgaaggaaatgctaagaactgggatggtcctactgcaaagtttgtggaaaaatgcaagtttcccaagaatggttcccctgtgaaatctctaagatatatcggaagtatggttgctgacgtccatcgtaccttactttacggtggcgtgttcttgtaccccgctgataagaaaagcccaaatggaaaactaagggttctctatgaagtctttccaatgtcattcttgatggaacaagctggaggacagtcgtttacaggaaaagaacgggctcttgacttggtccccaagaagatccatgaacgatctccgatattcttgggaagctatgatgacgtggaagaaatcaaggcactgtatgcagctgaagaaaaggcgtaaaagaagggttcttgt

SEQ ID NO: 2770 - DNA, 1223 bp, Guizotia abyssinica
ttttgtaaaccgatgaaattcaatctcctttgaatttgtttataatatacaaaagaaattagaaaaccttcatcgccggaggaagaaagatggatcatgaggcggatgcattccggacggatttgatgacgataactcggtttgtactgaacgagcaatccaagtatccagaatcgcgtggtgatttcagtattttgctcagtcacattgttctcggttgcaagttcgtctgtgctgctgttaataaggcaggcttggcaaaactcattggacttgctggggataccaatgtgcagggagaagagcagaagaaattggatgttttgtcgaatgaagtttttgtgaaggctttggtcagcagtggcagaacatgcatacttgtatctgaagaggacgaggaagcgatatttgtagaaccatccaagcgtggaaagtattgtgttgtttttgatccgttggatggatcttccaacattgactgcggtgtttccataggaactatttttgggatttacatgataaaagatagcggtgaggcccgtttggaagatgttcttcagcctggaaagaatatgttggctgctggatactgtatgtacggtagctcctgcacgcttgtgttaagcactggatctggtgtgaatggatttactcttgatccatctctcggggagtttatactcacccaccctgatattaagatcccaaagaaaggaaagatatattctgttaatgaaggaaatgctaagaactgggatggtcctactgcaaagttcgtcgaaaaatgcaagttccccaaggatggttcacctgcaaaatctcttagatatattggaagtatggttgcggatgttcatcgtaccttactttacgggggcgtgtttttgtaccctgctgacaagaaaagcccgaatggaaaactaagggttctctatgaagtctttcctatgtccttcttgatggaacaagctggaggacagtcatttaccggcaaagaacgggctcttgacttggtccccaagaagatccatgaaagatctccaatattcttgggaagctatgatgatgtggaagaaatcaaggcactgtatgcagcagaagaaaaggcataaaaaatgttgttcttgtgcaggtgtatttccatctatatctttgttctaaatccaggttttttataaattaattaactacaattaatgaaaattatgtattttatgtgcaaa

SEQ ID NO: 2771 - DNA, 1285 bp, Pennisetum glaucum
ggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgcgtcggcggtcaacaaggcggggctcgccaagctcatcggactcgccggggagacaaacgtccagggtgaggagcagaagaagcttgatgtgctctccaacgaagtctttgtcaaggcgctcgtcagcagcggccgcacctgcatccttgtgtctgaggagaacgaggaggccatattcgtcgacccggccctccgtggaaagtactgcgtttgtttcgatccactagatggttcctccaatattgactgcggtgtctctatcggaacaatctttgggatttacatgatcaaagataaagacaatgtgactttggatgatgtgatgcaacctggaacaaacatgcttgctgctggctactgcatgtatgggagttcctgcacgcttgtgctaagcactgggaatggagtcaacggtttcactcttgatccttcccttggggagttcatactgactcatccaaatatcaagatacccaagaaagggaagatctattctgtcaatgaagggaatgccaaaaactgggatgcgccgacagcaaagtatgtggagacatgcaagtttccccaggatggttcatcacctaaatcattgagatatattggaagtatggttgctgatgtccaccgtaccttgctatatggaggcatatttttgtacccagctgacaagaagagcccaaatggaaaactccgtgttctgtatgaagtcttcccaatgtcattcctgatggaacaagctggaggtcaggctttcacaggcaaacaacgggcccttgagcttgcccctactaagcttcatgagagatccccaatattcctggggagctacgatgatgttgaggagatcaaggcattgtacgcttcagagtcaagcaccgtttgattgttctcctgacttcctgattgtatcattctccggagggggacaatgtaattgtgtattgatcagatatttatgttctgatcttgccttcgtgaccttaatgtaaagtattcacagtcaactcaatgtatcttgctatcatgattccttaataatttttggattcaaaacgtacgaggacatgttttgaaactaacttggtgggagatctgccgattgtactaaaatgatgaaggcatgttacttgtgagattttaaata

SEQ ID NO: 2772 - DNA, 1220 bp, Helianthus annuus
atacagttaggttgcttgcttggtttgttattgaaggatggatcacgctgcggatgctatgcatacggatttgatgacgatcacgaggttcgtgttgaacgagcagtccaagtatccggagtcgcgtggtgatttcagtattttgcttagtcacattgttcttggttgcaagtttgtttgtgctgctgttaataaggcaggtttggcaaaactcattggacttgctggggagaccaatgtgcagggagaagaacagaagaaactggatgttttgtcgaatgaagtttttgtgaaggctttggtcagcagtggcagaacatgcatacttgtttccgaagaggacgaggaagcgataatcgtagaaccatccaagcgcggaaagtattgtgttgttttcgacccgttggatggatcttccaacatcgactgcggtgtttccataggaactatttttgggatttacatgataaaagatgctggtgcggcccgtttagaagatgttcttcagcccggaaagaatatgctggctgctggatactgcatgtacggtagctcttgcacgcttgtgttgagcactggatcgggtgtgaatggatttactcttgatccgtctttaggggagtttatactcacccaccctgacattaagattccaaagaaaggaaagatttattctgttaatgaaggaaatgctaagaactgggatggtcctactgcaaagtttgtcgaaaaatgcaagttcccgaaggatggttcacctgcaaaatctctaagatatattggaagtatggttgccgatgttcatcgtaccttactttacgggggtgtgtttttgtacccggccgataagaaaagcccgaatggaaaactaagggttctctatgaagtcttccctatgtcattcttgatggaacaagctggaggacagtcgtttaccgggaaagaacgggctcttgatttggtccccaagaagatacatgaaagatctccaatattcttgggaagctatgatgatgtggaagaaatcaaggctctgtatgcagctgaagaaaaggcataaataaggtttttcttgtgcattgtgcagttgtatccctctttttctttgttctaaatccagtttttttataactttttttgttataatttgttgtatttgatatgtgtctatttaattgtcatgtaatattgtgatttttatttttataataatggaataa

SEQ ID NO: 2773 - DNA, 1289 bp, Helianthus annuus
gggacgatcaattcatctccccctttatttatttaaaaaaaaaaaaaaatacatacatacatacatagatacagctaggttgcttggtttgtttgttattgaacgatggatcacgctgcggatgctatgcatacggatttgatgacgatcacgaggttcgtgttgaacgagcagtcaaagtatccggagtcgcgtggtgatttcagtattttgcttagtcacattgttcttggttgcaagtttgtctgtgctgctgttaataaggcaggtttggcaaaactcattggacttgctggggagaccaatgtgcagggagaagaacagaagaaactggatgttttgtcgaatgaagtttttgtgaaggctttggtcagcagtggcagaacatgcatacttgtttccgaagaggacgaggaagcgataatcgtagaaccatccaagcgcggaaagtattgtgttgttttcgacccgttggatggatcttccaacatcgactgcggtgtttccataggaactatttttgggatttacatgataaaagacgctggtgcggcccgtttagaagatgttcttcagcccggaaagaatatgctggccgctggatactgcatgtacggtagctcttgcacgcttgtgttaagcactggatcgggtgtgaatggatttactcttgatccgtctttaggggagtttatactcacccaccctgacattaagattccaaagaaaggaaagatttattcggttaatgaaggaaatgctaagaactgggatggtcctactgcaaagtttgtcgaaaaatgcaagttcccgaaggatggttcacctgcgaaatctctaagatatattggaagtatggttgccgatgttcatcgtaccttactttacgggggtgtgtttttgtacccggccgataagaaaagcccgaatggaaaactaagggttctctatgaagtcttccctatgtcattcttgatggaacaagctggaggacagtcatttaccgggaaagaacgggctcttgatttggtccccaagaagatacatgaaagatctccaatattcttgggaagctatgatgatgtggaagaaatcaaggctctgtatgcagctgaagaaaaagcataaataaggttgttcttgtgcattgtgcagttgtatccctctttttctttgttctaaatccagttttttttataactttttttgttataatttgttgtatttgatatgtgtctatttaattgtcatgtaatattgtgatttttatttttataataatgaaataa

SEQ ID NO: 2774 - DNA, 1235 bp, Avena sativa
gaggagccagcaccttccgtagctagctacctagccagagagatggatcacgcggcggaggcgcagcggacggacctgatgacgatcacgcggcacgcgctgaacgagcagggccggcacccggagtccaggggcgacttcaccatcctcctctcacacatcgtactcggctgcaagttcgtcgcctccgccgtcaacaaggccggcctcgccaagctcatcggcctcgccggagagaccaacatccagggggaggagcagaagaagctggacgtgctgtccaacgaggtctttgtcaaggcgctcgtcagcagcggccgcacctgcgttctcgtgtctgaagagaacgaggaggccatattcgtcgacggtcccctccgcgggaagtactgcgtgtgctttgacccgctggatggctcctccaacatcgactgcggcgtctccatcggaacgatcttcgggatctacatgatcaaagacaaggacaatgcgactctggaggacgtgctgcaacctggaaccaacatgatcgctgctggctactgcatgtatgggagttcatgcacgcttgtcttgagcactggaaatggtgttaatggtttcactctagatccttcccttggggaattcatactcacacatccaaacataaagattccgaacaaagggaagatctattcggtcaacgaagggaacgccagaaactgggatgttcctacagccaagtttgtagagaagtgcaaatttccccaagacggttcatcaccaaaatccttgagatatattggaagtatggttgctgatgttcaccgtaccctgctatatggaggcatattcttgtaccctgcagacaagaagagccccaacggaaagcttcgtgttctgtatgaggttttccccatgtcgttcctgatggagcaagctggaggccaatctttcactggcaaacaacgggcgcttgaacttgctcctactgagattcaccagagatctccaatattccttgggagctacgatgatgtggaggagatcaaatcattgtacgcttcagagtctagcactggtctgagtgcctgaagacagcagaaacatgttccgcattgcgtcgctcgaaaaaaagaaagaaactatgttcggcgtcttaactggattccttagatagttacttatggcgattctgggattgtcgtcttggccttgatgtacaagaatcagtatagatgttgcacaaagtt

SEQ ID NO: 2775 - DNA, 1274 bp, Triphysaria pusilla
acagataacatttctatactatatatacatggacacgcataaataaagtttcttggagttatcataataattatagtggagtgcgcagtcaaaaagatatagttttgtagttacacatttttcgcaaaggtttttggggcgatggatcacgcggcggatgcttaccggaccgatttgatgacgataacccgtcatgtgttgaacgagcagtcaaagcacccggagtcgcgtggggatttcacgattttgctcagtcatattgttcttggctgcaaattcgtttgctctgctgttagcaaggccggtttggctaaacttatcggactagccggagaaactaatgtgcagggtgaagaacaaaagaaattagacgtgctctcgaacgaagttttcatcaaggcgttagttagtagtggacgaacttgtatccttgtctctgaagaagatgaagaggcaacattcgtggagccctctcaccgtggaaagtattgtgttgtgtttgacccgttggatggatcttccaacattgattgtggtgtttcaattggaactatatttggtatttatgctatttacgatgggcatgatccgaaactggaagacgtgttacagcctgggaaaaacatgttagccgcaggctattgcatgtatggaagctcgtgcacgtttgtgttaagtactggatcgggagttaatgggttcacgctcgatccatctcttggtgaattcattttgactcatcctgatattaagattccgaaaaaaggcaaaatttattctgttaacgaaggaaatgccaagaactgggatggccctactgcaaagtatgtggagaaatgcaagtaccccacagacgggtcacctgcaaaatccctgagatacatcggaagtatggtagccgatgtccatcgcacgttgctctatggaggcgtatttttgtacccagccgataagaaaagcccaaatggaaaactgagggtcctatacgaagtttttcccatgtcgtttttgatggaacaagcaggaggacaagcatttacagggaaggagcgggcacttgatttgcttcctcagaagatacacgaccgctcaccgatattccttggtagctatgacgatattgaggagatcaaagcattatatgctgctgaggagcaaaaataatggacttgtaaatttcttttacggactttcgattttttactcattgttaattactctttcatgtaataaaaacacaattattcttttggaatatatagtttcggttctga

SEQ ID NO: 2776 - DNA, 1461 bp, Triticum aestivum
cacgccgcgcgtcacgtcacggctcgcagccggccacttcccgcgccgtacctctcgggcatagatagatcgctcacttccggggcctgcgctgcaagcaaagcccgcaacacgtaccaactctcctacgagctgagcgagcgaacgggagagagggtcggcgtcggagaaggaagatggatcacgcggcggacacgttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctctccaacgaggtgttcgtcaatgccctcgtcagcagcggccgcacctgcgttcttgtgtccgaggaggacgagaaggcgacgttcgtggaccctaagctccgtggaaagtactgtgtctgctttgaccccctggatggatcctccaacatcgactgcggcgtctccatcggaacgatctttgggatctacatgatcaagaaccaagacaccgtgactctggaggaagtactgcagcctgggaaggacatgattgctgccggatactgcatgtatgggagttcctgcacgcttgtcctgagcactggaaatggtgtcaacggcttcacgcttgacccctctctcggggagttcataatgactcatccagatatcaagataccgccgaaaggaaagatctattcggttaatgaagggaacgccaagaactgggacacgcctactgcaaagtacgtggagaagtgcaagtaccccacggatggttcatcacctaaatcccttagatacatcggcagcatggttgctgatgtgcaccgcaccttgctatacggcggcatatttctgtaccccgcggacaagaagagcccaagcggaaagctccgtgtgatgtatgaggtgttccccatgtcattcctgatggaggaggctggaggccagtctttcacaggcaaaggacggtcgctcgacctgatccccaccgacatccacgagagatcgccgatattcctcggcagcagcgacgacgtggaggagatcaaggcactgtacgcggaggaggccaagaaggcagggtctgcatgatgatcggcggccgtcgcgtgtgaatcgatggcgacccatgggcctttgctggcaatgtgattcgtatgtcaggcatttcttttctatacgtccgtgtcattcagtgtaatatagcgtgtggaggcctcgaacagcttcattcatgagcagccaaggcttctgcctctcacaacaatccactgatgatggcacgtaatatacctccataactacatgtttccagctgaccagctcaagaggaccagttgcc

SEQ ID NO: 2777 - DNA, 1445 bp, Triticum aestivum
gcgctgcaagcaaaacgagctctccgtccgagctaagcgaacgagagggagggtagggtcgtccccggccgatcggagaagatggatcacgcggcggacacgttccggacggacctgatgaccatcacgcggcacgtgctgaacgagcagagcaggcacccagagtcgcgcggcgacctcaccatcctcctctcccacatcgtcctcggctgcaagttcgtcgcctccgccgtcaacaaggccggcctcgccaagctcaccggtctcgccggcgagaccaacgtccagggggaggagcagaagaagctggacgtgctctccaacgaggtgttcgtcaatgccctcgtcagcagcggccgcacctgtgttcttgtgtccgaggaggacgagaaggcgacgttcgtggaccctaagctccgtgggaagtactgtgtctgctttgaccccctggatggctcctccaacatcgactgcggcgtctccatcggaacgatctttgggatctacatgatcaagaaccaagacaccgtgactctggaggaagtactgcagcctgggaaggacatgattgctgctggatactgcatgtatgggagttcctgcacgcttgtcctgagcactggaaatggtgtcaacggcttcacgcttgacccttctcttggggagttcataatgactcatccagacatcaagataccgccgaaaggaaagatctattcggttaacgaagggaatgccaagaactgggacacccctactgcaaagtacgtggagaagtgcaagtatcccacggatggttcatcacccaaatccttgagatacattggcagcatggttgccgatgtccaccgcaccttgctatacggcggcatattcctgtaccccgcggacaagaagagcccgagcggaaagctccgtgtgatgtatgaggtgttccccatgtcattcctgatggaggaggctggaggccagtctttcacaggcaaaggacggtcgcttgacctgatccccaccgacatccacgagagatccccgatattcctgggcagcagcgacgacgtggaggagatcaaggcgctgtacgcggaggaagccaagaaggaaggatctgcatgatggtcgaccggtcgtcgcgcgcaaggcgtgtgaatcgatgacgactcgtgggccttgctgacaatgtgattcgaatgtcaggcatttcttttctatatatacgtctgtgtcattcagtgtaatatagcgtggaggccttgaacagcttcactcgtgagcagccaaggcttctgcttctttccacaattcgttcactgatgatacgtaatatacatccatgtatacatatatccatctcaggaggaccagtgccgcaagctgtgcggaatgcgttgcatgtacatacagattgctgcatcgtgtgagtaaacatgtcgactatttcagag

SEQ ID NO: 2778 - DNA, 1535 bp, Triticum aestivum
gcagccggccacttcccgcgccgtactacttgggcggcatagatagatcgctcgctcacttccagggcctgcgctgcaagcaaagcgagctctccgtccgagctaagcgaacgagagggagggtagggtcgtccccggccggccggagaagatggatcacgcggcggacactttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctgtccaacgaggtgttcgtcaatgccctcgtcagcagcggccgcacctgcgttcttgtgtccgaggaggacgagaaggcgacgttcgtcgaccctaagctccgtggaaagtactgtgtctgctttgatcccctggatggatcctccaacatcgactgcggcgtctccatcggaacgatctttgggatctacatgatcaagaaccaagacaccgtgactctggaggaagtactgcagcctgggaaggacatgattgctgctggatactgcatgtatgggagttcctgcacgcttgtcctgagcactggaaatggtgtcaacggcttcacgcttgacccttctcttggggagttcataatgactcatccagacatcaagataccgccgaaaggaaagatctattcggttaacgaagggaatgccaagaactgggacacccctactgcaaagtacgtggagaagtgcaagtatcccacggatggttcatcacccaaatcattgagatacattggcagcatggttgctgatgtccaccgcaccttgctatacggcggcatatttctgtaccccgcggacaagaagagcccgagcggaaagctccgtgtgatgtatgaggtgttccccatgtcattcctgatggaggaggctggaggccagtctttcacaggcaaaggacggtcgctcgacctgatccccaccgacatccacgagagatccccgatattcctcggcagcagcgacgacgtggaggagatcaaggcgctgtacgcggaggaggccaagaaggcaggatctgcatgatgatcggcggccatcgcgcgcaaggcgtgtgaatcgatggcgactcgtgggccttgctgacgatgcgattcgtatgtcaggcattccttttctatatatacgtctgtggcactcagtgtaatatagcgtgtggaggcctcgaacagcttcattcatgagcagccaaggcttctgcctctcacaacaatccactgatgatggcacgtaatatatcataactacatgtatccagctgaccagctcaagaggaccagttgccgcaggttgtgcaggacgtatcgcatatacatgtaggacgtgtttggttgcatgcattaccttcaaccagccggttgggccaaaaaaaaaa

SEQ ID NO: 2779 - DNA, 1613 bp, Mimulus guttatus
tatggtctaaactttttctcgggttcataaaaaaaaggatatagctggtcaaagagatatatagatacagagtttgtgtacgtatattttgtatctggtttagcgatggatcacgcggcggatgctcaccggactgatttgatgacaataaccaggcacgtgctgaatgagcagacgaagcacccggaatcgcgtggggatttcaccatcttgctcagtcatattgttcttggctgcaaattcgtctgctctgctgttaacaaggctggtttggctaagcttataggacttgctggagagactaatgttcagggtgaagagcagaagaaactagatgtgctctcaaatgaagtattcatcaatgctttagtcagtagcggccgaacttgcattcttgtatctgaagaggatgaagaggcgactttcgtggaaccctctaagcgtggaaagtattgtgttgtattcgacccattggatggatcgtccaatatcgactgtggtgtttctattggaactattttcgggatttatttgatcaaagatggagatgaaccgaagctggaggacgttttgcagcctgggaagaatatgttagctgctggctattgcatgtatggaagctcttgcacgtttgtgttgagtactggaggtggagttaacgggttcacactcgatccatctcttggagaattcatactgactcatccagatattaagattccgaagaaaggaaagatttattcggttaatgaaggaaacgccaagaattgggatggaccgacagcaaagtatgtggaaaaatgcaagtttcctacagatgggtcagcatccaagtctctgagatacattggaagcatggttgctgatgttcatcgcacgttgctctatggaggtgtctttttgtaccctgctgataagaaaagcccaaacggaaaactgagggtcctctacgaagtcttcccaatgtcgtttttgatggaacaagcaggtgggcaagcatttactgggaagcaacgggcacttgatttggttcctgaaaagatacacgaccgttccccgatattccttggtagttatgatgacgtggaggagatcaaagcattgtatgcggctgaagagcaaaaataatcaacttgtaaattcttcttttccgaaactttttcagtttcttgattttgctaatactctttagcatatattttcaagtcgaaaagttattgatgaaaggacgggctccaagtataattaaataaaaatgcatgcatcttatgaaggaaaaaaaattgtctcgtactataagtttttacgcaataaaatgaacacacgagggatttggtgtgcgtttccattaacacaatggcgattttcgtaatttgaaggaataatgactggaaaataaattaaaacagcaagtaaaaatgagtaataatgtgacaagaataaccaagtgtcatagatttctatcattaagtaaaaaaaataaaaaaataaaaaaaatcatatatttatattttgtgcataaaattcttgaacatttggtgttggacccaaacggctttcgaccacactgcaactccaccgggtatcggcatcgaagttttgctcctatcttc

SEQ ID NO: 2780 - DNA, 1420 bp, Secale cereale
aagcagcacgtaccagctcactccccgtccgagctaagcgagccggagccggagccggagaagatggatcacgcggcggacacgttccggacggacctgatgaccatcacgcggtacgtgctcaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctctccaacgaggtgttcgtcaatgccctcgtcagcagcggccgcacgtgcgttcttgtgtccgaggaggacgagaaggcgacgttcgtcgacccaaagctccgtggaaagtactgtgtctgctttgatcccctggatggctcctccaacatcgactgcggcgtctccatcggaacgatctttgggatctacatgatcaagaaccaagacacggtgactctggaggaagtgctgcagcctgggaaggacatgattgctgctggatactgcatgtatgggagttcctgcacgctcgtcctgagcactggaaatggtgtcaacggcttcacgcttgacccttctcttggggagttcataatgactcatccagacatcaagataccgccgaaaggaaagatctattcggttaatgaggggaatgccaagaactgggacacccctactgcaaagtacgtggagaagtgcaagtatcccacggatggttcatcacccaaatccttgagatacattggcagcatggttgccgatgtccaccgcaccttgctatacggcggcatatttctgtaccccgcggacaagaagagcccgaacggaaagcttcgtgtgatgtatgaggtgttccccatgtcattcctgatggaggaagctggaggccagtctttcacaggcaaaggacggtcgctcgacctgatccccaccgacatccacgagagatccccgatattcctcggcagcagcgacgacgtggaggagatcaaggcgctgtacgcggaggaggccaagaaggcaggatctgcatgatgatcgacggtaaatcgacgacgactcatgggccttgctggcaatgtgattcgtatgccaggcatttcttttctgtacgtcagtgtcgttcagtgtaatatagcgtggaggcctcgaacagcttcactcatgagcagccaaggcttctgcttcttcccacaattcgttcactgataatacgtaatatacatccatgtacacatatattcatctcaggaggaccagtgccgcaagctgtgcagaatgcattgcatatacatgcagattgctgcatcatgtgtgtaaacatgtcgactatttcagagccgaaagatgcatgcca

SEQ ID NO: 2781 - DNA, 1454 bp, Secale cereale
ttccggggcctgcgctgcaagcaataagcaaagcagcacgtaccagctcactccccgtccgagctaagcgagccggagccggagccggagaagatggatcacgcggcggacacgttccggacggacctgatgaccatcacgcggtacgtgctcaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctgtccaacgaggtgttcgtcaatgccctcgtcagcagcggccgcacctgcgttcttgtgtccgaggaggatgagaaggcgacgttcgtcgacccaaagctccgtggaaagtactgtgtctgctttgatcccctcgatggatcctccaacatcgactgcggcgtctccatcggaacgatctttgggatctacatgatcaagaaccaagacaccgtaactctggaggaagtactgcagcctgggaaggacatgattgctgctggatactgcatgtatgggagttcctgcacgctcgtcctgagcactggaaatggtgtcaacggcttcacgcttgacccttctcttggggagttcataatgacccatccagacatcaagataccgccgaaaggaaagatctattcggttaatgaggggaatgccaagaactgggacacccctactgcaaagtacgtggagaagtgcaagtatccaacggatggttcatcacccaaatccttgagatacattggcagcatggttgccgatgtccaccgcaccttgctatacggcggcatatttctgtaccccgcggacaagaagagcccgaacggaaagctccgtgtgatgtatgaggtgttccccatgtcattcctgatggaggaagctggaggccagtctttcacaggcaaaggacggtcgctcgacctgatccccaccgacatccacgagagatccccgatattcctcggcagcagcgacgacgtggaggagatcaaggcgctgtacgcggaggaggccaagaaggcaggatctgcatgatgatcgacggtaaatcgacgacgactcatgggccttgctggcaatgtgattcgtatgccaggcatttcttttctgtacgtcagtgtcgttcagtgtaatatagcgtggaggcctcgaacagcttcgctcatgagcagccaaggcttctgcttcttcccacaattcgttcactgatgatacgtaatatacatccatgtacacatatatatccatctcaggagaggagaaccagtgccgcaagctgtgcagaatgcattgcatatacatgcagattgctgcatcatgtgtgtaaacatgtcgattatttcagagccgaaagatacatg

SEQ ID NO: 2782 - DNA, 1438 bp, Secale cereale
agcaataagcaaagcagcacgtaccagctcactccccgtccgagctaagcgagccggagccggagccggagaagatggatcacgcggcggacacgttccggacggacctgatgaccatcacgcggtacgtgctcaacgagcagagccggcacccggagtcgcgcggcgacctcaccatcctcctctcccacatcgtcctcggctgcaagttcgtcgcctccgccgtcaacaaggccggcctcgccaagctcaccggcctcgcgggcgagaccaacgtccagggggaggagcagaagaagctggacgtgctctccaacgaggtgttcgtcaatgccctcgtcagcagcggccgcacctgcgttcttgtgtccgaggaggatgagaaggcgacgttcgtcgacccaaagctccgtggaaagtactgtgtctgctttgatcccctggatggatcctccaacatcgactgcggcgtctccatcggaacgatctttgggatctacatgatcaagaaccaagacaccgtgactctggaggaagtgctgcagcctgggaaggacatgattgctgctggatactgcatgtatgggagttcctgcacgctcgtcctgagcactggaaatggtgtcaacggcttcacgcttgacccttctcttggggagttcataatgactcatccagacatcaagataccgccgaaaggaaagatctattcggttaatgaggggaatgccaagaactgggacacccctactgcaaagtacgtggagaagtgcaagtatcccacggatggttcatcacccaaatccttgagatacattggcagcatggttgccgatgtccaccgcaccttgctatacggcggcatatttctgtaccccgcggacaagaagagcccgaacggaaagctccgtgtgatgtatgaagtgttccccatgtcattcctgatggaggaagctggaggccagtctttcacaggcaaaggacggtcgctcgacctgatccccaccgacatccacgagagatccccgatcttcctcggcagcagcgacgacgtggaggagatcaaggcgctgtacgcggaggaggccaagaaggcaggatctgcatgatgatcgacggtaaatcgatgacgactcatgggccttgctggcaatgtgattcgtatgccaggcatttctttcctatacgtcagtgtcgttcagtgtaatgtagcgtggaggcctcgaacagcttcactcatgagcagccaaggcttctgcttcttcccacaattcgttcaccgatgatacgtaatatacatccatgtatacatatattcatctcaggaggaccagtgccgcaagctgtgcagattgcattgcatatacatgcagattgctgcatcatgtgtgtaaacatgtcgactatttcagagccgaaagatgcatgccaaagcgca

SEQ ID NO: 2783 - DNA, 1325 bp, Secale cereale
gcagcacgtaccagctcactccccgtccgagctaagcgagccggagccggagccggagaagatggatcacgcggcggacacgttccggacggacctgatgaccatcacgcggtacgtgctcaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctgtccaacgaggtgttcgtcaatgccctcgtcagcagcggccgcacctgcgttcttgtgtccgaggaggatgagaaggcgacgttcgtcgacccaaagctccgtggaaagtactgtgtctgctttgatcccctggatggatcctccaacatcgactgcggcgtctccatcggaacgatctttgggatctacatgatcaagaaccaagacacggtgactctggaggaagtgctgcagcctgggaaggacatgattgctgctggatactgcatgtatgggagttcctgcacgcttgtcctgagcactggaaatggtgtcaacggcttcacgcttgacccttctcttggggagttcataatgactcatccagacatcaagataccgccgaaaggaaagatctattcagttaatgaagggaatgccaagaactgggacacccctactgcaaagtacgtggagaagtgcaagtatcccacggatggttcatcacccaaatccttgagatacattggcagcatggttgccgatgtccaccgcaccttgctatacggcggcatatttttgtaccccgcggacaagaagagcccgaacggaaagctccgtgtgatgtatgaggtgttccccatgtcattcctgatggaggaagctggaggccagtctttcacaggcaaaggacggtcgctcgacctgatccccaccgacatccacgagagatccccgatcttcctcggcagcagcgacgacgtggaggagatcaaggcgctgtacgcggaggaggccaagaaggcaggatctgcatgatgatcgacggtaaatcgacgacgactcatgggccttgctggcaatgtgattcgtatgccaggcatttcttttctgtacgtcagtgtcgttcagtgtaatatagcgtggaggcctcgaacagcttcactcgtgagcagccaaggcttctgcttcttcccacaattcgttcaccgatgatacgtaatatacatccatgtacacatatattcatctcagaaggaccagtgcc

SEQ ID NO: 2784 - DNA, 1367 bp, Triticum aestivum
caagcaaagcccgcaacacgtaccaactctcctacgagctgagcgagcgaacgggagagagggtcggcgtcggagaaggaagatggatcacgcggcggacacgttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctctccaacgaggtgttcgtcaatgccctcgtcagcagcggccgcacctgcgttcttgtgtccgaggaggacgagaaggcgacgttcgtggaccctaagctccgtggaaagtactgtgtctgctttgaccccctggatggatcctccaacatcgactgcggcgtctccatcggaacgatctttgggatctacatgatcaagaaccaagacaccgtgactctggaggaagtactgcagcctgggaaggacatgattgctgccggatactgcatgtatgggagttcctgcacgcttgtcctgagcactggaaatggtgtcaacggcttcacgcttgacccctctctcggggagttcataatgactcatccagatatcaagataccgccgaaaggaaagatctattcggttaatgaagggaacgccaagaactgggacacgcctactgcgaagtacgtggagaagtgcaagtaccccacggatggttcatcacctaaatcccttagatacatcggcagcatggttgctgatgtgcaccgcaccttgctatatggcggcatatttctgtaccccgcggacaagaagagcccaagcggaaagctccgtgtgatgtatgaggtgttccccatgtcattcctgatggaggaggctggaggccagtctttcacaggcaaaggacggtcgctcgacctgatccccaccgacatccacgagagatcgccgatattcctcggcagcagcgacgacgtggaggagatcaaggcactgtacgcggaggaggccaagaaggcagggtctgcatgatgatcggcggccgtcgcgtgtgaatcgatggcgacccatgggcctttgctggcagtgtgattcgtatgtcaggcatttcttttctatacgtccgtgtcattcagtgtaatatagcgtgtggaggcctccaacagcttcattcatgagcagccaaggcttctgcctctcacaacaatccactgatgatggcacgtaatatacctccataactacatgtttccagctgaccagctcaagaggaccagttgcc

SEQ ID NO: 2785 - DNA, 1136 bp, Triticum aestivum
acgtaccaactctcctacgagctgagcgagcgaacgggagagagggtcggcgtcggagaaggaagatggatcacgcggcggacacgttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctctccaacgaggtgttcgtcaatgccctcgtcagcagcggccgcacctgcgttcttgtgtccgaggaggacgagaaggcgacgttcgtggaccctaagctccgtggaaagtactgtgtctgctttgaccccctggatggatcctccaacatcgactgcggcgtctccatcggaacgatctttgggatctacatgatcaagaaccaagacaccgtgactctggaggaagtactgcagcctgggaaggacatgattgctgccggatactgcatgtatgggagttcctgcacgcttgtcctgagcactggaaatggtgtcaacggcttcacgcttgacccctctctcggggagttcataatgactcatccagatatcaagataccgccgaaaggaaagatctattcggttaatgaagggaacgccaagaactgggacacgcctactgcgaagtacgtggagaagtgcaagtatcccacggatggttcatcacccaaatcattgagatacattggcagcatggttgccgatgtccaccgcaccttgctatacggcggcatatttctgtaccccgcggacaagaagagcccgagcggaaagctccgtgtgatgtatgaggtgttccccatgtcattcctgatggaggaggctggaggccaatctttcacaggcaaaggacggtcgcttgacctgatccccaccgacatccacgagagatccccgatattcctgggcagcagcgacgacgtggaggagatcaaggcgctgtacgcggaggaagccaagaaggaaggatctgcatgatggtcgaccggtcgtcgcgcgcaaggcgtgtgaatc

SEQ ID NO: 2786 - DNA, 3226 bp, Malus domestica
attccgttgtttccatgtctggcttttgtaacatttaaccctcccatcgagggttttgaattccaattcctcctcctcctccgccttcttcaaatctcaaactttgctgtgcgatttggaatcggaaccctaactatcgagccttggatcttaaagggttccaatggcggatcacgaggaggaggacctccgaatggcactgcggatgagtatgcagaattcacctccggagcccaagcgtagcaagcccagggacggacccgccggagctccggctgaggagccgtcggaagtgaagacccggagacttcagcgggagctcatggctgctgctgctgagaagagaatgctggacaccagtaagtgtccgccttcggcttcggcttcacctagcaaggtgttgtcggggtctgcgggttccggttcgggtttggcgccaaacgtggcgacgaaagataaggaattgagcttggaggaagtgaatttgggaaaggggttgagcgaagaggatgcaaagcagttgttttcgatggttttcggacccgaggttacgaagggcattcttgtgcagtggagtaatcagggaataaggtttagctctgatccagaaacatctatgggtctagtgcagcatgaaggtgggccctgtggcgttttagcagccattcaagcatttgttctcaaatacctccttttctacccagctgaattaggtaaagttgcaccaaacatgcatcaaaatacgggttcaaggacaccgtctaatagtcagtgtgttgcatcgaataattttgcctctcttactgaagatgcaaaagcaagtgtacttattagaagtatgggtgagatattgttcttatgtggaagcaataaaagggcggtgattgcaactttgagtgttattggagatgaaactgagagggctgatgacaacctgaatgatgaagtaataacaaagtcacttgaaagtctttcaatcgaatcagctgctgatttgcataaagtgctaagagttagcacttacacaacacaagaaagtgcgtttatggggctccaagcagtgcttcctgtcttccaaagtcgtatgggggcactgctgttccttatttctgctttactttctcgaggactggacttggtacaatctgacagggatgaccccggcctacctcttgtcactgctccatttgggcatgcttcacaggaaattgtgaacttattgctctgtgggcaggcagtccctaatgttttcgatggaaagatggatttaggtggtggcatgtctttaaaaggcatatccaaaactgtggaagttggattcctcactctgttagaatccctaaattactgtaaggttggtcagtatttgaaaagtccaaaatggccaatctgggtggttgggagtgagtctcattatacagtccttttttctcttgataccactgttcaagatgagaatgaactggaaggaagggaatcacagattcggagagcttttgatgcacaagatcagagtggtggtggtggttttattagtgtggaaggctttcatcaagtccttagggaaactaacgtaaaacttccaactgagaaggttgacctcctctgcaacacaggatttatcgtatggagtgagttgtggcaggtcattttggatttggacaagagcttaggaggcctgaaggattcaactggattgatgggtaagaaggtgtttgatctttaccattttaatggaattgcaaaatctgacctgaatggaagccagacaagctcgggaggcgagattccagttcaaagacctaggctcacaaaattgagggtgtcggtacctccaaggtggactcctgaagaatacatgacagatgtggtagtgtcctctgcttctagtggtaatgaatctggagggaaagtcacagaaattgctaagccggagcctgctcagcatgcacctctggtggactgcataagaacacgctggccccgtgctgtctgcaattgggtttttagtgacagtggttttgtggggaaaaaggaaggacggcagagaaaaatggatcacgcagccgatgctcaccggacggacttgatgaccataacgaggttcgtgctgaatgagcagtccaagcaccctgagtcccgcggtgacttcaccatcttgctcagtcatattgttcttggctgcaagtttgtctgctctgcagtcaacaaggctggtctggccaaacttatcgggcttgctggagagaccaatgttcagggtgaagagcaaaagaaactggatgttctttcaaatgaagtttttgttaaggctctggttagcagtggcagaacttctattcttgtttcagaagaagatgaagaggcgattttcgtggagccaaaattgcgtggaaagtactgtgttgtgttcgatccactggacggttcgtccaacattgattgtggtgtttccattggaacgatttttgggatttatgtggttaaagatggtgaaccttctcttaaagatgtcttgcaacctggaaagaaaatggttgcagcaggctactgcatgtacggaagcttttgcacgttggtgataagcactggatctggagttcatgggttcacccttgatccttctctcggggagttcatactaactcacccagacatcaagattccaaagaaaggaaagatctattcagtgaatgaagggaatgccaaaaattgggatggcccgacggccaagtatgtgcaaaagtgcaagtacccggaagatggttcatccccgaagtctctaagatacattggaagcatggttgctgatgttcatcggacattgctttatggcggtatctttttgtaccctgctgataagaagagcccaaacggaaaactgcgggttctctacgaagtcttcccaatgtccttcttgttggaacaagcgggcggtcagtccttcactggcaaggaacgggcccttgacctggttccgaccaagatacacgagcgctctccgatcttcctcggcagctacgacgacgttgaggaaatcaaggcactctatgcagctgaaggaaaggaatgaaacctataattctggttctctcatcgtaaatcacataattgttaatctatttgaactcctctattagatgaagtttgtatggagagcgtacaataatttgttgatgcttacaactctaacaaggttatagtcttaaattctggaaaaccgctt

SEQ ID NO: 2787 - DNA, 1154 bp, Chrysanthemum coronarium
taatatatcataacaagaaaaaaaaaaaatacatacagtattatatatttttttgagaaagaaaaaaaagatggatcatgaggcagatgcgtttaggacagatttaatgacgataacacgattcgtgttgaatgaacagtcgaaacatccggagtcacgtggtgattttagtattttgcttagtcacattgttcttggttgcaagtttgtttgtgctgctgttaataaggcgggtttggctaagctcattggacttgctggagagaccaatgtgcagggagaagagcagaagaaactggatgttctttcaaatgaagttttcgtgaaagctttggtcagcagtggcagaacatgcatacttgtttctgaagaggatgaagaagcaataattgtagaaccatctaagcgtgggaagtattgtgttgtgtttgatccgctagatggatcctccaacattgactgtggtgtttccattggaactatttttgggatctacatgataaaagacggtgatgatccatctttagaagatgtactgcagcctggaaagaatatgctggctgctggatactgcatgtatggtagctcttgcacgtttgttttgagcactggatctggtgtgaatggttttactcttgatccatctctaggagagtttatactcacccacccggacatcaagatcccaaagaaaggaaagatctattcggtcaatgaaggaaatgctaagaactgggacggtccgactgcaaaatttgtggaaaaatgcaagtaccccacggatggttcatctgccaaatctttaagatatattggaagtatggttgctgatgttcatcgcacattactttatggcggtgtgtttttgtaccctgctgataagaagagcccaaccgggaagctaagggttttgtatgaagtgttcccgatgtcgttcttgatggaacaagctggaggacagtcctttactggaaaggaacgggcacttgacctggttccaaagaagattcacgagcgatcccccatcttccttggaagctatgacgacgtggaagaaatcaaggcattgtatgcggccgaagagaaggcataaagaaggagttaagggtaattgatctcatctccgcgttcttgtgcagttcctattcgccatt

SEQ ID NO: 2788 - DNA, 1551 bp, Brachypodium distachyon
gtacctgatccgacacgcccccccgcctatttcaatcctcggaccgcggaccggatgccacctaccatctgagcctcattaactccaaatcgatccacgcaagaagaagagctagctagtaggacgatcgtgcagcagcagccagcagaaggtgatcacgaggtagtagtagtaacgatcatggatcacgcggcggaggcgcagcggacggacctgatgacgatcacgcggcacgcgctgaacgagcaggggcggcacccggagtcccggggcgacttcaccatcctcctctcccacatcgtcctcggctgcaagttcgtcgcatccgccgtcaacaaggccggcctcgccaagctcatcggcctcgccggcgtcaccaacgtccagggagaggagcagaagaagctggatgtgctgtccaatgaagtctttgtcaaggcgctcgtcagcagcggccgcacttgtgttctcgtgtccgaagagaacgaggaggccatattcgtcgatgctcccctgcgtggaaagtattgcgtctgctttgatccgttggatggctcctccaacatcgactgcggcgtctccattggaacaatctttgggatctacatgatcaaagaaaaggacaacgccactttggaggatgtactgcaacctggaactgacatgattgctgctggctactgcatgtatgggagttcatgcacgcttgtcctaagcacgggaaatggtgtaaatggtttcactctcgatccttcccttggggagttcatactaactcatccgaacataaagataccaaagaaaggaaagatctattcggtcaatgaagggaatgcccaaaactgggatgcgcccacagcaaagtttgttgagaaatgcaagttcccccaagacggtacatcagcaaaatccttaagatacattggaagtatggttgctgatgtccaccgtaccctgctatatggaggcatatttctgtaccctgcggacaaaaagagcccgaacgggaaacttcgtattctgtatgaagtttttcccatgtcattcctgatggagcaagctggaggccaggctttcactggcaaacagcgggcccttgaactcgttcctacagagatccatcagaggtctccgatattcctcgggagctacgatgatgtggaggagatgaaatcattgtatgcttcagagtcaagcacggcctgatctgggtgtaacaggatcagtgagatacttatcttgtgttcttgaccttgattgtaattactcgttatggacactcggtggtactctgtggatgtatcggtcgatatagcattgggtcggagcacggtctccggtaccggtgatgccgagcacctccttttcggttcggtggagggcgaggtgatcggtccggcgatcgccggagtgactatagacacgaagtgttgacacgagagtttacccaggtccggaccatccggaggtgtaataccctacgtcctgctttagagttgtatttcttaatgtgagtgttacaggttgccggggagtttccgagctttgcta

SEQ ID NO: 2789 - DNA, 1667 bp, Brachypodium distachyon
gggacacgtttggccgcgctgccaagcatatcccttcgccgctacccgcacccatgcggcacagacgtggaacccgtagtacctgatccgacacgcccccccgcctatttcaatcctcggaccgcggaccggatgccacctaccatctgagcctcattaactccaaatcgatccacgcaagaagaagagctagctagtaggacgatcgtgcagcagcagccagcagaaggtgatcacgaggtagtagtagtaacgatcatggatcacgcggcggaggcgcagcggacggacctgatgacgatcacgcggcacgcgctgaacgagcaggggcggcacccggagtcccggggcgacttcaccatcctcctctcccacatcgtcctcggctgcaagttcgtcgcatccgccgtcaacaaggccggcctcgccaagctcatcggcctcgccggcgtcaccaacgtccagggagaggagcagaagaagctggatgtgctgtccaatgaagtctttgtcaaggcgctcgtcagcagcggccgcacttgtgttctcgtgtccgaagagaacgaggaggccatattcgtcgatgctcccctgcgtggaaagtattgcgtctgctttgatccgttggatggctcctccaacatcgactgcggcgtctccattggaacaatctttgggatctacatgatcaaagaaaaggacaacgccactttggaggatgtactgcaacctggaactgacatgattgctgctggctactgcatgtatgggagttcatgcacgcttgtcctaagcacgggaaatggtgtaaatggtttcactctcgatccttcccttggggagttcatactaactcatccgaacataaagataccaaagaaaggaaagatctattcggtcaatgaagggaatgcccaaaactgggatgcgcccacagcaaagtttgttgagaaatgcaagttcccccaagacggtacatcagcaaaatccttaagatacattggaagtatggttgctgatgtccaccgtaccctgctatatggaggcatatttctgtaccctgcggacaaaaagagcccgaacgggaaacttcgtattctgtatgaagtttttcccatgtcattcctgatggagcaagctggaggccaggctttcactggcaaacagcgggcccttgaactcgttcctacagagatccatcagaggtctccgatattcctcgggagctacgatgatgtggaggagatgaaatcattgtatgcttcagagtcaagcacggcctgatctgggtgtaacaggatcagtgagatacttatcttgtgttcttgaccttgattgtaattactcgttatggacactcggtggtactctgtggatgtatcggtcgatatagcattgggtcggagcacggtctccggtaccggtgatgccgagcacctccttttcggttcggtggagggcgaggtgatcggtccggcgatcgccggagtgactatagacacgaagtgttgacacgagagtttacccaggtccggaccatccggaggtgtaataccctacgtcctgctttagagttgtatttcttaatgtgagtgttacaggttgccggggagtttccgagctttgctacttgtccctctaagggcttggctatttgggtgaatgct

SEQ ID NO: 2790 - DNA, 1826 bp, Zingiber officinale
gacacgcttccaactgtttgaacgtatctgccaataaggggagacagagggggagacagaggagagagagagaccggaagcggccaccggaggggcgttatctgcacctcaaccgccgaatccctatccttctctccgcctcttcttcatctttttcttcttcctcttcttccaatcgactctcgctctatatatgtacaagcgtatgcatctctaaaggtgaggcttgtgagatcgatctcagtcgctcgctgccgagaaagagggttagcgtcatggatcacgaggcggatgcgcaccggaccgacctcatgaccatcaccaggtacgtgctcaacgagcagtcgcggtacccggaatcgcgtggcgacttcagcatcctcctttcgcacatcgtcctcggctgcaagttcgtctgcaccgccgtcaacaaggccgggcttgctaagctcataggacttgctggggagacgaatgtacagggcgaagagcagaagaagcttgacgtgctttccaacgaagtctttgtcaaagctttgataagcagtgggagaacttgcattctagtttcggaagaggatgaagaggctacttttgtggatccatctctgcgtggaaaatactgtgtggtctttgatccactggatggttcctcaaacatcgactgtggtgtctccattggaacaatttttggcatttacatggttaaagacaaggagaatgtgactttaaatgacgtattacaacctgggaagaatatgctagcagctgggtattgcatgtacggcagttcttgcatgcttgtattgagcactggaagtggcgtgaatggtttcacgcttgatccttctcttggggagttcatacttacacatccatatattaagataccaaagaaaggcaaaatatattcagtgaatgaaggcaatgccaagaattgggatcgacctacaacaaagtatgtggaaaaatgcaaattccccgatgatggttcctcaccaaaatctctgagatacgttggaagcatggtggctgatgtacatcgaaccctgctttatggaggcatctttttatacccttctgacaagaagagtcctgatgggaaattacgtgttttatatgaagtcttccccatgtcattcttgatggaacaagcaggtggtcaatctttcactggaaagcaacgggctcttgacttagttcctacaaaaattcacgagaggtcacccatatttctaggcagctacgatgatgttgaggagattaaagcgctgtatgctgctgaagaaaacaacgattgatgcttctgttagtcttgtaaagttgtaatttactatcctaataaatactgtcatcatcaagcatgaatcaatctcaggcctatattctcacttcattacaacaattaaatccattgatattctgttagtttgtttttttggtttggaactaccaacaagcgactgatcagatctacatatattaaatagaaatgctatttagatgctgcttatatatctgttaatttgtatatactgctgtattttttaaaaaataaaatcatgtgtaacttgtgattaagacattttaatcatgcaaactattagcataaaaaagatctgactgaacaaaacagatgacaatattacaacaacattacttgcgacaacaatagaacaagagagttcaaaacttcttcccatcgtttaccatctccagccaaattaactattcaaaacaagatcttaaaaaaaattcgatttttgtagcactggcaagacaccatgttcgatccctcgtgccgaattcggcacgaggccccgtgc

SEQ ID NO: 2791 - DNA, 1300 bp, Helianthus annuus
gcggggacgatcaattcatctcctcctctaattattataaaaaaaaaaaaaaaatacatacatacatagatacagttaggttgcttggtttgtttgttattgaacgatggatcacgctgcggatgctatgcatacggatttgatgacgatcacgaggttcgtgttgaacgagcagtcaaagtatccggaatcgcgtggtgatttcagtattttgcttagtcacattgttcttggttgcaagtttgtttgtgctgctgttaataaggcaggtttggcaaaactcattggacttgctggggagaccaatgtgcagggagaagaacagaagaaactggatgttttgtcgaatgaagtttttgtgaaggctttggtcagcagtggcagaacatgcatacttgtttccgaagaggacgaggaagcgataatcgtagaaccatccaagcgcggaaagtattgtgttgttttcgacccgttggatggatcttccaacattgactgtggtgtttccataggaactatttttgggatttacatgataaaagacgctggtgcggcccgtttagaagatgttcttcagcccggaaagaatatggtggccgctggatactgcatgtacggtagctcttgcacgcttgtgttgagcactggatcgggtgtgaatggatttactcttgatccgtctttaggggagtttatactcacccaccctgacattaagattccaaagaaaggaaagatttattctgttaatgaaggaaatgctaagaactgggatggtcctactgcaaagtttgtcgaaaaatgcaagttcccgaaggatggttcacctgcaaaatctctaagatatattggaagtatggttgccgatgttcatcgtaccttactttacgggggtgtgtttttgtaccctgccgataagaaaagcccgaatggaaaactaagggttctctatgaagtcttccctatgtcattcttgatggaacaagctggaggacagtcgtttaccgggaaagaacgggctcttgatttggtccccaagaagatacatgaaagatctccaatattcttgggaagctatgatgatgtggaagaaatcaaggctctgtatgcagctgaagaaaaggcataaataaggttgttcttgtgcaaagtatccctctttttctttgttctaaatccagtttttttataacttttttttgttataatttgttgtatttgatatgtgtctatttaattgtcatgtaatattgtgatttttatttttataataatgaaataataaccaccttataaaata

SEQ ID NO: 2792 - DNA, 2590 bp, Cocos nucifera
ggcgacctcgactccttcaacccgtcccgttccgttttgaggcaggctgctatcagaagataaaatcccgcaagctccaaaccatcgtcgtacgcagagctcggcgagagagcgagagggcgggcgagcgttatcctcacagtgaccacggagccggagttacggcggagaggccacgtggcgtctaagcttcgatcgctcagcggataggcctatctatctccctgttctcatattctctcgctttcctttcttataaacaaggttgcaacatctcttcttcgccgcaagcgagaaagaaaaagagaatcatggatcacgcggcggatgcgcaccggacggatctgatgacgataacgcggcacgtgctgaacgagcagacgaagcatgcggagtcgcggggggacttcagcatcctcctcaaccacatcgtcctcggctgcaagttcgtctgctccgccgtgaacaaggctggccttgctaagctcattggacttgctggagagacgaatgtccagggtgaagagcaaaagaaactggatgtgctttcaaatgaagtctttgtcaaagctttgataagtagtggccgtacatgtattcttgtttcagaagaggatgaggaggcaacttttgtggatccagcacttcgtggaaaatactgtgtcgtctttgatccactggatggttcctctaacatagattgtggtgtttccattggaacgatttttgggatttacatggttaaagatgcaaatgaagtgactataaataatgtattacaacccgggaagaatatgctcgcagctggttattgcatgtatggaagttcttgcacgcttgtattgagcactggaagtggtgtcaatggtttcacactagatccatctcttggagagttcatactgacttatccaaacataaagataccaaagaaaggcaaaatatattctgtgaatgaaggaaatgccaaaaactgggatggtcctacagcaaagtttgtggagaaatgcaaatttccggaggatggttcctcgccaaagtccttgagatatattggaagcatggttgctgatgtccatcgtactcttctatatggaggcatctttttgtaccctgcagataagaagagtccaaatggaaaactacgtgtgctctatgaagtgttccccatgtcatttttgatggagcaagctggtggtcaagcttttacaggaaagcagcgggcccttgacttggttccgactaatattcatcagaggtctccaatatttctcggcagctatgatgaagttgaggaaatcaaagcactctatgctgctgaagagagcaaagcctgatgttgagatacttccttgcttacatctcaaattccaccaatcttctgttttgttatcataatcaactatcatgtccatcataaggcaaggcgtgatacttttccaaggactcgtatgacaatcctaataatttaatcaattcagtgaaaacttttgtttcttttttctttgaaacctgcattcatttatccgacccacctaattataccctatacataatacaacctgtccattttgcatcaaggttttcatcctcctatgctgtcttctcaaaatgctaaaaattgctagctactcaccattctcgtgccttgctaatttaacagacctattaagtttgaaatagggcttgctatgtgaacattcattctttacagctctctaacattatgtcagaaccttctaacctccagaatattagagaaggccatgaatttgtcaggtggtggtgaaatggttgtgatgctgaaaatgaccccctttttcaatgaaaaaccctagtctgtaccataacctcgtttacccgtgcattctatttgggctgggattgaagggatcatatctctgtgtactatactgttttgacctgttggcacccctctggaaaatgtaactctgctgcttatcattccaaactacttcagaaagctccagtgcacaatgagacaaggtagcggtcccaagatgtagcttgccactgcatcagcctctctaaacacacggagactcagaagttgccgactgcaagaccccaaacatcattcaaaaagagatggtaggaaatatcagaaaagggctactcttttaatcaccctcaaaccgtatataagtaggagggaacatgactctggtgaagttatggccagccaaagcagcaataagcactagaaactgaaactgaggtaagatgaatagttgttgctgccagcatctgccctgatcattttgcacttaaaaacctagcagctgttatctctcaatttaaacttcagcagcttatttatgttgatctttgttacccaggttggaccgtctctagctggtgtttttgtttggttttctacctatttcttttcttctccaccttttgtatcaatgcaccctcttgatgagatgctggtgacattggtcatcatttctcaggaaagaacaagaacaagaagatcataccttgccttggtctttagactaacttatcaaaaccaaggtccaagcgggctattgtgatattctctaaaagaatcctcagtcat

SEQ ID NO: 2793 - DNA, 1354 bp, Avena sativa
ccagatgcctcctccccatcccgcacccggtgccgcgcgtccatttgcttctcccacctctcgccatctgcatcctcactcgcttgtcacctcccacgatcgagaagagccagcaccgccccgagtaggtagagatggatcacgcggcggaggcgcagcggacggacctgatgacgatcacgcggcacgcgctgaacgagcagggccggcacccggagtcccggggcgacttcaccatcctcctctcccacatcgtactcggctgcaagttcgtcgcgtccgccgtcaacaaggcaggcctcgccaagctcatcggcctcgccggagagaccaacatccagggggaggagcagaagaagctggatgtgctgtccaacgaggtctttgtcaaggcgctcgtcagcagcggacgcacgtgcgttctcgtgtctgaagagaacgaggaggccatattcgtcgacggtcccctccgcgggaagtactgcgtgtgctttgacccgctggatggctcctccaacatcgactgcggcgtctccatcggaacgatctttgggatctatatgatcaaagacaaggacaatgcgactctggaggacgtgctgcaacctggaaccaacatgatcgctgctggctactgcatgtatgggagttcatgcacgcttgtcttgagcactggaaatggtgttaatggtttcactctagatccttctcttggggaattcatactcactcatcccaacataaagataccgagcaaaggaaagatatattcggtcaatgaaggaaacgccagaaactgggacgcgcccacagcaaagtttgtagagaaatgcaaatttccccaagacggttcatcaccaaaatccttgagatatatcggaagtatggttgctgacgttcaccgtaccctgctatatggaggcatattcttgtaccctgcagacaagaagagcccgaacggaaagcttcgtgttctgtacgaggttttccccatgtcgttcctgatggagcaagctggaggccaatctttcaccggcaaacaacgggcgcttgaacttgctcctactgagattcaccagagatctccgatattccttgggagctacggtgatgtggaggagatcaaatcattgtacgcttcagagtctagcactggtccgagtgcctgaagacagcagaaacatgttccgcattgcgtcgctcgaaaaaaagaaagaaactatgttcggcgtcataactggattccttagatagttacttatggcgattctgggattgtcgtcttggccttgatgtacaagaatcagtatagatgttgcacaaagttttaataagtgcaattggagttcctaaa

SEQ ID NO: 2794 - DNA, 1288 bp, Olea europaea
ccgccacaacacacgtaatttgtgtgtcagcactctgaattttgtattcctagaatcatgttccactcgtaccagataatattactatatagcctcacggccttgaccttttaaaatattttggaggacttaatcttctgttgtattttgggggaaaaatggatcatgcggctgatgcacatcggacggatttgatgaccataacgaggtttgtgttgaatgagcagtctaaacacccagaatcccgtggggatttcactatcttgcttagtcacattgttcttggctgcaagtttgtttgttctgctgttaacaaggccgggttggccaaactcatagggcttgctggcgagaccaatgtgcagggtgaagagcaaaagaaactagatgtgctctcgaatgaagtttttatcaaggctttggttagcagtggtcgcacatgcattcttgtttccgaagaggatgaagaggcaacatttgtggagccatctaagcgtggaaagtactgtgttgtctttgatccattggatggatcctcgaatattgactgtggtgtttctattggaacaattttcggcatttacatgatcaaagatggaggtgaaccggaactagaagatgtcttgcagcctggaaagaatatgatagctgcaggctactgcatgtatggaagctcctgcacgcttgttttgagtgctggaaggggagtcaatggattcaccctcgatccgtctcttggagaattcatattgacccatccagatataaagattcccaagaaagggaagatatattcagttaatgaaggaaatgccaagaactgggatggtccaacggctaagtatgtagaaaaatgcaagtttccaaaagatggttcagcaccaaaatctctaagatacatcggaagtatggtagctgatgtccatcgcacgttactttatggaggcatctttttgtaccccgctgataagaaaagcccaaatgggaagctgcgggttctctatgaagttttccccatgtcgttcttgatggaacaagctggaggacaagcatttactgggaagcagcgggcacttgacttggttcccaagaagattcacgagcgctcaccaatatttctcggtagctatgacgacgtcgaggagatcaaggccttgtatgcagctgaagagcaaaagtagtaaatgtaaatttcttttgtacctttgcagttgaccagttgttaaattgctgaaaactgatatatgtaataaaaccataacccataaactgtagattgttgatgaaa

SEQ ID NO: 2795 - DNA, 1441 bp, Triticum aestivum
gtgggggcagccggccacttcccgcgccgtacctctcgggcatagatagatcgctcacttccggggcctgcgctgcaagcaaagcccgcaacacgtaccaactcttctacgagctgagcgagcgaacgggagagagggtcggcgtcggagaaggaagatggatcacgcggcggacacgttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggcctcgccggcgagaccaacgtccagggggaggagcagaagaagctggacgtgctgtccaacgaggtgttcgtcaatgccctcgtcagcagcggccgcacctgcgttcttgtgtccgaggaggacgagaaggcgacgttcgtcgaccctaagctccgtggaaagtactgtgtctgctttgatccgctggacggatcctccaacatcgactgcggcgtctccatcggaacgatctttgggatctacatgatcaagaaccaagacaccgtgactctggaggaagtactgcagcctgggaaggacatgattgctgctggatactgcatgtatgggagttcctgcacgcttgtcctgagcactggaaatggtgtcaacggcttcacgcttgacccttctcttggggagttcataatgactcatccagacatcaagataccgccgaaaggaaagatctattcggttaacgaagggaatgccaagaactgggacacccctactgcaaagtacgtggagaagtgcaagtatcccacggatggttcatcacccaaatcattgagatacattggcagcatggttgctgatgtccaccgcaccttgctatacggcggcatatttccgtaccccgcggacaagaagagccgagcggaaagctccgtgtgatgtatgaggtgttccccatgtcattcctgatggaggaggctggaggccagtctttcacaggcaaaggacggtcgctcgacctgatccccaccgacatccacgagagatcgccgatattcctcggcagcagcgacgacgtggaggagatcaaggcactgtacgcggaggaggccaagaaggcagggtctgcatgatgatcggcggccgtcgcgtgtgaatcgatggcgacccatgggcctttgctggcaatgtgattcgtatgtcaggcatttcttttctatacgtccgtgtcattcagtgtaatatagcgtgtggaggcctcgaacagcttcattcatgagcagccaaggcttctgcctctcacaacaatccactgatgatggcacgtaatatacctccataactacatgtttccagctgaccagctcaagaggaccagttgcc

SEQ ID NO: 2796 - DNA, 1162 bp, Musa acuminata
agcagctgaggttccaacacatcaagcctagaacgatggatcacgcggccgacgcgcaccggacggacttgatgacgatcaccaggcacgtgctgaacgaacagtcgaagcaccccgagtcgaagggcgacttcaccatcctcctctcccacatcgtcctcggctgcaagttcgtctgctccgccgtcaacaaggctggcctcgccaaactcataggactcgcaggagagacgaacggtgaagaacagaagaagctggacgtgctctccaaccaagtcttcgtcaaggctttgatcagcagcggtcgcacatgtgttcttgtgtcagaagaggatgaggaagccacctttgtggatccatcactgcgtggaaagtactgcgtcgtcttcgatcccctggacggttcctctaacattgactgtggcgtctccattggaacaatttttggcatttacatggttaaagataaggataatgtgagccttgatgatgtgttgcaaccagggaagcatatggtagcagctggctactgcatgtacggcagttcttgcactcttgtgttaagcaccgggaacggtgtcaatggtttcactctcgatccatctcttggagagttcatgctcacccatccggacattaagatacccaagagaggcaaattgtactcagtgaacgaaggaaatgccaagaactgggatactcctacagcaaagtttgtggagaaatgcaagttcccaaaggatggttcatcaccaaaatctctgagatacattggaagtatggttgctgatgtccatcgaacactgctgtatggaggcatctttttgtaccctgcagataagcaaagtcctaatggaaaactacgcgttctgtatgaggtctttccaatgtcattcttgatggaacaagcaggaggtcaagcattcacaggagaacaacgggcccttgatttggttcccaccaagattcatcagaggtctccagtatttcttggcagctatgatgatgttgaggaaattaaagctctctatgctgccgaagagaagaaagcatgatcaacacacatcaaactccatcatgcttgtattccctgctcatagtcctctcacacagaactatggtgttgaacttgtattccctgtatacaagatgctcttctccc

SEQ ID NO: 2797 - DNA, 2085 bp, Chrysanthemum coronarium
gacatttacttaatcttcaatttataaaaagttgataaaaacttacagtaactcataaaaacattacaagtcaccttaattacatcaacatacaatctttattcttcataattattaaactaactccacctaggaaccaagtcctttcataaaaccatagtctctaaccaacccatgcttgccacgtggccgaggatacctttgattcacagtgatttagtcccaggtggaattttacaaacttaaaaattcaaactagaaatagtgacccgtaaaagaagaaacactttgcacttccatacttcaatttcacttctcaactgcatcaccttcttctttcttctcatcaactttctcttctggctcggcctcgggtgcaggtgcggtttcaggctcggcttttgctgcctcagttggttctgtttcagtttccacttcgggttctttggtttctttagcctcttcgggttcaggtgccacctttgcaggatgatccactggctccaccttagcttcttcttctagcacaaccttagcttcaacctcagctgcaaggacttcaggttccgattttggttccacttctagttcgggttcagcttcagttttaggttcaggtgcaacaactttgtcctcaaccggttccttaggaagttgatcatcatccttttttggttcatcaggtgtagctagtgttgtttcttgatcattggtgttattaatgtcctcctcttgaagcttgtcaaatgtttgctcattgattgtttcgtcatgcaatgccgttgtggctgatacaacctgagcagtggccattgtgttatggttgaaaattaatgaaatgcaaagaagaagaaatagaaggaaatggatcatgaagcagatgcgtttaggacggatttaatgacgataacgagatttgtgctgaatgaacagtcgaagcatccggaatcacgtggtgattttagtattttgcttagtcacattgttcttggttgcaagtttgtttgtgctgctgttaacaaggcaggtttggctaaactcattggacttgctggagagaccaatgtgcagggagaagagcagaagaaactggatgttctttcaaatcaagttttcgtgaaagctttggtcagcagtggcagaacatgcatacttgtttcagaagaggatgaagaggcaataattgtggaaccgtctaagcgtggaaagtattgtgttgtgtttgatccgctggatggatcctccaacattgactgcggtgtttccattggaactatctttgggatctacatgataaaagacggtgatgatccatctttagaagatgtactccagcctggaaagaatatgctggctgctggatactgcatgtatggtagctcttgcacgtttgttttgagcactggatctggtgtgaatggttttactcttgatccatctctaggagagtttatactcacccaccccgacatcaagatcccaaagaaaggaaagatctattcggtcaatgaaggaaatgctaagaactgggacggtccgactgcaaaatttgtggaaaaatgcaagtaccccacggatggttcatctgccaaatctttaagatatattggaagtatggttgctgatgttcatcgcacattactttatggcggtgtgtttttgtaccctgctgataagaagagcccaaccgggaagctaagggttttgtacgaagtgttcccgatgtcgttcttgatggaacaagctggaggacagtcgttcactggaaaggaacgggcacttgacttggttccaaagaagattcacgagcgatcccccatcttccttggaagctatgacgacgtggaagaaatcaaggcattgtatgcggccgaagagaaggcataaagaaggagttaagggtaattgatctcatctccgcgttcttgtgcagttcctattcgccatttctttgtttataaaaccgtgttccactcttttttcccccttttttcatatatgtaataaaaaggctaccttttaatcaatagtttttaactgttgtagaccgtagtcgtggagccaaatctttaaaacgagtagtgt

SEQ ID NO: 2798 - DNA, 1124 bp, Chrysanthemum coronarium
gaatggatcatgaagcagatgcgtttaggacggatttaatgacgataacgagatttgttctgaatgaacagtcgaagcatccggaatcacgtggtgattttagtattttgcttagtcacattgttcttggttgcaagtttgtttgtgctgctgttaacaaggcaggtttggctaaactcattggacttgctggagagaccaatgtgcagggagaagagcagaagaaactggatgttctttcaaatcaagttttcgtgaaagctttggtcagcagtggcagaacatgcatacttgtttcagaagaggatgaagaggcaataattgtggaaccgtctaagcgtggaaagtattgtgttgtgtttgatccgctggatggatcctccaacattgactgtggtgtttccattggaactatttttgggatctacatgataaaagacggtgacgatccatctttagaagatgtacttcagcctggaaagaatatgctcgctgctggatactgcatgtatggtagctcttgcacgtttgttttgagcactggatctggtgtgaatggttttactcttgatccatctctaggagagtttatactcacccacccggacatcaagatcccgaagaaaggaaagatctattcagtcaatgaaggaaatgctaagaactgggacggtccgactgcaaagtttgtggaaaaatgcaagtaccccacggatggctcatctgccaaatctttaagatatatcggaagtatggttgctgatgttcatcgcacactactttacggcggtgtgtttttgtaccctgctgataagaagagcccaaccgggaaactaagggttttgtacgaagtgttcccgatgtcgttcttgatggaacaagctggaggacagtcgttcactggaaaggaacgggcacttgacttggttccaaagaagattcacgagcgatcccccatcttccttggaagctatgacgacgtggaagaaatcaaggcattgtatgcggccgaagagaaggcataaagaaggagttaagggtaattgatctcatctccgtgttcttgtgcagtttcgattcgccatttctttgtttataaaaaccattctccactcttttccccc

SEQ ID NO: 2799 - DNA, 1768 bp, Ananas comosus
agggaggaagaggatggatcacgaggcggaggcgcaccggacggacctgatgacgataacgcggcacgtgctgaacgagcagacgaagcacgcggagtcgcgcggcgacttcagcatcctcctcagccacatcgtcctcggctgcaagttcgtctgctcctccgtcaacaaggccggcctcgcccatctcatcggcctcgccggcgacaccaacgttcagggcgaagagcagaagaagctggacgtgctctccaacgaagtcttcatcaaggctctggtcagcagcggtcgcacctgcattcttgtatcggaggaggacgaggaggcgacgtttgtcgatccgtctctgcgcggaaaatactgtgttgtctttgatccacttgatggttcttccaacatcgattgtggcgtttcgatcggaacgatttttggaatttatgtggttaaagataaggataacataagtcttgaagatgtgctgcaacctgggaaggacatgctggctgccggctactgcatgtatggaagttcttgcaatcttgtactcagcaccgggagtggtgtaaatggcttcactctcgatccgtctcttggcgagtttatcctgactcatccggatataaagataccaaagagaggaaaagtatactcagtgaacgaaggaaatgccaaaaattgggatggacctactgcgaaatttgtggagaagtgcaagtaccctcaggacggctcgccaccaaaatctctgagatatatcggaagtatggtcgctgacgtccatcgtacgttgctctacggaggcatctttatgtaccctgcagataagaagagtccaaacggaaaactacgggttctgtacgaagtttttccgatgtcgttcttgattgaacaagcaggaggtcaggcttttacggggaaacaacgggcccttgacttggttcctaccaagattcaccagaggtctcccatatttctcggaagctacgacgatgtcgaggagatcaaagcgttttacgctgccgaagacggccaggcttgatctgtaggatgttcttgcttaacaattgataaatgactgctattcttatagtggtcctatttgtaaccaatctctttctctctctaaatgaatcaatctttcgattttcgtgatcacttatttttagagatgttcaaaatatccgaaatctcgtaactgaccaaaattatgcattcagtttcatatatgggtccgaatattttatgttcatatccgattcagatctgacttggatccgatcatttgatgggtagggtgtataatcattttcatatccaaacccggacaagaactcggactcaatcatttgtaatagtgttttatgcaattatattatgtgtttgaacttattaatgtaattttaactattatgttattgcatgtgtttagagcgatgtaatatctgtaccccatcttaaacagataataactacccaaacacgatcaaatggattagatggatacactaattacctacaactacctacctggatcctatccggtccacggacatctctacttatttatctgcactctatctcatctgatagttcaaacctcgaaagaaagtttgtaaaatatcccttacttgagctttttaagggtaaaattataaaacatattgcacccaacaaaaaactgatttcatacgagcatcaccagaaaactccgaatagaagctgtttataactcatctttcccatacaaaactcagaaaagcacggcaaa

SEQ ID NO: 2800 - DNA, 1587 bp, Secale cereale
tctctaacgaccatccacgggcggtgcaatctgtttctatccgtcgttcccaccccacggccctcgctcgcccccgacgaccgggaagagagctagcgccgttgcccggcggaggaggccaggcgccggtggcagaggcggagcagagaagagaggatggaccacgcggcggatgcgcagcggacggacctgatgacgatcacgcggcacgcgctgaacgagcagggccggcacccggagtcccggggcgacttcaccatcctcctctcccacatcgtcctcggctgcaagttcgtcgcctccgccgtcaacaaggccggcctcgccaagctcatcggcctcgccggagagaccaacatccagggcgaggagcagaagaagctggacgtgctgtccaacgaggtctttgtcaaggcgctcgtcagcagcggccgcacctgcgttctcgtgtctgaagagaacgaggcggccatcttcgtggacgcgcccctccgcggaaagtactgcgtatgcttcgatcccttggacggctcctccaacatcgactgcggcgtctccatcgggacgatctttgggatctacatgatcaaagacaaggacaacgcgactctggaggacgtgctgcaacccgggaccgacatgatcgccgctggctactgcatgtacgggagctcatgcacgcttgtgttgagcactgggaatggtgtaaatggcttcactcttgatccttccctcggggagttcatacttacccatcccaacataaagataccaaacaaagggaagatctattcggttaatgaagggaacgccagaaactgggatgcgcccacagcaaagtacgtagagagatgcaagtttccccaagacggctcatcaccaaaatccttgagatacatcggaagcatggttgccgacgttcatcgtaccctgctctacggaggcatatttctgtaccccgccgacaagaagagccccaacggaaagcttcgtgttctgtacgaggttttccccatgtcgttcctgatggagcaagccggaggccaatctttcaccggcaagcagcgggcccttgaaattgtgccttctgagatacaccagaggtctccgatattcctcgggagctacgatgatgtggaggagattaaatcactgtacgcttcggagtcgagcaccgcctgatctgagtacctgaagacacatgcacatgttctgcgtcgcgttgctaaaagaaaaagagagcagttttagcatggtccctcttaccccctcttttcacatgagaggtaagagtatgtagtagatctgagccgttgatcacattaattagtggtcggattaactcttaccttcttacctcatatgtaaaaataaggggtaagagggagcatgttaaaatttgccaaaaaaaaatgttccgcgttgtgacaaaactccttaggtagtgttatggtgattctgagatcattgtcgtggcctcgatgtaacaatatccgtgtatgcatatatttggacatattgcacgccattttaacaagtattccctctttaaagaaatataagatcacggaccacaccgtaccccca

SEQ ID NO: 2801 - DNA, 1279 bp, Gossypium hirsutum
agagatggatcatgcagcagatgctcataggactgatttgatgacaataacacgtttcgtgttgaacgagcaatccaagtatcctgagtctcgtggggatttcaccatcttgcttaatcacatcgttcttggttgcaagtttgtttgctctgctgttaacaaggctggtcttgccaaactcatcggactcgctggggagactaatgttcagggtgaagaacaaaagaaattggatgtgctttcaaatgaagtctttgtcaaggctttagtaagcagtggcagaacatgcatccttgtctcagaagaagatgaagaggcgacttttgtagatccctcaaagcgtgggaggtactgtgttgtttttgatcctctagatggttcctccaacattgactgtggagtttccattggaacaatttttgggatttacatgatgaaagataaccatgaaccaactctagatgatgtactgcaacctggtaagcaaatgctggcagctggctattgcatgtatggaagctcttgcacgcttgttttgagcaccggagaaggagttaacggattcacccttgatccatctcttggagagttcatactaactcacccagatatcaagattccaaagaaagggaagatctattcagttaatgaaggaaatgctaagaactgggatggtccaacggccaagtatgtggaaaagtgcaagtttcccaaggatggttcttctccaaagtctctgagatacattggaagcatggtagctgatgtccatcgtacattactctacgggggtatctttttgtaccctgcagataagaagagccccagtggaaaactacgtgttctgtacgaggtctttccaatgtcgttcctgatggaacaagccggaggtcaggccttcaccggaaaacaacgggcacttgacttggtgccaacaaagatacatgagagatctccaatatttcttggcagctttgatgatgttgaagatatcaaagcactctatgctgctgaagggaaaaaggaataaatgtacaaattctcactctcactctcactctcactctcactcagatagcttcacttggcttcggttttaaatcgtgtttaaaagatatattgtatttgttacgggactattactgtttatccatggatatattttaaattttttgctcctgtcatgttaaatcttttctatatcttttttagtatcaacttgggaagaaattttgttcggcttcttcacttaattttattttaatcatccaaaaaagaa

SEQ ID NO: 2802 - DNA, 1342 bp, Ambrosia trifida
ataatatccttaatctctctcccttaaattgcgtgattttgtccaccgatcaaatccaatcccctctttaaagcagtttatatataaatatataataaaaaaaaatatagaaacagttggttcagttttattgttaagagaaggatggatcacgaagccgatgctttccgaaccgatttgatgacgattactcggttcgtgttgaacgagcaatcaaagtatccagaatcacgtggcgatttcagtattttgcttagtcacattgttcttggttgcaagtttgtttgtgctgctgttaataaggcaggtttggcaaaactcattggacttgctggagagaccaatgtgcagggagaagaacagaagaaattggatgttttgtcaaatgaagtttttgtgaaggctttggtcagcagtggcagaacatgcatacttgtttctgaagaggacgaggaagcgataattgtagaaccatccaagcgtggaaagtattgtgttgttttcgatccgttggatggatcttccaacatagactgtggtgtttccataggaactatttttgggatttacatgataaaagattctggtgcggcccgtttagaagatgttcttcagcctggaaagaatatggtggctgctggatactgcatgtacggtagctcttgcacgcttgtgttaagcactggatctggtgtcaatggatttactcttgatccatctttaggggagtttatactcactcaccctgacattaagattccaaagaaaggaaagatttattctgttaatgaaggaaatgctaagaactgggatggtccgactgcacagtttgtcgaaaaatgcaagttccccaaggatggttcacctgcaaaatctcttagatatattggaagtatggttgctgatgttcatcgcaccctactttacgggggcgtgtttttgtaccctgctgataagaaaagcccgaatggaaaactaagggttctctatgaagtcttcccaatgtcattcttgatggaacaagctggaggacagtcgtttaccgggaaagaacgggctcttgacttggtccccaagaagatacatgaacgatctccaatattcttgggaagctatgatgatgtggaagaaatcaaggctttgtatgcagctgaagaaaaggcataaataaggttgttgttgtgcagttgtaattcccttgttctaaatccaggttttttataagttaattttgttataatttgttgtatttgatatgtgtttatttaattgtcatgtaatattgtgatttttattcttatactaataatattaatagtaactacttcttaaaagttaaaaa

SEQ ID NO: 2803 - DNA, 1042 bp, Musa acuminata
tagaacgatggatcacgcggccgacgcgcaccggacggacttgatgacgatcaccaggcacgtgctgaacgaacagtcgaagcaccccgagtcgaagggcgacttcaccatcctcctctcccacatcgtcctcggctgcaagttcgtctgctccgccgtcaacaaggctggcctcgccaaactcataggactcgcaggagagacgaacggtgaagaacagaagaagctggacgtgctctccaaccaagtcttcgtcaaggctttgatcagcagcggtcgcacatgtgttcttgtgtcagaagaggatgaggaagccacctttgtggatccatcactgcgtggaaagtactgcgtcgtcttcgatcccctggacggttcctctaacattgactgtggcgtctccattggaacaatttttggcatttacatggttaaagataaggataatgtgagccttgatgatgtgttgcaaccagggaagcatatggtagcagctggctactgcatgtacggcagttcttgcactcttgtgttaagcaccgggaacggtgtcaatggtttcactctcgatccatctcttggagagttcatgctcacccatccggacattaagatacccaagagaggcaaattgtactcagtgaacgaaggaaatgccaagaactgggatactcctacagcaaagtttgtggagaaatgcaagttcccaaaggatggttcatcaccaaaatctctgagatacattggaagtatggttgctgatgtccatcgaacactgctgtatggaggcatctttttgtaccctgcagataagcaaagtcctaatggaaaactacgcgttctgtatgaggtatttccaatgtcattcttgatggaacaagcaggaggtcaagcattcacaggagaacaacgggcccttgatttggttcccaccaagattcatcagaggtctccagtatttcttggcagctatgatgatgttgaggaaattaaagctctctatgctgccgaagagaagaaagcatgatcaacacacatcaaa

SEQ ID NO: 2804 - DNA, 1302 bp, Gossypium hirsutum
ggtttagtagagatggatcatgcagcagatgctcataggactgatttgatgacaataacacgtttcgtgttgaacgagcaatccaagtatcctgagtctcgtggggatttcaccatcttgcttaatcacatcgttcttggttgcaagtttgtttgctctgctgttaacaaggctggtcttgccaaactcatcggactcgctggggagactaatgttcagggtgaagaacaaaagaaattggatgtgctttcaaatgaagtctttgtcaaggctttagtaagcagtggcagaacatgcatccttgtctcggaagaagatgaagaggcgacttttgtagatccctcaaagcgtgggaggtactgtgttgtttttgatcctctagatggttcctccaacattgactgtggagtttccattggaacaatttttgggatttacatgataaaagataaccatgaaccaactctagatgatgtactgcaacctggtaagcaaatgctggcagctggctattgcatgtatggaagctcttgcacgcttgttttgagcaccggagaaggagttaacggattcacccttgatccatctcttggagagttcatactaactcacccagatatcaagattccaaagaaagggaagatctattcagttaatgaaggaaatgctaagaactgggatggtccaacggccaaatatgtggaaaagtgcaagtttcccaaagatggttcttcttcaaagtctctgagatacattggaagcatggtagctgatgtccatcgtacattactctacgggggtatctttttgtaccctgcagataagaagagccccagtggaaaactacgtgttctgtacgaggtctttccaatgtcgttcctgatggaacaagccggaggtcaggcattcaccggcaaacaacgggcacttgacttggtgccaacaaagatacatgagagatctccaatatttcttggcagctttgatgatgttgaagatatcaaagcactctatgctgctgaagggaaaaaggaataaatgtacaaactctcactctcactctacttagatagcttcacttggcttcggttttaaatcgtgtttaaaacatatattgtatttgttacgggacttttactgtttatccatggatatatttttaaatttgttttgctcctgtcatgttaatcttttctgtatctttttgagtatcaacttgggaagaaattttgttcggcttcttcacttaattttattttaatcatccaaaataatatcagtaaatgcgctactttcagatga

SEQ ID NO: 2805 - DNA, 1338 bp, Curcuma longa
ggccaccggaggggcgttatctgcacctcaaccgccgaatccctatccttctctccgcctcttcttcatctttttcttcttcctcttcttccaatcgactctcgctctatatatgtacaagcgtatgcatctctaaaggtgaggcttgtgagatcgatctcagtcgctcgctgccgagaaagagggttagcgtcatggatcacgaggcggatgcgcaccggaccgacctcatgaccatcaccaggtacgtgctcaacgagcagtcgcggtacccggaatcgcgtggcgacttcagcatcctcctttcgcacatcgtcctcggctgcaagttcgtctgcaccgccgtcaacaaggccgggcttgctaagctcataggacttgctggggagacgaatgtacagggcgaagagcagaagaagcttgacgtgctttccaacgaagtctttgtcaaagctaagataagcagtgggagaacttgcattctagtttcggaagaggatgaagaggctacttttgtggatccatctctgcgtggaaaatactgtgtggtctttgatccactggatggttcctcaaacatcgactgtggtgtctccattggaacaatttttggcatttacatggttaaagacaaggagaatgtgactttaaatgacgtattacaacctgggaagaatatgctagcagctgggtattgcatgtacggcagttcttgcacgcttgtattgagcactggaagtggcgtgaatggtttcactcttgatccttcccttggggagttcatacttactcatccatatattaagataccaaagaaaggcaaaatatattcagtgaatgaaggcaatgccaagaattgggatcgacctacaacaaagtacgtggaaaaatgcaaatcccccaatgagggctcctcaccaaaatctctgagatacattggaagcatggtggctgatatacatcgaaccctgctttatggaggcatctttttatacccttctgacaagaagagtcctgatgggaaattacgtgttttatacgaagtcttccctatgtcattcttgatggaacaagcaggtggtcaatctttcactggaaaacaacgggctcttgacttggttcctacgaaaattcatcagaggtcacccatatttctaggcagctacgatgatgttgaggagattaaagcgctgtatgccgctgaagaaagcaacgattgatgcttctgttagtctttgaatttactatcctaagaaatactgtcatcatcaagcatgaatcaatctcaggcctatattctcacttcattacagcatctaagtccattgattttctgtt

SEQ ID NO: 2806 - DNA, 1690 bp, Triticum aestivum
cacatgaggatcacaggatcaggtcgagtcgaacataggataggagtagtacgaacggcgtccgggaggaaattatattagtatcaccggagtagtgtcctggtcaaatgggcacaagcgcttccagtaagtaatccagttgctcctccccttctttcccggacacgtctggccgcgctgccgtgccgagcatatccacgctacgctacaccgacgtggaagcccccaccgcacctcatccggcacgcctcccaccggcttcggcctatatcaatctccgggccgcgcaccggatgccgcctcccatttccccctcccatctctaacaaccatccgcgggcggtgcaatctgtttgtatccgtcgctcgctcccgacgaccgagaagagctagcgccgttgctcggcggaggccaggcgagaagaggagatggaccacgcggcggaggcgcagcggacggacctgatgacgatcacgcggcacgcgctgaacgagcaggggcggcacccggagtcccggggcgacttcaccatcctcctctcccacatcgtcctcggctgcaagttcgtcgcctccgccgtcaacaaggccggcctcgccaagctcatcggcctcgccggcgagaccaacgtccagggggaggagcagaagaagctggacgtgctctccaacgaggtctttgtcaaggcgctcgtcagcagcggccgcacctgtgtgctcgtgtctgaagagaacgaggcggccatcttcgtggacgcgcccctccgcggaaagtactgcgtgtgcttcgacccgttggacggctcctccaacatcgactgcggcgtctccatcggcacgatctttggaatctacatgatcaaagacaaggacaacgcgactctggaggacgtgctgcaacccgggacccacatgatcgccgctggctactgcatgtacgggagctcatgcacgcttgtgttgagcactgggaacggtgtaaatggcttcactcttgatccttccctgggagagttcatacttacccatcccaacataaagataccaaacaaagggaagatctactcggtgaacgaaggaaatgccagaaactgggacgcgcctacagcgaagtacgtagagagatgcaagtttccccaagacggctcatcaccaaaatccttgagatatattggaagtatggttgctgatgttcatcgcaccctgctctacggaggcatatttctgtaccccgccgacaagaagagccccaacgggaagcttcgtgttctgtacgaggttttccccatgtcgttcctgatggagcaagccggaggccagtctttcaccggcaaacatcgggcccttgaaattgttccttctgagatacaccagaggtctccgatattcctcgggagctacgatgatgtggaggagattaaatcactgtacgctgcggagtcgagcaccgcctgatctgagtacctgaagacacatacacatgttccgcatcgggtagctaaaagaaaaggttatgttccgcgttgtgacaaaactccttaggtagtgttatggtgattctgagatcattgtcatggcctcgatgtaacaatatccgtgtatacatatatttgacatattgcacgccattttaacaagtatttcctctgtaaagaaatataagatcgtatatttctttacagagggagta

SEQ ID NO: 2807 - DNA, 1208 bp, Triticum aestivum
gatggaccacgcggcggatgcgcagcggacggacctgatgacgatcacgcggcacgcgctgaacgagcaggggcggcacccggagtcccggggcgacttcaccatcctcctctcccacatcgtcctcggctgcaagttcgtcgcctccgccgtcaacaaggccggcctcgccaagctcatcggcctcgccggggagaccaacgtccagggggaggagcagaagaagctggacgtgctctccaacgaggtctttgtcaaggcgctcgtcagcagcggccgcacctgcgttctcgtgtctgaagagaacgaggcggccatcttcgtcgacgcgcccctccgcggaaagtactgcgtgtgcttcgatccgctggacggctcctccaacatcgactgcggcgtctccatcgggaccatcttcgggatctacatgatcaaagacaaggacaacgctactctcgaggatgtactgcaacccgggactaacatgattgctgctggctactgcatgtatgggagttcatgcacgctcgtgttaagcactggaaacggtgtaaatggtttcactcttgatccttccctcggggagttcatactaactcatcccaacataaagataccaaacaaagggaagatctactcggtgaacgaagggaatgccagaaactgggacgcgcctacagccaagtacgttgagagatgcaagtttccccaagacggctcatcgccaaaatccctgagatacattggaagtatggttgctgatgttcaccgcaccctgctctacggaggcatatttctgtaccccgcggacaagaagagccccaacggaaaactccgtgttctgtacgaggttttccccatgtcgttcctcatggagcaagccggaggccagtctttcaccggcaaacagcgggcccttgaaatcgttccttatgagatacaccagaggtctccgatattcctcgggagctacgatgatgtggaggagattaaatcgctgtacgcttcggagtcgagcaccgcctgatccgagtacctgaagacacatacacatgttctgcatcgcgttgctgaaagaacaaagttaaactcctcaggtagtgttatggtgattctgagatcattgtcatggcctcgacgtaacaatatccgtgtatacatatatttgacatattgcacgccattttaacaagtattccctctgtaaa

SEQ ID NO: 2808 - DNA, 1184 bp, Triticum aestivum
gagctagcgccgttgctcggcggagatcacccgccggtcgcagaggcggagtagagaagagaggatggaccacgcggcggaggcgcagcggacggacctgatgacgatcacgcggcacgcgctgaacgagcaggggcggcacccggagtcccggggcgacttcaccatcctcctctcccacatcgtcctcggctgcaagttcgtcgcctccgccgtcaacaaggccggcctcgccaagctcatcggcctcgccggcgagaccaacgtccagggggaggagcagaagaagctggacgtgctctccaacgaggtctttgtcaaggcgctcgtcagcagcggccgcacctgtgtcctcgtgtctgaagagaacgaggcggccatcttcgtcgacgcgcccctccgcgggaagtactgcgtgtgcttcgatccgctggacggctcctccaacatcgactgcggcgtctccatcgggacgatctttgggatctacatgatcaaagacaaggacaacgcgactctggaggacgtgctgcaacccgggactgacatgatcgccgctggctactgcatgtacgggagctcatgcacgcttgtgttgagcaccgggaacggtgttaatggcttcactcttgatccttcccttggggagttcatacttacccatcccaacataaagataccaaacaaagggaagatctattcggtcaatgaagggaacgccagaaactgggacgcgcccacagcaaagtacgtggagagatgcaagtttccccaagacggctcatcaccaaaatccttgagatacattggaagcatggttgccgatgttcatcgtaccctgctctacggaggcatatttctgtaccccgccgacaagaagagccccaacgggaagcttcgtgttctgtacgaggttttccccatgtcgttcctgatggagcaagccggaggccagtctttcaccggcaaacagcgtgcccttgaaatcgttcctgctgagatacaccagaggtctccgatattcctcgggagctacgatgatgtggaggagattaaatcactgtacgcttcggagtcgagcaccgcctgatctgagtacccgaagacacatacacatgctctgcatcgtgttccgcgttgtgacaaaactccctaggtagtgttaacatggtgattctgagatc

SEQ ID NO: 2809 - DNA, 1376 bp, Amaranthus tuberculatus
cctcacactgaggcaattataatttgggaccctcatcatttctctatcctccatttttgtggtgttcattcttcttgtatagagctgtatttatatatatagaagtagtggtacagtgattttttgttctgtaattctgttgattgttttccacaaattattcaaagaagaagaagatggatcatgcagcagatgcagcacggacggatttgatgacaataacacggcatgtgttgaatgaacaatccaaacgacctgaatctcgcggtgattttaccattcttcttagtcatatcgtgctggggtgtaaatttgtttgctctgctgttaacaaggctggtcttgccaagctcataggacttgctggggagactaatgttcagggtgaagagcaaaagaagcttgatgtactttcaaatgatgtctttgtcaaggccttgataagtagtggtcgaacttgcattcttgtgtcagaggaggatgaggaggcaacctttgttgagccatccttgcgtggaaagtattgtgtcgcctttgatcctctggatggatcttccaacattgactgtggtgtttcaattggcactatctttgggatttacatggtcaaagattttaataatgtaactcttgatgatgtcctaaaacctggaaagaatatggtagctgctggttattgcatgtatggaagctcttgcacgcttgtcttgagtactggaagcggtgtcaatggtttcacacttgacccatctcttggggagtttattttaactcatccagatatcaagatcccaaagaaaggtaaggtctactctgtgaatgaaggcaatgcaaagaattgggatggcccaacaacaaagtatgtgcagaagtgtaagttccctgaagatggctcaccaccaaagtctctcagatacattggaagtatggttgctgatgttcatcgcactttactatatggtggtatctttatgtaccctggtgataagaaaagccctaacggtaaacttcgggtcctctatgaggtctttccaatgtctttcctaatggaacaagctggtggacaagcttttaccggcaaacaaagggcactcgacttggtccctacaaagatacacgagcgatcgccagtattccttggcagctatgacgatgttgaagacatcaaagctctgtatgctgccgaagagcagaaggcctgagcatccgcaaatgctagactgcaccataattttctctttcgaatttaaataagctgcattacacagtggttacatatgaattatgctggtatatatgctccagaaatgtgcataacataggagtatttacattgattaattgtcaaacaactatatttcaaattaatgtcaatg

SEQ ID NO: 2810 - DNA, 1300 bp, Chrysanthemum coronarium
tatatcataacaaagaaaaaaaaaaatacatacagttatatatttttttttgagaaagaaaaaaaagatggatcatgaggcagatgcgtttaggacagatttaatgacgatcacacgattcgtgttgaacgaacagtcgaaacatccggagtcacgtggtgattttagtattttgcttagtcacattgttcttggttgcaagtttgtttgtgctgctgttaataaggcgggtttggctaagctcattggacttgctggagagaccaatgtgcagggagaagagcagaagaaactggatgttctttcaaatgaagttttcgtgaaagctttggtcagcagtggcagaacatgcatacttgtttctgaagaggatgaagaagcaataattgtagaaccatctaagcgtgggaagtattgtgttgtgtttgatccgctagatggatcctccaacattgactgtggtgtttccattggaactatttttgggatctacatgataaaagacggtgatgatccctctttagaagacgtacttcagcctggaaaaaatatgctcgctgctggatactgcatgtatggtagctcttgcacgtttgttttgagcactggatctggtgtgaatggttttactcttgatccatctctaggagagtttatactcacccatccggacatcaagatcccaaagaaaggaaagatctattcggtcaatgaaggaaatgctaagaactgggacggcccgactgcaaagtttgtggaaaaatgcaagtaccccacggatggttcatctgccaaatctttaagatatattggaagtatggttgctgatgtccatcgcacattactttatgggggtgtgtttttgtaccctgctgataagaagagcccaagtgggaaactaagggttctgtatgaagtgttcccgatgtcgttcttgatggaacaagctggaggacagtcgtttactggaaagatacggtcacttgacttggttccaaagaagattcacgagcgatcccccatcttccttggaagctatgacgacgtggaagaaatcaaggcattgtatgcggctgaagagaaagcataagaaaagtgttaaaagagttaaaagggtaattgatctcatctccatgttcttgtgcagcttctatttgacatttctttgtttataaaaccatgctccactctttgttcccttttttcacatatgtaataaaaaaggctaccttttaatcaatagttttgaactgttgtagacagtagtcgcgattctaaatgttattaattttcagttcag

SEQ ID NO: 2811 - DNA, 1679 bp, Eucalyptus grandis
gccgggggacgacggcgatcgagcaactgctccaccccccgcgccccctcctcgtcgtcgtcttcttcctcctcgcctcttcctcgattctcattcgtcgcagaagctggccccgtccgaaccttctcccctctctctctctctctctctctctaagagctcggtcaggacaagaagcgttatctcgggggggacggccgggaaccacgagccttgccccctcgcgggcgctgtcgccacgtgtcgttggaaacttccgctgccaccagatagacccatcctctccctctttcacacaaccaattcgatttatccccattagtattctatattcgtcatcgttatcatctctcctcgaataaagcgcattctgagctcggccttaccttgcacgaggggttcttatatacagagaatacgtgtcccagtgatttcacagagagagagagagagatggaccacgcaggcgatgcgcaccggaccgatttgatgaccataacccggttcgtgctcaacgagcagtcccggcacccggagtcccgcggcgatttcaccatcctcctcagtcacattgttctcggatgcaagttcgtctgctcttgcgttaacaaggcaggccttgccaaattgatcgggcttgctggagagaccaatgtccagggtgaagagcagaagaagctggatgtgctttcgaatgaagtatttgtaaaggcattagtcagcagtggccgcacaagcattcttgtgtcagaggaggatgaagaggccacgtttgtggagtcagccaagcgtggaaagtattgtgttgtttttgatccgctggatggatcctctaacatcgactgtggtgtttccattggaaccatctttgggatctatatgatcaagcatgccaatgatccaactttagaggatgtgttgcaacctgggaaaaacatgctggcagctggctattgcatgtatggcagctcttgcacgcttgtgctaagcactggatgtggtgttaatggttttaccctggacccatcattgggcgaattcatcctcacccatccagacatcaagattccaaagaaagggaagatctactcagtgaatgagggaaatgctaaaaactgggatggtccaactgctaagtatgttgagaaatgcaagttcccaaaagatgggtcatcctcaaaatctttaagatatattggaagcatggtagctgatgttcatcgtaccttactatatggaggtgtctttttgtaccctgctgataagaagagtcccagtggaaaactgcgcgttctttatgaagtcttcccgatgtccttcttgatggaacaagcaggaggtcaggcctttactggaaagcaacgggcacttgacttgatcccaaccaagatacatgagcggtctcccatattcctcggcagctacgacgacgtggaggaaatcaaggcactctacgctgctgaagaggacaaaaaataaagctgtagtttgctcttttcttgtgttcgcatcagacaagaccttgtccaactaccaggcttgattgatcgtgggttcacaagattagaaccctctatattgtttacttttaaccagatattggaataaatactttgtcagcaacctttgttgatctttgataggtagaaagtctaaattacagtgattttcaagaacaa

SEQ ID NO: 2812 - DNA, 1726 bp, Artemisia annua
gggatatttatatgatctatatatcataagaaaaaaaatacagtcttatttttttagaagtttagaaaaaaaaaaagtttgttcaagatggatcatgaggcagatgcgtttaggacagatttaatgacgatcacacgattcgtgttgaatgaacagtcgaaacatccggagtcacgtggtgattttagtatcttgcttagtcacattgttcttggttgcaagtttgtttgtgctgctgttaataaggcgggtttggctaaactcattggacttgctggagagaccaatgtgcagggagaagagcagaagaaattggatgtactttcaaatgaagttttcgtgaaagctttggtcagcagtggcagaacatgcatacttgtttctgaagaggatgaagaagcaataattgtggagccatctaagcgtggaaagtattgtgttgtgtttgacccgctagatggatcctccaacattgactgtggcgtttccattggaactatttttgggatctacatgataaaagacggtgatgatccatctttagaagatgtactgcagcctggaaagaatatgctggctgctggatactgcatgtatggtagctcttgcacgtttgttttgagcactggatctggtgtgaatggttttactcttgatccatcactaggagagtttatactcacccacccggacatcaagatcccaaagaaaggaaagatctattcggtcaatgaaggaaatgctaagaactgggacggtcccactgcaaagtttgtggaaaaatgcaagtaccccacggatggttcatctgccaaatcattaagatatattggaagtatggttgctgatgtccatcgcacattactttacgggggagtgtttttgtaccctgctgataagaagagcccagatgggaaactaagggttctgtatgaagtgttcccgatgtcgttcttgatggaacaagctggaggacagtcgtttactggaaaaatacggtcacttgacttggttccaaagaagattcacgagcgatcccccatcttccttggaagctatgacgacgtggaagaaatcaaggcattgtatgcggctgaagagaaggcataaagaaagagagctagttaagggtaattgatctcatctccatgttcttgtgcaggttctatttgacatttctttgtttataaaaccatgctccactctttgttcccttttttcatatatgtaataaaaaggctaccttttaatcaatagttttgaactgttgtagacagtagtcgcggagtcagaacatttattaagagcgccgaaattctaaatgttattaattttcatttcggaaattccttttgcactcgtcaaaaagacgactgaaagttcaagtttaagttttgacaaatttgatgatccaagtttttttatcccgacgaatgttcccgtttgttataattgtttcatagtccctctgatgagccaacaaagttttgaatattctgcaacacatttgcatattatgttacatttctcttgacaattttcaagttttatgttagttagaggaaaggccttactccttagttattacttataaaactctaaagtagctccatcaagtaataatgttaaatacaagtagtcacactttttgactacttttgatccatattacatgtcatggatcctcaataatgttaaatacaatttgttacacttttcaaaaaaa

SEQ ID NO: 2813 - DNA, 1153 bp, Helianthus annuus
gcttggcgggggatttaagcaataaaaaaaatagcaaaatctaaaatcttgtagtgtaatttgtgtgagaaagatggatcatgctgcggatgctatgaagacggatttgatgacgataactcggtttgtgttgaatgagcagtcgaagcatcctgagtcgcgcggtgattttagtattttgcttagtcacattgttcttggttgcaagtttgtttgtgctgctgttaataaggcaggtttagctaaactcattggacttgctggggagaccaatgtgcagggagaagaacaaaagaaactagatgttttgtcaaatgaagtttttgtgaaggcattggtcagcagtggcagaacatgcatacttgtttccgaagaggatgaggaagcgatttttgtagaaccatccaaacgcggaaagtattgcgttgttttcgaccctttggatggatcttccaacattgactgtggtgtttccatagggactatttttggggtctacatgttaaaagacggtgctgagtcgcgcttggaagatgtacttcagcccggaaagaatatgctggctgctggatactgcatgtatggtagctcttgcacgtttgtgttaagcactggatctggtgtgaatggatttactcttgatccatctctaggagagtttatactcacccaccctgacattaagatcccaaagaaaggaaagatttattctgttaatgaaggaaatgctaagaactgggatggtcccactgcaaagtttgtggaaaaatgcaagttcccaaaggatggttcaccagctaaatctctaagatatattggaagtatggttgccgatgttcatcgtaccttactctatgggggtgtgtttttgtaccctgctgataagaaaagcccaagtggaaaactaagggttctttatgaagtgtttcctatgtcattcttgatggaacaagctggagggcagtcatttactggaaaagaaagggctcttgatttggtcccaaagaagatacatgaaagatctccaatattcctgggaagctatgatgatgtagaagaaatcaaggccttgtatgcagctgaagagaaggcatagtaaaatttacctcatttccatgttgttcataataccatgctactttactggagtata

SEQ ID NO: 2814 - DNA, 1099 bp, Centaurea maculosa
ctttctttctttctacccaattattattattattattattattattatctgagatcgatcaagtgaagaaccatggatcatgccgccgatgctttccgtacggatttgatgaccataactcggtttgtgcttaacgagcagtccaagcatcccgaatcacgtggtgatttcagcatcttgctcagccacattgttcttggctgcaagttcgtttgctctgctgttaataaggctggtttggcaaaactcattggacttgcaggggagaccaatgtgcagggagaagaacagaagaaactggatgttctatcgaatgaagtttttgtcaaggctttggtcagcagtggaagaacatgcatacttgtctctgaagaggatgaagatgccataattgtggaaccttcaaagcgtggaaagtattgtgttgtttttgatccgctggatggatcttccaacattgactgcggtgtttccattggaactatttttgggatttacatgataaaagatggcggtgagccatctttagaagacgtactgcagcctggaaagaatatgctggccgctggatactgcatgtatggcagttcttgcacgcttgtattgagtgctggttctggtgtgaatggatttactcttgatccatctctaggggagtttatactcacccatcctgacattaagatcccaaaaaaaggaaagatttattcagttaatgaaggaaatgctaagaactgggatggtcccactgcaaagtatgtggaaaaatgcaagtttcctacggatggttcacctgcaaaatctctaagatatattggaagtatggttgctgatgttcatcgcaccttactttacgggggcatctttttgtaccctgctgataagaagagcccgaatgggaaactgagggttctgtatgaagtcttccctatgtcattcttgatggaacaagccggaggccagtccttcaccggaaaggagcggtcacttgatttggttccgaagaagatacatgaacgatctccaatcttccttgggagctacgatgatgtggaagaaatcaaggcattgtatgcagctgaagagaagaaggcataaa

SEQ ID NO: 2815 - DNA, 1182 bp, Cephalotaxus harringtonia
gaaaagatggaccacgaagcagatgcctatcgcacagacttgatgaccattactcgctttgttctgaacgagcagtcgaggcatcctgagtcacgcggggacttcaccattctcctcagtcacattgtcctcggctgcaaattcgtatgctctgctgttaacaaggcgggtctggctaaactcataggccttgcaggagagaccaacgtacagggcgaggagcaaaagaagttggatgtgctctccaatgaagtctttgtcaaggctcttgtaagcagcgggcgtacttgcattcttgtctcggaggaagatgaagaggccacttttgtggatccttcattgcggggaaagtactgtgtagttttcgatccacttgatggctcttccaacattgactgtggagtctcaattggaacgatctttggaatatactcgataaaggaaggagatgaacccacgttggcagatgttctgcaaccaggcaaacacatggttgcagcaggctactgtatgtatggaagctcttgcacgcttgtcctgagcactggcagtggggtaaatggttttacacttgacccctccctcggagaattcattttgactcatccaaacataaaggtcccaaagaaaggaaatatatattcagtaaacgaaggcaatgcgaagaactgggatgagcctaccaaaaagtatgttgagagatgtaaatttcccaaggatggaacatcccccaagtctcttagatacattggaagcatggtagctgatgtccaccgaaccctgctttatggaggcattttcatgtaccctgcagataagaagagtcccaatggaaaattgcgtgtattgtatgaagtgtttccaatgtccttcttgatggagcaagcaggggggcaatccttcacaggaaagaaacgagcactagacattgtcccatcaaagattcacgagcgttcctcaatcttccttgggagttatgatgacatagaggagattaaggctttatatgctcaagaggaagcaaaagcctgatgtctgttggctgcttggctgttctgggaattgtatttgtagccctgtttatgaattgctatcaatgataacaacaaattaatctttaattaacacaaagtctttacccaccctagtaaataaaatcttaggagtctatttttattatcc

SEQ ID NO: 2816 - DNA, 1447 bp, Gossypium raimondii
gccactaccctcctcaaacaatctttatcctctgcacctcgagaacagcactctattttcttatgtatatattaatataacaatataaattatttttcttgctgctttattgggtcactttttttctttcgttcaatatttggctctttgtttttgttttttggtttagagagatggatcatgcagcagatgctcataggactgatttgatgacaataacacgtttcgtgttgaacgagcaatccaagtatcctgagtctcgtggggatttcaccatcttgcttaatcacatcgttcttggttgcaagtttgtttgctctgctgttaacaaggctggtcttgccaaactcatcggactcgctggggagactaatgttcagggtgaagaacaaaagaaattggatgtgctttcaaatgaagtctttgtcaaggctttagtaagcagtggcagaacatgcatccttgtctcagaagaagatgaagaggcgacttttgtagatccctcaaagcgtgggaggtactgtgttgtttttgatcctctagatggttcctccaacattgactgtggagtttccattggaacaatttttgggatttacatgatgaaagataaccatgaaccaactctagatgatgtactgcaacctggtaagcaaatgctggcagctggctattgcatgtatggaagctcttgcacgcttgttttgagcaccggagaaggagttaacggattcacccttgatccatctcttggagagttcatactaactcacccagatatcaagattccaaagaaagggaagatctattcagttaatgaaggaaatgctaagaactgggatggtccaacggccaagtatgtggaaaagtgcaagtttcccaaagatggttcttcttcaaagtctctgagatacattggaagcatggtagctgatgtccatcgtacattactctacgggggtatctttttgtaccctgcagataagaagagccccagtggaaaactacgtgttctgtacgaggtctttccaatgtcgttcctgatggaacaagccggaggtcaggcattcaccggaaaacaacgggcacttgacttggtgccaacaaagatacatgagagatctccaatatttcttggcagctttgatgatgttgaagatatcaaagcactctatgctgctgaagggaaaaaggaataaatgtacaaattctcactctcactctcactctcactctcactcagatagcttcacttggcttcggttttaaatcgtgtttaaaacatatattgtatttgttacgggacttttactgtttatccatggatatatttttaaatttttttgctcctgtcatgttaaatcttttctgtatctttttgagtatcaacttgggaagaaattttgttcggcctcttcacttaattttattttaatcatccaaaata

SEQ ID NO: 2817 - DNA, 1476 bp, Secale cereale
gcatatccacgctacgctacaccgacgtggaagcccccacctgatccggcacgcctcccaccgtttcccgcctatttcaatccccggacctcccatctgccccctcccatctctaacgaccatccacgggcggtgcaatctgtttgtatccgtcgctcccacccctcggctcccgacgaccgggaagagctacgcgccgttgcccggcggaggaggccaggcgctggtggcagaggccgagcagagaagagaggatggaccacgcggcggaggcgcagcggacggacctgatgacgatcacgcggcacgcgctgaacgagcaaggccggcacccggagtcccggggcgacttcaccatcctcctctcccacatcgtcctcggctgcaagttcgtcgcctccgccgtcaacaaggccggcctcgccaagctcatcggcctcgccggagagaccaacatccagggggaggagcagaagaagctggacgtgctctccaacgaggtctttgtcaaggcgctcgtcagcagcggccgcacctgcgttctcgtgtctgaagagaacgaggcggccatcttcgtggacgcgcccctccgcggaaagtactgcgtatgcttcgatcccttggacggctcctccaacatcgactgcggcgtctccatcggaaccatctttgggatctacatgatcaaagacaaggacaacgcgaccctggaggacgtgctgcaacccgggaccgacatgatcgccgctggctactgcatgtacgggagctcatgcacgcttgtgttgagcactggaaatggcgtaaatggcttcactcttgatccttctctcggggagttcatacttacccatcccaacataaagataccaaacaaagggaagatctattcggtcaatgaagggaacgccagaaactgggacgcacccacagcaaagtacgtggagagatgcaagtttccccaagacggctcatcaccaaaatccttgagatacatcggaagcatggttgccgacgttcatcgtaccctgctctacggaggcatatttctgtaccccgccgacaagaagagccccaacggaaagcttcgtgttttgtacgaggttttccccatgtcgttcctgatggagcaagccggaggccaatctttcaccggcaaacagcgggcccttgaaattgttccttctgagatacaccagaggtctccgatattcctcgggagctacgatgatgtggaggaaattaaatcactgtacgcttcggagtcgagcaccgcctgatctgagtacatgaagacacatacacctgttctgcatcacgttgcctaaaagaaaaaagttatgttccgcgttgtgacaaaactccttaggtagtgttatggtgatcattgtcgtggcctcgatgtaacaatatccgtgtatacatatatttgacatattgcacaccattttaacaagtattccctctttaaagaaa

SEQ ID NO: 2818 - DNA, 1225 bp, Triphysaria pusilla
tttcttggagttatcataataattatagtggagtgcgcagtcaaaaagatatattttgtagttacacatttttcgcaaaggtttttggggcgatggatcacgaggcggatgcttaccggaccgatttgatgacgataacccgtcatgtgttgaacgagcagtcaaagcacccggagtcgcgtggggatttcacgattttgctcagtcatattgttcttggctgcaaatttgtttgctctgctgttagcaaggctggtttggctaaacttatcggactagccggagaaactaatgtgcagggtgaagaacaaaagaaactagatgtgctttcgaacgaagttttcatcaaggcgttagttagtagcggacgaacttgtatccttgtctctgaagaagatgaagaggccacattcgtggagccctctcaccgtggaaagtattgtgttgtgtttgacccgttggatggatcttccaacattgactgtggtgtttcaattggaactatatttggtatttatgcgatttacgatgggcatgacccgaaactagaagacgtgttacagcctgggaagaacatgttagccgcaggctattgcatgtacggaagctcgtgcacgttcgtgttaagtactggatcgggagttaatgggtttacactcgatccatctcttggagaattcattttgactcatcctgatattaagattccgaaaaaaggcaagatttattctgttaacgaaggaaatgccaagaactgggatggccctactgcaaagtatgtggagaaatgcaagtaccccacagacgggtcaccggcaaaatccctgagatacatcggaagtatggtagccgatgttcaccgcacgttgctgtatggaggctattttttgtacccagctgataagaaaagcccaaacggaaaactgagggtcctatatgaagtttttccgatgtcgtttttgatggaacaagcaggaggacaagcatttaccgggaaggagcgggcacttgatttgcttcctcagaagatacacgaccgctcaccgatattccttggtagctatgacgatatcgaggagatcaaagcattatatgcagctgaggagcaaaaataatggacttgtaaatttctttaccgagtttcgattttttactcattgctaattactcttctatgtaataaaaacacaattattcttttggaatatatcgtcataaggaccga

SEQ ID NO: 2819 - DNA, 1285 bp, Tragopogon dubius
ctctcctcgaattgagcgatttttgtcaaccgatgaaattcaatcttatgtgattttgacgccaataaaaaatcttatagcgttgtcagcgatcaactcatcgccggagaaagatggatcatgaatcagatgccttccggacggatttgatgaccataactcggtttgtgctgaatgagcagtcgaagcatccggagtctcgtggggatttcagtattttgctcagtcacattgttcttggttgcaagttcgtctgcgctgctgttaacaaggcaggtttggcgaaactcatcggacttgccggggagacgaatgtgcagggagaagagcagaagaaattagatgttctgtcaaatcaagtttttgtgaaggcgttggtcagcagtggaagaacatgcatacttgtttctgaagaagatgaagaagcaatatttgtggaaccatccaaacgtggaaagtattgtgttgttttcgatccgctggatggatcttccaacattgactgtggtgtttccataggaactatttttgggatttacatgattaaagatggtgatgaggcgcgtatagaagatgtactgcagcctggaaagaatatgctagctgctggatactgcatgtatggaagttcctgcacgcttgtgttaagcactggatctggtgtgaatggatttactcttgatccatctcttggggagtttatactcacacaccctgacattaaaatcccaaaaaaagggaaagatttattcggttaatgaaggaaatgctaagaactgggatgggcccaccgcaaagtttgtcgaaaaatgcaagttccccacagatggttcatccgcaaaatctttaagatatatcggaagtatggttgctgacgtccaccgaactttactttatgggggtgtctttttgtaccctgctgataagaagagccctactgggaaattaagggttctttacgaagtgttcccgatgtcgttcttgatggaacaagctggagggcagtcatttacgggaaaggaacgggcacttgacttggtacccaagaagatacatgaaagatctccgatattcttgggaagctatgatgacgtggaagaaatcaaggcattgtatgcagctgaagagaagaaggcataaagagtcttatttctatgttgccatttctttgttcataaaactatgttttttatttgtatttgtaataaaaataagctacattttaagtacttgtcagtaaataatgttgcacgaaaaaaaaaaaaaaaaaagtctctgcgttgat

SEQ ID NO: 2820 - DNA, 1274 bp, Chrysanthemum coronarium
taatatatcataacaagaaaaaaaaaaaatacatacagtattatatatttttttgagaaagaaaaaaaagatggatcatgaggcagatgcgtttaggacagatttaatgacgatcacacgattcgtgttgaacgaacagtcgaaacatccggagtcacgtggtgattttagtattttgcttagtcacattgttcttggttgcaagtttgtttgtgctgctgttaataaggcgggtttggctaaactcattggacttgctggagagaccaatgtgcagggagaagagcagaagaaactggatgttctttcaaatgaagttttcgtgaaagctttggtcagcagtggcagaacatgcatacttgtttctgaagaggatgaagaagcgataattgtggaaccatctaagcgtggaaagtattgtgttgtgtttgatccgctggatggatcctccaacattgactgtggcgtttccattggaactatttttgggatctacatgataaaagacggtgatgatccatctttagaagatgtacttcagcctggaaagaatatgctggctgctggatactgcatgtatggtagctcttgcacgtttgttttgagcactggatctggtgtgaatggttttactcttgatccatcactaggagagtttatactcacccacccggacatcaagatcccaaagaaaggaaagatctattcagtcaatgaaggaaatgctaagaactgggacggcccgactgcaaagtttgtggaaaaatgcaagtaccccacggatggttcatctgccaaatctttaagatatattggaagtatggttgctgatgttcatcgcacattactttacgggggtgtgtttttgtaccctgctgataagaagagcccaagtgggaaactaagggttctgtatgaagtgttcccgatgtcgttcttgatggaacaagctggaggacagtcgtttactggaaagatacggtcacttgacttggttccaaagaatattcatgaacgatcccccatcttccttggaagctatgacgacgtggaagaaatcaaggcattgtatgcggctgaagagaaagcataagaaaagtgttaaaagagttaaaagggtaattgatctcatctccatgttcttgtgcagcttctatttgacatttctttgtttataaaaccatgctccactctttgttcccttttttcacatatgtaataaaaaaggctaccttttaatcaatagttttgaactgttgtagacagtagtcgcg

SEQ ID NO: 2821 - DNA, 1109 bp, Chrysanthemum coronarium
atcatgaagcagatgcgtttaggacggatttaatgacgataacgagatttgtgctgaatgaacagtcgaagcatccggaatcacgtggtgattttagtattttgcttagtcacattgttcttggttgcaagtttgtttgtgctgctgttaacaaggcaggtttggctaaactcattggacttgctggagagaccaatgtgcagggagaagagcagaagaaactggatgttctttcaaatcaagttttcgtgaaagctttggtcagcagtggcagaacatgcatacttgtttcagaagaggatgaagaggcaataattgtggaaccgtctaagcgtggaaagtattgtgttgtgttcgatccgctggatggatcctccaacattgactgtggtgtttccattggaactatctttgggatctacatgataaaagacggtgacgatccatctctagaagatgtactccagcctggaaagaatatgttggctgctggatactgcatgtatggtagctcttgcacgtttgttttgagcactggatctggtgtgaatggttttactcttgatccatctctaggagagtttatactcacccaccccgacatcaagatcccaaagaaaggaaagatctattcggtcaatgaaggaaatgctaagaactgggacggtccgactgcaaaatttgtggaaaaatgcaagtaccccacggatggttcatctgccaaatctttaagatatattggaagtatggttgctgatgttcatcgcacattactttatggcggtgtgtttttgtaccctgctgataagaagagcccaaccgggaagctaagggttttgtacgaagtgttcccgatgtcgttcttgatggaacaagctggaggacagtcgttcactggaaaggaacgggcacttgacctggttccaaagaagattcacgagcgatcccccatcttccttggaagctatgacgacgtggaagaaatcaaggcattgtatgcggccgaagagaaggcataaagaaggagttaagggtaattgatctcatctccgtgttcttgtgcagtttctattcgccatttctttgtttataaaaaccattctccactc

SEQ ID NO: 2822 - DNA, 1589 bp, Theobroma cacao
cgacaaaagacctcataaccgtcgaatgctgaaggacaagaaagacgacgaacttcgttaactcgttatcttcagcgacgaccactgcctcccagcctcgctctgctccctccacgtgtctgccgaaacttccatttccaacagataacccctcccgtaccaatcacccactgccccaaagcaatctttatcctctctttctccccacctcgaaaaaagcaaatccaatctctcttttattaaatatatattcttttcctcttctttgtagcttatttgttgctgtagttgctttattgggtcaattttatttttcgtctcttttgcttagctttgggtctttggaggggttgagaaagatggatcatgcagctgatgctcataggactgatttgatgacaataacacgctacgtgttgaacgagcaatctaagtacccggagtctcgtggcgatttcaccatcttgcttaatcacatagttcttggctgcaagtttctttgctctgctgttaacaaggctggtcttgccaaactcattggactagctggggagactaatgttcagggtgaagagcaaaagaaactggatgtgctttcaaatgaagtctttattaaggctttagtaagcagtggcagaacatgcatccttgtctcggaagaagatgaagaggcaacatttgtggagccctcaaagcggggaaggtactgtgttgtttttgatccactagatggttcctccaacattgattgtggagtttccattggaacgatttttgggatttacatggtgaaagatagccatgaaccaactctagatgatgtgctgcaacctgggaagcatatgttggcagcaggctattgcatgtatggaagctcttgcacgctcgtgttgagcactggagaaggagttcatggattcacccttgatccatctcttggagagttcatactaacccacccagacatcaagattccaaaaaaaggaaagatttattcagttaatgagggaaatgctaaaaactgggatggtccaacggccaagtatgtggaaaaatgcaagttccctaaagatggttcctcatcaaaatctctgagatacatcggaagcatggtagctgatgtccatcgcacattactctatgggggtatctttttgtaccctgcggataagaagagccccaatgggaagctgcgtgttctctatgaggtctttccaatgtcattcttgatggaacaagctggaggtcaggcattcactggcaagcaacgggcacttgacttagttccaacaaagatacatgagcgatctccaatatttctcggcagctatgatgatgttgaagaaattaaagcactgtatgctgcagaagggaagaaggaataaatcctagctgaacctaagatgagcttcagtgactgcttacaaaggttcttgcagaggtctcccacggaatgttgttgtgaattgaagcagctttcctccgccattcaacaatcataacaaagttgtttttcagagtgcttgattagttcacttgtttcaatcttagcttcgtcaatcaattcatttgacaacttcgaataattc

SEQ ID NO: 2823 - DNA, 1746 bp, Sesamum indicum
gggataataatactacaaccattttttccctccactactgcctcatcccatccctatccacacacattcacacgtactttgtgtgtcagcatttcgttgttagtcttcctcgaacgacgttccaagaattacacgataacgtgctctgcttactatatatacgcaggcataaataatatatgcaccggccctctgaattttcttggagttttaaatataatagcttcgcctttagtcaaagcaacatatatatacgtatatattttgtaaagtagggtggtggtttgacgatggatcacgcggcggaggctcatcggacggatttgatgaccataactaggtatgtgttgaatgagcagtcaaagcatccggagtcgcgcggggatttcaccatcttgctcaatcatattgttcttggctgcaagttcgtttgctctgctgttaacaaggctggtttagccaaactcatcggtcttgctggagagacgaatgtgcagggtgaagaacagaagaaactagatgttctctcaaatgaagtgttcatcaaggcattagtcagcagtggtcgaacttgcatcctcgtctctgaagaggatgaagaggcaacattcgtggaaccctctaagcgtggaaggtactgtgttgtgttcgatccattggatggatcgtccaatatcgactgtggtgtttctattggaactatctttgggatctacatgatcaaagagggaggtgaaccaaaactagaagacgtgttgcagcccgggaagaatatgctagctgctggctattgcatgtatggaagttcttgcacgcttgtgctgagtactggagctggagttaatggattcacactcgatccatctcttggagaattcatattgactcatccagatattaagattccaaagaaaggaaaaatatattctgttaatgaaggaaatgccaagaactgggatggtccaacagcaaagtatgtggaaaaatgcaagttccccaaagatgggtcaccagcaaaatctctaagatacattggaagtatggtagctgatgtccatcgcacgttactttatggaggcatctttctgtacccagctgacaagaaaagcccaaatggaaaactgagggtgctgtatgaagtctttcctatgtcgtttctgatggaacaagcgggaggacaggcatttacggggaagcagagggcactcgatttggtcccaaagaagatacacgagcgttctccaatattcctcggtagctacgatgatgtcgaggagatcaaagcattgtacgctgctgaagagccaaaataataaacttgtagatttcatttccggcttgcagctactcattgctgatatgtaataagacataatattcttcagagtacagttttcagttggaaagttatccgctgttctctgccaacacctgaatctggttgaacaatgatgatgttctgatacggaaaacaattaaatctcattttcttttgtatctcgctgatatgagaacagtgaaaatggagcgtccaagttcagtaagcatgactgactgaacttgcgacatatctcccagatgagtccaagagatgtggggaagaacacttgatcggcgttaaaatctgtcaacatgttgaataatatagtagagaagtcgagaaagtaacaacctacaagaaaacatattagtcctgtctgcatctgaaaactttcctctgttctctgcttaatttatttaaatggg

SEQ ID NO: 2824 - DNA, 1358 bp, Triphysaria pusilla
ccacaactgcctcatccccatctctatccacacacaaatcgggcgtaatttctgcgtcagcattcttcgattatttatgtcctttcctcgatttacggtccaagattcacagataacatcactatactatatatacatggacacgcataaataaagtttcttggagttatcataataatcatagtcgagtgcgcagtcaaaaagatatattttgtagttacacatttttcgcaaaggtttttggggcgatggatcacgcggcggatgcttaccggaccgatttgatgacgataacccgtcatgtgttgaacgagcagtcaaagcacccggagtcgcgtggggatttcacgattttgctcagtcatattgttcttggctgcaaatttgtttgctctgctgttagcaaggctggtttggctaaacttatcggacttgccggagagaccaatgtgcagggtgaagaacaaaagaaactagatgtgctctcgaacgaagttttcatcaaggcgttagttagtagcggccgaacttgtatccttgtctctgaagaagatgaagaggctacatttgtggagccctctcaccgtggaaagtattgtgttgtgtttgacccgttggatggatcgtccaacattgactgtggtgtttcaattggaactatatttggtatttatgctatttacgatgggcatgatccgaaactagaagacgtgctacagcctggaaagaacatgttagccgcaggctattgcatgtacggaagctcgtgcacgtttgtgttgagtactggatcgggagttcatgggttcacactcgatccatctcttggtgaattcattttgactcatcccgatattaagattccgaaaaaaggcaagatttattctgttaacgaaggaaatgccaagaactgggatggcccaactgcaaagtatgtagagaaatgcaagtaccccacagatgggtcaccggcaaaatccctgcgatacatcggaagtatggtagccgatgttcatcgcacgttgctctatggaggcgtatttttgtacccagctgataagaaaagcccaaatggaaaactgagggtcctttacgaagtttttccgatgtcgtttttgatggaacaagcaggaggacaagcttttacagggaaggagcgggcacttgatttgcttcctcagaagatacacgaccgctcaccgatattccttggtagctatgacgatatcgaggatatcaaagcattatatgcagctgaggagcaaacataatggacttgtaaatttcttttaccgagtttcgattttttactcattgttaattactcttttatgtaataaaaacacaattattctttg

SEQ ID NO: 2825 - DNA, 1289 bp, Ambrosia trifida
gtactcggggacttatcctctcctctcgtacgtcctttatttcatcacccttacgccactgtcatccaaccttccattgacaatcagataaccctcatctcgattcgcgtgcacacacacatatctatatatatacatacatatacacatatatctaatattctcaatctgatcccttaatttgcgtgattttgtccaccgatcaaatccaatccttcttattctaactctgcctttgaaccgaaacagttagcttcaattaatcaattgtattgttaacgatggatcacgaagccgatgctttccgaaccgatttgatgacgattactcggttcgtgttgaacgagcaatcgaagtaccctgagtcacgtggcgatttcagtattttgctgagtcacattgttcttggttgcaagttcgtttgtgctgctgttaataaggcaggtttggcgaaactcattggacttgctggagagaccaatgtgcagggagaagaacagaagaaattagatgttttgtcaaatgaagtttttgtgaaggctttggtcagcagtggcagaacatgcatacttgtttctgaagaggacgaggaagcgataattgtagaaccatccaagcgtggaaagtattgtgttgttttcgatccgttggatggatcttccaacatagactgtggtgtttccataggaactatttttgggatttacatgataaaagatgctggcgctgcccgtttagaagatgttcttcagcctggaaagaatatggtggctgctggatactgcatgtacggtagctcttgcacgcttgtgttaagcactgggtctggtgtcaatggatttactcttgatccatctttaggggagtttatactcactcaccctgacattaagatcccaaataaaggaaagatttattctgttaacgaaggaaatagccaagaactgggatggtcctaccgcaaagtttgtcgaaaaatgcaagttccccaaggatgattcacctgcaaaatctctaagatatattggaagtatggttgctgatgttcatcgcaccctactttacgggggcgtgttttgtaccctgctgataagaaaagcccgaatggaaaactaagggttctctatgaagtcttccctatgtcattcttgatggaacaagctggaggacagtcatttaccgggaaagaacgggctcttgacttggttcccaagaagatacatgaaagatctccaatattcttgggaagctatgatgatgtggaagaaatcaaggctctgtatgcagca

SEQ ID NO: 2826 - DNA, 1232 bp, Valeriana officinalis
ccgcctcagacggcgacgagtggcggcaacgttatcttaaaccccgttcacggtgccatttgattgacaccttgaagtgagtaacaactggaaaatcaaagcggaaattgtgacctacgtcaaaccggaaactatggatcacgcggcggatgctcaccggactgatttgatgactattactcggttcgtgcttaacgagcagtccaagcatcctgaatcgcgaggtgattttagtatattgcttagtcatattgttctcggctgcaagttcgtctgctctgctgttaataaggctggtttggcaaaactcattggacttgctggtgagaccaatgtgcagggagaagagcaaagaaattagacgtgctttcgaatgaagtatttgtcaaggcactggttagcagtggacgaacgtgcattcttgtttctgaggaggatgaagaggctatatttgtgaagccgtctaaccgtggaaggtattgcgttgtttttgatccattggatggatcctctaatatagattgtggcgtctccattgggactatctttggtatttatttgatgaaagatggaggcgaaccatctttggatgacgtgttgcaacccggaaagaatatgttagctgctggatattgtatgtatggaagctcttgtacgtttatgttgagtaccggatctggtgttaatggatttactcttgacccgtctctaggagagtttattctgactcatccagacattaagattcctaagaaaggaaagatttactctgtgaatgaaggaaatgccgagaactgggaccgtccaacagcagcatacgtgcatggttgcaagtacccaaaagacggatcatctccaaaatctttaagatacatcggaagtatggtagcggacgttcatcgaacattactttatggtggtgtctttttgtatcctgctgatcagaagagccctaatggaaaacttcgagttctgtatgaagtgtttcccatgtctttcttgatggaacaagctggcggtcagtcatttaccggcaaacaacgggcacttgatttggttccaaagaaaatacatgacaggtctccgatatttcttggtagctatgacgatgttgaggaaattaaagcactatatgctgccgaagccaaagattagaaaaataaatacagtatgttacttgtgaatcctttctttgcattgcagattttgctgtgatgaatacaaaggatgtc

SEQ ID NO: 2827 - DNA, 1186 bp, Flaveria ramosissima
atcctctcaatttcacgctaatacacaaaacacaagagttcaatctcgttcaatttctccgccggagaaccgatggatcatgctgctgatgcctccgtacggattgatgaccatcacgcggtttgtgctgaacgaacagtcgaaacatccggagtcgcgtggggatttcagtattctgctcagtcatattgtcttggatgcaagtttgtttgtgctgctgttaataaggcaggtttggcaaaactcattggacttgcaggggagactaatgtgcagggagaagagcagaagaaactggatgttttgtcgaatgaagtttttgtgaaggctttggtcagcagtggcagaacatgcatacttgtttctgaagaggatgaagaagcgataatcgtagaaccatccaagcgtggaaagtattgtgttgttttcgatccgttggatggatcttccaacattgactgtggtgtttccataggaactagttttgggtatttacatgaataaaagatagtggtgacggtcccgtttaggaagatgttcttcagcctaggaaagaatatgctggctgctggatactgcatgtatggtagctcttgcacgcttgtgttaagcactggatctggtgtgaatggatttactcttgatccatctttaggggagtttatactcacccaccctgacattaagattccaaagaaaggaaagatttattctgttaatgaaggaaatgctaagaactgggatggtcctactgcaaagtttgtggaaaaatgcaagtttcccaaggatggttcccctgtgaaatctctaagatatatcggaagtatggttgctgacgtccatcgtaccttactttacggtggcgtgttcttgtaccccgctgataagaaaagcccaaatggaaactaagggttctctatgaagtctttccaatgtcattcttgatggaacaagctggaggacagtcgtttacaggaaagaacgggctcttgacttggtccccaagaagatccatgaacgatctccgatattcttgggaagctatgatgacgtggaagaaatcaaggcactgtatgcagctgaagaaaaggacgtaaagaagggttcttgtgctgttgtatttccctttattcagctcttatataagttaaattttattgcaatttgatgaaaataatgtgtttat

SEQ ID NO: 2828 - DNA, 2668 bp, Solanum tuberosum
gccaaagtgaggattcatttcacacacagatcttcttccttcacttccatcatctctctcaatctcgactatagtaatgtacgtatagctctgcgtttggattccggttgattcaataattctactccctgaaggtgattaaccctattcaaatggctcgccatgggcatctaccttcagtatttctcctgatcttctcgttatccttgatccaaagcgctctcgttcactctaaaaccctcaaacgtgacgtgaaagctctgaatgaaattaaggcatctcttggatggagagtggtgtatgcatgggttggagatgatccttgtggtgatggtgatttacctccatggtctggtgttacatgttcaacgcagggtgattatagagtagttactgaattggaagtttatgctgtttcaattgttggcccatttcctactgctgtcactaatttattagatcttactagactggatctgcataataacaagctgaccggccctcttccttctcaaattgggcgtttgaagcgtcttaaaatattaaacgtgaggtggaataagctgcaagatgtcattccacctgaaataggtgaactaaagcagttaacacatctctacctaagttttaataatttcaaaggcgaaatacctaaggagcttgctaatcttcctgaacttcgttatctccatctgcatgaaaatcattttattggacgaattccacctgaactgggttccttacagtatcttcgacacctggatgttggtaacaatcgtttggttggaactataagagaactcatacgtattgaaggatgttttccggttctccgcaacctatacttaaacaataattatcttactggaggcattccagcgcaacttgcaaatctgacgaacttggagatcttgtatctatcctacaacaagatgacaggagttataccatatagcattgctcatattcctaagttaacttacttgtatctcgatcataatcaattttctgggaggattccagatgccttctacaaacaccctttcttgaaggaaatgtacattgaagagaacacgttccggcctggtgtaaaaccaattggcctgcacaaagtgctagaactttcggacgcagatttccttgtttagaaaatgccaactcctgttatttgttcatgagcaaagtgtacctaggttgtcgaaagaagcagccggtccctgttctgtcaagtatctattctttagttgccagatgagaaaaaaggttccatcttttttgtgcaaagaagtaatcaaccaaacttagttgcggttgctgcagttaaatagtaccacgttatgaatcattattaagtaagtgcgacatacgtctcaatcagttctcacttgccttgaattcttgcatttggtttttgattatacatgatgcgatttcagagagtttgagggagaagaaggaagaaagtagagcgatggatcacgcagcagatgctcatcggactgatttgatgactataactaggttcgtgttgaacgaacagagtaaataccctgaatctcgcggcgatttcactattttgctcagtcatattgttcttggctgcaaatttgtttgtactgctgttaacaaggcaggtttggccaaactccttgggcttgctggtgagactaatgtgcagggtgaagaccaaaagaaactggatgtactctcaaatgaagttttcatcaaggctttggtcagcagtggccgaacatgcattctcgtgtctgaggaagacgaagaagctacttttgtagagccatctaagcgtggaaagtactgtgtagtttttgatcctctggatggatcttccaacattgattgtggtgtttctattggaacgatctttgggatttacatgatgaaagatgttcatgaaccaacactagatgatgtcttgcaacctggaaagaatatgttagctgctggatactgcatgtatggaagttcttgtacgcttgtcttgagcactggaaaaggtgttaatggttttacacttgacccctctttaggcgagttcattttgactcatccagatatcaagattccgaagaaagggaagatttattcagtgaatgaaggaaatgccaagaactgggatggtccaacatccaaatatgtggagagctgcaaattccccaaggatggttcttcacccaaatctttaagatatattggaagcatggtagctgatgttcatcgcactttactctacggaggtatctttttgtacccagctgataagaaaagccccaatggaaagctgcgggttctctatgaagtatttcccatgtcatttctgatggaacaagcaggaggtcaagcatttaccggaaaggagcgggcattggacttagttcctacgaagatacatgaaagggcgccaatattcctcggtagttacgatgatgtggaggagatcaaaaggctttatgctgctgaagagaaaaactaatggatgtacatttacattcattatctcacttcacaattcttgctgatgctcattgctaatttgttgtaatatagcaaatttctggttgttataagtcacaaaataatcaattatgattacagatgtatgttccacgttagcttgttagctactgtgataataatacctgcatat

SEQ ID NO: 2829 - DNA, 1380 bp, Solanum lycopersicum
aaatgatgtcaaactcgaatctgtcaactaaataggagcctcgaattgcgggctactggtgtaaacatgaaattgcgtgccacccaattttttccccaattttataatttgatgtataactgttattgaagagttttggagaagaaagcagagcgatggatcacgcagcagatgctcatcggactgatttgatgactattactaggttcgtgttgaatgaacagagtaaataccctgaatctcgcggcgatttcactattttgctcagtcatattgttcttggctgcaaatttgtttgtactgcagttaacaaggcaggtttggccaaactccttgggcttgctggtgagactaatgtgcagggtgaagaccaaaagaaactggatgtactctcaaatgaagttttcatcaaagctttggtcagcagtggtcgaacatgcattctcgtgtctgaagaagacgaagaagctactttcgtagagccatctaagcgtggaaagtactgtgtggtttttgatcctctggatggatcttccaacattgattgtggtgtttctattggaacgatctttgggatttacatgatgaaagatgttcatgaaccaacactagatgatgtcttgcaacctggaaagaatatgttagctgctggatactgcatgtatggaagttcttgtacgcttgtcttgagcactggaaaaggtgttaatggttttacacttgacccctctttaggcgagttcatcttaactcatccagatatcaagattccgaagaaaggaaagatttattcagtgaatgaaggaaatgccaagaactgggatggtccaacatctaaatatgtggagagctgcaagttccccacggatggttcttcacccaaatctttaagatatatcggaagcatggtagctgatgttcatcgtacattactctacggaggtatctttttgtacccagctgataagaaaagccccaatgggaagctacgggttctctatgaagtatttcccatgtcatttctgatggaacaagcaggaggtcaagcatttactggaaaggagcgggcactggacttagttcctacgaagatacacgaaagagcgccaatattccttggtagttacgatgatgtggaggagatcaaaaggctttatgctgctgaagagaaaaactaatgaatgtacatttacattcattatcttattttacaattcttgttgatgcttattgctaatttgttgaaatatagcaaatttgctggttgttataagtcacaaaatcataaaattatgactacaactgtatgttccacattagcttgttggctactgtgataataatacctgcatataaatgagcaatcttaaaaaaaaattg

SEQ ID NO: 2830 - DNA, 2140 bp, Aristolochia fimbriata
cgtcgcgacaaagcagccaatcttactcgatcaaatgggacgggtccgcattttaaggaaaagaaggatcggatcgggggtgctgactcatcgcctcgtccctgtcatttccgtttattgaactatcctctgcaactcctcaattacgtcgatggctcctctctctcaggggtctcagggtcgtctctcgtctctcctcattttcagtcgtcaccacgcccgagacggatatcataaataacagacccctccacctttggactttgctccgagcaggacaaatcaaacgaacgtcctcaagaacagccgctgggagggccgttttacgagccagccaagggctcgttatcttcggctccgccactctacgctcccccagctcttcgttcatggcggtcgcgacacgtgtcgtctcgcgtctccagtgacctcagatagcgctatccttctctctctggtttcccttctcctgttctcgacctgggtattgacgtataagtaggctgcggtgtgggattttatttcttggtttgtcaattcgataaacaggtggtggtgggttgtgggggtctttgtttttttttcctggggaggagacatggatcacgcggcggatgctcaccggacggatttgatgaccattacccgtttcgtgctcaacgagcagtcgaagcatccggagtcgaggggggattttaccatcttgcttagccatatcgttctcggatgcaagttcgtctgcactgccgttaacaaggcgggcttggctaaacttattggactcgctggagagactaatgttcagggggaggagcagaagaaattagatgtgctttcaaatgaggtttttgtcaaggctttggtcagtagtggtcgaacaagtattcttgtatcggaagaggatgaggaggcaacctttgtggaagcatcaaaacgtgggaggtattgtgttgtatttgatccattggatggatcttccaacattgactgtggtgtgtcaattggaactatcttcggaatatatatgttgaaagacacaaatgatcccaaacttgaagaagtcttgcaacctgggaagaatatgcttgccgctgggtattgcatgtatgggagctcttgcacgctcgtgctgagcactggtagcggtgttaatggttttaccctggatccatctctaggggagtttatattgacacatccagacattaagatcccaaagaagggaaaaatttactctgtgaatgaaggaaatgctaagaactgggatgagccaacttccaagtatgtggagaagtgcaagtttccgaaagatggttcatctccaaaatcactgagatatattggaagtatggttgctgatgtccaccgtacgttactttatggaggtatctttttatacccaggagacaaaaagagcccaaatggcaaacttcgtgtactctatgaggtcttccccatgtctttcttgatggagcaagccggaggtcaagcatttacaggcaaggaacgggctcttgacttgattcctacaaagatccatcagcgatcccccatctttcttggcagctatgatgatgtggaagaaataaaagcactctatgctgctgcagcagaaaaaacagcataatcttgacatacaaaatctcgaagcttctcctcgcagtcaaccacctcctcctgtaccgtctcattcctttctgattagtatattaacaaaaggtcaaatcttcatgcaagatcctggtgacaacgaaggcatttatataggcctcttgaggattggttgctgtattctagcaatttttccccctttctaccatttgtccatgttttgatgtactacattctatgctcacaacttgcaagagtgtgtgaatatccctggaagaataagtgtgtccgaacaatgacacagcaaaacttgtaagaatgcataaatgtctagaagaataagtgcgctgatgctccatgttgtcataaacagtatacatatgactgtacaagggtccaggcttcatcttgatgctttatttagtactttcggcttcttcatcctgttgaacaagaccataaaaacaaagttagcttcactattaagaaaaaaaaaaaaaaaagtacggatgcgttgttaccactgctt

SEQ ID NO: 2831 - DNA, 1519 bp, Theobroma cacao
tttttattctcccactttctctttcttagcaagccaaacagggaaaaacagagggattctttgctgtcctaagttaccttgtttcttttgggtgcttattttgatcgccaagagaaagatttaaccaatcgagagaagatttttgtgagttttgttcctgacaaagggcgtcatggatcatgctgctgatgctcatagaactgatttgatgaccatcactcgccatgtcctgaatgagcaatccaagtacccggaatctcgtggcgacttcaccattttgctcagtcacatcgttcttggctgcaaattcgtctgctctgctgttagcaaggcaggtcttgcaaaactcattggactcgcgggagagaccaatgttcagggtgaagaacagaagaagttggatgtgctttcgaatgaagtttttgtcaaggcgttgattagcagcggccgaacatgcatccttgtttccgaggaggacgaagaggctacattcgtggagccatcaaagcgtggaagatacattgttgtttttgaccctttggatggatcctcgaacattgactgcggtgtttccatcggaactatttttggtatatacttagtgaaagataaggataacccaacccttgatgatgtactgcaacctggaagaaatctgttggcagctggctattgtatgtacggaagttcctgcacgctggtgctgagtacggggagtggcgtcaatggattcacacttgatccatctctcggggagttcatactaactcatcccgatatgaagatacctaagaaaggaaagatttattcagtgaatgaaggaaatgccaaaaactgggatgagccaactacaaggtttgtggaaaaatgcaagttccctacggatggttcgccaccaaagtcccttagatacgttggaagcatggttgcagatgtccaccgcacgttgctttatggtggtatctttttataccctgcagataagaaaagtcccaacgggaagctacgtgttctctacgaggtgttcccaatgtcatacctgatggagcaagcaggaggtcaggctttcaacggcaagcaacgggcacttgacttggttcccaagaagatacatgagcgttctccagtttttcttggcagttacgatgatgttgaagaaattaaagcactctatgctgctgctgaggaaaataatgcataaacttgcagacttcatacatgtgatgtgatgcttacatataataagttttctttgtacaagaatgatagtaccatttttttggtcaagaagaatagtaccatttattgtagtataaatcatggtcatcagcaaatgtattatgtaaaactttatgttcctgatctagatttaatgtaaattaccaagtgagaagcagtcagaatcgaatttctgattccttcgatgatagataatataacagcgaacagatatcctggacaaatgatgtgatctttatatgataaaaaagagaacaggaaaaggaaggggagcacctag

SEQ ID NO: 2832 - DNA, 1135 bp, Centaurea maculosa
aaccatggatcataacgccgatgctttccgtacggatttgatgaccataactcggtttgtgctgaatgagcagtccaagcatcccgaatcacgcggtgatttcagcatcttgctcagccacattgttcttggttgcaagttcgtttgctccgctgttaataaggcaggtttggcaaaactcattggacttgcaggggagaccaacgtgcagggagaagaacagaagaaactggatgttctatcgaatgaagtttttgtcaaggctttggtcagcagtggaagaacatgcatacttgtctctgaagaggatgaagatgccataattgtggaaccgtcaaagcgtggaaagtattgtgttgtttttgatccgctggatggatcttccaacattgactgcggtgtttccattggaactatttttgggatttacatgataaaagatggcggtgagccatctttagaagatgtactgcagcctggaaagaatatgctggccgctggatactgcatgtatggcagttcttgcacgcttgtgttgagcgctggttctggtgtgaatggatttactcttgatccatctctaggggagtttatactcacccatcctgacattaagatcccaaaaaaaggaaagatttattcagttaatgaaggaaatgctaagaactgggatggtcccactgcaaagtatgtggaaaaatgcaagtttcctacggatggttcatctgcaaaatctctaagatatattggaagtatggttgctgatgttcatcgcaccttactttacgggggcatctttttgtaccctgctgataagaagagcccaaacgggaaactgagggttctgtatgaagtcttccctatgtcattcttgatggaacaagccgggggccagtccttcaccggaaaggagcggtcacttgatttggttccgaagaagatacatgaacgatctccgatcttccttgggagctacgatgatgtggaagaaatcaaggcattgtatgcagctgaagagaagaaggcataaaaaggccaaggcataaacatcatcttgtgcagttgctacttgtcatttctctcttcataaaccatgcaatctatgctacttttccttcatataatttgtaataaa

SEQ ID NO: 2833 - DNA, 1176 bp, Cirsium arvense
gattttgtcaaccgatgaaattcaatcttgtactctgattgattatttttctttctttcacccaattatcatcaaccatggatcataacgccgatgctttccgtacggatttgatgaccataactcggtttgtgctgaatgagcagtccaagcatcccgaatcacgcggtgatttcagcatcttgctcagccacattgttcttggttgcaagttcgtttgctcagctgttaataaggctggtttggcaaaactcattggacttgctggggagaccaatgtgcagggagaagaacagaagaaactggatgttctatcgaatgaagtttttgtcaaggctttggtcagcagtggaagaacatgcatacttgtctctgaagaggatgaagatgccataattgtggaaccgtcaaagcgtggaaagtactgtgttgtttttgatccgctggatggatcttccaacattgactgcggtgtttccattggaactatttttgggatttacatgataaaagatggcggtgagccatctttagaagatgtactgcagcctggaaagaatatgctggccgctggatactgcatgtatggcagttcttgcacgcttgtgttgagcgctggttctggtgtgaatggatttactcttgatccatctctaggggagtttatactcacccatcctgacattaagatcccaaaaaaaggaaagatttattcagttaatgaaggaaatgctaagaactgggatggtcccactgcaaagtatgtggaaaaatgcaagtttcctacggatggttcgtctgcaaaatctctaagatatatcggaagtatggttgctgatgttcatcgcaccttactttacgggggcatctttttgtaccctgctgataagaagagcccgaatgggaaactgagggttctgtatgaagtcttccctatgtcattcttgatggaacaagccggaggccagtccttcaccggaaaggagcggtcacttgatttggttccgaagaagatacatgaacgatctccgatcttccttgggagctacgatgatgtggaagaaatcaaggcattgtatgcagctgaagagaagaaggcataaaaaagagaaggcataaacatcatcttgtgcagttactacttgtcattcataaaccatgcaatctatgctactt

SEQ ID NO: 2834 - DNA, 1425 bp, Cirsium arvense
tcttgtactctgattgattatttttctttctttcatccacccaattatcaagtgaaaaagaatcatcaaccatggatcataacgccgatgctttccgtacggatttgatgaccataactcggtttgtgctgaatgagcagtccaagcatcccgaatcacgcggtgatttcagcatcttgctcagccacattgttcttggttgcaagttcgtttgctcagctgttaataaggctggtttggcaaaactcattggacttgcaggggagaccaatgtgcagggagaagaacagaagaaactggatgttctatcgaatgaagtttttgtcaaggctttggtcagcagtggaagaacatgcatacttgtctctgaagaggatgaagatgccataattgtggaaccgtcaaagcgtggaaagtattgtgttgtttttgatccgctggatggatcttccaacattgactgcggtgtttccattggaactatttttgggatttacatgataaaagatggcggtgagccatctttagaagatgtactgcagcctggaaagaatatgctggccgctggatactgcatgtatggcagttcttgcacgcttgtgttgagcgctggttctggtgtgaacggatttactcttgatccatctctaggggagtttatactcacccatcctgacattaagatcccaaaaaagggaaagatttattcagttaatgaaggaaatgctaagaactgggatggtcccactgcaaagtatgtggaaaaatgcaagtttcctacggatggttcatctgcaaaatctctaagatatattggaagtatggttgctgatgttcatcgcaccttactttacgggggcatctttttgtaccctgctgataagaagagcccgaacgggaaactgagggttctgtatgaagtcttccctatgtcattcttgatggaacaagccggaggccagtccttcaccggaaaggagcggtcacttgatttggttccgaagaagatacatgaacggtctccgatcttccttgggagctatgatgatgtggaagaaatcaaggcattgtatgcagctgaagagaagaaggcataaaaaagagaaggcataaacatcatcttgtgcagttgctacttgtcatttctctcttcataaaccatgccatgctatgctacttttccttcatatatttgtaataaaaagactattatgaccaaaaccacatgctaatctgcttttgttagattctattatttactcaaacaataaacaaacaaaacttgtaaaaaatactttcaattcctcaaacaaaacctagggaaacaattaagaaaaacattgggattacttgccttcacaataaatatggaacctttttactaagaacacttgcacaaagccctattatatcattctcaatgtg

SEQ ID NO: 2835 - DNA, 1737 bp, Prunus mume
gtttgcttgaaatccacacaacggaacctcgtccacttcatcctccatctccatagacaagacaaaaacctgataaccgccgaatcagggagaaaacgacgagaggcgttatctttagtgacggcctcagagctcactgccccatcccaggccctccacgtgtcctccgaaacttccattagtaccagattagtcccctcccttcccaatccactaacacctcgaatcgagtaccaccaccaccatctaatccaaatctaaacaactattttgacccaaaaacaaaaaacaaaaaaaaaacgactatttatttatttttctgtaaatgttttttgggggataaatatatatatttatttggccattggtgggttttgtgtttttggtttctcaagtttttagtgacagtggtggtgggttgtggagagagagagagaaagaaataggcgaaaatggatcacgcagccgatgctcaccgtacggatttgatgaccataacgaggttcgtgctgaatgagcagtccaagcaccctgagtctcgcggagacttcaccatcttgctcaatcatattgttcttggctgcaagtttgtctgctctgctgtcaacaaggcgggtctggccaaacttattgggcttgctggagagaccaacgttcagggtgaagagcaaaagaaactggatgtgctttcaaatgaagtttttgttaaggccctggttagcagtggcagaacttctatccttgtttcggaggaagatgaagaggccatatttgtggagccatccaagcgtggaaagtactgtgttgtatttgatccactggatggttcgtctaacattgattgtggtgtttccattggaacgatttttgggatttatgtggtaaaagatggcattgaacctactctgcacgatgtcttgcaacctggaaagaatatggttgcagcaggctactgcatgtatggaagctcttgcacgtttgtgttgagcactggaactggagttcatgggttcactctggatccatctcttggggagttcatactaactcacccagacatccagattccaaagaaaggaaaaatctattcagtgaatgaagggaatgccaaaaattgggatggtccgacggccaagtatgtggaaaagtgcaaatacccgaaagatggttcatcaccaaagtctctaagatacattggaagcatggttgctgatgttcatcggacactgctttatggaggtatctttttgtatcctgctgacaagaagagcccaaatgggaaactgcgtgttctctacgaagtcttccccatgtctttcttgatggaacaagcaggcggtcagtcattcactggcaaggaacgggcccttgatctagttccaaacaagatccatgagcgctctccaatcttccttggcagctatgatgatgttgaggaaatcaagacactctacgccgcagaagggaagaagtaatgaacttataattctgattctgttacagtaattacgtaattgttcggctatctgaacttccatcttttaaatcaagctgtaaagagaacgtcagtacaataatttattgacgtgtacaactctaacaaggtattcttatgttttgaattacaccctcataacgttttttggctcaagttttcttaaaatatgatatattacaacataaatcataaaatagcatcattagatttaattttatttatagattaaatggaaaaat

SEQ ID NO: 2836 - DNA, 1267 bp, Solanum phureja
agtaactgaagagtttgaggcagaagaaggaagaaagtagagcgatggatcacgcagcagatgctcatcggactgatttgatgactataactaggttcgtgttgaacgaacagagtaaataccctgaatctcgcggcgatttcactattttgctcagtcatattgttcttggctgcaaatttgtttgtactgctgttaacaaggcaggtttggccaaactccttgggcttgctggtgagactaatgtgcagggtgaagaccaaaagaaactggatgtactctcaaatgaagttttcatcaaggctttggtcagcagtggccgaacatgcattctcgtgtctgaagaagatgaagaagctactttcgtagagccagctaagcgtggaaagtactgtgtagtttttgatcctctggatggatcttccaacattgattgtggtgtttctattggaacgatctttgggatttacatgatgaaagatgttcatgaaccaacactagatgatgtcttgcaacctggaaagaatatgttagctgctggatactgcatgtatggaagttcttgtacgcttgtcttgagcactggaaaaggtgttaatggttttacacttgacccctctttaggcgagttcattttgactcatccagatatcaagattccgaagaaagggaagatttattcagtgaatgaaggaaatgccaagaactgggatggtccaacatccaaatatgtggagagctgcaaattccccaaggatggttcttcacccaaatctttaagatatattggaagcatggtagctgatgttcatcgcactttactctacggaggtatctttttgtacccagctgataagaaaagccccaatggaaagctgcgggttctctatgaagtatttcccatgtcatttctgatggaacaagcaggaggccaagcatttaccggaaaggagcgggcgctggacttagttcctacgaagatacatgaaagggcgccaatattcctcggtagttacgatgatgtggaggagatcaaaaggctttatgctgctgaagagaaaaactaatggatgtacatttacattcattatctcacttcacaattcttgctgatgctcattgctaatttgttgaaatatagcaaattgctggttgttataagtcacaaaaatcatcaattatgactacaaatgtatgttccacattagcttgttagctactactgtggtaattatacctgcatataaaggcgcaatcttcaaaaaaa

SEQ ID NO: 2837 - DNA, 1472 bp, Capsicum annuum
gcacgaggcgtagctcccccttgtctctccacgtgtcatatgaaacttgcattgacatcagatacccccaagtaccaatcccgttcattttcccaggttacccttttatcgacactaattatttattgcatgatcactcgtgtcaacatcgaattgcgtgccaccctaattgatatacatacaattgtactactactataaactactgctttattgctggagtattggaggggaagaagaagaaggaggaattgaagagttatcggatatggatcacgcagcggatgcgcatcggacagatttgatgacaataacaaggttcgtgttgaatgagcaaactaaatatccagaatctcgcggcgacttcactatattgctcagtcacattgttcttggctgcaaatttgtctgtactgctgttaacaaggcaggtttggccaaactccttgggcttgctggtgagactaatgtgcagggtgaagaccaaaagaaactggatgtactctccaatgaagttttcatcaaggctttggtcagcagcggccgaacatgcattctcgtgtctgaagaagacgaagaagctactttcgtagagcctgctaagcgtggaaagtactgtgtagtttttgatcctctggatggatcttccaatattgattgtggcgtttctatcggaacgatctttgggatatacatgatgaaggatgctcatgaaccaacactagatgatgtcttgcaacctggaaagaatatgttagctgctggatactgcatgtatggaagttcttgtacgcttgtcttgagcactggaaaaggtgttaatggttttacacttgacccctctttaggcgagttcatcttaactcatccagaaatcaagattcctaagaaaggaaagatttattcagtgaatgagggaaatgccaaaaactgggatggtccaacatccaaatatgtggagagctgcaagttccccgaggatggttcttcacccaaatccttaagatatatcggaagcatggtagctgatgttcatcgtacattactctatggaggtatatttttgtacccagctgataagaaaagccccaatggaaagctgcgggttctctatgaagtatttcccatgtcatttctgatggaacaagcaggaggccaagcatttaccggaaaagagcgggcactggacttagttcctacgaagatacatgaacgggcaccaatatttcttggtagttatgatgatgtggaggagatcaaaaagctttatgctgctgaagagaaaaattaatggatgcatatttacaatcatcctctcactttacaattcttgctgatgctcattactaatttgttgaaatagagcaaatttctgtttgttaccaagtcacaaaatcatcaatattacaacatatgtatgttgcacattagcttgttggctactgtcaaacaataatacgagcatatatgag

SEQ ID NO: 2838 - DNA, 1791 bp, Hordeum vulgare
agtgtcctggtcaaatgggcacaggctgctcctcccttctttcccggacacgtctggccgcgctgccgagcatatccacgccgacgtggaagcccgcaccgcacctcatccggcacgcctcccaccggccaccggcttccgttccgccgcctatatcatcaatccccgggccgcgcatcggattccctctccccatctctaacaaccatccgcgggcggtgcaatctgtttgcatccgtccttcccacccctcagccgccctcgctcgctagcgcagttgctcggcggagaatcggcgtcggtccagagcagagcagagaagagaagatggaccacgcggcggaggcgcagcggacggacctgatgacgatcacgcggcacgcgctgaacgagcagggccggcacccggagtcccggggcgacttcaccatcctcctctcccacatcgtcctcggctgcaagttcgtcgcctccgccgtcaacaaggccggcctcgccaagctcatcggcctcgccggcgacaccaacatccagggggaggagcagaagaagctggacgtgctctccaacgaggtctttgtcaaggcgctcatcagcagcggccgcacctgccttctcgtgtctgaggagaacgaggcggccatattcgtggacgccccgctccgcgggaagtactgcgtatgcttcgaccccttggacggctcctccaacatcgactgcggcgtctccatcgggaccatctttgggatctacatgatcaaagacaaggacaacgcgactctggaggacgtgctgcagcccgggaccgacatgatcgctgctggctactgcatgtacgggagttcatgcacgcttgtgttaagcactgggaatggtgtgaatggcttcactcttgatccttcccttggggagttcatacttacccatcccaacataaagataccaagcaaggggaagatctattctgtcaacgaagggaatgccagaaactgggacgggccgacagcaaagtacgtagagagatgcaagttcccccaagacggctcatcgcccaaatccttgagatatattggaagcatggttgctgatgttcaccgtaccctgctctacggaggcatatttctgtaccccgcggacaagaagagccccaacggaaagcttcgtgttctgtacgaggttttccccatgtcattcctgatggagcaagccggaggccaatctttcaccggcaaacagcgggcccttgaaattgtcccttgtgacatacaccagaggtctccgatattcctcgggagctacgatgatgtggaggagattaaatcactgtacgcttcggagtcgagcaccgcctgatccgagcacatatacgcatgttctgcatcgcgttgctaaaaggaaaagttatgttcagcgttgtgacggaactccttgggtagctgctacgcatccatcgggtgatgtttagaaaacattcaccatcttgataaccgtaggattgtaagctcatcaaccgtccgatcttctttcaatgaactttgcaacaaggctcgtgttgcgttcggcgctttgcaacacgagtcatgttgtgctacggtcgaactgtttttttttttgaaacaatgcctatgtttcagaaacaaagactgtgttgcgaaaatatctatataattgtatttacaacagagtttgttatagagtattttctgcaacaaagatcgcgttgcagaaatatctaccgttaggacgtttgcaacagagttcgtgttgcagaacttttgcagcgcatatatt

SEQ ID NO: 2839 - DNA, 1502 bp, Coffea canephora
gcatggatctctatcctctgtcttcgtgtggcctcgtcagctgcgccttatttctcctagtccttcctccttgatttgagtaccaccagtgacttcgactgcttccagcctactatttcctaagataagaagagcaaattccatcgatcccatcaattcttgataatcttcatattggtatttgaatttgtaaggctgcaaaaaacaagaaatggatcattcggcggatgcatacaggactgatttgatgaccataaccaggtttgtattgaacgagcagtccaagcacgcagaatctcgcggggatttcactatcttgctcagtcacattgttctgggctgcaagttcgtttgttctgctgtcaacaaggcaggcttggccaagctgattgggcttgcaggtgagacaaatgtgcagggtgaagagcaaaagaagcttgacgtgctatcaaatgaagtttttgtcaaagctctggtcagcagcggtcgaacatgcattctcgtctctgaagaagatgaactggccattgttgtggagccatccaagcgggggaagtattgtgttgtgtttgatcccttggatggatcctccaacatcgactgtggtgtctcaattggaactatttttggtatttacatgattaaagatcacagtgaaccaaaattagaagacgcgttgcagcctgggaaggacatggtagctgctggctactgcatgtacggtagctcttgcacgcttgtgttgagcactggaagtggtgttaatggatttactcttgatccatctcttggagagttcatactgactcatccagatattaagattccaaagaaaggaaagatatactctgtaaatgagggaaatgcaaggaactgggatgctccgacagctaaatatgtggagaaatgcaagttcccaaaagatggttcatcagctaaatcattaagatacattgggagcatggtagccgatgttcaccggacattgctctatggaggtatctttttgtatccagctgataagaaaagtcctaacgggaaattgagagttctatatgaggtcttcccgatgtctttcttgatggaacaagctggaggacaagcatttactgggaaggaacgggcacttgacctagttccaaagaagattcatgaaagatcaccaatatttcttggtagttatgatgatgttgaagaggtcaaagcactttacgctgaagagcagaaagcatagatatgtgaaactcttttaccttgttgatttggtccatctggaggctttgactgctaatttcttggagcaaaacaaactgttcgtttagtttttctttcaagttgcaaaactactgtattgcggtaaactgtgtgtgtcaagattgtggttcatgtcagtgaccatcacaactgacatagagatgcactatgcacatatgttgacataaagaagcatgtgtagttttctacctcattattcacttgtacatctttactgattaaacatc

SEQ ID NO: 2840 - DNA, 1177 bp, Taraxacum officinale
actcaatcaccagacaaagatggatcatgaagcggatgccttccggacggatttgatgaccataactcggtttgtgctgaatgaacagtcgaagcatccggagtcacgaggggatttcagtatcctgctcagtaacattgttctaggttgcaagttcgtctgctccgctgttaacaaggcaggtttggcaaaactcattggacttgcaggggagacgaatgtgcagggagaagaacagaagaaattggacgttctctcaaatgaagttttcgtaaaagctttggtcagcagtggtagaacaagcatacttgtttctgaggaagatgaagaagcaatatttgtggaaaaatccaagcgtggaaagtattgcgttgtttttgatcccctggatggatcctccaacattgactgtggtgtttccataggaacgatatttgggatttacatgataaaagatggtaatgatgcatgtatagaagatgtattgcagcctggaaaggagatgctggctgctggatactgcatgtatggtagctcttgcacgcttgtattaagcactggatctggtgtgaatggattcactcttgatccatctcttggggagtttattctcacccaccccgacattaagatcccaaagaaaggaaagatttattcagtcaacgaaggaaatgctaagaactgggatggtccaactgcaaaatatgtggaaagatgcaagtacccaacagatggttcacctgctaaatccttaagatatatcggaagtatggttgctgatgttcatcgaaccttactttatggtggtatctttttgtaccctgctgataagaagagccctgatgggaaattaagagttctctatgaagtgttcccgatgtctttcttgatggaacaagctggcggacagtcatttaccggaaaggaacggtcacttgacttggtaccaaagaagatacatgaaaggtctccgatattcctgggaagctatgatgacgtggaagaaattaaggcactttatgcggctgaaggaaagggaaattaaacttatttgatctccatgttcttgtgttgccatttctttgttcataaaatcatgtacttttccttgcatttgtaataaataaaaaagcgacactttatgtaattgttctaaatattaggagtaatgttacat

SEQ ID NO: 2841 - DNA, 1502 bp, Citrus clementina
catacacgtcctcttcaacatacacgcaaaacaacataaccgtcgaatcagatcgtttcatcgagtacaagctgacgaaacacgctatcttcacttttcagtgacgaccacccaacctttctctcactttccacccgccacgtgtccttccactcttccatttcctgccgataacacaatcccctacgcttacacatatatccgctctcaatctcacgcccttgaatccagcgctttatctttgcatatctcttagaaaacgacagcgtttctcttttaaccgccgaagaagatggatcacgaagcggacgcgcaccggacggacttgatgactattactcgttttgtgctgaacgagcagtcgaagcacccggagtcccgcggcgacttcagcatcttgcttagtcacattgttctcggctgcaagttcgtttgttctgctgttaacaaggcgggtcttgccaagctaattggacttgctggagaaaccaatgttcagggtgaagagcaaaagaaattagatgtcctctctaatgatgtctttgtcaaagctttgatcagcagtggccgaacatgcatccttgtctccgaagaagatgaagaggcaatatttgtggagccctctaagcgtggaaggtactgtgttgtttttgatccgttggatgggtcttctaacattgattgtggtgtttccattggaacgatatttgggatttatatgatgaaagatagccatgaaccgactctagatgatgtgttgcaacctggcaacaatatgttggctgctggctattgcatgtatggaagctcttgcacgcttgtattgagcactgggagtggtgtcaatgggtttacgcttgatccgtctcttggggagttcatactaactcacccagatattaagattccaaagaaaggaaagatttactcggtaaatgaaggaaatgctaagaactgggatggtccaacagccaagtatgtggaaaaatgcaagttccctaaagatggttcatcaccaaagtccttaagatacattggaagcatggtagctgatgtccaccgcacattactttatggaggtatctttatgtatcctcgtgataagaagagccccaatggcaaattgcgtgtgctctatgaagtcttcccaatgtcattcttgatggaacaagccggtggtcaatctttcactggcaagcaacgggcacttgacttggttccaaagaagattcatgaacgttctcccatatttttgggcagctatgatgatgtcgaagaaatcaaagcactctatgctgcagaagagaagaaagaatgagcttgtcaattctatctttcatgatgcttacatatctctatcagatcccatttctgatcaactttccataacatgttacaaaactttcattaaggttcctttatgtattggaaatgatacagttccagtccaagctgtatattttgaataaaatgaaggtgaatgtttcagtttttgtattatt

SEQ ID NO: 2842 - DNA, 1497 bp, Citrus sinensis
cgtcctctgcaacatacacgcaaaacaacataaccgtcgaatcagatcgtttcatcgagtacaagctgacgaaacacgctatcttcacttttcagtgacgaccacccaacctttctctcactctccacccgccacgtgtccttccactcttccatttcctgccgataacacaatcctctacgcttacatatatatccgctctcaatctcacgcccttgaatcgagcgctttatctttgcgtatctcttagaaaacgacagcgtttctcttttaacccgccgaagaagatggatcacgaagcggacgcgcaccggacggacttgatgactattactcgttttgtgctgaacgagcagtcgaagcacccggagtcccgcggcgacttcagcatcttgcttagtcacattgttctcggctgcaagttcgtttgttctgctgttaacaaggcgggtcttgccaagctaattggacttgctggagaaaccaatgttcagggtgaagagcaaaagaaattagatgtcctctctaatgatgtctttgtcaaagctttgatcagcagtggccgaacatgcatccttgtctccgaagaagatgaagaggcaatatttgtggagccctctaagcgtggaaggtactgtgttgtttttgatccgttggatgggtcttctaacattgattgtggtgtttccattggaacgatatttgggatttatatgatgaaagatagccatgaaccgactctagatgatgtgttgcaacctggcaacaatatgttggctgctggctattgcatgtatggaagctcttgcacgcttgtattgagcactgggagtggtgtcaatgggtttacgcttgatccgtctcttggggagttcatactaactcacccagatattaagattccaaagaaaggaaagatttactcggtaaatgaaggaaatgctaagaactgggatggtccaacagccaagtatgtggaaaaatgcaagttccctaaagatggttcatcaccaaagtccttaagatacattggaagcatggtagctgatgtccaccgcacattactttatggaggtatctttatgtatcctcgtgataagaagagccccaatggcaaattgcgtgtgctctatgaagtcttcccaatgtcattcttgatggaacaagccggtggtcaatctttcactggcaagcaacgggcacttgacttggttccaaagaagattcatgaacgttctcccatatttttgggcagctatgatgatgtcgaagaaatcaaagcactctatgctgcagaagagaagaaagaatgagcttgtcaattctatctttcatgatgcttacatatctctatcagatcccatttctgatcaactttccataacatgttacaaaactttcattaaggttcctttatgtattggaaatgatacagttccagtccaagctatgtattttgaataaaatgaaggtgaatgtttcagtttttgtattatt

SEQ ID NO: 2843 - DNA, 1303 bp, Platanus occidentalis
ttgattccttttgctttcaacaatccaaaccctagccctatcttctcctcatattcctcctcatccatttctctatttaattctctctgaatctctgttattgatttcttggaaggtttgagtgattgattaatcgccatggatcacgcggcggaagcttaccgaacggatttgatgaccatcactcgctatgttctcaacgagcaatccaagtacccggaatcgcgtggagatttcactatcttgctcagtcacattgttctcggttgcaagttcgtctgtactgctgttaacaaggctggccttgcaaaacttattggacttgctggagagactaatgttcagggtgaagagcaaaagaaactggatgtgctttcaaatgaagtttttgtcaaggctttgataagcagtggccgaacatgtattcttgtttctgaagaggatgaagaggcaacgtttgtggagccattgctgcgtggaagatattgcgttgtttttgatccattggatgggtcctctaacattgactgtggtgtttccattggaactatctttggaatttatatgatgaaagataaaggtgaaccaactctaggtgatgtgttgcaacctgggaagaatatgttagcggctggctactgcatgtatggaagctcttgcacgtttgtgttgagcactgggaatggcgtcaacgggttcactcttgatccatctcttggagaattcatactaacccatccagatatcaagattcccaaaaaaggaaagatatactctgtaaatgagggaaatgccaagaactgggatgagccaacgtcaaagtacgtggagaaatgcaagttccctaaagatggttcatcaccaaagtcccttagatacattggaagcatggtagctgatgtccaccgcacattgctttatgggggtatctttttgtaccctgctgataagaagagtccaaatggaaaactacgtgttctctatgaagtctttccaatgtcattcttgatggaacaagcaggtggtcaagcttttactggcaagcaacaggcacttgacttgatcccaaagaagatccatgagaggtctcccatattccttggtagctatgatgatgttgaggagatcaaagcactctacgctgttgaagaaaagatagcataaatctgtgaatcccaaacccctcatactattgaaacattttgtcactgattatgccggtataaaatccattccctggtcatattttcataatttctctttgtaattaaagaatagaacttattaaagaaaaccagggttt

SEQ ID NO: 2844 - DNA, 1190 bp, Triphysaria pusilla
ctgaacaggacaagcaggttttgggcaatggatcacgaggcggatgcttaccggaccgatttgatgacgataacacgtcatgtgttgaccgagcagtcaaagcacccggagtcgcgtggggatttcacgattatgctcagtcatattgttcttggctgcaaattcgtttgctctgctgttagcaaggccggtttggctaaacttattggactagccggagagaccaatgtgcagggtgaagaacaaaagaaattagacgtgctttcgaacgaagttttcatcaaggcgttagttagtagtggacgaacttgtatccttgtatctgaagaagatgaagaggctacatttgtggagccctctcaccgtggaaagtattgtgttgtgtttgacccgttggatggatcttccaacattgactgtggtgtttcaattggaactatatttggtatttatgcaatttacgatgggcatgatccgaaactggaagacgtgttgcagcctgggaagaacatgttagccgcaggctattgcatgtatggaagctcatgcacgttcgtgttgagtactggatcgggagttcatgggttcacgctcgatccatctcttggtgaattcattttgactcatcccgatattaagattccgaaaaagggaaagatttattctgttaatgaaggaaatgccaagaactgggatggccctactgcaaagtatgtggagaaatgcaagtaccccacagacgggtcaccggcaaaatccctaagatacatcggaagtatggtagccgatgttcatcgcactttgctctacggaggcgtatttttgtacccagctgataagaaaagcccaaatggaaaactgagggtcctatacgaagtttttccgatgtcgtttttgatggaacaagcaggaggacaagcatttacagggaaggagcgggcactcgatttgcttcctcagaagatacacgaccgctcaccgatattccttggtagctatgacgatatcgaggatatcaaagcattatatgctgctgaggagcaaaaataatggacttgtaaatttctgagtttcgattttttactcattgttaattactcttctatgtaataaaaacacaattattcttttcgaatatatagtttcggttctgatgaaaggccgatgttatgtgaccttaaaaaaaaaaa

SEQ ID NO: 2845 - DNA, 1546 bp, Prunus persica
cagagctccctgccccatcccaggccctccacgtgtcctccgaaacttctgttagtaccagattagccccttcccttcccaatccattaacacctcgaatcgagtaccaccaccaccatctaatccaaatctaaacgactattttgactcaaaaaaagaaaaaaagaaaaaaaaggactgtttatttatttttctgtaaatgttttttaggggataaatatatatatatatatatttatttggccattggtgggttttgtgtttttggtttctgaagtttttagtgacagtggtggtggtggtggattgtggagagagagagagagagagaaataggcgaaaatggatcacgcggccgatgctcaccgtacggatttgatgaccataacgaggttcgtgctgaatgagcagtccaagcaccctgagtctcgcggagacttcaccatcttgctcaatcatattgttcttggctgcaagtttgtctgctctgctgtcaacaaggcgggtctggccaaacttattgggcttgctggagagaccaacgttcaggcaagtggtgaagagcaaaagaaactggatgtgctttcaaatgaagtttttgttaaggccctggttagcagtggcagaacttctatccttgtttcggaggaagatgaagaggccatatttgtggagccatccaagcgtggaaagtactgtgttgtatttgatccactggatggttcgtctaacattgattgtggtgtttccattggaacgatttttgggatttatgtggtaaaagatggcattgaacctactctgcacgatgtcttgcaacctggaaagaatatggttgcagcaggctactgcatgtatggaagctcttgcacgtttgtattgagcactggaacaggggttcatgggttcactctggatccatctcttggggagttcatactaactcacccagacatccagattccaaagaaaggaaaaatctattcagtgaatgaagggaatgccaaaaattgggatggtccgacggccaagtatgtggaaaagtgcaaatacccgaaagatggttcatcaccaaagtctctaagatacattggaagcatggttgctgatgttcatcggacactgctttatggaggtatctttttgtatcctgctgacaagaagagcccaaatgggaaactgcgtgttctctacgaagtcttccccatgtctttcttgatggaacaagcaggcggtcagtcattcactggcaaggaacgggcccttgacctagttccaaacaagatccacgagcgctctccaatcttccttggcagctatgatgatgttgaggaaatcaagacgctctacgccgcagaagggaagaagtaatgaacttataattctgtttctgttacagtaattacataaatgttcagctatctgaacttccatctattaaatcaagctgtaaagagagcgtacaataatttcttgacgtgtacaactctaacaaggttatattcttatgttttgaattatagcctcacaacgttttttggctcaa

SEQ ID NO: 2846 - DNA, 1535 bp, Cirsium arvense
ccggtacgtgacggcctctagcgtcaccgtcacgccgtactccgccacgtgtcatctaaacttccactgccctcagataacctcatctcccctgattctccttaaatatatataatataaatacgctattatttccctcctcgaattgcgtgattttgtcaaccgatgaaattcaatcttgtttgatttcatttccacccaattacaaaacccttgtagcgccattagagatcaccggagaaccaaccatggatcatgctgccgatgctttccgtacggatttgatgaccataactcggtttgtgctgaatgagcagtcgaaacatccggaatcacgtggtgatttcagcatcttgctcagtcacattgttcttggttgcaagttcgtttgcgctgctgttaataaggcaggtttggcaaaactcattggacttgctggggagaccaatgtgcagggagaagaacagaagaaattggatgttctttcaaatgaagtttttgttaaggctttggtcagcagtggaagaacatgcatacttgtttctgaagaggatgaagatgccataattgtggaaccatcaaagcgtggaaagtattgtgttgtttttgatcctctggatggatcttccaacattgactgcggtgtatccattggaactatctttgggatttacatgataaaagatgggggcgagccatctttagaagatgtactgcagcctggaaagaatatgctggcagctggatactgcatgtatggtagttcttgcacgcttgtgttgagcactggttctggtgtgaatggattcactcttgatccatctttaggtgagtttatactcacccatccgaatatcaagatcccaaagaaaggaaagatttattcagttaatgaaggaaatgctaagaactgggatggtcccactgcaaagtatgtggaaaaatgcaagtttccaactgatggttcatctgcaaaatctctaagatatattggaagtatggttgctgatgttcatcgtaccttactttatgggggcatctttttgtaccctgctgataagaagagcccggatgggaaactgagggttctctatgaagtcttccctatgtcgttcttaatggaacaagctggaggtcagtcgtttactggaaaggaacggtcacttgatttggttccaaagaagatacatgaacgatctccgatcttccttggaagctacgatgatgtggacgaaatcaaggcattgtatgcagctgaagaaaaggtataaaaagagagtaaaagcaatggaaattaacctcaactccatcatgttgtgcagttgctacttttgatgccatgctactttcttacatattttgttataaaaaagctacattttgtgaagtattattactattaaatgttacgtaacatgtcgtgggttatttaggataattgaaaaccttttaatagattttttaaacgtacgatcttctcacatatttaagaatgtatgtgcttaaacaaaaaaagaaaaaagtaaccgactgcg

SEQ ID NO: 2847 - DNA, 1289 bp, Distylium racemosum
ggccagatacatcagattctgctgcagctttgcttgatagtgggacacaattttggtgggaggaattataataaaaatggaccacgcagctgatgcctttcgcacagacttgatgacaataacaagatttgtgctgaatgaacagtcgaaacatcccgagtccagaggggacttcaccattttgctcaaccacattgttctcggctgcaaatttgtgtgctctgctgtcaacaaggccggtctggctaaacttattggccttgcaggagagaccaacgtgcagggtgaagagcaaaagaaattagacgtactctctaatgaagtgtttgttaaggctcttgtaagcagtggccgtacgtgtattcttgtttcagaggaggatgaagaggccacttttgtggagcattcattgaggggaaagtactgtgtagtttttgatccacttgacggctcttccaatattgattgtggagtctcaattggaacaatctttggaatatacttgattaaggatggaggtgaacccacattggcagatgttctgcaaccaggcaaaaacatggttgctgcaggctactgcatgtatggaagctcttgcacgcttgtcctgagcactggcagtggggttaatggttttacacttgacccctcccttggagaattcatcttaactcatccaaacataaagatcccaaagaaaggaaaaatatattcagtgaatgaaggcaatgcaaagaactgggatgagcctaccaagaagtatgttgagagatgcaaatttccaaaggatgggtcatcccccaagtctctcagatacattggaagcatggtagctgatgttcacagaacccttctatatggaggtattttcatgtaccctgcagataagaagagtcccaatggaaaactgcgtgtactgtatgaagtatttccaatgtctttcttaatggagcaagcaggaggtcaagccttcacaggaaagaaaagagcactagaccttgtcccatccaagattcatgagcgttcctcagtcttccttgggagttatgatgatatagaggatgttaaggccttgtatgctgaacaggataaaaaagcctgacataagttggttgcttgtctagcagatatattgtatttgtagcctgtttatttgtagccaggtttatatgatcaatgtcagactaatattgtatttgtagcctgtttatttgtagccaggtttatatgatcaatgtcagacttaattttaatttacataattctttcctcaaccttgtaaagaaaac

SEQ ID NO: 2848 - DNA, 1375 bp, Solanum melongena
agaatctattactctttaattttggaatattgaattgatttagttaatttatgtacatggtagcttcctcaatctattttcagcaagctaagcattgaatagcgtgccacccaaattgtatattagaagagtgtttttgttagtggagatttttgaggggaggaagggcgatggatcacgcagcggatgctcatcggactgatttgatgaccatcactaggttcgtgttgaatgaacagagtaaataccccgaatctcgtggagatttcactattttgcttaatcatattgttctcggctgcaaatttgtttgttctgctgttaacaaggcaggtttggccaaactccttgggcttgctggtgagactaatgtgcagggcgaagaccaaaagaaactggatgtactctcaaatgaagttttcatcaaggctctggtcagcagtggccgaacatgcattctcgtgtctgaagaagacgaagaagctactttcgtagagccagctaagcgtggaaagtactgtgtagtttttgatcctctggatggatcttccaacattgattgtggtgtttctatcggaacgatctttgggatttacatgatgaaagatgctcatgaaccaacacttgatgacgtcttgcaacctggaaagaatatggtagctgctggatattgcatgtatggaagttcttgtacgcttgtcttgagcactggaagaggtgttaatggttttacacttgacccctctttaggcgagttcatcttaactcatccagatattaagattccaaagaaagggaagatttattcagtgaatgaaggaaatgccaagaactgggatggtccaacgtccaaatacgtggagagctgcaagttccccaaggatggttcttcacccaaatctctaagatatattggaagcatggtagctgatgttcatcgtacattactctacggaggtatctttttgtacccagctgataagaaaagtcccaatgggaagctgcgggttctctatgaagtatttcccatgtcatttctgatggaacaagctggaggccaagcatttaccggaaaggagcgggcattggacttagttccaacgaagatacatgaaagggcgccagtattccttggtagttatgatgatgtagaggagatcaaaaggctttatgctgctgaagagaagaactaatggatgtacatttacattcattatctctctctacaattcttactcatgctaatttgttgaaatagactaaattggtggttcttgtaaggcacaaaatcatcaattttatgactacagatgtatgttgctagtagcttgttagctactgtgataataatacctgcttataaatgaacaatttt

SEQ ID NO: 2849 - DNA, 1461 bp, Nicotiana benthamiana
ctaaccaaaggtaccatttctctctctacgtgtcatccgaagcttccattgacatcagataggcccaatccccttcattttcccagattacccttttttatctattgtattatatagtagtagtatttctcgtgtcagcatcgaattgcgtgccaccccattgacatactagttgcatatagtaaaaattactctattgctgtgttgttgaaagttgacgaagagaaaggaagagttagctagccatggatcacgcagcggatgctcataggactgatttgatgaccataacaaggttcgtgttgaatgagcagagcaaataccctgaatcacgtggtgacttcactatcttgctcagtcacattgttcttggctgcaaattcgtctgtactgctgttaataaggcaggtttggccaaactcttggggcttgctggtgagactaatgtgcagggtgaagaccaaaaaaaactggacgtactctcaaatgaagttttcatcaaggctcttgtcagcagtggccgaacatgcgttcttgtgtctgaagaagatgaagaagctacttttgtggagccagctaagcgtggaaagtactgtgtagtttttgatcctctggatggatcttccaacattgattgtggtgtttcaatcggaacgatttttgggatttacatgatgaaagatgctcatgaaccaacactagatgatgtcttgcaacctggaaagaatatgttagctgctggatactgcatgtatggaagttcttgtacgcttgtcttgagcactggaaaaggtgttaatggttttacacttgacccctctcttggcgaattcatcttaactcatccagatatcaagattcctaagaaagggaagatttattcagcgaatgaaggaaatgccaagaactgggatggtccaacatccaaatatgtggagaactgcaagttccccaaggatggttcttcacccaaatctttaagatatattggaagcatggtagctgatgttcatcgaacattactctatggtggaatctttttgtacccagctgataagaaaagccccaacgggaagctgcgggttctttatgaagtatttcccatgtcatttctgatggaacaagcaggaggccaagcatttacaggaaagcagcgggcacttgacttagttcctaagaaaatacatgaaagggcgccaatattccttggtagttatgatgatgtggaggagatcaaaaggctttatgctgctgaagagaaaaactaatgggtgcacatttaccttttctcacttcacaactcttgctgttgctgattactaatttgtcaatgtagagcaaattgctcatcatagttcaaacttcaaaatcatcaaggatgattacagttctatgttccacaatagagtataagctactctactaataatacgtgcatataaatgagcttgtgcaagctgc

SEQ ID NO: 2850 - DNA, 1575 bp, Sequoia sempervirens
ggtttgtggaggttttgctgctccgttgaactatgcagattactgtgtcattatcacagataatggatttgatgcattatttgcagctaatcgtattactgcttctatcagggaaaaagctcgtacacatccactccgattagcaggtttggttggaaatcgtacatctaaaagagatcttattaataaatatgtagaagcctgtccaatgcccgtaatagaagtgttacctcttattgaagatattcgagtttcgagagtcaaggggaaaaccttatttgaaatggttggatccgaaccatcccttaactatgtatgtgaatattatttagacatagcggatcaaatattgtcccaaccagaaggtattgtgccaaaggagattccagatcgggaattattcagtttactctctgacctttatctcaatcctattgatgaggggaaagcaaagaaagaaagatggatcacgctgcagatgcctatcgcacagatttgatgactatcactcgcttcgttctgaacgagcagtctcggtaccccgagtcgcgaggggatttcaccattcttctcagtcacattgtccttggctgcaaattcgtgtgctcagctgttaacaaggctggtctggctaaacttattggccttgcaggagagaccaacgtgcaaggtgaggagcaaaagaaactggatgtgctctccaatgaagtctttgtcaaggctcttgtaagcagtgggcgtacgtgcattcttgtctcggaggaagatgaagaagccacttttgtggagcctgcattgcggggaaagtactgtgtagtttttgacccacttgatggctcttcgaacattgactgtggagtctccattggaacgatctttggaatatactcgataaaggctggagaggaacctaaattggaagatgttttgcaaccaggcaaacatatggttgcagcaggctattgtatgtatggaagctcttgcacgcttgtccttagcactggtagtggggtaaatggttttacacttgatccctcccttggagaattcattttgactcatccagacataaaggtcccaaagaaaggaaaaatatattcggtcaacgaaggcaatgcgaagaactgggatgagcctacaaagaagtatgttgagagatgtaagtttccaaaggatggatcgtccccgaagtctctgagatacattggaagcatggtagctgatgtccacagaaccctgctttatggaggcattttcatgtaccctgcagacaagaagagtcccaatggaaaattgcgtgtactgtatgaagtgttcccgatgtctttcttaatggagcaggcaggggggcaatccttcacaggaaagaaacaggcactagaaattgttccaacaaagattcatgagcgttcctcagtcttccttgggagttatgatgacgtagaagagattaaggctttatatgctcaagaggaagtaaaagcctgaagttagctggctgcactgcctatctgggaattgtatttgtagccctgtttatggatttgtatcaatgataataactaaagtaaattt

SEQ ID NO: 2851 - DNA, 1079 bp, Chrysanthemum coronarium
aggacggatttaatgacgataacgagatttgttctgaatgaacagtcgaagcatccggaatcacgtggtgattttagtatcttgcttagtcacattgttcttggttgcaagtttgtttgtgctgctgttaacaaggcgggtttggctaaactcattggacttgctggagagaccaatgtgcagggagaagagcagaagaaactggatgttctctcaaatcaagttttcgtgaaagctttggtcagcagtggcagaacatgcatacttgtttcagaagaggatgaagaggcaataattgtggaaccgtctaagcgtggaaagtattgtgttgtgttcgatccgctggatggatcctccaacattgactgtggtgtttccattggaactatctttgggatctacatgataaaagacggtgacgatccatctctagaagatgtactccagccaggaaagaatatgctggctgctggatactgcatgtatggtagctcttgcacgtttgttttgagcactggatctggtgtgaatggttttactcttgatccatctctaggagagtttatactcacccacccggacatcaagatcccgaagaaaggaaagatctattcagtcaatgaaggaaatgctaagaactgggacggtccaactgcaaagtttgtggaaaaatgcaagtaccccacggatggttcatctgccaaatctttaagatatattggaagtatggttgctgatgttcatcgcacactactttacggcggtgtgtttttgtaccctgctgataagaagagcccaaccgggaaactaagggttctgtatgaagtgttcccgatgtcgttcttgatggaacaagctggaggacagtcctttactggaaaggaacgggcacttgacctggttccaaagaagattcacgagcgatcccccatcttccttggaagctatgacgacgtggaagaaatcaaagcgttgtatgcggctgaagagaaggcatagagagaaagagagttaagggtaattgatctcgtctccgtgttcttgtgcagtttctattcgccatttctttgtttataaaa

SEQ ID NO: 2852 - DNA, 1441 bp, Glycine max
aactaagtacgaaaatcgttatccgccgcaacagccactaagatgttctttgagtcttggcacgccacgtgtcagaactgccaacagatagccccatctctttctccttctccctaaacctcgaactcagcacccccatccactggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgtttgttccgctgtcagcaaggctggtcttgctaaacttattggactcgctggagaaaccaatgttcagggtgaagaacagaagaaactggatgttctttccaatgaggttttcatcaaggctctcataagcagtggccgaacatgcatcttggtttctgaagaagatgaagaagcgataattgtggagccttctaagcgcggaaagtactgtgtttgctttgacccattggatggctcgtccaacattgattgtggggtttccattggcacaattttcggggtttatgcgttgaaagatgtccatgaaccaaccatagaagatgtcctgcttcctgggaagaacatggtggcagctggttactgtatgtatggaagctcttgcacgcttgtgttaagcactggagcaggtgttaatggtttcacccttgacccatctcttggtgagttcatcctaactcaccctaacattaagatcccaaagaaaggtaaaatttattcagtgaatgaaggaaatgccaaaaactgggatcgtcctactgctacttacgttgaaaaatgcaagtttcctgaagatggttcatcaccaaagtctctaagatatattggaagcatggtagctgatgttcatcgtacgttgctttatggaggcatctttttgtaccctgctgacaaaaaaagtccaaatggaaaacttcgtgtcctgtatgaagtcttcccaatgtcattcttgatggaacaggcaggaggacagtctttcacgggcaaggaacgggcacttgatttagttccaacgaagttgcacgagcgatctcccatattccttggtagctatgatgatgttgaggaaatcaaagctctttatgctgctgctgagggtgaacaagaatgaaattggaaaggtttcttgtatctttcgctacttacaagcgcttgttttctaattgttactagcaggtgcttataagaaaactagttatctggtcatgtatatgttaataaaattggttgatgtgcctgtcagggctatagaatttatttagataaaatacttagattaaagtatcattttgttgctgaagaagtataactgcttactttccctcaagatgcatttcaaagttaaatccgc

SEQ ID NO: 2853 - DNA, 1232 bp, Conyza canadensis
ccattacggccggatttaatgacaataacgcggtttgtgttgaacgaacaatccaagcacccggaatcacggggtgattttagtattttgcttagtcacattgttcttggttgcaaattcgtttgtgctgctgttaataaggcaggtttggcaaaactcattggacttgctggggagaccaatgttcagggagaagagcagaagaaattggatgttctgtcgaatgaagtctttgtgaaggctttggtcagcagtggcagaacgtgcatacttgtatctgaagaggatgaagatgcaatcattgtggaaccgtccaagcgtggaaaatattgtgtagtttttgatccactggacgggtcctcgaacattgactgtggtgtttccattggaacaatttttggaatttacatgataaaagatggcgatgaggcacgcttagaagatgtgttgcagcctggaaagaatatgctagccgctggatattgcatgtatggtagctcttgcacgtttgtgttaagtactggatctggtgtcaatggatttactcttgatccatctctaggagagtttatactcacccacccggacatcaagatcccaaagaaaggaaagatctattcagttaatgaaggaaatgctaagaactgggatggtcccaccgcaaagtttgtggaaaaatgcaagttcccaactgatggttcatcggcaaagtctctaagatacattggcagtatggttgctgatgttcatcgcaccttactgtatggaggtgtgtttttgtaccctgctgataagaagagtcccaatgggaaactaagggttctctatgaggtcttccccatgtcgttcttgatggaacaagctggaggacagtcatttaccggaaaggaacgggcacttgacttggttccgaagaagattcacgatagatctccaatattccttggaagctatgatgatgttgaagaaatcaaggcactgtatgcagctgaagagaaggcataaagagagtcaagtaaggcaacatttacccatctccttgttgtccttgtgcggttgttactttgtcaatttctgtccataaaaccatgttactttccttcatattatttgtaataaaagctaccttatatgcagtagtcctgaattgtaggtaattatatcatctatggtggcgagtttcaaaaatttcaggggttaagatatattgtgtatatgattttgtaccggta

SEQ ID NO: 2854 - DNA, 1158 bp, Nicotiana benthamiana
aaaatcaagaaaaggtagcgatggatcactcggcggatgcacataggactgatttgatgaccataacaaggtttgtgttgaatgaacagagtaagcatcctgaatcccgtggtgacttctctatcttgctcagtcacattgttcttggctgcaagttcgtctgcactgctgttaacaaggcaggtctggcaaaactcctagggcttgctggtgaaactaatgtgcaggcaaaagatcaaaagaaactggatgtactctcaaatgaagtatttatcaaggctctggttagcagtggccgaacatgcgttcttgtatctgaagaagacgaagaggctacatttgtggagccagctaagcgtggaaaatactgtgtagtctttgatcctcttgatggatcctcgaacattgattgtggtgtttctattggaacgatcttcgggatttacatgatcaaagacggtcatcaaccaacactagatgatgtcttacaacctggaaagaacatgttagctgctggatactgcatgtatggaagttcttgtacgctagttttgagcactggatctggagttaatggttttacccttgatccctctcttggcgagttcattctaactcatcctgacatcaagattcctaagaaagggaagatctattcagtaaacgaagggaatgccaagaactgggatggtccaacatccaaatatgtgcagaattgcaagtaccccactgatggttcttcgccaaaatctttgagatatattggaagcatggttgctgatgttcatcgtacattactctatggtggtatcttcttgtacccagcagataagaagagccccaacgggaagctgagggttctctacgaagtatttcccatgtcatttctgatggaacaagcaggaggccaatcatttaccgggaagcagcgggcacttgacctagttccaaagaagatacacgaacgcgctcctatattccttggtagttatgatgacgttgaggagatcaaaaagctttacgctgctgaagagcagaactgatggatgtacataccctctgatcatcacttcagtgctctggccggtgcagataactgactgatttctcaaatcagagcaagttgctggttgttatagttagagaattgcggataat

SEQ ID NO: 2855 - DNA, 1513 bp, Gossypium raimondii
aaaaataataataaaaagatctgaccttgattcttgatgactcacagccaagtgatcaaagggtaccccaaacgtgtcatcccaatcctccattgactcgacctggttctgttcattttggttatattctttggtatcatcatcccacattcccaacttgttatccctaattcgtggaatattatatattcctctacttcaccttcatacgcaacaataacagaagcaaaaaagaaaagggttctttgctcactaagttttattcttttatcatttcatttgatcgccaaaaaaagaaaagcttaatccaaattgaagaggaaaaaaaaaaagggtgcaccatggatcatgcagctgatgctcatagaactgatttgatgaccatcactcgccatgtccttaatgaacaaaccaagtaccctgaatctcgtggtgatttcaccatcttgctcaatcatattgttcttggctgtaaattcgtttgctcttctgttagcaaggcgggtcttgccaaactatttggacttgctggagaaaccaatatccagggtgaagaacaaaagaaattggatgtgctttctaatgaagtttttgttaaggctttgattagcagtggaagaacatgcctcctggtttctgaggaagatgaagaagctatatttgtggatcaatcaaagcgtggaaaatacattgttgtttttgatccattggatggatcctcaaacattgattgtggtgtttccataggaactatatttgggatttatatggtgaaacataaagacaatcccaccattgatgatgtattacaacccggaaataatctcgtagcagccggttattgtatgtacggaagctcctgcacgttagtgctaagtactgggagcggcgttaacggtttcactctcgatccatctctaggggagttcatattaactcatcccgatatcaagatacctaagaaaggaaagatttattcagtaaatgaaggaaatgccaaaaattgggatgaaccaactcgaaagtttgttgaaaaatgcaagttccctacagatggttcacccccaaagtcccttagatacattggaagcatggttgcagatgttcaccgaacattgctttatggtggtatctttttataccctgcagataagaaaagtcctaatgggaagctacgtgttctttacgaagttttccctatgtcattcctaatggaacaagctggaggtcaagcttttactggaaagcaaagggccctcgatttagttccggggaagatacatgaacgatctccggttttccttggtagctatgatgacgttgaagaaattaaagcactctatgctgctgctgatgctgcaaaataggaagaagaaaatgctgcataaacttgtagactttatatcagtctttttaagctttttaacatgtggttccttaagagtactaataatttaattgaagaatcaaataagactaaattgatataaaattaatatttattatttaaaaa

SEQ ID NO: 2856 - DNA, 1202 bp, Allium cepa
tacggcctagttacgggggaatccgaattgagttcatttgcagccatggatcatgcagcagacgcgtaccgtacagacctcatgaccattactaggttcgtgctaaatgagcagtcgaagcgtcctgaatcaagaggcgatttcactattttacttagtcacattgttcttggttgcaagttcgtttgctctgctgttaacaaggctggtcttgccaagctcatagggcttgcaggggaaacaaatgtccaaggtgaagaacaaaagaaattagatgtgctttcaaatgaagtctttgtgaaagcattaacaagcagtggacgaacatctattcttgtttcagaagaagatgaagaagccacatttgtagaccctgcattgcgtggaaaatattgcgtagtcttcgacccactggatggttcctctaacattgattgtggagtttccattggaacaatttttggaatttacctgattaaagacaaggatcaagcaaagctagaagatgtgttgcaagcaggaagcaacatggtagcagctggatactgcatgtatgggagcttttgtgagcttgtgataagcactgggaatggagttaatggtttcacgcttgatccatctcttggggagttcattctaacacatccagatataaaggtaccaaagaaaggcaaaatatattccgtgaatgaaggaaatgccaaaaattgggatggaccaactgcaaaatatgttgaaaaatgcaagtaccctactgatgggtcatcaccaaaatctctgagatatgttgggagcatggttgcggatgttcacagaactatgctttacggaggcatctttttgtaccctgcagataagaaaagtcctgatggaaaattacgtgttctttatgaagtctttccaatgtcattcttgatggaacaagcaggaggtcaagctttcactggaaaggaacgcgccctagatttggtacctaaacagattcatgaaaggtctccgatatttctgggaagttatgatgatgtagaagaaatcaaggcactctacgctgctgaaaagattgaaggttgattggataaatataaaagcgttcttaatctcttattggaaatttatgtgctccatgtatagacactaatcagtctttcggaaatgtgaatgacgatacatattgttcttttaattaattttctatttactcc

SEQ ID NO: 2857 - DNA, 1290 bp, Lotus japonicus
gaaactaagaatcatggatcacagtgaggaagctcatcgcactgatctcatgaccattacccggtttgtattgaacgagcaatccaagcaccctgagtctcgcggtgatttctccatcttgctcagtcacattgttcttggttgcaaatttgtttgctctgctgttagcaaggctggtcttgctaagcttattggacttgctggagagacaaatgttcagggtgaagagcaaaagaaactggatgtcctttccaatgaggtctttatcaaggctttagtaagcagtgggagaacaagcatcttggtgtctgaagaagatgaggaggcaacatttgtggaggcttctaagcgtggaaagtactgtgttgtttttgacccactggatggttcctctaacattgattgtggggtttccattggcactatttttgggatttatatggtgaaagaccaggaaccaaccattggagatgtgttgcaacctgggaagaacatgttggcagctggttattgtatgtatggaagctcatgcacgcttgtgataagtacaggaagtggtgttaatggtttcacccttgatccttcccttggagagttcatcctaactcacccaggcatcaagatcccaaagaaaggcaagatctattcagtgaatgaaggaaatgctaaaaactgggatggtcctactgccaagtatgtggagaaatgcaagtatccaacagatggttcatcaccaaagtcgctaagatatattggaagcatggttgctgatgttcgccgcacattgctttatggaggtgtctttctgtacccggctgataaaaagagtccaaatgggaaacttcgtgtactctatgaagtcttccccatgtcattcttgcttgaacaggcaggaggacaatctatcaccggcaagcaacgggcacttgatttagttccaacgaaattgcacgagcgatcccctatattccttggtagctatgatgatgtggaagaaatcaaagctctctatgctgcagaggaagaaaagaaatgaacctgaatagcattctgtctttcgcaacatgttgggctaagaaatggttttcagttgggaatttaaagaaccatggttctagtaaaagtaataagctattagcttctactaaaactatggttttgataaaggtatgcggtgcaaatctatacatactgttgttgttaatgttcctgccacatttgtataatttctggggccaaaacatacttcagattccgttaatatgatgctggcagcaaggttattgattt

SEQ ID NO: 2858 - DNA, 1950 bp, Arachis hypogaea
aatttccgtcacttgaattactgaaaactcaaaaaaacccaaccgcagcatcaaaatctgagtcactaagcttgaagagaatggaccacagcgcagatgcacaccgtacggacctgatgaccataacacgattcgtgcttaacgaacagtcaaagcaccctgaatcgcgcggtgacttcaccatcttactcagtcacattgttcttgcttgcaagttcgtctgctcttctgttaacaaggctggtctcgccaaactcattggacttgctggagagactaacgttcagggtgaagagcagaagaaactggatgtgctttccaatgaagtcttcatcaaggccttgattagcagtggccgaactagcatattggtttcggaagaagacgaggaagcaaccttcgtggagccttctttgcgtggaaagtactgcgtcgtttttgatcctttggatggttcctctaacattgattgtggcgtttcaattggcaccatatttgggatttatatggtgaacgatgtgaatgaaccaacactagaagatgttttgcaacctggcaagaacatgttggctgctggttattgtatgtatggaagctcttgcacgtttgtgttaaccactggtagtggtgttaatggtttcacgcttgacccatcacttggtgagttcatactaactcaccctgacatcaagatcccaaagaaaggcaagatttattcagtgaatgaaggaaatgctaagaactgggatggtcctactgccttttatgtggagagatgcaagttccccaaagatggttcatcaccaaagtctctaagatatattggaagtatggtagctgatgttcatcgaacattgctatatggaggtatctttttgtaccctgctgataaaaagagtcctaatggaaaactacgtgtactatacgaggtatttccaatgtcatttttgatggaacaagcagggggacaagcattcactggcaaacaacgggcacttgatttgattcctaagaagttacatgagagatctcccatattccttggaagctacgatgatgttgaggaaatcaaagctctttatgctgctgaggccaagtaggaatcaccctaaagagtgtcctttcgccatgcactcaatccatgcatcttagaacaaattgtgaataaagaataaattgattgagataacatggatattaatgaaagaaggataactgcatccttttctttcaactggttgtaatagtttcaatcttatagcattataaggcatactagtttctctcataatggtatcaactctttcaagaaatgagacttatcaagaatcatatctatagagcagcttagaagtaaagacaatgctgcactgccaccaagagtctagtcatgtacatgctgtgattctcatgctcaataaaactaaaatctgtctcaaacagaaatgaaccactagcaaacacggcaattaaggactaatctaatcataaccactatcttaacaagctaatacattttcagcaagattgataatcttcattaaaatgaatacaaagattccctccatgtcaattgtcatgcagtcctcagcggcggggaaaccagtattactccatctcccctaacaaacaagaaaggaacagtacgccttgtcgtcctcacaatttcttcgtatgtttcatcatcaatttcaacagtagtaacaatttcttcaacatcaccaaggatcatattaagatgctgatcgtaagcatgaagtttgccgcgaagttcacggtcggaacggagcttgacatagatgcgctcgtcgaggctcagccttatcagatccaaaggctccttcacagcgctttcttcttctgcagcagccattgctctctctctctctctctcttcgaagacagagagactcccacacacacccccccgtactctgcgttgataccact

SEQ ID NO: 2859 - DNA, 1624 bp, Populus trichocarpa
atcctcaaaacacgaacagaaccaaaacagaaacctcataaccgtccaatcagagataaacgacggaaggtgttatctgcagcgacggccacacacctcagtctctcactctcttgtctccacgtgtcctccgaaacttccgtttacaccagatagccccatcccctccctctcatcgctttcatatttatcttctcctctcgaactgaccaacacgcattctcgtcaataaaaaaaaatactcaaattatattacaaaccggattcgaacaagtttttgagagagagagagagatggatcacgcagcagatgctcacaggacggacctgatgaccataacgaggttcgtgttgaacgagcaatccaaatatcctgagtcgcgtggtgatttctctattctgctaaatcacattgttcttggctgcaagttcgtttgctctgtcgttaacaaggcgggtctagccaaaattattggacttgctggggagactaatgttcagggtgaagagcaaaagaaacttgatgtcctttcaaatgaagtgttcatcaaggctttagtaagcagtggccgaacatgcatccttgtctcagaagaagatgaagaagcaacatttgtggagccttccaggcgtggaaggtactgtgttgtgtttgatccattggatggatcctccaacattgattgtggtgtttctattggaacgatttttggaatttacatggtgaaagatgaccatgaaccaactctagatgatgtgttgcaacctgggaaaaatatgcttgcagctggctattgcatgtatggaagctcttgcacgtttgttttgagcactggaactggtgttaatggtttcaccctggatccatccctcggggagttcatactcacacaccctgacataaagattccaaagaaaggaaagatttattcagtgaatgaaggaaatgtgaggaactgggatggtccaacagccaagtatgttgaaaaatgcaagtttccccaggatggttcctcagcaaaatctctaagatatattggaagcatggtagctgatgtccatcgcacattactttatgggggtatatttttgtaccctgccgataaaaagagccccaatgggaaactgcgtgttctatatgaagtcttcccgatgtcctttttgatggaacaagcaggaggtcaggcttttactggcaagcaacgggcactggacctagttccgacgaagatacatgagcgctctcctatatttcttggaagctatgatgaggttgaggaaatcaaagcactctatgccgctgaagagaagaaagcataaacacctatgctgtggctctgtttggtatggcgctgcaccactctgtggtcaacggggctaccgtgtcaaaattagcgcaatgccgagcaggggttgttattaccactgtcttatagaactcgtaatacttctgtctgtgggcatctgacctacttctaatcatctatctattcattagataacgtgttttcatgattttcttctgatgtgttcattgatgggataaacaaaccatttggctgatattagaataatgagaaaggatgcaatacatgaccacgtgaatttttccatgctggaaaaa

SEQ ID NO: 2860 - DNA, 1488 bp, Solanum tuberosum
aaatcagttaacagaatgacgaattggatcacgctttatcttagtgccaaccactgatcccatgcatcactctgctctttccacgtggcatcctctgacgtcagatcagattcctcttctttcttttttttttctgtatatatatgagcattttagtagtactgcgtgcccaatctcttacataaaaatcgaagcacgatggatcacgcggcggatgcacaccggacggatttgatgacaataacaaggtttgtgttgaatgagcagacgaagcaccctgaatcccgtggagacttcagtattttgctcagtcacattgttcttggctgcaagttcgtatgcactgctgttaacaaggcaggtttagccaaacttctaggacttgctggtgagactaatgtgcagggagaagatcaaaagaaacttgatgtactctcaaatgaagtgtttatcaaggctttggttagcagtggccgaacatgcattcttgtctctgaagaagatgaagaagccacatttgtggagccagctaaccgtggaaaatactgtgtagtttttgatcctctggatggatcatcgaacatcgattgtggtgtttctattggaacgatctttggaatttacatgatcaaagacggtcatgaaccaacactagatgatgtcttacaacctgggatgaacatgttagctgctggttactgcatgtatggaagttcttgtacgctagttttgagcactggatctggagttaatggttttacccttgatccctctcttggcgagttcatcctaactcatcctgacatcaagattcctaagaaagggaagatttattcagtgaatgaaggaaatgccaagaactgggacggtccaacatccaaatatgtgcagagctgcaagtatcccgctgatggttcttcaccaaaatctttgagatatattggaagtatggttgctgatgttcatcgtacattactctatggaggcatcttcttgtaccccggagataagaaaagccccaacgggaaactgagggttctctatgaagtatttcccatgtcatttctgatggaacaagcaggaggccaagcatttactgggaagcaacgggcacttgacttagttccagagaagatacacgaacgctctcctatatttcttggtagttatgatgacgttgaggagatcaaaaagctctacgctgctgaagagcaaaactgatagatgtatctataccatgtaatcacttcactactcttgctggtgcagatatcaaatttctcaaattacagcaagttgttactgtttatgttgcacaatagctgctgtgacgcgataatacgttcacattactggcttgttctaactttttgtcttgaagtatctatttctcatcaacaataaaatgttgaatagagaagttctggcttattattgttatcaaagttcttttgtaatgtcatccatttagaatcaagctaatttttt

SEQ ID NO: 2861 - DNA, 1180 bp, Fagus grandifolia
atatatatacatatctgctttgacctcgaaccgagcaccaattgattccaatctcatctttcctaagaaagacagagaaaaatggatcacgcggcggaggcgcaccggacggacttgatgaccataacgcggtacgtgctgaacgagcaatcaaagcacccggagtcacgcggcgatttcaccatcttgctcagtcacattgttctcggttgcaagttcgtctgctctgctgtcagcaaggcgggtcttgcaaaactcattggacttgctggagagacgaatgttcagggtgaagagcaaaagaaactggatgtgctctcgaatgaagtatttatcaaggctctagtaagcagtggccgaacatgcatccttgtatcagaagaggatgaagtggcaacatttgtggagccatctaagcgtggaaggtatgctgttgtttttgacccgttggatggatcatccaacatcgattgcggggtttcaattggaactatctttgggatttatatggtgaaagatagtcaagaaccaactctagatgaggtgttgcaacctgggaagaatatgttggcagctggctattgcatgtatgggagctcttgcacgtttgtgttgagcactggaactggtgttaatggcttcacccttgatccatctcttggggagttcattctaactcatccagatatcaagattccaaagaaaggaaagatttattcagtaaacgaaggaaatgctaagaactgggatggtccaacagccaagtatgtggaaaagtgcaagtttccaaaagatggttcatcaccaaagtctctaagatacattggaagcatggtagctgatgtccatcgcacattactttatgggggtatctttttgtatccagctgacaagaagagcccaaatgggaaactgcgtgttctctatgaagtgtttccaatgtcattcttgatggaacaagcaggaggtcaggctttcaccggcaagcaacgggcacttgacttggttccaaccaacatacatgagcgatctccaatattcctcggcagctatgatgatgttgaggaagtcaaagctctttatgatgctgaagataaggaataaagtcattctcatttctgtagtactactcacatagccttagcaatttctgcagctactccaatttatttggggtctt

SEQ ID NO: 2862 - DNA, 2647 bp, Euphorbia peplus
acgaatattttgaaagagtatttacgcaccacacccaactttaagcatatgatataattgagtgagtggtcaccatgcatgcatgctctcacccattatatttatgctccctcccacttactctctatccaataaatgactacatctcctaatatttctacccattaaaaccctcaaatatatagatcacacttaattaattaattacaataccttagacattgaactttcttttcttatatttcccccttttacctcactttaatgacgacgcgtaagctttaaaagttttgagcaatgaacaattctaacggagagcaaaatcagtcatgtataaggccggctagactgttgtaatattatgtatgtggtagaattgaaatattagtaggaatggttaaagacattgaagatgtcttgggcatgtgataagatggtcattagtgaggccagcagcttgcatgaaggaataaataacagttggaccaacatttctaaaacctctcttgaccatgtctttgcttatgctttctgattttgatgtctttactggaatcttgttgctcctcttgtattcctttttcattgccttgtcattcacaaatccccacatgtacttctcaaatctcccatattctttcttcacctggagaattctgatagagttgtcaacaactcctcgaacttggcttatatcaattccatactcaccactaattgatattatcttcttttcacggaattgagcaacaacttcagcatcaaatcctgagaaggcctccctaaatgcaggtcttttcttcaggacagaggtccaatctgagcctacttgtgctcctgtcagtactagcaattcaaacaataccttgtcacagtggacaggaactccccattcttcatcatggtaagctacatatataggatctgaatttggagtgataaagctacatctttttccttccttaactatacttgtatcaagatcaggaacagccttattatagctattaatagagttgttaagcctcccatattgacaagttttcagtttcctttgttcttgcaaaatagaagcttgctctctcattgcagctgctatgctaccagctggagcttcaactctcatagaagaagatttgcttagaataatgttttgatcagcactagaattaatattccctgatgatctcttcaccggtaacggccttggagatttgatattgggagaagacaaagatgagttaaccatattcatattaataggtaaagagaaaggagtagggggtttgggttgttctttttaagtgaatttcttctttccaataaggttgggacttggttggttttgggttccaggacagccctgcccttaatagtattaccattttggtgcagcctagtttttgaagaacacattatttagcagaggaatgtggggaaaatggatcacgaagcagatgcataccgtacggatttaatgactataacaaggttcgttttgaatgaacaatcgcgacaccctgattctcgtggtgattttactattttgcttagtaatattgtccttggctgcaaatttgtttgcactgctgtcaacaaggcgggtcttgccaaacttattggactagctggggagactaatgttcagggtgaagagcaaaagaaactggatgtgctttcaaatgaagtctttgtcaaggctttagtaagcagcggtcgtacttgcatccttgtctcagaagaagacgaggagccaacttatgtggaggcttcaaagcgcggaaagtactgtgttgtttttgatccattggatggatcttccaatattgactgtggtgtctcaattggaactatctttgggatctacatggtgaaacatagcaatacccctacattagaagatgttttgcaacctgggagtaatatggtagcagctggctattgtatgtatggaagttcatgcacgcttgtgttgagcactgggagtggtgtcaatggtttcactcttgatccatcccttggggagttcatacttactcatcctgatgttaagattccaaagaaaggaaagatttattcagtaaacgaaggaaatgcgaagaattgggatggtccaacagccaagtatgtggaaaagtgcaagtatcctacggatgggtctcctgcaaagtctttgagatatatcggaagtatggttgcggatgttcaccgcacgttactttacgggggcatatttttgtaccctgcagataagaagagccccaatggaaaattgcgtgttttgtacgaagtgtttccaatgtcattcttgatggagcaagcgggtggacaagcttttaccggaaagatacgggcccttgatttggaaccggagaagatacacgaaaggtctccgatatttcttggaagctatgatgacgttgaggagatcaaagcattgtatgctgctgaagggcagagtgcataaagaatcatattattcattctcttttaattcctactttctgtattctgcctactttctaatcatctgtctctctttctcaaagttgctttaataagaattatatgattcttgctacattgttcatatatatctttcaatgatatcaatgatatatcatgccataagcaaggaatttttcgc

SEQ ID NO: 2863 - DNA, 1655 bp, Panax ginseng
cccccttacccctcgtgtgccttgtcctcccaccgactactagattgtagggtttacgttgtgccaaaactaaggcgactcgaattgggttccgaaaatttaaatttacgtattggtactgtttggtcgtttattcttctataattagggtcgtataatacaaagaaagaagaaggacgacgaagcagctttattcttccgtcgacgaccactggtggtcgaactatcaaaccctacaagcaactaggcgaccacgtgtcataccgtaacttacctattgtacatcaggatagcttactccaccgccacctcctcttctatattatatatatatatatatatatatatatatatatatgggtattatttctatcaattggaaagattatcctcctcgttttctgagggttcctcgaattgcgtgaaaaagcactggtactatctctgccggaaaaaggaaaggatggatcacgccgccgatgcttttcagaccgacttgatgaccataactcggttcgtgttgaatgagcagtctaagtatccagaatctcgtggtgatttttcaatcttgctcagtcacattgttctgggctgcaaattcgtctgctctgccgttaacaaggcgggtttagccaagcttattggacttgctggtgagaccaatgtgcagggtgaagaacaaaagaagctggatgtgctctccaatgaagttttcgtcaaggctctgatcagcagtggccgaacatgcatccttgtctccgaagaagatgaagaagcaacctttgtagagaaacctaagcgtggaaggtattgcgttgtttttgatccattggatggatcctcaaacattgactgtggtgtttcaattggaaccatctttgggatttatatgatgaaacatggagaagaacccactttagaaggtgtgctgcaacctgggaagaatatgttagccgctggctattgcatgtatggaagctcttgcacgtttgtgttaagcaccggaagtggcgtgaatggctttacccttgatccatctctgggagaattcatactcactcatccagacattaagattccaaagaaaggaaagatatattcagtgaatgaaggaaatgccaagaactgggatggtccaacagcaaagtacgtggaaaaatgcaagttccccaaagatggttcatcagcaaaatctctaagatacattggaagcatggtagccgacgttcatcgcacattactttatggtggcatctttttgtaccctgctgataagaaaagccctagtggcaaacttcgggttctgtatgaagtctttccgatgtctttcttgatggagcaagctggaggtcaggcatttacgggcaaggaacgggcacttgacttggttccgaagaagatacatgagaggtctccaatattccttggtagctacgatgatgtcgaggaaatcaaagcactctattctgctgacgagacaaaataagagcatgtaaagagaactttgtttctacattgcagttgtgcagctggtagttactgatttaaattcatttggcaaaacctgaatccttcatgaagatgtaatattaataaactctttactaatgaaaaaccaggtatgccgttcacacagctcttgcctgtggttgctg

SEQ ID NO: 2864 - DNA, 1233 bp, Allium cepa
ggggatccgaattgagttcatttgcagccatggatcatgcagcagacgcgtaccgtacagacctcatgaccattactaggttcgtgctaaatgagcagtcgaagcgtcctgaatcaagaggcgatttcactattttacttagtcacattgttcttggttgcaagttcgtttgctctgctgttaacaaggctggtcttgccaagctcatagggcttgcaggggaaacaaatgtccaaggtgaagaacaaaagaaattagatgtgctttcaaatgaagtctttgtgaaagcattaacaagcagtggacgaacatctattcttgtttcagaagaagatgaagaagccacatttgtagaccctgcattgcgtggaaaatattgcgtagtcttcgacccactggatggttcctctaacattgattgtggagtttccattggaacaatttttggaatttacctgattaaagacaaggatcaagcaaagctagaagatgtgttgcaagcaggaagcaacatggtagcagctggatactgcatgtatgggagcttttgtgagcttgtgataagcactgggaatggagttaatggtttcacgcttgatccatctcttggggagttcattctaacacatccagatataaaggtaccaaagaaaggcaaaatatattccgtgaatgaaggaaatgccaaaaattgggatggaccaactgcaaaatatgttgaaaaatgcaagtaccctactgatgggtcatcaccaaaatctctgagatatgttgggagcatggttgcggatgttcacagaactatgctttacggaggcatctttttgtaccctgcagataagaaaagtcctgatggaaaattacgtgttctttatgaagtctttccaatgtcattcttgatggaacaagcaggaggtcaagctttcactggaaaggaacgcgccctagatttggtacctaaacagattcatgaaaggtctccgatatttctgggaagttatgatgatgtagaagaaatcaaggcactctacgctgctgaaaagattgaaggttgattggataaatataaaagcgttcttaatctcttattggaaatttatgtgctccatgtatagacactaatcagtctttcggaaatgtgaatgacgatacatattgttcttttaattaattttctatttactccaatgtcttccaattttttatttcaaatctacaagagttctctgcatg

SEQ ID NO: 2865 - DNA, 1643 bp, Solanum phureja
gaaaaacaaatcagttaacagaatgacgaattggatcacgctttatcttagtgccaaccactgatcccatgcatcactctcctctttccacgtggcgtcctctgacgtcagatcagattcctcttttctttttttttctgtatatatgtgagcattttagtagtactgcgtgcccaatctcttccataaaaatcgaagcacgatggatcacgcggcggatgcacaccggacggatttgatgacaataacaaggtttgtgttgaatgagcagacgaagcaccctgaatcccgtggagacttcagtattttgctcagtcacattgttcttggctgcaagttcgtatgcactgctgttaacaaggcaggtttagccaaacttctaggacttgctggtgagactaatgtgcagggagaagatcaaaagaaacttgatgtactctcaaatgaagtgtttatcaaggctttggttagcagtggccgaacatgcattcttgtctctgaagaagatgaagaagccacatttgtggagccagctaaccgtggaaaatactgtgtagtttttgatcctctggatggatcatcgaacattgattgtggtgtttctattggaacgatctttggaatttacatgatcaaagacggccatgaaccaacactagatgatgtcttgcaacctgggatgaacatgttagctgctggttactgcatgtatggaagttcttgtacgctagttttgagcactggatctggagttaatggttttacccttgatccctcccttggcgagttcatcctaactcatcctgacatcaagattcctaagaaagggaagatttattcagtgaatgaaggaaatgccaagaactgggacggtccaacatccaaatatgtgcagagctgcaagtatcccgctgatggttcttcaccaaaatctttgagatatattggaagtatggttgctgatgttcatcgtacattactctatggaggcatcttcttgtaccccggagataagaaaagccccaacgggaaactgagggttctctatgaagtatttcccatgtcatttctgatggaacaagcaggaggccaagcatttactgggaagcaacgggcacttgacttagttccagagaagatacacgaacgctctcctatatttcttggtagttatgatgacgttgaggagatcaaaaagctctacgctgctgaagagcaaaactgatagatgtatctataccatgtaatcacttcactactcttgctggtgcagatatcaaatttctcaaattacagcaagttgttactgtttatgttgcacaatagctgctgtgacgcgataatacgttcacattactggcttgttctaactttttttcttgaagtatcaatttctcatcaacaataaaatgttgaatagagaagttctggcttattattgttcattttaaatcaaatttcttttgtaatgtcatccatttagaatcaagctaattttttatgctagatgatttctggttctcatagcattgttttctttcataagttgttgactaacaagtaacatctatttatgatatcactggcttacttcttgtgaacattcttgataatggaacggaaagattgccaatataattttt

SEQ ID NO: 2866 - DNA, 1094 bp, Taxus baccata
ttcgcagatgcgcagcgcacagacttgatgacaataactcggtatgttctgaacgagcagacgaggtatcccgagtcacgcggggacttcactattctcctcagtcacattgtcctcggctgcaaattcgtctgctctgctgttaataaggcgggtctggctaaactgataggccttgcaggagagaccaacgtgcagggtgaggagcaaaagaagttggatgtgctctctaatgaagtctttgtcaaggctcttgtaagcagcgggcgtacttgcattcttgtttcggaggaaaacgaagaggccacatttgtggatccttcattgcggggaaagtactgtgtagttttcgatccacttgatgggtcttccaacattgactgtggagtctcaattggaacgatctttggaatatactcgataaaggatggagatgaacccaaattggcagatgttctccaaccaggaaaacacatggttgcagcaggctactgtatgtatggaagctcatgcacgcttgtcctgagcactggcagtggggtaaatggttttacacttgacccttcccttggagaattcattttgactcatccagacataaaggtcccaaagaaaggacaaatatattcagtgaacgaaggcaatgcaaagaactgggatgagcccaccacgaagtacgttgagagatgtaaatttcccaaggatggatcatcccccaagtctctcagatacattggaagcatggtagctgatgttcacaggacactgctttatggaggcattttcatgtaccctgcagataagaagagtcccaatggaaaattgcgtgtattgtatgaagtgtttccaatgtctttcttaacggagcaagcaggggggcaatccttcactggaaagaaacgagcactagacattgtcccaaacaagattcatgagcgctctgcaatcttcctcgggagttatgatgacatagaggagattaaggctttatatgctcaagaggaagcaaaagcttgatgtctgttgactgctaggcttatctggcaattgtatttgtggccctatctatgaattattgtcaatgataatgacaa

SEQ ID NO: 2867 - DNA, 1514 bp, Amorphophallus konjac
aagagaggcgtggggagcacagcagcagctgcaggagctccgggccacgagccctagctcccggcggagccgccacgtgtctccgacgcttccattgccacgagatagccctatcgcttccacccggcctttgttcctctcgttgccctcatataaaccgcccggcgccgtcccggtcaccttccacccccctccccttcactgcacagagagacgccggcaggcagctgaccacctcgacctgcggcgccatggatcacgaggcggacgcgcaccggacggatctgatgacgctgacgaggcacgttctgaacgagcagtcgaagtatcccgaggccaagggcgactgcaccatcctgctcagccacatcgtgctgggttgcaagttcgtctgcgccgccgtcaacaaggctggccttgcgaaactcattggacttgctggagagaccaatgtccagggtgaggagcaaaagaaattagatgtgctttcaaatgaagtttttgtcaaggctttgataagtagtggaaggacttgtgttcttgtttccgaggaagatgaggaggcaacctttgtggatccatcattgcgtggaaggtattgtgttgtatttgatcctttggatggttcttccaacattgactgtggtgtttcaattggaacaatttttgggatttacatggtgaaagataaggataaggtgactatagaagatgtactgcaacctgggaaggatatggttgcagcaggttattgcatgtatgggagttcttgtatgcttgtgttgagcactggaaatggtgtcaatggatttacacttgatccatctcttggggagttcatactgacacatccgggtataaagatcccaaagaaaggaaacatatactcagtgaatgaagggaatgccaaaaactgggatgggccaacggctaagtatgtagaaagatgcaagttccctgaggatggttcatctccaaagtcacttagatatgttggaagcatggttgctgatgttcatcgaactctgctttatgggggtatctttttgtaccctgcagataagaagagcccagatggaaaactacgtgtcctctatgaagtctttcctatgtcattcttgatggagaaagcaggaggtcaagctttcaccggcaagcaacgggcactcgatctggttccaacaacgattcaccaaagatcacccatatttattggtagctatgatgatgtcgaggatataaaagcactctatgcttctggggagacaaaagcgtagaccaggtgtccaccatgaagggcgtgctggattgtacaatcttgtttctcttattcatcactacaatatgttctctcagaaaaaagggggaaattcataagcctttctgccgaacttcggtaccgttcataatgtattgaaaacagttaattgtatagatccaatttatctgcatgtcattctatgtcatagcttcatacattgttaattttgatgttactctagattgccaattac

SEQ ID NO: 2868 - DNA, 1267 bp, Gossypium hirsutum
aagaaaagggttctttgctcactaagttttattcttttatcatttcatttgatcgccaaaaaggaaaagcttaatccaaattgagaggaaaaaaaaagggtagcaccatggatcatgcagctgatgcccatagaactgatttgatgaccatcactcgccatgtccttaatgaacaaaccaagtaccctgaatctcgtggtgatttcaccatcttgctcaatcatattgttcttggctgtaaattcgtttgctcttctgttagcaaggcgggtcttgccaaactatttggacttgctggagaaaccaatatccagggtgaagaacaaaagaaattggatgtgctttctaatgaagtttttgttaaggctttgattagcagtggaagaacatgcctcctggtttctgaggaagatgaagaagctatatttgtggatcaatcaaagcgtggaaaatacattgttgtttttgatccattggatggatcctcaaacattgattgtggtgtttccataggaactatatttgggatttatatggtgaaacataaagacaatcccaccattgatgatgtattacaacctggaaataatctcgtagcagccggttattgtatgtacggaagctcctgcacgttagtgctaagtactgggagcggcgttaacggtttcactctcgatccatctctaggggagttcatattaactcatcccgatatcaagatacctaagaaaggaaagatttattcagtaaatgaaggaaatgccaaaaattgggatgaaccaactcgaaagtttgttgaaaaatgcaagttccctacagacggttcacccccaaagtcccttaggtacattggaagcatggttgcagatgttcaccgaacattgctttatggtggtatctttttataccctgcagataagaaaagtcctaatgggaagctacgtgttctttacgaagttttccctatgtcatacctaatggaacaagctggaggtcaagcttttactggaaagcaaagggccctcgatttagttccggggaagatacatgaacgatctccggttttccttggtagctatgatgacgttgaagaaattaaagcactctatgctgctgctgatgctgcaaaataggaagaagaaaatgctgcataaacttgtagactttgtatcagtctttttaagctttttaacatgtggttccttaaagagtactaataatttaatccctgtactattgaagaatcaaatatgaccaaattaaaata

SEQ ID NO: 2869 - DNA, 1268 bp, Sciadopitys verticillata
ggaaaatggaccacgctgcagatgcctatcgcaccgacttgatgaccattactcgtttcgttctgaacgagcagtcaaagcatcctgagtctcgtggggacttcactatcttgctcagccatattgtgctaggatgcaaatttgtttgcactgctgtcaacaaggcgggtctggctaaactcattggtcttgcaggagaaacgaacgtgcagggcgaagagcaaaagaaattggatgtgctctccaatgaagtctttgtgaaggctcttataagcagtgggcgtacgtgcattcttgtttcggaggaggacgaagaggccacttttgtggagcctgcactgaggggaaagtactgtgtagtttttgacccacttgatggctcttccaacattgactgtggagtctcaattggaacgatctttggaatatatttggttaaggatggaggtgaacccacaatagcagatgttctacgaccgggcaaaaacatggttgccgcaggctactgcatgtatggaagttcttgcacgcttgttctgagcactggcagtggagtaaatggttttacacttgatccctcgcttggagaattcattttgactcatccagccataatggtaccaaagaaaggaaaaatatattcagtgaacgaaggcaatgcaaagaactgggacgagcctaccaagaagtatgttgagaaatgtaaatttccaaaggatggatcatcctccaagtctctcagatacattggaagcatggtagctgatgttcacaggaccctcctttatggaggcattttcatgtatcctgcagataagaagagtcccagtggaaaattgcgtgtcctgtatgaagtgtttcccatgtctttcttaatggagcaagcagggggccaatccttcacaggaaagaaaagagcactagacattgttccaacaaagattcatgaacgttcctcagtcttccttggcagttatgatgatgtagaggagattaaggctttatatgctgaagaggtagcaaaagcctaatgtgggttgactgctttgcatgtttgccaattgtatttgtagccctgtttatcagctgcctctaccaatgatgaatggctaactaatttttggtgaacataagttcttccccaaaccttgcaaaaaaaattgcatggagtttttttatctaaccagtgtaggtagattaaaagtattgtttataaatcaatgtgggtgataagttgtcttgttcttgtggatggcaaggcccagtct

SEQ ID NO: 2870 - DNA, 1237 bp, Cyclamen graecum
aggtaggagtgggggagatggatcacgcggcggaggctcatcggacggacttgatgacgatcacccggttcgtgttgaacgagcagtcgaagcacccggagtcgcgaggggacttctccatactgatgagtcacatagtcctcggatgcaagtttgtttgctcagccgttaacaaggcgggtcttgctaagctcattggacttgctggtgaaaccaatatccagggcgaagagcaaaagaaactggatgtgctttcaaatgaagttttcgtcaaggccttggtcagcagcgggcgaacatgcatcctcgtatccgaagaagacgaggaggcgatatttgttgatccatctattcgtggaaggtactgtgtcgtctttgatccactggatggatcctccaacattgattgcggagtttcgattggaacaatcttcgggatttatatgatcaaagatagcggagaaccaagtttagatgacgtgctgcaaccagggaaaaatatgatagccgcaggatattgtatgtatggaagttcttgcacgcttgttttaagcacgggaagtggggttaatggatttaccctggatccgtctcttggggaatttatactgactcacgcagatattaagattccgaagaaaggaaagatatactctgttaacgaaggaaatgccaagaactgggatgcgccaactgcaaagtatgtggaaagctgcaagttccctaaagacggatctccagcgaagtccttaagatacatcggaagtatggtggctgatgtccaccgcactttactttatggtggtatctttttgtaccccgcggataagaaaagccccagtgggaaactgagggttctttatgaagtctttccgatgtcgttcctgatggaacaagctggagggcaggcctttacggggaaagaacaggcacttgacatggttccgaagaagatccacgagaggtctcctatatttctgggtagctacgatgaagtcgaggaaatcaaagcgctctacgctgctgaagaaaattaagatgggaaacccattcccgtctctagtgtttgcgcagactctcgaatatgaccagtttcatttgcttgcataaaacgaagccttttaagcgatgcagttgatgataatactaggataaagtactcattctgtttctaaactgcatctcaggctctcaatctcatattgcttaataattctactacgttctttcatgaggc

SEQ ID NO: 2871 - DNA, 1069 bp, Capsicum annuum
agttgtgggaaaatcaagaagagggtagagatggatcacgcagcggatgcacaccggacagatttgatgaccataacaaggtttgtgttgaatgaacaaaccaaacatcctgaatcacgtggtgatttcagtatcttgctcagtcacattgtccttggctgcaagttcgtttgcagtgccgttaataaggcaggtctggccaaactactaggacttgctggtgagacaaatgtgcagggagaagatcaaaagaagctggatgtactctcaaatgaagtgtttatcaaggctctggttagcagtggccgaacatgcattcttgtctccgaagaagacgaagaggctacatttgtggagccagctaagcgtggaaaatactgtgtagtttttgatcctctggatggttcctcgaacatcgattgtggtgtttctattggaacgatctttgggatttgcatgattaaagagggtcatgaaccaaatctagaagatgtcttgcaacctgggatgaacatgttagccgccggttactgcatgtatggaagttcttgtacgctagttttgagcactggatctggagttaatggttttacccttgatccctctcttggcgagttcatcctaactcatcctgacatcaagattcctaagaaagggaagatctattcagtaaatgaaggaaatgccaagaactgggatggtccaacaaccaaatatgtgcagagctgcaagtaccccactgatggttcttctccaaaatctttgagatatattggaagtatggttgctgatgttcatcgtacattactctacggaggcatcttcttgtaccctggagataagaaaagtcccaacggaaaactgagggttctctacgaagtatttcccatgtcatttctgatggaacaagcaggaggccaagcatttactgggaagcagcgcgcgctcgacctagttccagagaagatacacgaacgttctcctatatttcttggtagttatgatgacgttgaggagatcaaaaagctctacgctgctgaagagaaaaactgatggaagtgtttatacc

SEQ ID NO: 2872 - DNA, 1280 bp, Capsicum annuum
gggaaaatcaagaagagggtagagatggatcacgcagcggatgcacaccggacagatttgatgaccataacaaggtttgtgttgaatgaacaaaccaaacatcctgaatcacgtggtgatttcagtatcttgctcagtcacattgtccttggctgcaagttcgtttgcagtgccgttaataaggcaggtctggccaaactactaggacttgctggtgagacaaatgtgcagggagaagatcaaaagaagctggatgtactctcaaatgaagtgtttatcaaggctctggttagcagtggccgaacatgcattcttgtctccgaagaagacgaagaggctacatttgtggagccagctaagcgtggaaaatactgtgtagtttttgatcctctggatggttcctcgaacatcgattgtggtgtttctattggaacgatctttgggatttgcatgattaaagagggtcatgaaccaaatctagaagatgtcttgcaacctgggatgaacatgttagccgccggttactgcatgtatggaagttcttgtacgctagttttgagcactggatctggagttaatggttttacccttgatccctctcttggcgagttcatcctaactcatcctgacatcaagattcctaagaaagggaagatctattcagtaaatgaaggaaatgccaagaactgggatggtccaacaaccaaatatgtgcagagctgcaagtaccccactgatggttcttctccaaaatctttgagatatattggaagtatggttgctgatgttcatcgtacattactctacggaggcatcttcttgtaccctggagataagaaaagtcccaacggaaaactgagggttctctacgaagtatttcccatgtcatttctgatggaacaagcaggaggccaagcatttactgggaagcagcgcgcgctcgacctagttccagagaagatacacgaacgttctcctatatttcttggtagttatgatgacgttgaggagatcaaaaagctctacgctgctgaagagaaaaactgatggaagtgtttataccctgtaatcacttcactactctcagcttggtggtgcagataacaaatttctcaaattagagcaagttatgatgactacattgtttactgtttatgttgcagtgtagctactttgacgcgataatacgttcacattacttgctcttttctcaaactcccaaagtatccatttctcatcaacaataaaaggtttaatagagaagttctggcttattattg

SEQ ID NO: 2873 - DNA, 1837 bp, Populus trichocarpa
aagacgggtttgttcaagttagagagagaaatataagtagagagagaaagagagatggatcactcagcagatgctcacagaacggatttgatgaccataacgaggttcgtgttgaacgagcaatccaagtatcctgagtctcttggtgatttctctattttgctcaatcacattgttcttggctgcaagttcgtttgctctgctgttaacaaggcgggtctagccaaacttattggacttgctggggagaccaatgttcagggtgaagagcaaaagaagctcgatgttctgtcaaatgaagtgttcattaaggccctagtaagcagtggccgaacatgcatccttgtctcggaagaagatgatgaagcaacatttgtggagccttcaaggcgcggaaggtactgtgttgtatttgatccattggatggatcctccaacattgattgtggtgtttctattggaacgatttttgggatttacatggtgaaagatggccatgaaccaactctaaatgatgtgttgcaacctgggaagaacatgcttgcagccggctattgcatgtatggaagctcttgcatgcttgttttgagcaccggatctggtgttaatggtttcaccctggatccatcccttggggagttcatacttactcaccctgaaataaagattccaaagaaaggaaagatttattcagtgaatgaaggaaatgcaattaattgggatggtccgacagccaagtatgttgaaaaatgcaagttccccgaggatggatcctcagcaaaatctctaagatacgttggaagcatggtagctgatgtccatcgcacattactttatgggggtatatttttgtaccctgcggataagaagagccccaacgggaaactgcgtgttctatatgaagtcttcccgatgtcctttttgatggaacaagcaggagggcaggcttttactggcaagcaacgggcactggacttagttccaacgaagatacatgagcgctctcctatatttcttggcagctatgatgacgtcgaggaaatcaaagcactctatatataatgctgaagagaagaaagaatagacacctatatatactgtggctatatttgggatggcgttgcaccatgccacaacgctcgaaattccgaagggggttatttgttgttacttgtattatagtactcataatattttcatagcctttaattgttctatgggcatttgacctgtttctgataatctatttcatcagaaaagcgttttcatttcatctgatgtgtgttcattgatgggataaacaaacctttcggctgatactggaaaaatgaggaaggatgtgatcatacacgattgatacatcgtgaccacataggaagctagatccattaatttctccatgcgggaaaacgttgcatgcaacttgtttgtcttggacagcaagtgcacataattaagcacgctctgaagtttacagttttatagatgcttttcagcctcgcaagggccggggtactgctgtccacaggaacgtggagctagtaacgaagacaccatggcacgcacacggaaatggcacggagtgatttcgctttacttccggggcaattgcttgtctttttcctttttgtgcttccatgagtgtttcttatcattttctaattcaaagtttcaaaatcttcatgctccagatgccatgtggcgcatcatgcaatgggccctttgctagcactgcatggttcgtttgattagtcttttttatatatcatttcatcctgccaaagctatctgtttcacattcgttcgcaatgatgacaaaaatctgcaatcatgctta

SEQ ID NO: 2874 - DNA, 1516 bp, Aquilegia formosa
gaagaagaaagacaaaatcattaaccgtttggagagagatagagaagggagcgaagaagaaagaagacgttatctatcatcttaagtgataaccacacagagattaattcatggcgtaaccaacacgtgtcattcaattcttccattgaccattagatagccctatctccttcttcttcttcttgttcgttcgtatatatctttaatccaatcttttttctttgtttttgaatttagaaaaaaaacatcaaagtttgaattttttctttttattgattgaatcaaaagaatttgagcaccatggatcacgaatcagcaactcataatactgatattatgactattactcgacatgttttgaatgagcaatctaagtatcctgaatctcgtggagatttttcaatcttgcttagtcacattgttcttggttgtaagttcgtttgtagtgctgttaacaaggcaggacttgctaaactcattggacttgctggagagactaatgttcagggtgaagagcaaaaaaaactagatgtgctatcaaatgaagttttcgtcaaagctttagtaagcagtggtcgaacgtgtattttggtttcagaagaggatgaagaagctatttttgtggagccttcaaagcgtggaaaatattgtgttgtttttgacccgttggatggatcctcaaacattgactgcggtgtttccattggaactatatttgggatttatatgataaaagatggaggtgaaccagttctcgaggatgttttgcaatctgggaaacatatggtggctgctggctattgtatgtatgggagctcttgtacgtttgtgttgagcacaggaagtggtgtcaatggctttacactcgatccgtctctaggggagttcattatgactcatccagatatcaagataccaaagaagggtaaaatctattcagtgaatgaagggaatgccaaaaactgggatggaccaacaaccaagtatgtggagaaatgcaaatttcctacagatggttcgtccccgaagtctcttagatacataggaagcatggtggcagatgtccaccgaacattactttatggaggtgtctttttgtaccctggggataagaaaagcccaaatgggaaactacgtgttctctatgaagttttcccaatgtcgttcttgatggaacaagcagggggtcaagcttttacgggcaaagaacgggcacttgacttggttccaaagaagatccatgagcggtctcctatattccttggcagctatgacgatatcgaggaaatcaaagcgctctatgctgctgaacaaaagacagcataagtatgcaaatcccaataatattctatagtttctttcatctattactttctcataagctatgaagcctcgttgtaatatgaggatacattttatggatgaaaagcaagaaaatccagttttcaatttctgaatcaaattgttgggtatgaggatacattttatggatgaaaaagaagaaaattcagttttc

SEQ ID NO: 2875 - DNA, 1629 bp, Solanum lycopersicum
cagccagtgagagatacaaacaaattcagcagagaagaaaaacaaattagttacagaaatgacgaattggatcacgctttatcttagtgcgaaccactgatcccatgcatcactctcctctttccacgtgtcatcctctgacgtcagaccagattcctcttctctttttttttttaaatatatatgagcattttagcaagtactgcgggcccaatctcttgcacaaaaatcgaaagcacgatggatcacgcggcggatgctcaccggacggatttgatgacgataacaaggtttgtgttgaatgaacagacgaagcaccctgaatcccgtggagacttcagtattttgctcagtcacattgttcttggctgcaagttcgtatgcactgctgttaacaaggcaggtttggctaaactcctaggacttgctggtgagactaatgtgcagggagaagatcaaaagaaacttgatgtactctcaaatgaagtgtttatcaaggctttggttagcagtggccgaacatgcattcttgtctctgaagaagatgaagaggccacatttgtggagccagctaaccgtggaaaatactgtgtagtttttgatcctctggatggatcatcgaacatcgattgtggtgtttctattggaacgatctttgggatttacatgatcaaagacggtcatgaaccaacactagatgatgtcttgcaacctgggatgaacatgttagctgctggttactgcatgtatggaagttcttgtacgctagttttgagcactggatctggagttaatggttttacccttgatccctctcttggcgagttcatcctaactcatgctgacatcaagattcctaagaaagggaagatttattcagtgaatgaaggaaatgccaagaactgggatggtccaacatccaaatatgtgcagaactgcaagtatcccgctgatggttcttcacctaaatctttgagatatattggaagtatggttgctgatgttcatcgtacattactctatggaggcatcttcttgtaccccggagataagaaaagccccaacgggaagctgagggttctctatgaagtatttcccatgtcatttctgatggaacaagcaggaggtcaagcatttactgggaagcaacgggcacttgacttagttccagagaagatacacgaacgctctcctatatttcttggtagttatgatgacgttgaggagatcaagaatctctacgctgctgaagagcaaaactgatagatgtatctataccatgtaatcacttcactactcttgctggtgcagatatcaaatttctcaaattagagcaagttgttactgtttatgttgcacaatagctgctgtgacgcgataatacgttcacattactggcttgttctaacttttttcttgaagtatccttttctcatcaacaataaaatgttgaatagagaagttctggcttattattgctcattttaattcaaagttcttttgtaatgtcatccatttagaatcaagccaatcttttctgctagatgttgtctggttctcattgcattgttatctttcataggttgttgactaacatctatataaatgatatcactggcttcttgtgaa

SEQ ID NO: 2876 - DNA, 1469 bp, Lupinus angustifolius
ccacatatccttcttaatctttgtggtccctctccctctttattcaatatatataaatattcttatatataaattcacaagtaactagttcagttgaattgttttttgggtttagtttcttcttcttgatagtgaaaatggaccacagtgcagatgcattccgcactgatttgatgaccattacacggttcgtgcttaacgagcaatctaagcaccctgaatcacgcggcgatttctccatcttgctcagtcacattgtcctcggttgcaagttcgtctgttctgctgtcaacaaggctggtcttgctaagctcattggacttgctggagagaccaatgttcagggtgaagaacagaagaaactggatgtactttccaatgaagtctttgtcaaggctttgataagcagtggccgaacttgcatattggtgtctgaagaagatgaggatgcaatatttgtggagccttctaagcgtggaaagtacgctgttgtatttgacccactggatggttcttctaacatcgattgtggtgtttccattggcacgatttttggtatttatgcgttgaaagataaccatgaaccaactatagaagatgttctgcaacctgggaagaacatggtagcagctggttattgcatgtatggaagttcttgcacgcttgtgttaagtactggaagtggtgttaatggtttcactctggacccatctcttggtgagttcatcctaactcaccctgacattaagatcccaaagaaaggcaatatttattcagcgaatgaaggaaatgccaaaaactgggatagtcctactgccacctatgtggagaaatgcaagtttccaaaagatggttcatccccaaagtctctaagatacattggaagtatggtagctgatgttcatcgtacattgctttatggagggatctttttgtaccctgctgataaaaagagtcctaatggaaaacttcgtgtactctatgaggttttcccaatgtcattcttgatggaacaagcaggaggacaatctttcactggcaaggaacgggcacttgatttgattccaacaaagttgcatgaacggtcaccaatattccttggtagctatgatgatgttgaggaaattaaaactctttatgctgctgaagctaaacaggaatgaacctgtaaaccgtccttgtgttcctcaattattaaacaatcatctggtcatgtatatgttcagagaacttgttattgttctttaggaaggaaaacaacatactttttcctcttctcgtatatccaagcatgttttccctctacttgtttataagttaaattcgataggtattgtggcatactagttatcattttatatggataaaaataccatatctcatgataaacactttactcgatggtcaatagcattccacatatttttcctgatgaacattgtttcttgtggcattgatagctatgaact

SEQ ID NO: 2877 - DNA, 1231 bp, Cajanus cajan
atatattatgatattattgatggataaatatgaaagcagttaaagtgatatgatatccatgacgtagtatccagttgctgtatgctgagaaaacatggatcacactgcggatgcccaacgcacggacctcatgaccataacccgtttcgtgctcaacgaacagtccaagcgccctgagtctcgtggcgatttcacaatcttgctcagtcacattgttcttggctgcaagttcgtttgctctgctgttaacaaggcgggtcttgctaagcttattggacttgctggagagacaaatgttcagggtgaggagcaaaagaaactggatgtcctttccaatgatgtctttatcaaggctttgatcagcagtgggagaacttgcatcttggtgtctgaagaagatgaggaagcaacatttgtggagccttctaagcgtggaaagtactgtgttgtttttgaccctctggatggttcctctaacattgattgtggtgtttccattggcacaatttttgggatttatttggtgaaagaagaccgagaaccaaccatagaagatgttttgcaacctgggaagaacatgttggcagctggttattgcatgtatggaagctcttgtacgcttgtgttaaccactggaagtggtgttaatggtttcacccttgatccatctcttggggagttcattctaactcaccctgacatcaagatcccgaagaaaggcaagatctattcggtgaatgaaggaaatgccaaaaattgggatggccctactaccaagtatgtggagaaatgcaagtttccaaaagatggttcatcgtcaaagtccctgagatatattggaagcatggtagctgatgttcaccgcacattgctttatgggggtatctttctgtacccggctgataaaaagagcccaaatgggaaacttcgtgtactgtatgaagtattcccaatgtcattcttgatggaacaagcaggagggcaggctttcactggaaaggaaagggcacttgatttggtaccaaagaagttgcacgagcgatctcccatattccttggtagctatgaggatgtggaggaaatcaaggctctttacgctgctcaggaatgaatcaacctgcaaatcattatttgcctttcccttcatgtatatgttcagaaaaaacacttgttaaacttttgtcatttagaaaaatattttatttagctatatctaattattataatctta

SEQ ID NO: 2878 - DNA, 1236 bp, Papaver somniferum
taccgagaaatagtttattggaaaaagaagaagaagaggaagaaaaaatggatcatgctgctgaggctcatatgactgatttgatgaccattactcggtttgttcttaacgaacaatcgaaacatcctgaatcacgtggagacttttccatcttgcttagtcatattgttctgggttgcaaattcgtttgtgctgctgttaacaaagctgggcttgcaaaactcatcggacttgctggggagaccaatgttcagggcgaagagcaaaagaaactggatgttctttcaaatgatgtatttgttaaggctctcgtaagcagtggaagaacgtctattctagtatcggaagaggatgaagaagcaacttttgtggatccagcgttgcgtggaagatactgtgtggtttttgatcccttggatggttcttctaacattgactgtggtgtttccattgggaccatatttggtatttatatgatgaaagcaaatgaggaaccacatctagaagatgtcttgcaaccagggaaaaatatgttagcagctgggtattgcatgtacgggagttcttgcacgtttgtgttgagcactggaactggtgtcaatggtttcactcttgatccatcccttggggagttcattatgactcatccagacattaagattcccaagaagggaaaaatctactcagtaaatgaaggaaatgccaaaaactgggatacaccaacagcgaagtacgttgagagatgcaagtaccctcaggatggttcatctccaaagtctctcagatacattggaagtatggttgctgacgtgcaccgcacattactttacggaggcatatttatgtatcccgcagacaagaagagcccaagcggaaaactacgtgttctctatgaagttttcccaatgtcctttttgatggaacaagcaggaggtcaagcttttactggaaaagaaagggcactcgacttggtgccaaagaaaatacatgaacgatcacctatatttcttggaagttatgacgatgttgaagaaataaaagtgctttatgccgctgaagaaaagaaggcgtaaatgtgccaaccgcttctaaagacctcaaaacatcctcatgtttcttctgccggtagctgagccagtgagccagtttattcatctattcttaaaatggaacttctcaatacgctttctgtgacaatcagaaaatacatttcattaatgagagatgatggtttag

SEQ ID NO: 2879 - DNA, 1318 bp, Fragaria vesca
gacgagaggcgttatctgagtttgaaccaccagctccgtaacccatcccaagccctacacgtgtcctcagaaacttccattgggttgcagattaggcctcgagaagaagagagagaggaaaaaatggatcatgaagctgatgcttaccgtactgacttgatgaccatgactcggttcgtgctgaacgagcagtccaagcaccctgagtcacgaggagacttcaccatcttgctcagtcatattgttcttggctgcaagtttgtgtgctctgctgtcaataaggctggtctggctaaacttattggccttgctggagagaccaatgttcagggtgaagagcaaaagaaactggatgttctttcaaatgaagtttttgtgaaggctctggtcagcagtggtcgaacttgtatccttgtttctgaggaagatgaagatgccatatttgtggaaccatcaaagcgcggaaagtactgtgttgtatttgatccactggatggttcgtctaacattgattgtggcgtttcaatcggcacgatatttgggatttatgcactatatgatggtggtgaaccgaaactagatgatgtgttgcaaccgggaaagaatatggtggcagcaggctattgcatgtacggaagttcttgcacgtttgtgttgactactggaagcggagttcatggtttcacccttgatccatctcttggagagttcatactaactcacccagacatcaagattccgaagaaaggaaagatttattctgtgaatgaagggaatgctaagaactgggatggtccaacagccaaatatgtggagaaatgcaaattcccaacagatggttctccaccaaagtctctaagatacattggaagcatggttgctgatgttcatcggacattgctttatggaggtatctttttgtaccctggtgataagaagagtccaaacggaaaactgcgtgttctctacgaagtcttccccatgtcattcttgctggaacaggcgggaggtcaagccttcactggcaaagaacgggcccttgacctcgttccaaagaagatacatgagcggtctccaatattcctcggcagctatgatgatgtggaggagatcaaggcactctatgctgctgaagaaaagaaagaatgaacttacagttctgattcttttatgcgtattacatgaccttttattgttgctctgctacttccacatactttatgaatctataaatgggagagtacagtttgttgatgctaacagaggttttatgcttatctttgtcagtctcctagggaatcgtatgccttacatgctt

SEQ ID NO: 2880 - DNA, 1211 bp, Trifolium pratense
aagattttgaaaaatggaccacagcgcagatgcacaacgtacagatttgatgaccataacccgtttcgttttgaacgaacagtctaagtaccctgaatcacgcggtgatttcaccatcttgctcagtcacattgttcttggctgcaaattcggttgttctgctgttaacaaggctggtcttgctaagctaattggacttgctggagagaccaatgttcagggtgaagaacagaagaagctggatgttctttccaacgaggtgttctgcaaagctttgataagcagtggcaggacttccatcttggtctctgaagaagatgaggatgcaatatttgtgcagccttcactgcgtggaaagtattgtgttgtttttgatccattggatggctcctccaacattgattgtggtgtttccattggaactatttttgggatttatatgatgaaagatagccatgaaccagtcatagaagatgttctgcaaccagggaagaacctgttggcagctggttattgcatgtatggaagctcttgcacgcttgtgataagcactggtagtggtgttaatggtttcacccttgacccttctcttggcgagttcatcctaactcaccctgatattaagattccaaagaaaggcaagatttattcagtgaatgaagggaatgccaagaattgggatggccctactgcctcttatgtggagaaatgcaaatttccaactgatggttcacccgcaaagtctctaagatatatcggaagcatggtagctgatgttcatcgtacattgctttatggaggtacatttttgtaccctgctgacaaaaagagtccaaatggaaaacttcgtgtattgtatgaagttttcccaatgtccttcttgatggaacaggcaggtggacaggctttcactggcaaggaaagggcactggatttaattccaacaaagttgcatgaaagatctcccatatttcttggtagctatgatgatatcgaggaaatcaaagctctttatgctgcagaagagggcaaataagagaaacctgaaaaaagcttccttctggttttcactacttgcaagcatttatgcaattgttaggctaacaagtgcctataacaattaaaacttgtttaccttatcatgtatatgttataagaaaacttgttaatgtgcttgcttgccttggttatagtttattaatggataaaca

SEQ ID NO: 2881 - DNA, 1419 bp, Trifolium pratense
tgggttcagtcagttacgattcattcatttcatcatcatcatcgtcgtcataggttgaaattggaaagtactaactaatcaattgaacaagattttgaagaatggatcacagcgcagatgcacaacgtacagatttgatgaccataacacgtttcgttctcaacgaacagtctaagcaccctgaatcacgcggtgatttcactatcttgctcagtcacattgttcttggctgcaaattcgtttgctctgctgttaacaaggctggtcttgctaagctcattggacttgctggagagaccaatgttcagggtgaagaacagaagaagctggatgttccttccaatgaggtgttctgcaaagctttgataagcagtggcaggacttccatcttggtctctgaagaagatgaggatgcaatatttgtgcagccttcactgcgtggaaagtattgtgttgtttttgatccattggatggctcctccaacattgattgtggtgtttccattggaactatttttgggatttatatgatgaaagatagccatgaaccagtcatagaagatgttctgcaaccagggaagaacctgttggcagctggttattgcatgtatggaagctcttgcacgcttgtgataagcactggtagtggtgttaatggtttcacccttgacccttctcttggtgaattcatcctaactcaccctgatattaagattccaaagaaaggcaagatttattcagtgaatgaagggaatgccaagaattgggatggccctactgcctcttatgtggagaaatgcaaatttccaactgatggttcacccgcaaagtctctaagatatatcggaagcatggtagctgatgttcatcgtacattgctttatggaggtacatttttgtaccctgctgacaaaaagagtccaaatggaaaacttcgtgtattgtatgaagtcttcccaatgtccttcttgatggaacaggcaggaggacaggctttcactggcaaggaaagggcacttgatttaattccaacaaagttgcatgaacgatctccaatatttcttggtagctatgatgatatcgaggaaatcaaagctctttatgctgcagaagagggcaaataagaggaacctgaaaaaagcttccttctggttttcactacttgcaagcatttatgcaattgttagactatcaagtgcctataacaattaaaacttgtttacctcttatcatgtatatgttataagaaaacttgttgatgtgcttgcttgccttggttgtagtttattaatggataaacaacattagattaaaaaaatgtagtctaattataagcaatgaactacgtgatcattttaatgacaactactacaattataaaattgcgtaagagttttcattaaaatgatcatgtagtat

SEQ ID NO: 2882 - DNA, 1389 bp, Trifolium pratense
tcatcatcatcatcataggttagaattggaaagttattattcattttgattgaatcgaagatttttgagaatggaccacagcgcagatgcacaacgcacagatttgatgaccataacccgtttcgttttgaacgaacagtctaagtaccctgaatcacgcggtgatttcaccatcttgctcagtcacattgttcttggctgcaaattcgtttgctctgctgttaacaaggctggtcttgctaagctcattggacttgctggagaaaccaatgttcagggtgaagaacagaagaagctggatgttctttccaatgaggtgttctgcaaggctttgataagcagtggcagaactagcatcttggtctctgaagaagatgaggatgcaatatttgtgcagccttcactgcgtggaaagtattgtgttgtttttgatccattggatggctcctccaacattgattgtggtgtttccattggaactatttttgggatttatatgatgaatgataaccatgaaccaatcatagaagatgttctgcaaccagggaagaacatgttggcagctggttattgcatgtatggaagctcttgcacgtttgtgataaccactggcagtggtgttaatggtttcacccttgacccttctcttggcgagttcatcttaactcaccctgatattaagattccaaagaaaggcaagatttattcagtgaatgaagggaatgccaagaattgggatggccctactgcctcttatgtggagaaatgcaaattcccaactgatggttcaccagcaaagtctctaagatatatcggaagcatggtagctgatgttcatcgtacattgctttatggaggtacatttttgtaccctgctgacaaaaagagtccaaatggaaaacttcgtgtattgtatgaagtcttcccaatgtccttcttgatggaacaggcaggaggacaggctttcaccggcaaggaaagggcacttgatttagttccaacaaagttgcatgaaagatctcccatatttcttggtagctatgatgatatcgaggaaatcaaagctctttatgctgcagaagagggcaaataagaggaacctgaaaaaagcttccttctgtttttcactacttgcaagcatttatgcaattgttaggctaacaaatgcctataacaattaaaacttgtttacctcttatcatgtatatgttataagaaaacttgttgatgtgcttgcttgccttggttgtagtttattaatggataaacaacattagattaaaaaaatgtagtctaattataagcaatgaactacgtgatcattttaatgacaactactacaattataaaattgcgtaagagttttcattaaaatgatcatgtagtatt

SEQ ID NO: 2883 - DNA, 1611 bp, Abies balsamea
ttatccgttcaagcagatgcagaggagatcataaaaagaattgctgctgcctcgacacgtggataccgaagcctccactggtcgctgataatacgctccatctccacaacttaaaccgaatgatcagcagcccctggatgcgcgtggcagaggacattcgaatttaagataagatgccctttatttcgttattatcactccacttcggtttatttaaataaacaaatcacaggcagggagtggggttgaatttaattggaagtgaatcgccttggattcaatttgtggggaaagaacatggaccacgcagcagatgcctttcgcacagatctcatgaccattacgcgatttgttctgaacgagcagtctaagtatcctgaatcgcgaggagatttctctattttgctcagtcacattgttctcggatgcaagtttgtatgttctgccgtcaacaaggcaggtctggctaaactcattggccttgcaggagagaccaacgttcagggcgaagagcaaaagaaattggatgtgctctccaatgaagtatttgtcaaggctcttgtcagcagtgggcgcacgtgcattttagtttcagaggaggatgaggaggccaccttcgtggagcattcacagcggggaaagtattgcgtagtcttcgacccactcgacggctcttccaacatcgattgtggagtgtcaattgggacgatatttggaatatacttggtgaaggatggaggagaggcgaccttgggtgatgttctcaaaccaggcaagaacatggttgcagcaggttactgcatgtacgggagctcctgcacgcttgtgctgagcactggaagtggtgtaaatggctttacgcttgatccctcccttggggaattcattttgactcatcctgacataaagattccaaagaaagggaaaatatattcggtgaacgaaggcaatgcaaagaactgggacgagcccaccaggaagtacgttgagagatgcaagtttccccaggatggttcatctcccaagtctctcagatacattggaagcatggtagctgatgtgcacagaaccctactctatggcggtattttcatgtaccctgctgataagaagagtcccactggaaaattgcgtgttctctacgaagtgttccccatgtcattcctaatggagcaagcaggaggtcaagctttcacaggaaacatacgagcacttgatctggtacccactaagattcatcagcgttcccctgtctttcttgggagttatgatgacgtggaggagatcaaggttttgtacgctgcacaggaaggaaagccttaaattccatccatgaataggcaattgtatttgctaaggattgattcactcattttcaaattaaaaaaaaaaatggatgccgataagaaaacatgaatttatcgtttaagcttatttctactcagacatgaaccgagtcaaaccattgtaatatgtaatgttactgaaatcttatatttgtagaatgcattatatgtgtgcttgtagatgcagataattgatgtccattacaagtttgtaatttaacgatttttttttaatcttaatcagtatatgattcttttcaattga

SEQ ID NO: 2884 - DNA, 1417 bp, Amsonia hubrichtii
cctcatttccactcccttgaattgggtacctctagataaccagatagccgtaaaaaagtaccaattctcctccaattagtcctcgccactaaattataagcactatttgtatctattgcttactatatatacatgtgatgaactgaattcttgacttcttggttcaagaaaatatagatctcttcgttgttgatataagaaatttgtaagaaatggatcatgcagcggatgctcaacgcactgatttgatgaccataacaaggtatgtgttgagcgagcaatcaaagcatccagcttctcgtggggacttcactatcttgcttagtcacattgttctgggctgcaaatttgtttgttctgctgttagtaaggcaggattggccaagctcattgggcttgcaggcgagacaaatgtgcagggtgaggagcaaaagaaactggatgtgctctcaaatgaagtcttcatcaaagctttgataagcagtggtcgaacatgcattcttgtctctgaagaagatgaactggcaacatttgtcgataagcctaatcgcgggaaatactgtgtggtgtttgaccctctggatggatcctcaaacatcgactgtggtgtctctattggaactatctttggaatttacatgataaaggatgatattgttgaaccaacactagcggatgtattgcagccggggaagaatatggtagctgctggttactgcatgtatggtagctcttgcatgcttgtgttaagcactggttctggtgttaacgggtttactcttgatccttctcttggggagttcatacttacccatgctgatatgaagattccaaagaaaggaaagatttactcagtgaatgaaggaaatgcgaagaactgggatggtcccacagccaaatatgtggagatgtgcaagttcccaaaagatggttcatcaccaaaatctttaagatacattggaagcatggtagctgatgttcaccgcacattactttatggtggtatctttatgtacccaggtgataagaagagtcccaacgggaaattgcgagttctctatgaagtcttccctatgtctttcttgatggaacaagctggaggacaagcgttcactggcaagcaactggcacttgacctggttcctcagaagatacacgaacgttcaccaatatttcttggtagttatgatgatgtcgaggagatcaaaacactttatgcagaagctcagaaagcataaatatgtaaatctccttttcccttcactgttgtggaggtgttaaatcactaatctcttgtagcagaaattagctttttgatgttgtttaaaattgttgatgttgttttaggctgtatgttaaataatagctaatgtcaattactgtcataactggcagatacattcatatatgaaggaag

SEQ ID NO: 2885 - DNA, 1323 bp, Cedrus atlantica
ggagagccttaatttaattgaactgaattgccttggattcaatttgtggggaaagaacatggaccacgcagcagatgcctttcgcacagatctcatgaccataacgcgattcgttctgaacgagcagtctaagtatcctgaatcgcgaggagatttctccattttgctcagtcacattgtcctcggatgcaagtttgtatgttctgccgtgaacaaggcaggtctggctaaactcattggccttgcaggagagaccaatgttcagggggaagagcaaaagaaattggatgtgctctccaatgaagtatttgtcaaggctcttgtcagcagtgggcgcacgtccattctagtttcagaggaggatgaggaggccacctttgtggagcattcaaagcggggaaagtattgcgtagtcttcgacccactcgacggctcttccaacatcgattgtggtgtgtcaattggtacgatatttggaatatacttggtgaaggatggaggagaaccgaccttgggtgatgttctcaaaccaggcaagaacatggttgcagcaggttactgcatgtacgggagctcctgtacgcttgtgctgagcactggaagtggtgtaaatggctttacgcttgatccttcccttggggaattcattttgactcatcccgacataaagatcccaaagaaagggaaaatatattcggtgaatgaaggcaatgcaaagaactgggatgagcccaccaggaagtatgttgagagatgcaaatttccccaggatggatcatctcccaagtctctcagatatattggaagcatggtagctgatgtgcacagaaccctactctatggcggtattttcatgtaccctgcagataagaagagtcccaatggaaaattgcgtgttctgtacgaagtgttccccatgtcattcctaatggaacaagcaggaggtcaagctttcacaggaagcaaacgagcacttgatctggttcccattaagattcaccagcgttcccctgtctttcttgggagttatgatgacgtagaggagataatggctttgtacgctgcagaagaaggaaaggcttagagtccatccatgaataggcaattgtatttgcttaaggatcgattcactaattttcaaaattttcaaaatgtggatgcctatatgaaaacattaatttatcagttaagtttattttttaagcagacagaggcaagccaaaccattgtaatctgtgatgtatttatagaatgcattatatgtgtacttgtggatgtagatagttgatgtctgttacaagtctcaatgaaccttttagtatt

SEQ ID NO: 2886 - DNA, 1362 bp, Pinus taeda
acttcggtattaacggacagaccacaggcagagaggaagaggctgaatttaattgaatttggaggaaagaacatggaccacgcggcggatgcctatcgcacagatcttatgaccataacgcgattcgttctgaacgagcagtctaagcatcctgaatcgcgaggagatttttccattttgctcagtcacattgtcctcggatgcaagtttgtgtgctctgccgtcaacaaggcgggtctggctaaactcattggccttgcaggggagaccaatgttcagggggaagaacaaaagaaattagatgtgctctccaatgaagtatttgtcaaggctcttgtcagcagtggacgcacgtgcattttagtttcagaagaggatgaggaggccacctttgtggagcattcacagcggggaaagtattgcgtagtcttcgatccactcgatggctcttccaacatcgattgtggagtgtcaattgggacgatatttggaatatacttggtgaagaaagaaggagaggcggccctgagtgatgttctcaaaccaggcaagaacatggttgcagcaggttattgcatgtacgggagttcctgcacgcttgtgctgagcagcggcagtggtgtaaatggctttacactggacccctcccttggggaattcattttgactcatcccgacataaagataccaaagaaaggaaaaatatattcggtgaatgaaggcaatgcaaagaactgggatgagccaaccaggaagtatgttgagagatgcaaatttccccaagatggatcatctcccaagtctctcagatatattggaagcatggtagctgatgtgcacagaaccttactctatggcggtattttcatgtaccctgcggataagaagagtcccaatggaaaattgcgtgttctgtacgaagtgttccccatgtcgttcttaatggaacaagcaggaggtcaagcttttacaggaagcatacgagcacttgatctggttcccactaagattcaccaacgttcccctatctttcttgggagttatgatgatgtggaggagattaaggctctgtacgcagcacaggaagggaaggtttaaaagtccgtccatgaataggcaattgtattttctaaggattgatgactaattttagaaacaaaaaatatgaatgcccagaagaaaacattatttttcattattttttaagcaagccaaaccacgaaatatgtaatgtcactgaattctcatatttgtaccatgcagtatatgtgtacttgtacatgcatatagtgcgtgtccataacaagtctgtattttaatgtgaaaagttaatattaaaccgtttatggttattttcaaccg

SEQ ID NO: 2887 - DNA, 1593 bp, Vaccinium corymbosum
ggcgttatcctgagtggcaaccacagaaccccccctttacggcggagccaccacgtgtcatcctccacttccactgacatcagatagcccccatctccctctctcatcgcttcttcgttatccctagatatatatatcgatacacttacgtgtaataaatatctgctgtatatatctattcacaggttggttatagcatcgtcaggcctcgaaatgagcgactgatgctgcactcgatacaatctcgactcgattgaaaaacccctaattcgaaaaccctagaggaagttgttgattagattgaagagagatggatcacgcagcggacgcatacaggacggattgatgaccataacgcggttcgtgctcaacgagcagtccaagtacccggagtcgcgtggggacttctcgattttgctcagtcacattgttctgggttgcaagttcgtttgctctgctgtcaacaaggcaggtcttgctaaactaattggacttgctggagaaaccaatgtgcagggtgaagagcaaaagaactagatgtgctttcaaatgaagttttcgtcaaggccttggtcagcagtggccgaacgtgcatccttgtctctgaagaggacgaagaggcaacatttgtcgagaaatctaatcgtggaaggtactgtgtcgtctttgatccactggatggatcctccaacattgactgtggtgtttccattggaacgatctttgggatttatattgtgaaagatggtggcgaaccagctttagatgatgtgctgcagcctgggaaaaatatggtggctgccgggtattgcatgtacggaagctcttgcacgcttgtgataagcaccggaggtggcgttaatggatttacccttgatccatctcttggggagttcattctaactcatccagacattaagattcctaaaaagggaaaaatctactcagtgaatgaaggaaatgccaaaaactgggatggaccaacaacaaagtatgttgaaaaatgcaagttccctaaagatggatcatctccaaagtctctaagatacattggaagcatggtggctgatgtccaccgcacgttactttacggtggtatctttttgtaccctgctgataagaaaagccccaatggaaaactgcgggttctttatgaagtcttcccaatgtcattcctcatggagcaagctggaggtcaggcatttacgggcaagcaacgggcacttgacttgcttccatcgaatatacatgagcgatctccaatatttctgggtagttatgatgatgttgaggaaattaaagcactctatgctgctgaagagagcacgtgaatgcatttccgcttggtgcttgtgcaaatgctaaaatgaacttggtaactgattataaactgttcatgagatgaaacctctcattaagtttttccttgtaatgaaatgatacaattggttcatggaatttcaggcatgaagttcgcttgtttcttgaagtagtacagtaaaattcaatgtttgcgattaacaaaagaatttgagctatacttgatcatgtgcataaactggcattagaacaatataatctctctggtgtttt

SEQ ID NO: 2888 - DNA, 1261 bp, Cyclamen graecum
tggtggcaagaattggatagagagataggtaggagtgggggagatggatcacgcggcggaggctcatcggacggacttgatgacgatcacccggttcgtgttgaacgagcagtcgaagcacccggagtcgcgaggggacttctccatactgatgagtcacatagtcctcggatgcaagtttgtttgctcagccgttaacaaggcgggtcttgctaagctcattggacttgctggtgaaaccaatatccagggtgaagagcaaaagaaactggatgtgctttcaaatgaagttttcgtcaaggccttggtcagcagcgggcgaacatgcatcctcgtgtccgaagaagatgaggaggcgatatttgttgatccatctattcgtggaaggtactgtgtcgtctttgatccgctggatggatcctctaacattgattgtggagtttcgattggaacaatctttgggatttatatgatcaaagatagcagagaaccaacattggatgacgtgctgcagccagggaaaaatatgattgccgcaggatattgcatgtacggaagctcttgcacgcttgttttaagcgcgggaagtggggttaatggatttaccctcgatccatctctcggagaatttatactgactcatgcagatattaagattccgaataaaggaaagatatattctgtaaacgaaggaaatgccaagaactgggacgagccaactgcaaagtatgtgcaaaaatgcaagttccctgaagatggatctccggccaagtccttaagatacatcggaagcatggtggctgatgtccaccggactttactttatggtggcatctttttgtaccctggtgataagaaaagccccagtgggaaactgagggttctttatgaagtctttccgatgtcgttcctgatggaacaagctggagggcaggcctttacggggaaagaacaggcacttgacatggttccgaagaagatccacgagaggtctcctatatttctgggtagctacgatgaagtcgaggaaatcaaagcgctctacgctgctgaagaaaattaagatgggaaacccattcccgtctctagtgtttgcgcagactctcgaatatgaccagtttcatttgcttgcataaaacgaagccttttaagcgatgcagttgatgataatactaggataaagtactcattctgtttctaaactgcatctcaggctctcaatctcatattgcttaataattctactacgttctttcatgtg

SEQ ID NO: 2889 - DNA, 1236 bp, Cyclamen graecum
ccctcattttggttctctctccagctggctggcttatagtaaagagattttgattgagaagagatcgtagccgttgagagatggatcacgaggcagatgcttaccggacggatttgatgacgatcacgcggttcgtgttgaacgagcagtcaaagttccccgagtcacgcggggacttcaccatattgatgagccacattgtcctcggatgcaagttcgttcacgccgccgtcaacaaggccggtcttgctaagcttcttggacttgcgggtgaaaccaacatccagggcgaggagcaaaagaaactggatgtgctttcaaatgaagttttcgtcaaggccttggtcagcagtgggcgaacaagtatccttgtatcggaagaagatgaggaggcgacatttgttgatccatctattcgtggaaggtactgtgtcgtctttgatccgctggatggatcctctaacattgattgtggagtttcgattggaacaatctttgggatttatatgatcaaagatagcagagaaccaacattggatgacgtgctgcagccagggaaaaatatgattgccgcaggatattgcatgtacggaagctcttgcacgcttgttttaagcgcgggaagtggggttaatggatttaccctcgatccatctctcggagaatttatactgactcatgcagatattaagattccgaataaaggaaagatatattctgtaaacgaaggaaatgccaagaactgggacgagccaactgcaaagtatgtgcaaaaatgcaagttccctgaagatggatctccggccaagtccttaagatacatcggaagcatggtggctgatgtccaccggactttactttatggtggcatctttttgtaccccggtgataagaaaagccccagtgggaaactgagggttctttatgaagtctttccaatgtcgttcctcatggaacaagctggaggtcaagcatttacggggaaagaacgggcacttgacatgattccaaagaagatccatgaaaggtctcctatatttttgggaagttacgatgatgtcgaggaaattaaagcactctatgctgctgaagcaaattaagacgtgaaacgtattcccgtctctattgtttctgcagaatctcgaatgtgaccaatttcatttacttgcataacgcaaaacttcctcggttttccttgaaattcattaagtgatacagttgttgataatacaggga

SEQ ID NO: 2890 - DNA, 1302 bp, Beta vulgaris
cccacatcacataaaaagagctccaatctttgaggagagagaaagtgcaaaagaagaagaagaacatggatcatgcagcggatgcaactcgtacagacttgatgaccataacacgtttcgtattgaatgaacagtcgaaacgtcctgagtctcgtggtgacttcaccattcttatgagtcacattgttcttggctgcaaatttgtctgctctgctgttaataaggctggtcttgccaagctcataggacttgcaggggagacaaatattcagggtgaagagcaaaagaagttggatgttctttcaaatgaagttttcattaaggccttgataagtagtggcagaacttgcattcttgtgtctgaggaggatgaggaggcaacattcgttgagccatctctacgtggaaagtattgtgttgtttttgaccctttggatggatgttccaacattgactgtggtgtatcgattggcactatctttgggatttacatggtgaaagatcttaataatgcaactcttgatgatgtcctccaacctggaaaaaatatggtagctgctggttattgcatgtatgggagctcttgcacgcttgtcatgagcactggaagcggtgtcaatggtttcactcatgacccatctcttggagagtttattttaactcatccggacatcaagatcccaaagaagggtaagatctattctgtgaatgaaggcaatgcaaagaactgggatggcccaacaacaaagtacgtggagaaatgtaagttccctaaggatggttcatcaccaaaatctctcagatacatcggaagtatggtagcggatgttcatcgcactctactttatggtggcatctttatgtaccctggtgataagaagagccctaacggaaaactacgagttctttatgaggtctttcccatgtcattcttaatggagcaagcaggtggacaagcttttactggcgaacaacgggcacttgacttggtcccaaagaacatacatgatcgttcaccagtattccttggcagctatgacgacgttgaagacatcaaagcactctatgctgctgaacagaagaatgcttgagcttcagcagatgttagatctacctgagttccctccaattggatccaaatttactttctacatataacagtggtcacaactgaactttgtgcccgtatatatgctccataaatgtgcataacataggaatatatacatttacgtgagcactggttaattgttaagtaactatatttcttcattaatgtcaatggtaaacctgttctaaacc

SEQ ID NO: 2891 - DNA, 2251 bp, Ricinus communis
gtttgataaatatacatgcatataattttatctccaaaaataaaaataaatgtatataatttttaaattcataatttaataatgtgatgtaaggcgagtttatggaaaaaataataatataattttttttttatagaaaaacttgaataatattataaaaagttgtaaccaaaagaataaaaataaagaaaaacgaatctcgaagtgcaccaccacgacctcgtcatctgcaaagatgaagagagacaaaaagctgataaccgtcgaatcgtatacagacgaccaaaggcgttatccgcagtgacggccacacacatcactaccaccctccttccgcgccacgtgtcgtaggaaacttccattatatgtaacccgatagcatcccgctgtctacaggctacagatagtccaagtgctctctcccttatcgctttcgcacaactgctgtcccacttctcctcgaactcggcaacctttcacctctgctatttaacccttttgctcaaaagcttccattttcatttatttagttacttagagagagagagagagagagagagagagagagagagagagggagagagagagagatggatcacgcagcagatgcacacaggactgatttgatgaccataacaaggtttgtattgaatgagcaatcaaagcatcctgattctcgtggagatttcaccatcttgcttagtcatattgttcttggctgcaagttcgtttgctctgctgttaacaaggctggtcttgctaagcttattggacttgctggggagacgaatgttcagggtgaagagcaaaagaagttggatgtgctttcaaatgaagttttcatcaaggctttagtaagcagtggccgaacatgcattcttgtctcagaagaagatgacaaggcaacatttgtggagcctgccatgcgcggaaagtactgtgttgttttcgatccattggatgggtcctctaacattgattgcggtgtttctattggaacgatctttgggatttacatggtgaaacatggcaatgaaccaacactagatgatgtcttgcaacctgggaagaatatggttgcagctggttattgcatgtatggaagctcttgcatgtttgtgttgagcactggaaatggtgttaatggtttcaccctcgatccatcccttggggagttcattcttactcatcctgatattaagattccaaagaaaggaaagatttattctgtaaatgaaggaaatgctaagaactgggatgatccaacagccaaatatgtggagaattgcaagttccccaaggatggctcttcaccaaagtctctaagatacgttggaagcatggtagccgatgtccaccgcacattcctttatggggggatatttttgtaccctgctgataagaagagtcccaacggaaaattgcgtgttctatatgaagtctttccaatgtcattcttggtggaacaagccggaggtcaggctttcactgggcagcaaagggcacttgatctaattccaacaaagatacacgagcgatctccaatatttcttggaagctatgatgatgttgaggaaatcaaagcactatatgctgcagaagcaaaaagggcgtaaaagaatcattcctcggtcacatatttacatagcctttaattattgtatgatggctacttgaccacattcctgagcatatattcatagaataaaactctctttcacaatttttttttttcaataggggatatgtttactggtgacaagaagtgagtgttggttgatttatttggaataatcccatctactcaaattggatgcgatcatttatcaacttcgagctttgataaataaatactaaactcttacagaattgaaagttaagaagaaagttgagcattgtaggtgcgaagtaaccttctagatgcatatggacatttcaactttgaattgtacatagcaatgactgaatggttattcatacctgaaagttgaaactggacaggacaacagaactctcacggaattacttaccagggaaatcccattacttctggatttaagttaccgactaagatgtttctgcaatcaatttgaagtttgcttgcctaataagttatcatgaccagtataccttgaattactggaacctaaacaacttttaatttctgaaatgactttattttccgccgttaaatacatacaccggatgctttatatgtagataataaaaaatcatattttaaattaaataa

SEQ ID NO: 2892 - DNA, 1185 bp, Ricinus communis
agagagagagagagagggagagaaagagatggatcacgcagcagatgcacacaggactgatttgatgaccataacaaggtttgtattgaatgagcaatcaaagcatcctgattctcgtggagatttcaccatcttgcttagtcatattgttcttggctgcaagttcgtttgctctgctgttaacaaggctggtcttgctaagcttattggacttgctggggagacgaatgttcagggtgaagagcaaaagaagttggatgtgctttcaaatgaagttttcatcaaggctttagtaagcagtggccgaacatgcattcttgtctcagaagaagatgacaaggcaacatttgtggagcctgccatgcgcggaaagtactgtgttgttttcgatccattggatgggtcctctaacattgattgcggtgtttctattggaacgatctttgggatttacatggtgaaacatggcaatgaaccaacactagatgatgtcttgcaacctgggaagaatatggttgcagctggttattgcatgtatggaagctcttgcatgtttgtgttgagcactggaaatggtgttaatggtttcaccctcgatccatcccttggggagttcattcttactcatcctgatattaagattccaaagaaaggaaagatttattctgtaaatgaaggaaatgctaagaactgggatgatccaacagccaaatatgtggagaattgcaagttccccaaggatggctcttcaccaaagtctctaagatacgttggaagcatggtagccgatgtccaccgcacattcctttatggggggatatttttgtaccctgctgataagaagagtcccaacggaaaattgcgtgttctatatgaagtctttccaatgtcattcttggtggaacaagccggaggtcaggctttcactgggcagcaaagggcacttgatctaattccaacaaagatacacgagcgatctccaatatttcttggaagctatgatgatgttgaggaaatcaaagcactatatgctgcagaagcaaaaagggcgtaaaagaatcattcctcggtcacatatttacatagcctttaattattgtatgatggctacttgaccacattcctgagcatatattcatagaataaaactctctttcacaatttttttttttcaataggggatat

SEQ ID NO: 2893 - DNA, 1403 bp, Ambrosia trifida
taccgggggttcgatctagtggataatatgcagtaatagtttgttacagcaggggtgttattgtaatttgcgtgattttgtccaccgatcaaatccaatcccttcttattctaactctgtcctttgaaccgaagcagttagtttcaattaatcaattgtattgttaacgatggatcacgaagccgatgctttccgtaaccgatttgatgacgattactcggttcgtgttgaacgagcaatcgaagtaccctgagtcacgtggcgatttcagtattttgctgagtcacattgttcttggttgcaagttcgtttgtgctgctgttaataaggcaggtttggcgaaactcattggacttgctggagagaccaatgtgcagggagaagaacagaagaaattggatgttttgtcaaatgaagtttttgtgaaggctttggtcagcagtggcagaacatgcatacttgtttctgaagaggacgaggaagcgataattgtagaaccatccaagcgtggaaagtattgtgttgttttcgatccgttggatggatcttccaacattgactgtggtgtttccataggaactatttttgggatttacatgataaaagatgctggcgctgcccgtttagaagatgttcttcagcctggaaagaatatggtggctgctggatactgcatgtacggtagctcttgcacgcttgtgttaagcactgggtctggtgtgaatggatttactcttgatccgtctttaggggagtttatactcactcaccctgacattaagatcccaaataaaggaaagatttattctgttaacgaaggaaatgccaagaactgggatggtcctaccgcaaagtttgtcgaaaaatgcaagttccccaaagatgattcacctgcaaaatctctaagatatattggaagtatggttgctgatgttcatcgcaccctactttacgggggcgtgtttttgtaccctgctgataagaaaagcccgaatggaaaactaagggttctctatgaagtcttcccaatgtcattcttgatggaacaagccggaggacagtcgtttactgggaaagaacgggctcttgacttggtccccaagaagatacatgaaagatctccaatattcttgggaagctatgatgatgtggaagaaatcaaggctctgtatgcagctgaagaaaggcaataaataaggttgttcttgtgcagttgtaattcccttgttctaaatccaggttttttataacttaattttgttataatttgttgtatttgatatatgtttatttattatcatgtaatattgtgatttttattcttatctacactacattataaaggagaaaaaatatctacaaatgtcattttacatgaaaaaagaaaaaaaataccgactgcg

SEQ ID NO: 2894 - DNA, 1679 bp, Cicer arietinum
atcttctaaaatatctatattatgtccaaacaaatataccaaccacaccacacatacaaattaaaatctatttcattcatctatcgtcgtaagtgtttgatttgaacggtttagttctaaaaaaaatattaattacaataattttaataataaaataaattagaataatagaattggtgaattaataaaagataggaaagtaaaaatagaagaaaagtaatagaagcgatgacgcaaggcacgcatatttatatatgagagttttgtacgttgtactaaattgcgtttggtactgagtgagtgaaaaagttggaaagttgattattgaattgaaagattgaaattggaagaaaaaatggaccacatcgcagatgcacaacgcacagatttgatgaccataacacgtttcgtattgaacgaacaatctaagcatcctgaatctcgcggcgatttcactatcttgcttagtcacattgttcttggctgtaaattcgtttgttctgctgttaataaggctggtcttgctaagctcattggacttgctggagagaccaatgttcagggtgaagaacagaagaagcttgatgttctttccaatgatgtgttcatcaaggctttgaaaagcagtggcagaacatgcatcttggtctctgaagaagacgaagaggcaatctttgtggagccatctcaacgtggaaagtactgtgttgtttttgatccattggatggctcctccaacattgattgtggtgtttccattggaactatttttgggatttatatgatgaaagataaccatgaaccaatcatagaagatgtcctgcaacctggaaagaacatgttggcagctggttattgcatgtatggaagctcttgcacgcttgtgataagcactggaagtggtgttaatggtttcacccttgacccatctcttggtgaattcattctcactcatcctgatattaagatcccaaagaaaggcaagatttactcagtaaatgaagggaatgccaagaattgggatggtcctactgcctcttatgtggaaaagtgcaagtttccaaaagatggttcatcagcaaagtctcttagatatattggaagcatggtagctgacgttcatcgcacattgctttatggaggtacctttttgtaccctgctgacaaaaagagtccaagtggaaaacttcgtgtattgtatgaagtcttcccaatgtccttcttgatggaacaggcaggaggacaggctttcactggcaaggaaagggcacttgatttaattccaacaaagttgcatgagagatctcccatatttcttggtagctatgatgatatagaggaaatcaaagctctttatgctgcagagggtaaataaaggaacatgagaagcttctataagctctttatgtctttcactacttgcaagcatttatatcaaattgttggtctaacaagtgcctataagaaaacttgtttacttgatcatatgtatatgttataagaatacttgttaatgtgcctaccatgtttataatcttttttttttaacaagccaaagagaataaatatattaacaaagactgtttaccacaaaagatgtgctgccattaatgaatagaaaaaatacaagacattcacaatacttatggaaaagaaacaccacaacttaataagcgaac

SEQ ID NO: 2895 - DNA, 1197 bp, Cleome spinosa
aagcgcgtctttatctcatcatcttcctcgaaatgggcgacacacaaaaaaggagggaaagattgtaaatttacatcaacccatttggcttctccctctagagattgaaggactttgttggtttcgtgtgcgagagggagagcgagagatggatcatgcggcggatgctcaccgtacggatttgatgaccataacgaggttcgtgttgaacgagcagtcaaagtatccggaatctcgtggggatttcactatcttgctcagtcacatcgttttgggctgcaaattcgtttgcagtgcagtgaataaggcaggtctagcgaagctcattggacttgcaggggaaaccaacattcagggtgaagagcagaagaagctagatgtgctctccaatgacgtctttgtcaaagcctttgttagcagtggcagaacgtccatccttgtctctgaagaagacgaggacgcaacgtttgtggaaccttccaagcgtggaaagtattgtgttgtcttcgatccgctcgatgggtcctcaaacatcgactgtggtgtttccattgggacgattttcgggatttacacgttgaagcacaacgatgaaccgaccatcgatgatgtcctacaaccgggaagcgagatggtggcagctgggtattgtatgtacggaagctcatgcatgctcgttttgagcgctggaaccggcgtcaatggatttacccttgacccatctcttggagagttcatactaactcatcccgacattaagattccgaaaaagggaaagatctattccgtaaacgagggcaatgccaagaactgggatggtccgactacaaggtacgtagagaaatgcaagtttcccgaagatggttcgcccccaaagtctctgagatatgtcgggagtatggtggctgatgtccatcgaacgctgctctatggaggtatctttttgtaccccgctgacaagaaaagccccaacgggaaattgcgagtcctctacgaagtcttcccgatgtcattcttgatggagcaagctggaggtcaggccttcaccggcaaggaacgggcgctagatctcgtcccgaggaagatccacgagcgttcgccgatattcctgggaagctacgaggatgtcgaagagatcaagactctctatgccaatgacgccaagaacgcataagctcctcagtctctctctctctc

SEQ ID NO: 2896 - DNA, 1160 bp, Medicago truncatula
aaagaatttggtacgtacgtagttgattggtttcggttacgattcattcattggaaagaagattttgaagattcatcgaaaatggaccacagcgcagatgcacatcgtacagacttgatgaccataacacgttttgtgttgaatgaacagtctaagcatcctgaatcacgtggagatttcaccatcttgcttaataacattgttcttggttgcaaatttgtttgttctgctgttaacaaggctggtcttgctaagctcattggacttgcaggagagaccaatgttcagggtgaagaacagaagaagctggatgttctttccaatgaggtgttctgcaaggctttgataagcagtggtagaacatgcatcttggtttctgaagaagatgaggatgcaatattcgtggagcctaagcagcgtggaaagtactgtgttgtttttgatccattagatggctcctccaacattgattgtggtgtttccattggaactatttttgggatttatatgatgaaagataaccatgaaccagtcatagaagatgctctgcaaccagggaagaacatgttagcagctggttattgcatgtacggaagctcttgcacgtttgtgataaccactggaagtggtgttaatggtttcacccttgacccttctcttggcgagtttatcctaactcaccctgacattaagatcccaaagaaaggcaagatttattcggtgaatgaagggaacgccaagaactgggatggtcctaccgctgcttatgtggagaaatgcaagtttccaacagatggttcaccagcaaagtctctaagatatattggaagcatggtagctgatgttcatcgtacattgctatatggaggtacctttttgtaccctgctgacaaaaagagtccaaatggaaaacttcgtgtattgtatgaagtcttcccaatgtccttcttgatggaacaggcaggaggtcaggctttcactggcaaggaaagggcacttgatttaattccaacaaaattgcatgaaagatctccaatatttcttggtagctatgatgatatcgaggaaatcaaagctctttatgctgcagaggctaaataagaggatcatgaaaaatttccttttgtttttcactacttgcaagcatttatatccaattg

SEQ ID NO: 2897 - DNA, 1062 bp, Pisum sativum
atggatcatgctggggatgcaatgcgtacggacttgatgaccataacacggtatgtgttgaatgagcagtccaaacgccccgagtctcgtggtgatttcacaattcttctcagtcacattgttcttggctgcaaatttgtttgctctgctgttaacaaggctggtcttgccaagctcataggacttgcaggggagactaacattcagggtgaagagcaaaagaagctagatgtgctctcaaatgaagtttttgttaaggctttgacaagtagtggccgaacttgcatccttgtgtctgaagaggacgaggaggcaacattcattgagccatctctgcgtggaaagtattgtgttgtatttgaccctctggatggatctttcaacattgactgtggtgtttcaattggcacgatatttgggatttacatggtcaaagattttgaaactgcgactcttgaagatgtcctgcaacctggaaagaatatggtagctgctggttattgcatgtatgggagctcttgcacgcttgttttgagcactggaagcggtgttaatgggtttactctagatccatctcttggagaatatattttaactcatccagacatcaagattccaaacaagggtaagatctattcagtgaatgaaggcaatgcaaagaattgggatggcccaacaacaaagtatgtggaaaaatgtaagttcccgacagatggttcatcacccaagtctctcagatacattgaaagtatggtagctaatgttcatcgcactttactatatggtggcatctttttgtaccctggtgataagaagagccccaacggaaaactaagagttctctacgaggtctttccaatgtccttcttaatggaacaagctggcggacaagcttttaccggcaaacaacgggcacttgacttgatcccgacaaaaatacatgaacgctcaccagtattcctcggcagctatgatgatgttgaagacatcaaagccctctatgctgctcaagagaagacggcctgaacgtcagcagttgttagatccatcttaaagtaactc

SEQ ID NO: 2898 - DNA, 1201 bp, Vinca minor
aaatggatcatgaagcggacgcgtatcgtactgatttgatgacaataacaaggtatgtgttgaatgaacaaacaaaatatccggcttctcgtggggacttctctatcttgcttagtcacattgttcttggctgcaaatttgtttgctctgctgttagcaaggcaggattggccaagctgattggtcttgcaggggagacaaatgtgcagggtgaggagcaaaagaaactggatgtgctctcaaatgaagttttcgtcaaggctttggtcagcagtggtcgaacatgcattcttgtctctgaagaagatgaactagcaacgtttgtcgctatgcctaatcgcgggaaatactgtgtggtttttgaccctttggatggatcctcaaacattgactgtggtgtctctattggaacgatctttggaatttacatgataaaggatgatgttactgaacctacattagaggatgtgttgcaacctgggaagaatatggtagctgccggctattgtatgtacggaagctcttgcatgcttgtgttgagcactggatctggtgtcaacgggtttactcttgatccttctcttggggagttcatacttactcatgctgatattaagattccaaagaagggaaagatttactcggtgaatgaaggaaatgcccagaattgggatgctccaactgccaactatgtggaaaaatgcaagttcccgaaagatggttcatcgccaaaatctttgagatacattggaagcatggtagcagatgttcaccgcacattactttacggaggtatctttatgtacccaggtgataagaagagtcccaatgggaaattgcgagttctgtatgaggtcttccctatgtctttcttgatggaacaagctggaggacaatcgttcactggcaagcaaccggcacttgacttggttcctcagaagatccacgaacgttcgcccatatttctgggtagttatgatgatgttgaggagatcaaagcactttatgaagaagagaaaaaatcataaatatgtaaaaaagtttcgtttgccctacaccctgatgtggaggtgttaaccactaatctctcttgtagcaaaaagtttattcattttgtttttagtttgtatgttgaaataaatgtcaaatactgccatggctaagcagatatattcatatatgaggaaaagtagcatttgca

SEQ ID NO: 2899 - DNA, 1323 bp, Glycine max
cttatttgattttttctacaaaattttcttgagccagcaagagtcacacatcataagaccgtgatctttaagcaggacaaaacaaaatctatcaaggaagccatatattggtatccaaattccaaacttgtgttgggtttggttccttgagttgagaggagtgaaaaaatggatcacagtgcggatgctcaacgcacggacctgatgaccatcacccgtttcgtgctgaacgaacagtcgaagcacccagagtctcgtggcgatttctcaatcctgctcagtcacattgttctcggctgcaagttcgtctgctctgctgttaacaaggcgggtcttgctaagcttattggacttgcaggagagacaaatgttcagggtgaagagcaaaagaaattggatgtcctatccaatgatgtcttcatcaaggcattgatcagcagtggacgaacatgcatcttggtgtctgaagaagatgaggaagcaacatttgtggaaccttctaagcgtggaaaatactgtgttgtttttgacccgctggatggttcctctaacattgattgtggtgtttcaattggcacaatctttgggatttatttgataaaagaagaccatgaaccaaccgtagaagatgttttgcaacctgggaagaacatgttggcagctggttattgcatgtatggaagctcttgcacgcttgtgttaagcactggaagtggtgttaatggtttcacccttgatccatctcttggggagttcattctaactcaccctgacatcaagatcccaaagaaaggcaagatctattcagtgaatgaaggaaatgctaaaaactgggatggccctactaccatgtatgtggaaaactgcaagtatccaaaagatggttcatcaccaaagtccctaagatatattggaagcatggttgctgatgttcaccgcacattgctttatggaggtatctttctgtacccggctgataaaaagagtccaaatgggaaacttcgtgtactctatgaagtcttcccaatgtcattcttgatggaacaagcaggaggacaggctttcaccggcaaccaaagggcacttgatttggttccaaagaagttgcacgagcgatctcccatattccttggtagctatgaagatgtagaggaaatcaaggctctttactctgctgatgaaaaataggaatgaagctggaagaaagctatctttgtctttcgctactcacaagcaattgttatctaattgttacacatgtcatgtatatgttaagaaaagttattaatgttttgtgatttagaaaaattattttattcctta

SEQ ID NO: 2900 - DNA, 1377 bp, Phaseolus vulgaris
gtggagtgattcttatttattatcatcatcagttcttttcgtcttcctcctcttaaatatataaacacatgcactcactaacttgttgtgtctgagtgggattaaagttgttaaggttatcgaaagttgttgggattgaaaatggaccacagtgccgatgcacttcgcacggacttgatgaccataacgcgcttcgtgttgaacgagcaatccaagcaccccgagtcacgcggcgatttcaccatccttctcagtcacattgtgcttggttgcaagttcgtctgcaccgcggttaacaaggctggacttgctaagcttattggactcgctggagagaccaatgttcagggtgaagaacagaagaagctagatgttctttccaatgaggttttcatcaaggctctcgtaagcagtggccgaacctgtatcttggtttctgaagaagatgaagacgctataattgtggagccttctaagcgcggaaagtactgtgttgtttttgaccccttggatggctcgtctaacattgattgtggggtttccattggcacaatttttggaatttatacgttagcagatgtccatgaaccaactgtagaggatgtcctgctacctgggaagaaaatggtggcagctggttattgtatgtatggaagctcttgcacgcttgtcttaagtactggagctggtgttaacggtttcacccttgacccatctcttggtgaattcatcctaactcaccctgacattaagatcccaaagaaaggaaagatttattcagttaatgaaggaaatgcgaaaaactgggatggtcctactgcagcttacgttgaaaaatgcaagtttccagaagatggttcatcgccaaagtctctaagatatattggaagcatggtagctgatgttcatcgtacattgctttacggaggcatctttttgtaccctggtgataagaaaaatcctaacggaaaacttcgtgttctgtatgaagtcttcccaatgtcatttttgttggaacaggcaggaggacagtctttcacgggcaaggaacgggcacttgatttagttccaacgaagttgcacgagcgatctcccattttccttggtagctatgatgatgttgaggaaatcaaagcgctttatgctgctgagggtaaagaagaatgatcctgaaagacacatgcatccttgtatttttggctactcacatgcacttgttttcccattgttattagcaggttcttgttcaaaacttcttaactgctctgtatttatgctaataaaagtggttaacgtgcctgtcatggttataaaatttatgtacataaaaaattatttagaataaagtagcaatttagcatcttactggagaagaac

SEQ ID NO: 2901 - DNA, 1234 bp, Tropaeolum majus
ggatcacgcagcggatgcaaacaggaccgatttgatgaccataactcgtttcgtactgaacgagcaaagcaagcaccctgagtctcgtggcgatttctccattttactgagtcacatcgttcttggttgcaagttcgtttgttctgctgttaacaaggctggtctggctaaacttcttggactggccggggacaccaacattcagggtgaggagcaaaagaaactggacgtgctctcaaatgatgtctttgtcaaggcattgataagcagtggtcgaacaagcattcttgtctctgaagaggacgaggaggcaacatttgtggagccttcgttgcgtggaaagtattgtgttgtttttgatccactggatggatcctctaacattgactgtggggtctccattggaacaattttcgggatttacatgatgaaagatatccatgaaccaactctagatgatgtcttgcaacccgggacgaatatgttggcagctgggtattgcatgtatggaagttcttgcacgcttgtgctgagcacggggaacggtgttaacggtttcacccttgacccctcccttggggagttcatattaactcactcagacattaagataccaaagaagggaaaaatctattcggtaaatgaaggaaatgctaggaactgggatgccccaacttccaagtttgtcgagaagtgcaagttcccgacagatggatcgtcgccaaagtctatgagatacatcgggagtatggttgcggacgtccaccggacattgctatatggaggtatttttttgtaccctgctgataagaagagccccagtgggaaattacgtgttctttatgaagttttcccgatgtcattcttgatggaacaagctggtggtcaggcattcaccggaaaagaacgggcactcgatttggtaccgaagaagattcacgagcgctcaccggtatttcttggcagctacgacgatgtggaggaaatcaaggcactctatgctgccgaagagaagaaggaataacttcttgttaatctcatctctcttgcttctaacagagttactccccaacctccagagcagtacatataatatttaagaagcctttgtatgtatgtgttgtagtttatatgtaagaagatacacagttttttttacatataaatggaagttataaattataattatctaataaatcatttaaataatattcgattaagatagaaaaaaaaa

SEQ ID NO: 2902 - DNA, 1422 bp, Cajanus cajan
tctctcactctactcttgccacgtgtcacaactgcaagcgtcccatctctttctccacccaaacctcgaactcaacaacctagtgaaccaaatttttattctcatcatcaattattaattaatcacacactgtgcatggttgttcccttgggatagcaatcggaagaaatggaccatcatgcggacgcacatcgcacggacttgatgaccatcacgcggttcgtgctgaacgagcaatccaagcaccctgaatcgcgcggcgatttcaccatcttgctcaatcacattgtcttcggttgcaagttcgtttgttcttccgttaacaaggctgggcttgccaagcttattggactcgctggagagaccaacgttcagggtgaagagcagaagaagctggatgttctttccaatgaggttttcatgaaggctctcaaaagcagtggccgaacttgcgtcttggtttctgaagaagatgaagaagcgacaatagtggagccttcgttgcgtggaaagtactgtgttgtttttgaccccttggatggttcctctaacattgattgtggggtttccattggcacaatttttgggatttatgcgttgaaagatgtccatgaaccaagcatagaagatgtcctgcttcctgggaagaacatggtggctgctggctattgtatgtatggaagctcttgcacgcttgtgttaagcactggagctggtgttaatggtttcacccttgacccatctcttggtgagttcatcctaactcaccctgacatcaagatcccaaagaaaggcaagatttattcagtgaatgaaggaaatgccaaaaactgggacggtcctactgcagcttacgttcaaaaatgcaagtttccagaagatggttcatcgccaaagtctctaagatatatcggaagcatggtagctgatattcatcgaacattgctttatggaggcatctttttgtaccctgctgataaaaaaaatccaaatggaaaacttcgtgtcctgtacgaagtcttcccaatgtcattcttgatggagcaggcaggaggacagtctttcacaggcaaagaacgggcacttgatttagttccaacgaagttgcacgagcgatctcccatagtccttggtagctatgatgatgttgaggaaatcaaagctctttatgctgctgagggtacagaaaaatgaaccttgaaagcttccttcttgtatcttttgctacttgcaagcacttgttattcaatttgttaccggcaggggcttatgagaaaacctgctatctggtcatgtacatgttaataaaagttgttaatgtgcctgctttggttttgattaaattaatattttgccatgttactgaagaaggataagtacttactttcccttgagatgcatttcaaagttgaactccacgag

SEQ ID NO: 2903 - DNA, 1377 bp, Chenopodium quinoa
acgacgaaattcgttatctgcagtctgcaagactgagaggcaggcagagagttttacctcatcatctccaaaccccactttctctcctcctttgacgtcccatcctaaattccctatattatcacaaacaaaaccaacaaccaattaactgttccaaactttgaggagagaaaatcacaggaagaagaagaagatggatcatgcagcagatgctaggtgcacggacttgatgaccataacacggtacgtgttgaatgagcagactaaacatcccgagtctcaaggcgatttcaccattcttctcagtcacattgttcttggttgcaaatacgtttgctctgctgttaacaaggctggtcttgccaagctcctaggacttgcaggagaaactaatgttcagggtgaagagcaaaagaagctagatgtgctctcaaatgaagtttttgtcaatgccttaacaagtagtggccgaacttgcattcttgtgtccgaggaggatgaagaggcaacattcgttgagccagctctacgtggaaagtattgtgttgtatttgatcctctggatggatcttccaacattgattgtggtgtttcaattggcacgatatttggtatttacatggtcaaagatttcaaaaatgtaactcttgatgaggtactgcaacctggaaagaatatggtggcggcaggttattgcatgtatgggagctcttgcacgcttgtcttgagtgctggaagcggtgtcaatggtttcactctagacccatctcttggagagtatattttaactcatccaaacatcaagatcccaaagagaggtaagatctattcagtgaatgaaggcaatgcaaagaactgggatggcccaacaacgaagtttgtagaaaaatgtaagttccccactgatggttcttcaccaaagtctcttagatacattggaagtatggtagctgatgttcatcgcactttactttatggtggcatctttatgtaccccggtgataagaagagccctgatggaaaactacgtgttctctacgaggtctttccaatgtcattcttaatggaacaagcaggtgggcaagcttttacaggcaaagaacgggcacttgacttagtcccaaagaagatccacgagcgctcgccggtgttccttggaagctatgatgatgttgaagacatcaaagccctgtatgctgctgcagcaaagaatgcttgagcttcagcatttgttggatccacctgaaatcccttctatcggatccaaagttgcacttcgtacattttacagtggttacaagcaaactatgtgcaagtatatatgctccataaatgtgcataacgtaggaatattgtacatttgtgtgagcactgatc

SEQ ID NO: 2904 - DNA, 1300 bp, Vinca minor
agctgctcctcatttccactccacttgaattgcgtgtaccatgagaggctgctatatctagatatggataatcagataataataataaccataaataaataaccaaaattttccaatttagtcctctccactgatatataatccccaattttctattttctactatatatatatacttgaattttcaactcaattccttgaagaaaactctctttgattttttgggttgtaagaaaatggatcatgcagcggatgcccaacgtacagatttgatgaccataactcggtatgtgttgaatgagcaatcaaaacatccagcttctcgtggggacttcactatcttgcttaatcacattgttctgggctgcaaatttgtttgctctgctgttagtaaggcaggattggccaagctgattggtcttgcaggggagacaaatgtgcagggtgaggagcaaaagaaactggatgtgctttcgaatgaagtttttgtcaaggctttggtcagcagtggtcgaacatgcattcttgtctctgaagaagatgaactagcaacttttgttgctaagcctaatcgtgggaaatactgtgtggtgtttgaccctttggatggatcctcaaatattgactgtggtgtctctattggaactatctttggaatttacatggtaaaggatgatgttgttaccgaaccaacactagaggatgtgttacaacctgggaagaatatggtagctgctggctattgtatgtacggtagctcttgcaatcttgtggtgagcacgggatctggtgttaacgggtttactcttgatccttctcttggggagttcatacttactcatgctgatattaagattccaaagaaaggaaagatttattcggtaaatgaaggaaatgccaagaattgggatggtccaactgccaaatacgttgaaaagtgcaagttcccaaaagacggttcatcaccaaaatctttgagatatattggaagcatggtagccgatgtacaccgtacattactttatggaggtatctttatgtacccaggtgataagaagagtcccaatgggaaattgcgagttctttacgaggtctttcctatgtctttcttgatggaacaagctggagggcaatcgttcactggcaagcaacgggcacttgacttggttcctcagaagatccacgaacgttcaccaatatttctcggtagttattatgatgttgaggagatcaaagcacttatgcagaagaggaaaaagtaataaataatgtaaaatttagatttgccctttcctgttgt

SEQ ID NO: 2905 - DNA, 1410 bp, Picea glauca
tttaagataagatgcccttcatttcattattatcattccacttcggtatttaaacaaacaaaccacgggccgggaggaaggctgaatttaattgaatttccttggatttaatttggaggaaagaacatggaccacgcagcagatgcctatcgcacagatctcatgactatcacgcgattcgttctgaacgagcagtctaagtatcctgaatcgcgaggagatttctccattttgctcagtcacattgtcctcggatgcaagtttgtatgctctgccgtcaacaaggcaggtctggctaaactcattggccttgcaggagagaccaacgttcagggcgaagagcaaaagaaattagatgtgctctccaatgaagtatttgtcaaggctcttgtcagcagtgggcgcacgtgcattttagtttcagaagaggacgaggaggccacctttgtggagcattcgaagcggggaaagtattgtgtagtcttcgacccactcgacggctcttccaacatcgattgtggagtgtcaattgggacaatatttggaatatacttggtgaaggatggagcagagccgaccgtgggtgatgttctcaaaccaggcaaaaacatggttgcagcaggttattgcatgtacgggagttcctgcacgcttgtgctgagcagcggcagtggtgtaaatggctttacactggacccttccctgggggaattcattttgactcatcccgacataaggataccaaagaaagggaatatatattcggtgaacgaaggcaatgcaaagaactgggatgagccaaccaggaagtatgttgagagatgcaaatttccccaggatggatcatctcccaagtctctcagatatatcggaagcatggtagctgatgtgcacagaaccttactgtatggcggtattttcatgtaccctgcggataagaagagtcccaatggaaaattgcgtgttctgtatgaagtgttccccatgtcattcttaatggaacaagcaggaggtcaagctttcacaggaaacataagagcacttgatctggttcccactaagattcaccagcgttcccctgtctttcttgggagttatgatgatgtggaggagattaaggctttgtacgctgcacaggaaggaaaggcgtaaaagtccatccaggattaggcaattgtagttgctcaggattgattcactatttttcaaaactaaaaaatatgaatgcccatttaatgttatttttaagcaaacatgaaccaagtcaaaccactgaaatctgtactgtcactgatttcttatatttgtactatgcagtatatgtgtccttgaacatggatatatttgatgtccattacaagtctgtattttaatgaaaaaaattaatgttaatccgtatatgattatttt

SEQ ID NO: 2906 - DNA, 1221 bp, Chenopodium quinoa
gacgaaattcgttatctgcagactgcaagactgagaggcaggcagagagttttacctcatcatctccaaaccccactttctctcctcctttgacgtcccatcctaattccctatattatcacatacatacccaccaaccaatcaactgttccaaactttaaggagatagaaaatcaaaggaagaagaagatggatcatgcagcagatgctaggtgcacggacttgatgaccataacacggtacgtgttgaatgagcagactaaacatcccgagtctcaaggcgatttcaccattcttctcagtcacattgttcttggttgcaaatacgtttgctctgctgttaacaaggctggtcttgccaagctcctaggacttgcaggagaaactaatgttcagggtgaagagcaaaagaagctagatgtgctctcaaatgaagtttttgtcaatgccttaacaagtagtggccgaacttgcattcttgtttccgaggaggatgaagaggcaacattcgttgagccagctctacgtggaaagtattgtgttgtatttgatcctctggatggatcttccaacatcgattgtggtgtttcaattggcacaatctttgggatttacatggtcaaagatttcaaaaatgtaactcttgatgaggtcctgcaacctggaaagcatatggtggcagcaggttattgcatgtatgggagctcttgcacgcttgtattgagcactggaagcggtgtcaatggtttcactctagacccatctcttggagagtatattctaactcatccaaacatcaagatcccaaagagaggtaagatttattcagtgaatgaaggcaatgcaaagaattgggatggcccaacaacaaagtttgtagaaaatgtaagttccccactgatggttcttcgccaaagtctctcagatacattggaagtatggtagccgatgttcatcgcactttactttatggtggcatctttatgtaccccggtgataagaagagccctgatggaaaactacgagttctttacgaggtctttcctatgtcatttttaatggaacaagcaggcggacaagcttttacaggcaaagagcgggcacttgacttgatcccaaagaagatccacgagcgctcgccggtgtttcttggaagctatgatgatgttgaagacatcaaagccctgtatgctgctgcagcaaagatgcttgagcttcagc

SEQ ID NO: 2907 - DNA, 1203 bp, Arabidopsis thaliana
gattcaaacgcatttggtaggctgagagaaagaaagaaaaagataaagatggatcacgcagcagatgctcaccgtacggatttgatgaccattacaagattcgtgttgaatgaacaatcaaagtatccagaatctcgtggtgatttcaccattttgcttagtcacatcgttttgggttgcaaattcgtttgcagtgctgttaataaggctggtttggctaagttaattggacttgcaggggaaacaaacattcagggtgaagagcaaaagaaacttgatgtgctctctaatgatgtctttgtcaacgctttggttagcagtggtagaacttctgttcttgtctcggaggaagatgaggaagctacgtttgtggagccatccaagcgtggaaagtactgtgttgtttttgatccgcttgatggatcttcaaacattgactgtggtgtttccattggcacaatttttggaatttacacgttggaccacactgatgagccaaccactgcagatgttctgaaacctgggaatgaaatggtggctgcaggttattgtatgtacggaagctcctgcatgcttgtgttgagcactggaaccggtgtccacggatttacactggacccatctctaggagagttcattctaactcacccggacattaagattccaaataagggaaacatttattcggtgaatgaaggcaatgcgcagaactgggatggtccaactacaaagtatgtagagaaatgcaagtttcctaaagatggttctcctgcaaagtctctgagatacgtaggaagtatggtagctgatgttcatcgtacactactttatggaggaatcttcttgtacccggctgacaagaaaagccccaatggaaaattgcgtgtcttgtatgaagttttcccgatgtcgtttttgatggagcaagccggaggtcaggcctttacgggaaagaaaagggcgctagaccttgtcccggagaagatccatgagcgttctccgatatttcttggtagctacgatgatgtagaagagattaaagctctctatgctgaggaggaaaagaagaactaagcttctcattcttcttttattctcttactgtctctgtctctcttatttctatatacagtatcttcttctgatgagaagaacaatataactcatttacaaaaggaagatctttctttatcattaaatgca

SEQ ID NO: 2908 - DNA, 1489 bp, Gossypium hirsutum
ttacactctttcctccccaggaaaacagtcattatcctactccacctcgaaaaggcaaaacccaatctctaatttctcctttatagttgttttgttactgtcattgctctgttgggtcacttccttttttttctttgtcttttgttttgtgtttttggagggagaagagagatcatggatcatgcagcagatgctcataggactgatttgatgaccataacacgtttcgtgttgaacgagcaatccaaatatcccgagtctcgtggtgatttcaccatcttgctcaatcacatcgttcttggttgcaagtttgtttgctcttctgttaacaaggctggtcttgccaaactcattggacttgctggggagatcaatattcagggtgaggagcaaaagaaactggatgtgctttcaaatgaagtctttatcaaggctttagtgagcagtggcagaacttgcatccttgtctcggaagaagatgaagatgcaattattgtggagccctcaaagtgtggaaggtactgtgtagttttcgatccactcgacggttcctccaacattgattgtggtgtttctattggaacaatttttgggatttacatggtgaaagatgaccatgaaccaacactagctgatgtgctgcaacctgggaagcaaatggtagctgctggctattgcatgtatggaagttcttgcacgcttgtgttgagcactgggaaaggagttaatggattcacccttgatccatctcttggagagttcatactaactcacccagacatcaggattccaaagaaagggaagatctattcagttaatgaaggaaatgccaagaattgggacggacctacggctaagtatgtcgaaaattgtaagttccctaaggatggttccccttcgaagtctctgagatatattggaagcatggtagcggatgtccatcgcacgttactctacggagggacctttatgtaccctgctgataagaagagccccagtggaaagctgcgtgttctctatgaagtctttccaatgtcctttttgatggaaaatgccggaggtcaagcgttcactggaaagcaacgggcacttgacttggttccaactaagatacatgataggtcaccaatatttcttggcagctatgatgatattgaagaaattaaagcactctatgctgctgaagggaaaaaggaatgagtgtacaattctcattcttctccactctatctttactggattcaggtttcaatcatcaaagtatttaatccatttcaaagcttattctgtaatgggatactatatttatattgaacaatagttaagtttccccaaaagatatgggatgagaataaaaagaagttattttaactgttatgcttgatatttttttatcatataattactagtctgtaatattatttactatttacttgaaaaatgatggtatgaaacagggatattatttatttttaatagtttaatatca

SEQ ID NO: 2909 - DNA, 1335 bp, Vigna unguiculata
catatgcataagcatgtaatgtaagtatatcatcactttgtgggttagtgaagagtgaaagatggatcacagtgcggatgctcaacgcacagacttgatgaccataacccgtttcgtgctgaacgaacagtcgaagcaacctgaggctcgcggcgatttcacaatcttgctcagtcacattgttcttggctgcaagttcgtttgttctgctgttaacaaggcgggtcttgctaagcttattggactagctggagagacaaatgtccagggcgaggagcagaagaaactggacgttctttccaatgatgtctttgtgaaggctctggtcagcagtggacgaacatgcatcttggtgtctgaagaagatgaggaagcaacatttgtggagccttctaagcgtggaaagtacatagttgttttcgatccgctggatggttcctctaacattgattgtggtgtttctattggcacaatttttgggatttatttggtgaaagaaaaccgcgaaccaaccatagaagacgttttgcaacccgggaagaacatgttggctgctggttattgtatgtatggaagctcttgcacgtttgtgttaagcaccggaagaggtgtgaatggtttcacccttgatccatctcttggagagttcattcttactcaccctgacatcaaggtcccgaagaaaggaaagatctattcagtgaatgaaggaaatgctaaaaactgggatggtcctactaccaagtatgtggaaaactgcaagtttccaaaagatggttcatcaccaaagtccttaagatatgttggaagcatggtagctgatgttcaccgcacatttctttatggaggtatctttctgtacccggctgataaaaaaagtccaaatgggaaacttcgtgttctctacgaagtcttcccaatgtcattcttgatggagcaagcaggaggacaggctttcaccggcaaggaaagggcacttgatttggttccgacaaagttgcacgagagatctcccatattccttggtagctatgaggatgtggaggaaatcaaggccctttatgctgctgatcaaaaattggaatgaaagaaaccataattctttgtcttttccaacttacagtcaattctcatctaattgttgcacagatacattgccatgtatatatgtcaagaaggcttgttaatggtttgtgatttacaaaaggtattatattacgtgatatccaaatacattttaatttaataatttcaatatatagcaatattttaatttttgtagatagttttctgatgatttcttgattattataatgttaaaattgcattttgtct

SEQ ID NO: 2910 - DNA, 1208 bp, Glycine max
ttgtgcgttgagagataagtgcaagaagaaatggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcagggcgaagagcaaaagaaactggatgtcctttccaatgatgtctttatcaaggctttggtcagcagtggacgaacatgcatcttggtgtctgaagaagatgaggaagcaacatttgtggaagcttctaagcgtggaaaatactgtgttgtttttgacccgctggatggttcttctaacattgattgtggtgtttcaattggcacaatctttgggatttatttgataaaagaagaccatgaaccaaccattgaagatgttttgcaacccgggaagaacatgttggcagctggttattgtatgtatggaagctcttgcacgcttgtgttaagcactggaagtggtgttaatggtttcacccttgatccatctcttggggaattcattctaactcaccctgacatcaagattccaaagaaaggcaagatctattcagtgaatgaaggaaatgctaaaaactgggatgaccctactaccaagtatgtggagaactgcaagtatccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggcaaccaaagggcacttgatttggttccaaagaagttgcacgagcgatctcccatattccttggtagctatgaggatgtcgaggaaatcaaggctctttacgctgctgaggaatgaagctggaagaaagcattctttgtctttcgctacttacaagcaattgttatctaattgttacacacatacatggtcatgtatatgttaagaaaacttgttaatgttttgtgctttagaaaaattatttcattagttatatctaaatattttaaattttaata

SEQ ID NO: 2911 - DNA, 1301 bp, Arabidopsis lyrata
atcctctcatcatcttcctcgaaacgtacaacacacaaaaattgtctataaagattgcaaatttcaatcattaaatatctgattcaaaacgcatttggtaggctgagaaagaattaggatcacaaaggatggatcacgccgcagatgctcaccgtacggatttgatgaccattacaagattcgtgttgaatgaacaatcaaagtatccagaatctcgtggtgatttcaccattttgcttagtcacatcgttttgggttgcaaattcgtttgcagtgctgttaataaggctggtttggctaagttaattggtcttgcaggagaaacaaacattcagggtgaagagcagaagaaacttgatgtgctctctaatgatgtttttgtcaaagctctggttagcagtggaagaacttctgttcttgtctcggaggaagatgaggaagctacgtttgttgagccatccaagcgtggaaagtactgtgttgttttcgatccacttgatggatcttcaaacattgactgtggtgtttccattggaacaatttttgggatttacacgttggaccacactgatgagccaaccactgaagatgttctgaaacctgggaatgaaatggtggcggcgggttattgtatgtatggaagctcctgcatgcttgtgttgagcactggaacgggtgtccacgggtttactctcgacccatctctaggagagttcattctaactcacccggacattaagattccaaataagggaaacatttattcagtgaatgaaggcaatgcgcagaactgggatggtccaactacaaagtatgtagagaaatgcaagtttcctaaagatggttctcctgcaaagtctctgagatacgttggaagtatggtagccgatgttcatcgcacactactttatggaggaatcttcttgtacccagctgacaagaaaagccccaatgggaaactgcgtgtgttgtatgaagttttcccgatgtcgttcttgatggaacaagccggaggtcaggcctttacgggaaagaaaagggcactagaccttgtcccggagaagatccatgagcgttctccgatatttcttggtagctacgacgatgtagaggagattaaggctctgtatgctgaggaggaaaagaagaactaagcttctcattcttctttttttctcttactgtctctgtctctcttattcctatatacagtatcttcttctgatgagacgaacataactcatttacaaaaggaagacctttctttaccttaaatgcacataaaaatcttccttctttca

SEQ ID NO: 2912 - DNA, 6027 bp, Cannabis sativa
aaaaaaaaaatgaaagaaaagaagtaaaagattgtatagatctaatatataataatatcaaaacaccattcaatcaaagtgtagaggtttagttagcttattaactttttcccatatagatttcttctggttgcctctgtctattactataaaacaacattaaatcatcatcaagtaattaaagaaacttataagttctgtttgataattggataggccttctgcagcatattggttgtagtaaatacttgagctagtattatggatcaagggactcatcaacatagtctttgtgataatgctggagcaaaactacatcatttttatttcgacgatcaatagcatgaattagccagagataatgtgctccaagtgaccaggttaaatcctaagaactgacagacttaattttgtctaaaaagtatcgaatacaacaccagaaacttaataataacatattatattacattttcctatcaaaatttgtagatagcaccaaaaaaacaaaatctaattggagtaatatctctaatggaaagagctaaaaatatatttacatttaaaactccacataaatatatatataacaaaccacatagtttgattaattgattcaaacaagaattattcaaacatatatacttatttgtataaagtcaatgaaatagtttgtttgcatgatagcctttaagcttaagcaaatacaaggatgtataattgtattaaatattcaaagtcaaatagagtggtgtctcgtaaaagaatttattcatgaaacaggatatatggcaaacttttatttgtaataacatttttacaagtgcaatgcatgaccaaaacatataacttgatgagttttgagtaagaaaagacttgtccatgggctgcacctatttcattaaatcatttcaagaaagaaactaaagatcacatgcatatacaaggaaaccaaaccgaataacacacaaaaatattaaattaaagggttacatggtattgcaaatatggttttcatataaatcaatgtcaatgacattaatagaagtcttatatttatataaacacagaaaatacaattatagaacttatataattgtgttgtacaagtatttttacatgctatatatcatcataaatttatagaagaattcaaagacataaattaaatcacatttcgtttgcaattgaactattaagtagaacaaaatgccaaatcattgaacgaagtataagaaaaaaaaaaaaaaatacacaaatttgggtaaatagagaaaataaggtaaatgatagtaagaagaaaacactaaacaatgtaaacctggtttttcatacaagctaagtgaaaagagtttttcagaaaaatattcaactaatagaaatctgtagagttgaattaatttgaaattttaggtctaataataaatataaactaattaccattgaatcagcatggcccaaacaacttttaattcttataaaaccctaaactcagatcaaagatactctacacaataaataaaattaaacatgactttgaaaaataaataaatcaatataaatgaaagtaaaagaaaaaatatcagaaccttttgatatccatgatcaaagtgagcattaaggtagcacagatagctagcgtgagatttgagaacaagagactttgggttctaatgcgtgtcaatttttttttggagaaaagtggcaatgaagtaggtgaagcaggattagggataagtggagaggataggcggtgaacaaaaaaaatatataattgtatgaaaaatacaataaacccacttcaaccagctacaatagaagggtattattgtcctttaagcaggacgtgaagatgagtcttattatatataagatatcttcactgacatatgaaatattgagcactactaataccgagtaatgatgctcactaattaagttataatacattatgggaaagaaataatagttttgaaccaatagatctaattgagccattaatacccattgaaattaacaattccttttgactaaattacacacataacccgattctatgccaccaataaattcaatttataaattataaataaatgcatgccaagtaagcttaaagactaatctgagtcgataagaatttagagtgagagagagataaagcttacgcctcaccagtcaccaccacgtcagaaaggaagaggcaggggtacaaaggaatacaaaacacaaaattaaggacttatttgcaattacacaaatataaaaaaaacaaactaaaataacggccctcgtctgcatatattgtacataagataatgacaaaaacctgggaaccgtcgaatcagatgaccgtgaaagacgacgagaggcgttatctgctgtgaccgactgacgaccaccaacgcctgccacgtgtcatcagaagcttcctcttcacacaaaaggaagaagaacccaatccccccaaattcccaatctatatctatccatggcttctctcagtgtataaaaaaggaatctttcttgtttttcgtttggcctcgaaccgagcacctccaccaccaccgcatcatcatcatcatcatcatctaatatccaaaaagaaacaacctttaccatctttctcttttgggtcatttggttttttctttttttccattggggattttcgtcgaacagagagatggatcacgaggccgacgcttaccggacggatttgatgaccattacgaggttcgttttgaacgaacagtctaagcatccagagtctcgtggtgactttactatcttgctcagtcatatcgttttgggatgcaaattcgtttgctctgctgttaacaaggctggtctggccaaactcatagggcttgctggagagactaatgtacagggtgaagagcagaaaaagcttgatgtgctttcaaatgaagtttttgtcaaagctttgattagcagtggtcgaactagcattcttgtgtcagaagaagatgaagaagcaaccattgtcgacaaatccatgcgtggaaggtactgtgttgtttttgatcctttggatgggtcctccaacattgattgtggtgtttcgattgggacgatatttgggatttatgctatcaaagatgatcatgaacctggtcttgatgatgtcttgcaacctgggaagaatatggtggctgctggctattgcatgtacggaagctcttgcacgcttgtgttgagcactggggaaggtgtcaatggattcactcttgatccttctcttggggagttcatactaactcaccctaacatcaagattcccaagagagggaagatttattcagtgaatgagggaaatgccaagaactgggatggtccaacttctaagtatgtggagaaatgcaaataccctactgatggttcttctcctaagtctctgagatacattggaagcatggtagctgatgttcaccgcacattgctatatgggggtatcttcttataccctggtgataagaagagccccaatgggaaactacgtgttctgtatgaagttttccccatgtcattcctgatggagcaagccggaggtcaatctttcaccggcactcaaaggtcactggatttggttcccaagagcatccatgaacgttctccgatatttctcggtagctatgatgatgttgaggatattaaggcactctatgctgctgcagagaagtaagaataaggctcatggtggttggcatccttgtactaagtatataactcatctattttgttgttacactgaaatcctttctaatcatctattcccaagatgaaactatattgtaagtatacaatacaatcatcaacaaataaacaagttccaatctttctttatattgaataagcaagttccaattcattttcatattctttttcatgaattaataaacatatattgttttctttaataacaacaagcttcaaatgggtggccattttcttttcaacaattcattttcatattctttttcatgaattaataaacatatattgttttctttaataacaacaagcttcaaatgggccgggacattataatcgatatgtaaagggtatgtttggttagaggataatggaatggaatagaaaagaattttggtgaattttgtattaaagtttatttcattcctattcttatccttattcttatggttcctgaaaaagtgaaatttattcacaatgttatatcaagtatggcatgcattctaaagcaattaacaccaaaaaatcaagatgggaccttaaattaacaccaaaaaatagattgagcagtgaaaaatcaagtacatgagttttggaatttgattgatattttatcatttaatatctattgtgaagcagaggaacaacagaaaagcaaattagcaaagtagggtaacttctctcattctgcatgaacattacaaggaatgtgagaaagctagtctaaaatttaagcaatttcattcattcaatttcagccatgttaaaagtacaactgaactcttcatacttgatagggagtatcacaaaaaccgttctttctaataatcagaaaaaaaaaaaaaaacacacattaacacattccgattacgtttcctaattaatcaagctgtcctcaaaggaggagaaacaagaataacaccatctcctctaacaaagagaaaggggaccattcgctttgtagtctgaaataaagaagtgtaaattagtaatcaaatatgttcatccctcagagcaaaagaaatgacaaaacaaagaaccaatgaaaaatactatttctttatttatctaactctgtattcagttttataggcagccccgttttcatgcacttcaattcaaattagcttctttgacactatagtatagattcaaagtcaaaatggaatataaacatgcaagtaaaatgcccttggctacttgcctaacgggttcttcgaatatgtcatgaattcatttcagtgatgcagtgtcattataaaatatctcacagtaattttccattcaaaaagaagaacaactttcttcgaaatcgagaacgacatcgaaaatcttttagctttatgtgagcatacttgtgcttagataaacagaacaatgactatctggttcaaagttacccaatagttactatttccacttccacatttaaactctaaaaataacaaccataaaatcaaacatacccgtactatctcttcataagtttcatcatcaatttctacagtggtcactacttcttcaacatcaccaagaatcatatttaaatgttgatcatatgcctgcacatacaaagcccacaaaaagaagaaaatctatcatgacaactaatacaatggtagaaatatccagcaacagaatagggttctcttcactagtatcgccccaaaacaaacaatttagtattgaaaggaacaattatcagtaaatgagcaatttaggtttcaagtttgaaccaagaaaaaagaaaaccctcaaaagtgctcatctttatctaatcaacaatacaatactaaccctctctacaaatttcgaccaattgcaaaggtttaaccacagaataacaacacagttaaaaccctaaaccctaaacattgttccgggtaccaatcgaatcgaataaaagctggaaaactaaaccctagacgatagtagtattgaaaagaagagcaatggaatggtacggaaaccctaaaatgtgcatagagagagaaagagagagaggggggtacggggtaccaatcgaatcgaataaaagctggaaaactaaacctagacgatagtagtattgaaaagaagagcaatggaatggtacggaaaccctaaaatgtacatagagagagaaagagagagaggggggtacatggagcttgccacggagctcgcggtcggagcgaagcttgacgtagatgcgctcgtcgaggctgagcctgatgagatccaaaggctccttcactgcgctttcttcttcggtggccattttcttttcaacaactctgctttttcctataacaacac

SEQ ID NO: 2913 - DNA, 1339 bp, Gossypium raimondii
tctcctttatagtggttttgttacagtcatagctctgttgggtcacttcctttttttttctttgcttttgttttgtgtttttggagggagaagagagatcatggatcatgcagcagatgctcataggactgatttgatgaccataacacgtttcgtgttgaacgagcaatccaaatatcccgagtctcgtggtgatttcaccatcttgctcaatcacatcgttcttggttgcaagtttgtttgctcttctgttaacaaggctggtcttgccaaactcattggacttactggggagatcaatattcagggtgaggagcaaaagaaactggatgtgctttcaaatgaagtctttatcaaggctttagtgagcagtggcagaacttgcatccttgtctcggaagaagatgaagatgcaattattgtggagccctcaaagcgtggaaggtactgtgtagttttcgatccactcgacggttcctccaacattgattgtggtgtttctattggaacaatttttgggatttacatggtgaaagatgaccatgaaccaacactagctgatgtgctgcaacctgggaagcaaatggtagccgctggctattgcatgtatggaagttcttgcacgcttgtgttgagcactgggaaaggagttaatggattcacccttgatccatctcttggagagttcatactaactcacccagacatcaggattccaaagaaagggaagatctattcagttaatgaaggaaatgccaagaattgggacggacctacggctaagtatgtcgaaaattgtaagttccctaaggatggttccccttcgaagtctctgagatatattggaagcatggtagcggatgtccatcgcacgttactctacggagggacctttatgtaccctgctgataagaagagccccagtggaaagctgcgtgttctctatgaagtctttccaatgtcctttttgatggaaaatgccggaggtcaagcgttcactggaaagcaacgggcacttgacttggttccaactaagatacatgataggtcaccaatatttcttggcagctatgatgatattgaagaaattaaagcactctatgctgctgaagggaaaaaggaatgagtgtacaattctcattcttctcccactctatctttactggattcaggtttcaatcatcaaagtatttaacccatttcaaagcttattttgtaatgggatactatatttatattgaacaatagttaagttcccccaaaagatatgggatgagaataaaaaaaagttattttaactgttatgcttgatatttttttatcatataattactagtct

SEQ ID NO: 2914 - DNA, 1137 bp, Vitis vinifera
tgcttgcttcctttttcaaaaccctaaccgctgtctttgcctgggcaattcgggacgatggatcacgaggctgattctcaccgcaccgatttgatgaccataacgcgttatgtgctgaacgagcagtccaggcatcccgagtcgcgcggtgacttcaccatcttgctcagtcacattgtgctcggctgcaagttcgtctgcactgccgttaataaggcgggtcttgccaaactgattggacttgctggagagaccaatgttcagggtgaagagcaaaagaaactggatgtgctttcgaatgaagtttttatcaaggctttagtaagcagtggccgaacatgcatccttgtatctgaagaggatgaagaagcaacaattgtggagccatctaagcgtggaaggtattgtgttgttttcgatcccttggatggatcctctaacattgactgtggtgtttccattggaaccatctttgggatttatatggtgaaagatggtggtgagccaactcttgataatgtgttgcaacctggaaagaatatgttggcagctggttattgcatgtatggaagctcttgcacgcttgtgttaagcactggaactggtgttaatggatttacccttgatccatcacttggggagttcatacttactcacccaaacattaagattccaaagaaaggaaaaatttactcagtaaatgaaggaaacacaaagaattgggatgctccaacagccaagtatgtggaaaaatgcaagttccccaaagatggttcatcaccaaaatctctacgatacattggaagcatggtagctgatgtccaccgcacattactttacggtggtatctttttgtaccctgctgataagaagagccccaacggaaaactgcgtgttctctatgaagtctttccaatgtcattcttgatggaacaagcaggaggtcaagcttttactggaaagcaacgggcacttgacttagttccaaagaatatccacgaacggtctccaatattccttggcagctacgatgatgttgaagaaattaaagcactctatgctgctgaagagaagccctgttgcaatagagaatgtccaaggaaagaatgaatgcaggcatctccaaaatgtagataa

SEQ ID NO: 2915 - DNA, 1521 bp, Pinus pinaster
aggggaggtcatgcaaagaattactgccgcttgacacgtggaagcaaatcgtccactggacgctgataatacacactatctttccaccttacagcgtgtgatctccatcccctggacgcgcgtggcctagaaaatcggatttaagataagataaccttcctttcattatttttatcacacttcggtattaaacggacagaccacaggcagagaggaagaggctgaatttaattgaatttccttggattgaatttggaggaaagaacatggaccacgcagcggatgcctatcgcacagatcttatgaccataacgcgattcgttctgaacgagcagtctaagcatcctgaatcgcgaggagatttttccattttgctcagtcacattgtcctcggatgcaagtttgtgtgctctgccgtcaacaaggcgggtctggctaaactcattggccttgcaggggagaccaatattcagggggaagaacaaaagaaattagatgtgctctccaatgaagtatttgtcaaggctcttgtcagcagtgggcgcacgtgcattttagtttcagaagaggatgaggaggcgacctttgtggagcattcacagcggggaaagtattgcgtagtcttcgatccactcgacggctcttccaacatcgattgtggagtgtcaattgggacgatatttggaatatacttggtgaaggaaggaggagaggcggccctgagtgatgttctcaaaccaggcaagaacatggttgcagcaggttattgcatgtacgggagttcctgcacgcttgtgctgagcagcggcagtggtgtaaatggctttacactggacccttcccttggggaattcattttgactcatcccgacataaggataccaaagaaaggaaaaatatattcggtgaatgaaggcaatgcaaagaactgggatgagccaaccaggaagtatgttgagagatgcaaatttccccaagatggatcatctcccaagtctctcagatatattggaagcatggtagctgatgtgcacagaaccttactctatggcggtattttcatgtaccctgcggataagaagagtcccaatggaaaattgcgtgttctgtacgaagtgttccccatgtcattcttaatggaacaagcaggaggtcaagcttttacaggaagcatacgagcacttgatttggttcccactaagattcaccaacgttcccctgtctttcttgggagttatgatgatgtggaggagattaaggctctgtacgcagcacaggaagggaaggtttaaaagtccgtccatgaataaggcaattgtattttctaaggattgatgactaattttagaaacaaaaatatgaatgcccagaagaaaacattatttttcattattttttaagcaagccaaaccacgaaatatgtaatgtcactgaattctcagatttgtaccatgcagtatatgtgtacttgtacatgcatatagtgcgtgtccataacaagtctgtatcttaatgggaaaa

SEQ ID NO: 2916 - DNA, 3911 bp, Pseudotsuga menziesii
gttaaattaattgaatttccttggattgaattcgtggggcaaagaacatggaccacgcagcagatgcctatcaaacagatctgatgaccataacgcgattcgttctgaacgagcagtcaaagtatcctgaatcgcgaggggatttctccattttgcttagtcacattgttctcggatgcaagtttgtatgctctgccgtcaacaaggccggtctggctaaactcattggccttgcaggagagaccaacgttcagggcgaagagcaaaagaaattagatgtgctctctaatgaagtatttgtcaaagctcttgtcagcagtggtcgcacgtccattttagtttcagaagaggatgaggaagctacctttgtggagcatacaaagcggggaaagtattgtgtagtcttcgatccactcgacggctcttccaacatcgattgtggagtgtcaattggtacgatatttggaatatacttggtgaaggatggaggagaggcatccttgagtgatgttctcaaaccaggcaagaacatggttgcagcaggttattgcatgtacgggagttcttgcacgcttgtgctgagcactggcagtggtgtaaatggctttacactagacccctcccttggggaattcattttgactcatcctgacataaagataccaaagaaagggaaaatatactcagtgaacgaaggcaatgcaaagaactgggatgaggcaaccaggaagtacgttgagagatgcaaatttccccaggatggatcatctcccaagtctctcagatatattggaagcatggtagctgatgtgcacagaactctactctatggtggtattttcatgtaccctggagataagaaaagtcccaatggaaaattgcgtgttctgtacgaagtgttccccatgtcattcttgatggagcaagcaggaggtcaagctttcacaggaaacatacgagcacttgatctggttcccactaagattcaccagcgttcccctatttttctggggagttatgatgatgtggaggagattaaggttctgtacgctgcacaggagggaaaggcatgaagtccatccatggatagccaattgtattttctcaggatagattaactaattttcaaaattaaaaaatatgaatgcccataagaaaacattaatttgtcatttaatgttatttttaagcaggccccaacaaatcattgtaatctgtaatgtcactgaattctatatatttcaagtatgcattctatgtgcgtttgtacatgcatatattcgatgtccattacaagtctgtattttaatgaaaaaatctaaatattaatgggagaagggaacatgtcggcttcaattttcttttgggtatttttctcaccacgtcaggtttagaaaacacgatatattgagtgacaggtgttggagagggcaagattgcggtttgagcgtaagcatataatgctaatgtcaatctttctgggcagtagactgtcgttgcggatggcacattgataggaggagggggagtggagcggaaggtgacagaaaaaaatttgaaaacacagagacgaaagagggcagagttcgttgaacttccaccatttttattattcttcaaaaccaaattctttggattgtgaattgggttttttctttgtttttagatagagagatatcgttattatcatcaatggcagcagtagcggcaccacagtttcctccactggcttctctgtatgtaggggatctcgacccagaggttacagacagccaacttcatgagttcttcatgactatgggaagtgtgacctctgttcgagtatgccgggatagcatgacccagcgctcccttggatatggatatgtcaattatcttgacccttcagatgctagggatgccattgaagctttgaactacaaaaaattgaatgagaaacccattcggatcatgtggtctcaccgagacccaatatcacgcaggagtggagtgggaaacgtatttatcaagaatcttcatgagaatattgggaatgcaagtcttcatgataccttcattaaattcgggaacattttatcgtgtaaagtagcgacccatgatgggaaaagcaagggatacgggtttgtacattttgaaacagaggaatctgcaaacgaagccatagagaaggttaatgggatgctgatagagggcaagcaagtatatgtgggaaagttcattaaaaggaatgataggattggatcttctgccgatcaaaaattcaccaatttgtatgtcaagaacttggaagattatgtaactgaggagcttttgtctgagaagttctcaaagtttggcaaaatctctaatgtagttgtaatgagggatgaaaatggcaatccaaggggatttggatttgtcaactttgaagatccagatgatgctaaaacagcagtggagagtatgaatggtgtgcagataggtaataagctcatatatgttggaagggctcaaaagaaggcggagcgtgagcagatgttgcggcggcaatatgaagagagacgccaagagcggatattaaaatctcagggatcaaatctatatgttaaaaacattgatgattcaattgatgatgatgaactgcaaagagtatttagtcattgtggaatgatcacttcagctaaagtaatgcgggatgagaagggactcagtagaggctttggatttgtttgctttacaactcccgaagaagcaaagaaagctctggtagaattatctgggtctatgttgcatagtaaacctctttatgtagctattgcccagcgcagggaggttcggcgcatgcagttacaagcccgttttgcccagcctatgccagccctttctggacctggaggggcttctgttccttctacatatccagctatgtattatacacctactcctggtgttgtcccacatttgcccccacgtcaaggcatcatgtatccacctagtttaggcttaagaccagcaggatggaggccatcaggtggtttggcccctccacaaagacctactttccaacatgtgccacttgctgtgatttcaaataatcccaggcaacaaaggcaaccgagagtacgtatgactggacccatgcttcctcagccaggtcaaccaatggcctatgtgacaccattgcaacaacaggccatggccccagctacatacaaagatatggctggaaatcagcagcgtccttggtactctggggctgcaaaatacacacctaatggtcgacctcgtgaaatgaataatatgacacagacttcagttcccaacgctggttttgcaccccaaactgcaatgaatggatctgcatctattgctggagcgagttctgtagtagcaacaaatcaagcatcggaggtatggagcagtgtgctggctgctgcaacaccacaacaacagaagcagatgcttggggagcgcttgtttcctcttgttcaaaatcatcagtttgaacttgcaggtaaaattactgggatgctgttggagatggacaataatgagttgttgcttttgttggagtcgcctgattccttggctgccaaggtagaggaagctgtccaagtcctcaaaatgtccaagtcgaaggtgtcagctcaagatcctcacactggaaatttcttggctggagagattgccgtcaactgatagttttgtagtgtgaatttattttttgatagtacattcattccggctttcttaatatacataaatggttgagtgagagaatcaacaaatttgaagttgaaacattagtctagctttttgtgcctcagcattcttctataacttttctggtctgattaaccatggaggttatattagctctattctttgattaatttttaaagggcaatgcaccataaaatttgaaattcctg

SEQ ID NO: 2917 - DNA, 1235 bp, Amaranthus tuberculatus
atttgatgacaataacacggcatgtgttgaatgaacaatccaaacgacctgaatctcgcggtgattttaccattcttcttagtcatatcgtgctggggtgtaaatttgtttgctctgctgttaacaaggctggtcttgccaagctcataggacttgctggggagactaatgttcagggtgaagagcaaaagaagcttgatgtactttcaaatgatgtctttgtcaaggccttgataagtagtggtcgaacttgcattcttgtgtcagaggaggatgaggaggcaacctttgttgagccatccttgcgtggaaagtattgtgtcgcctttgatcctctggatggatcttccaacattgactgtggtgtttcaattggcactatctttgggatttacatggtcaaagattttaataatgtaactcttgatgatgtcctaaaacctggaaagaatatggtagctgctggttattgcatgtatggaagctcttgcacgcttgtcttgagtactggaagcggtgtcaatggtttcacacttgacccatctcttggggagtttattttaactcatccagatatcaagatcccaaagaaaggtaaggtctactctgtgaatgaaggcaatgcaaagaattgggatggcccaacaacaaagtatgtgcagaagtgtaagttccctgaagatggctcaccaccaaagtctctcagatacattggaagtatggttgctgatgttcatcgcactttactatatggtggtatctttatgtaccctggtgataagaaaagaccctaacggtaaacttcgggtcctctatgaggtctttccaatgtctttcctaatggaacaagctggtggacaagcttttaccggcaaacaaagggcactcgacttggtccctacaaagatacacgagcgatcgccagtattccttggcagctatgacgatgttgaagacatcaaagctctgtatgctgccgaagagcagaaggcctgagcatccgcaaatgctagactgcaccataattttctctttcgaatttaaataagctgcattacacagtggttacatatgaattatgctggtatatatgctccagaaatgtgcataacataggagtatttacattgattaattgtcaaacaactatatttcaaattaatgtcaatggtcaaaatatctggtgtatacctccttgcattttttgttcgatcttgaatgtatgatcattcaac

SEQ ID NO: 2918 - DNA, 1463 bp, Daucus carota
tgttactttatatatatatgggggggggctcctcgatttgtgtgattagattttcacacaaactgacgctttatatagataaaaaatctcgaatatcaatttgaggaaaaagagatggatcactcagcagatgcattccgcacggacttgatgaccataacgaggttcgtgttgaacgaggcttctaagtacccggaatctcgcggtgatttttcgattctcatcagtaacattgttctcggctgtaagtttgtttgtgctgctgttaacaaggccgggttagccaagctcattggacttgctggtgagaccaatgttcagggcgaggaacaaaagaaactggatgtgctctcgaatgaagtttttgtcaaggccttggtcagcagtggccggacatgcatccttgtctctgaagaagatgaagaggcgacttttgtagagacaaccaagaggggaaggtattgtgttgtttttgatccgttggatggatcctcaaacattgactgtggtgtttcaattggaactatatttgggatctatatgatgaatgatggagaagaacctactttagaaggtgcattgcaacctgggaagaatatggtggctgctggttactgcatgtatgggagctcatgcacgtttgtgatgagcactggatctggagtgaatggctttacccttgatccatctttgggggagttcatcctcacccatccagacattaggatcccaaaaaaggaaagatatattcagtgaatgaaggaaatgcaaagaattgggatggaccaacagcaaagtatgtggagaagtgcaagttccctacagatggttcaccggcaaaatctctaagatacatcggaagcatggtagcagatgttcatcgcactttactctatggtggtatatttttgtaccctgccgataagaaaagccccactggtaaactaagggtcctctatgaagtcttccccatgtctttcttgatggagcaagctggaggtcagtcatttaccggcaaggaaaggtcgctggacttggtaccgaagcatattcatgagaggtctcctatatttcttggtagctacgacgatgttgaagaaatcaaagccctgtatgctgctgaagcaaaaaattcgtagtcctttcgtgtaaagatggaagttgaaatatgtgttgcagttaatctgctgatacttactgaattatatattcaatggtagaacctgatctttcatgaagatgtattagtacattaataaactcttctctaattatgacaggtatgccgttgacacaaatataaaatgttgtagtacatattgggaagtaaggcagtataatcctatatttgtagtccaaagttaatcagggtcaactaccatctcgctcagttgcgtccatgcccctgaatgtagtatggcactatggctatggcctaatcacacaaaataaaggaaaaattg

SEQ ID NO: 2919 - DNA, 1389 bp, Petroselinum crispum
tctaaaataaaaaatccaagggatggatcactcagcggacgccttccgtacggatttgatgaccataacaaggttcgtgttgaacgaggcttccaagtaccctgaatctcgcggtgacttttccattttgctcagtaacattgttcttggttgtaagtttgtttgtgctgctgtcaacaaggcaggtttagcaaagctcattggacttgctggtgagaccaatgtgcagggtgaggagcaaaagaaactggatgtgctctcaaatgaagtttttgtcaaggccctggtcagcagtggccgaacatgcatccttgtctctgaagaagatgaagaggcgacttttgtagagacatccaagaggggaaggtattgtgtcgtttttgatccattggacggatcctcaaacattgactgtggtgtttctattgggactatttttgggatctatatgctgaaagagggagaagagcctactttagaaggtgcattgcaacccgggaggaatatggtggctgctggttactgcatgtatggaagctcatgcacgtttgtgatgagcactggatctggagttaatggatttacccttgatccatctttgggggagttcatactcactcatccagacattaagatcccaaaaaaggaaagatatattcagtgaatgaaggaaatgcaaagaattgggatggtccaacagcaaagtatgtggagaagtgcaagttccctacagatggttcaccagcaaaatctctaagatacatcggaagcatggtagcagatgttcatcgcactttactgtacggtggtatatttttgtaccctgccgacaagaaaagccccagtggtaaactaagggttctttatgaagtcttccccatgtctttcttgatggagcaagctggaggtcagtcatttaccggcaaagaaagatcacttgacttggtgccgaagcatatacacgacaggtctcctatattccttggtagttacgacgatgtcgaagaaatcaaagccctctatgctgctgaagcggaaggaaagaaataatactcctttcatgtaaagaaaaagttcagttccgtattgcagttaatctgctgctacttactgatttatatttccatggtagagcctgatatttcatgaagatgtattagtacattaataaactcttctctaatgataacaggtatgccgttaacacaaaaatatactataaagtacaatattaagacaatagataatcatatactaattgaaggttcatcagggtcagttgtcatctctctatagtatagatcaataacagtgaatataaattacacaaggcctatatacattctcagtttcttagcatataatttcttttaattagaaggtaatcat

SEQ ID NO: 2920 - DNA, 1409 bp, Manihot esculenta
tcgaatccagcaatttctcacctcagctgatcccttatatctcttattgatgctcttgtaatctcactcgtcaagcttaaatttttatggttttcttgtagtaaattttgtgggttgagcgagagagggagagagagatggatcacgcagcagatgcccaccggaccgatttgatgaccataacgaggtttgtattgaatgagcaatcaaagcacccggcttctcgtggggatttcactatcttgctcaatcatattgttcttggctgcaaattcgtttgctcagctgttaacaaggcgggtctcgccaagcttattggacttgctggggagacaaatgttcaggcaagttgttattggggtgaagagcaaaagaaactggatgtgctttcaaatgaagtattcatcaaggctttagtaagcagtggacgaacatgcatacttgtctctgaagaagatgatgaggcaatatttgtggagcctggcaagcgtggaaagtactgcgttgtgttcgatccattggatggatcctccaacattgactgtggtgtttctattggaacgatctttgggatttacatggtgaaacatggcaatgaaccaactctagatgatgttttgcaacctggatcaaatatggttgcagctggctattgcatgtatggaagctcttgcatgcttgtgttgagcactggaagtggtgttaacggttttacccttgatccatctcttggggagttcatacttacacatcctgatattaagattccaaagaaaggaaagatttattcagtaaatgaaggaaatgctaagaactgggatggtccaacggccaaatatgtagaaagatgcaagttccctaaggatggttcctcaccgaagtctctaagatacgttggaagcatggtggctgatgtccatcgcacattactctatggggggatatttttgtaccctgcagacaagaagagtcccaatgggaagctgcgtgtgctgtatgaagtctttccaatgtcatttttgatggaacaagcaggaggtcaatcatttactggcaagcaacaggcacttcacttggttccagagaagatacaccagcgatctccaatatttctgggcagctatgatgatgttgaggaaatcaaagcactctatgctgctgaaaatgcagaagcttagagtgcagtaagaatcattctcttatatgtggccttattaattgtaatgtggctacttgaccactcttctaatattatatttataggctaaaaatctctttctcaagtttctttcaataagatgatagtttatcagtgataactagtttttggttaatatattttaaataatgttaaaatcattttgttgaagtggtttgaatggaagttcatgtgcttcatgattctcaat

SEQ ID NO: 2921 - DNA, 1339 bp, Quercus alba
tatatatatatatatacactctgagtttgacctctaaccgagcaccaaggtgtttggagagagagggagagaagagagaaaagaaaaggaagggggggaaaatggatcacgcggcggaggcaaacaggacggacttgatgacaataacaaggttcgtgctgaatgagcagtcgaagtacccagagtcacgcggcgatttcaccatcttgcttagtaacattgttctcggctgcaagttcgtctgcactgctgtcaacaaggcaggtcttgccaaactcattggacttgctggagagaccaatgttcagggtgaagagcaaaagaaactagatgtgctttcaaatgacgtttttgtcaaggctctgataagcagtggccgaacatgcatccttgtatcagaagaggatgaactggcaacatttgtggagccatctaagcgtggaaggtatgctgttgttttcgatccactggatggatcctccaacattgattgcggagtttcaattggaactatctttgggatttatatggtgaaagatagtattgaaccaactctagatgaggttttgcaacctgggaagaatatgttggcagcaggctattgcatgtatgggagctcttgcacgtttgtgttgagcactggagctggtgttaatggcttcacccttgatccatctcttggggagttcattctaactcacccagatatcaagattccaaagaaaggaaagatttattcagtaaacgaaggaaatgctaagaactgggatggtccaacagctaagtatgtggaaaggtgcaagtttccaaaagatggttcttcaccaaagtctctaagatacattggaagcatggtagctgatgtccatcgcacattactctatgggggtatctttttgtatccagctgacaagaagagcccaaatgggaaactgcgtgttctctatgaagtctttccaatgtcattcttgatggaacaagcaggaggccaggctttcaccggcaagcaacgggcgcttgacttggttccaaacgacatacatgagcgatctccaatatttcttggcagctacgaggatgttgaggaagtcaaagctctttatgctgctgaagataagaaataaattcataagttttattttattattactacccacatagccttagcaatttatgcagctactccaaaatgattggggtcttcattgcaaaatcagggtctaggccaatttcatcatccatccataagacaaactctttttgaagataaactctttttgaggcttctttgtaatgagatgatacattctattgatggataaataaggtcaagtttata

SEQ ID NO: 2922 - DNA, 1173 bp, Castanea mollissima
ggatcacgcggcggaggcaaacaggacggacttgatgacaataacaaggttcgtgctgaatgagcagtcgaggcatccagagtcacgcggcgatttcaccatcttgcttagtaacattgttctcggctgcaagttcgtctgcactgctgtcaacaaggcaggtcttgccaaactcattggacttgctggagagaccaatgttcagggcgaagagcaaaagaaactagatgtactttcaaatgacgttttcgtcaaggctctgataagcagtggccgaacatgcatccttgtatcagaagaggatgaacaagcaacatttgtggagccatctaagcgcggaaggtatgctgtcgtttttgatccactggatggatcctccaacattgattgcggagtttcaattggaactatctttgggatttatatggtgaaagatagtattgaaccaactctagatgaggttttgcaacctgggaagaatatggtggcagcaggctattgcatgtatgggagctcttgcacgtttgtgttaagcactggagctggtgttaatggcttcacccttgatccatctcttggggagttcattctaacccacccagacatcaagattccaaagaaaggaaagatttattcagtaaacgaaggaaatgctaagaactgggatggtccaacagctaagtatgtggaaaggtgcaagtttccaaaagatggttcttcaccaaagtctctaagatacattggaagcatggtagctgatgtccatcgcacattactctatgggggtatctttttgtatccagctgacaagaagagcccaaatgggaaactgcgtgttctctatgaagtctttccaatgtcattcttgatggaacaagcaggaggccaggctttcaccggcaagcaacgggcgcttgacttggttccaaaggacatacatgagcgatctccaatatttcttggcagctatgaggatgttgaggaagtcaaagctctttatgctgctgaagataagaaataaattcataagttttattttattattaccacccacatagccttagcaatttatgcagttactccaaaatctttggggtcttcaatgcaaaatcagtgtctaggccaatttaatcttccatccataaatactctttttgaggtttctttgtaatg

SEQ ID NO: 2923 - DNA, 1428 bp, Phaseolus vulgaris
aaaaaagagggatgtcatgcactgaccaaatctcgctggtagatttagtccacggttgccacctcagtagtcttctttttaataatactcaacatctctcgtcttcttcctattaaatagataaatatattcactaactaacttgatgtttccgatgtgggattaagttgttcagtttattgaagattgttggaattgaagatggaccacagtgccgatgcacatcgcacggacttgatgaccataacgcgcttcgtgttgaacgagcaatccaaacaccctgagtcacgcggtgatttcaccatccttctcagtcacattgtgcttggttgcaagttcgtttgcaccgccgttaacaaggctggacttgcgaaacttattggactcgctggagagaccaatattcagggtgaagaacagaagaaactggatgttctttccaatgaggttttcattaaggctctcgtaagcagtggccgaacctgtatcttggtttctgaagaaaacgaagacgcgataattgtggagccttctaagcgtggaaagtactgtgttgtttttgaccccttggatggctcgtcaaacattgattgtggggtttccattggcacaatttttggaatttatacgttagcagatgtccatgaaccaactgtagaggatgtcctgcttcctgggaagaaaatggtggcagctggttattgtatgtatggaagctcttgcacgcttgtgttaagtactggagctggtgttaacggtttcacccttgacccatctcttggtgaattcatcctaactcaccctgacattaagatccctaacaaaggaaagatttattcagtaaatgaaggaaatgccaaaaactgggatggtcctactgcagcttacgttgaaaaatgcaagtttccagaagatggttcatcgccaaagtctctaagatatattggaagcatggtagctgatgttcatcgtacattgctttacggaggcatctttttgtaccctggtgataagaaaaatcctaacggaaaacttcgtgttctgtatgaagtcttcccaatgtcatttttgatggaacaggcaggaggacagtctttcacgggcaaggaacgggcacttgatttagttccaacgaagttgcacgagcgatctcccattttccttggtagctatgatgaagttgaggaaatcaaagcgctttatgctgctgagggtgaagaagaatgatcctgaaaaacatgcatccttgtatttttggctactcacatgcacttgttttcccatttttattagcaggttcttattgaaaacttcttagctgctatgtatttatgctaataaaagtggttagcgtacctttcatggttataaaatttatgtatataaaaattatttagaataaagtagcaatttagcatggtcctgttt

SEQ ID NO: 2924 - DNA, 1249 bp, Catharanthus roseus
agtcagccactcccttgaattgagtacctctagcctccagataatcagataaaccattaaaaatatataaatatacactaattttcctccaattagttctgtccaccgaaatataagcgccattctttactatatatacttctttttcaactgatttcttcaagaaatctattagtttccttcttgggtttgtaaagatacagaagaaaattgtacgaaaaaaaaatggatcacgcagcggacgcacagcgtactgatttgatgaccataacaaggtatgtgttgaacgagcaaacaaagtatccggcttcgcgtggggatttcactatcttgcttaatcacattgttctgggctgcaaatttgtttgttcttctgttagtaaggcaggattggccaagcttattggtcttgcaggggagacaaatgtgcagggggaggagcaaaagaaactggatgtgctttcaaatgatgtttttatgaaagctttgatcagcagtgggcgaacatgcattcttgtctctgaagaagatgaactaccaacatttgttgataagcctaatcgtgggaaatactgtgtggtatttgaccctttggatggatcttcaaacattgactgtggggtctctattggaactatctttggaatttacatgataaaggatgatgttactgaaccaacattggaggacgtgttgcagcctgggaagaatatggtagctgctggctactgtatgtatggaagctcttgtatgctcgtgataagcactggagctggtgttaatgggtttactcttgatccttctcttggagagttcatacttactcatcctgatatgaagatcccaaagaaaggaaagatttactcagtgaatgaagggaatgccaagaattgggatggtccaacagctaaatatgtggaaaagtgcaagttcccaacagatggttcatcaccaaaatctttgagatacattggaagcatggtagccgatgttcaccgcacattactttatggaggtgtctttatgtacccaggcgataagaaaagtcccaatgggaaactgcgagttctctacgaggtctttcctatgtcattcttgattgaacaagctggaggacaatcattcactggcaagcaacggtcacttgaccttgttcctcagaagatacacgaacgttccccaatatttctcggtagttatgatgatgttgaggagatcaaagcactttatgcagaagagcaaaaggcat

SEQ ID NO: 2925 - DNA, 1257 bp, Cleome gynandra
agtacgcggggaagcgcgtctttatctcatcatcttccctcgaaatgagcaacacacaaaggaaggaataaattcgtagctttatatcgacccatttgactctagatattgaagggcggtgttgttgtctatagggaaagatggatcacgcggcggatgctcaccgtacggatttgatgaccataacgaggttcgtgttgaacgagcagtcaaagtatccggagtctcgtggggatttgacgatcttgctcagtcacatcgttttgggctgcaaattcgtttgcagtgctgtgaataaggcaggtcttgcgaagctcataggacttgcaggggagaccaacgttcagggtgaagagcaaaagaaactcgatgtcctctccaacgacgtctttgtcaaggccttaattagcagcggcagaacttccattcttgtctcggaagaagatgaagaggcaacatttgtggaaccatccaagcgtggaaagtactgtgttgtatttgatccgcttgatggatcctcaaacatcgactgtggtgtttccattggaacaatttttggaatttacactatgacgcacgataatgaaccaaccatagatgatgtcctacaacctgggaccgagatggtggcagctgggtattgcatgtatggaagctcttgcatgcttgtgttgagcactgggaccggcgtcaatggattcacccttgatccgtctcttggagagttcatactaactcaccctgacataaagatgccgaagaaaggaaagatctattcggtgaatgaaggcaatgctaagaactgggatcgtgcaactaccgcgtatgtggagaaatgcaagtttcccgaagatggttcatccccgaagtctttgagatacgtcggaagtatggtggctgatgtccatcgtacactgctctatggaggtatcttcttgtaccctgctgacaagaaaagccccaatgggaaattacgtgtcctgtacgaagtcttcccaatgtcattcttaatggaacaagccggaggtcaggcctttaccggcaaacaacgggcgttagatcttgtcccgcagaagatccacgagcgatcaccgatatttcttggaagctatgaagacgtagaagagatcaagactctctatgccgcagaggccaagaacgcataatctccttagtctctttttgcttatctgtctctaataatccaaaggccttcaacaaggctttccatctgtaatgatacaatgatacatcact

SEQ ID NO: 2926 - DNA, 1185 bp, Sarracenia psittacina
atcgaaatgggtaactgatctttcgccattaatcgatcagaaatacgaaaacctaaccctagaggtattcgcaccagagtgatcgaaagatggatcatgctgccgatgcttacaggacggatttgatgaccatcactcgcttcgtactcaacgagcagtcgaagcatcccgaatcgcgcggtgatttcaccatcttgctcagccacatcgtcctcggttgcaagttcgtttgctctgctgtgagcaaggcgggtcttgctaaactcattggacttgctggtgaaaccaatgtgcagggtgaggagcaaaagaaacttgatgtgctctcaaatgaagttttcattaaggccttggtcagcagtggtcgaacatgcatccttgtctctgaagaggatgaagaggcaacttttgttgaggcatctaagcgtggaaggtactgtgttgtttttgatccactggatgggtcctctaacattgattgcggtgtttccattggcacgatatttgggatttatacggtgaaagatgttgaagaaccaactttagatgatgtgctgcaaccaggaaaaaatatgctggctgcaggctattgcatgtatggaagctcttgcacgcttgtgttaagcactggaagtggcgttaatggatttactcttgatccatctcttggggagtttatactaactcatccagacattaagattcctgaaaagggaaaaatctattcagtaaatgaaggaaatgccaaaaactgggatggtccgacagcgaagtatgtggaaaagtgtaagttccctaaggatggatcatcatcaaagtctctaagatacattggaagcatggtggctgatgtccatcgcacattactttatggtggtatcttcttgtaccctgctgataagaaagtcccaagggaaaactgcgtgttctttacgaagtgtttccaatgtcattcctggtggaacaagctggagggcaggcatttacgggcaagctgcgggcacttgacttgattccagagaagatacacgatcgatctccgatatttctgggtagttatgacgatgttgaagaaattaaagcactctatgctgctgaagagagtatatgaatatatttcccacatgctgcttgtgcagatgctaaacttggtaactgtttattaattcatccatttattagata

SEQ ID NO: 2927 - DNA, 1159 bp, Chrysanthemum coronarium
acacgattcgtgttgaacgaacagtcgaaacatccggaatcacgtggtgattttagtattttgcttagtcacattgttcttggttgcaagtttgtttgtgctgctgttaataaggcgggtttggctaagctcattggacttgctggagagaccaatgtgcagggagaagagcagaagaaactggatgttctttcaaatgaagttttcgtgaaagctttggtcagcagtggcagaacatgcatacttgtttctgaagaggatgaagaagcaataattgtagaaccatctaagcgtgggaagtattgtgttgtgtttgatccgctagatggatcctccaacattgactgtggtgtttccattggaactatttttgggatctacatgataaaagacggtgatgatccctctttagaagatgtactgcagcctggaaagaatatgctggctgctggatactgcatgtatggtagctcttgcacgtttgttttgagcactggatctggtgtgaatggttttactcttgatccatctctaggagagtttatactcacccatccggacatcaagatcccaaagaaaggaaagatctattcggtcaatgaaggaaatgctaagaactgggacggcccgactgcaaagtttgtggaaaaatgcaagtaccccacggatggttcatctgccaaatctttaagatatattggaagtatggttgctgatgtccatcgcacattactttatgggggtgtgtttttgtaccctgctgataagaagagcccaagtgggaaactaagggttctgtatgaagtgttcccgatgtcgttcttgatggaacaagctggaggacagtcgtttactggaaagatacggtcacttgacttggttccaaagaagattcacgagcgatcccccatcttccttggaagctatgatgacgtggaagaaatcaaggcattgtatgcggctgaagagaaagcataagaaaagtgtttaaagagttaaaagggtaattgatctcatctccattttcttgtgcaggttctatttgacatttctttgtttataaaaccatgctccactctttgttcccttttttcacatatgtaataaaaaaggctaccttttaatcaatagttttgaactgttgtagacagtagtcgcg

SEQ ID NO: 2928 - DNA, 1266 bp, Cucumis melo
taatttttttgattgtgcaaaaggggtttttcacagcaccatggatcacgccgcggatgctcagaggacggacttgatgaccattactcgcttcgtcttgaatgagcaatccaagtaccctgaatcccgtggtgatttcaccattttgcttagtcatattgttcttggctgcaagttcgtctgctctgctgttaataaggcaggtttagctaaacttattggacttgctggagagaccaatgttcagggtgaagagcaaaagaaactggatgtgctctcaaatgaagtctttatcaaagctttggtcagcagtggcagaacttgtattcttgtttctgaagaagatgaagagccaacatatgtcgagccatctcggcgtggaaggtattctgtggtgttcgatccactggatggttcctccaacattgattgtggtgtttccattggaacgatttttggaatttatcacttgaacgacagccacgaacctaacctagaagacgtcttgcaacctggaaagaatatggtggctgctggctattgcttgtatggcagctcttgcacacttgttttaagtactggaactggtgttaatggattcactctcgatccttctcttggggagttcattttaactcacccagaccttaagattccaaagaagggaaagatctattcagtgaatgaaggaaatgcaaagaactgggatggtccgactgcaaagtatgtagagaagtgcaagtttcctactgatggttcgcctcccaagtctttgagatatgttggaagcatggtagctgatgtccatcgtacattgctttatggtggtatatttttgtaccctggtgacaagaagagccccaatgggaaattgcgtgtgttgtatgaagttttcccaatggcgttcttgatagaggaggcaggaggtcaagcattcactggaaaaataagggcacttgacttggttccaaagaagatacatgagagatctcccatatttcttggtagctatgatgatgttgaagaaatcaaagctttgtatgctgctgctgaggagtgaatgaaggacttcaaaacctagaaccaagttacttgtgattcatgttggcttccttgcaagttgtcccttcttttagtgtttctaattgtaattgcatttgttcctatagaatttcaatgccttattggttgttcttagttctttaatgataatgaatgcataaagtgtggccatgagaatggttttctttcgctcggaacaacggg

SEQ ID NO: 2929 - DNA, 1472 bp, Allium cepa
gaaattcactcatcattccatcagcaaacaaaacgaaataatgaaaaatcgttatctccacggcaaccactgaacttttctttctcatcttagcctgccacgtgtcaagaaaccttctgagctcttatctcgatttcgtgcgtgcccttaaaaataccacctttcatcgtttccctcgtttcaaaatttcattctaaaaggtataaaaatatccgataaagcctatctttatagaattctgcgaaaaatggatcacgctgccgatgcattccgaactgatttgatgacgattacgaggtttgtgctgaatgagcagtccaagcatcctgaatcgagaggtgatttcacgatcttgctcagtcatatcgtgcttgggtgcaaatttgtttgctctgctgttaataaggctggccttgcaaaacttataggacttgctggagaaactaatgtccagggtgaagagcagaagaagctggatgtgctttcaaacgaagtctttgtcaaagcattaataagcagcggtcgaacttgtattcttgtttcagaagaggaagaggaggcaacatttgtggatccagcattgcggggaaaatatgcagtagtctttgatccgcttgatggttcctcaaatatcgactgtggtgtttctgttggaactatatttggaatatacttgattgaaaataaggatgaagctaaacttgaagatgttctgcaatcagggaatagtatggtagcagcaggatattgcatgtatgggagtttctgtgagcttgtgattagcacagggaatggtgtcaatggtttcactcttgatccatctcttggagagtttattttgactcatccagacataaaggtgcccaagaaaggcaaaatatattctgtaaatgaaggaaatgccaaaaactgggatgaaccaacggcgctgtatgttgacaaatgcaaatttcccaaggatgattcctctgcaaaatcattgagatatgtggggagcatggttgccgatgtccatcgaacattgctttatggaggaatatttttgtaccccgcagacaagaagagtcctactggaaaactacgtgttctctatgaagtttttccaatgtccttcttgatggaacaagctggtggtcaagcttttactggcaaagaaagggcacttgacttggtccctaaaaccattcatgaaaggtctcctatattcctagggagctacgatgatgtagaagaaatcaaagcactctatgcagctaaagaggccaaagcgtgatcgtataagttgatttacctgcttcccatatcaattcacatagcaattaccaggcttgataataacacactactcaagtgtttgatctataattcaatcatatatgattcttcttgtccaattccttttcatcctatagcaaaattaaaattcagtcctaagcaatgtcttattgcgcctaattatttgattgattttt

SEQ ID NO: 2930 - DNA, 1245 bp, Phaseolus vulgaris
ctcatatgtacatgcagtgttgaagtcatcatcatcactttgagggttcgtgaagagtgaaagatggatcacagtgcggatgctcaacgcacagacttgatgaccatcacccgtttcgtgctgaacgaacagtccaagcaacctgaggctcgtggcgatttctcaatcttgctcagtcacattgttctcggctgcaagttcgtttgttctgctgttaacaaggcgggtcttgctaagcttattggacttgctggagagacaaatgtccagggtgaggagcaaaagaaactggacgtcctttccaatgatgtctttgtcaaggctctggtcagcagtggacgaacatgcatcttggtgtctgaagaagacgaggaagcaacatttgtggagccttctaagcgtggaaagtacattgttgtttttgatccgctggatggttcctctaacattgattgtggtgtttccattggcacaatttttgggatttatttggtgaaagaaaacggtgaaccaaccatagaagatgttttgcaacctgggaagaacatgttggctgctggttattgtatgtacggaagctcttgcacgtttgtgttaagcactggaactggtgttaatggtttcacccttgatccatctcttggagagttcattctaactcatcctgacatcaaggtcccgaagaaagggaagatctattcagtgaatgaaggaaatgctaaaaactgggatggtcctactaccaagtatgtggagaactgcaagtttccaaaagatggttcatcaccaaagtccctaagatatgttggaagcatggtagctgatgttcaccgcacatttctttatggaggtatctttctgtacccggctgataaaaagagtccaaatgggaaacttcgtgtactctatgaagtcttcccaatgtcattcttgatggagcaagcaggaggacaggctttcactggcaagcaaagggcacttgatttggttccaacaaaattgcacgagcgatctcccatatttcttggaagctatgaggatgtggaggaaatcaaggccctttatgctgctgatcagacactggaatgaatgaatgaaaaagcataattctttgtcttttccaacttacaatcaattctcatctaattgttgcacagatacatggtcatgtatatgttaagaaagcttgttaatgttttgtgatttacaaaaattagtttattactccatatctaaatattttac

SEQ ID NO: 2931 - DNA, 1294 bp, Tripterygium wilfordii
caagcaaaccatcaaagcttttcgaagaacgatttctgggtttcgtagtagtagtggtcgtcgttcacaatggatcatgcaagcgaggctttccggactgatctgatgacaatcactcgtttcgtcctcaacgagcagtctaagtttcccgagtcacgcggtgacttaactatcttgctcaatcacattgttctcggctgcaaattcgtctgcaatgctgtcagcaaggcaggtcttgctaaactgattgggctagccggagagactaatgttcagggtgaagagcagaagaaattggatgtgctttcaaatgaagttttcattaaggctttggtcagcagtggacgcacgtgcatacttgtctctgaggaagatgaagaagctacttttgtggaggtatcgaagcgaggaagatacattgttgtttttgacccattggatggatcctcaaacattgactgtggtgtttccattggaactatatttgggatttacacggtgaaaaacactgacaatccaactttggaggatgtgttgaaacctggtagccatatgacagctgctgggtattgcatgtatggaagttcttgcacgctggtttttagcactggaagtggtgtcaatggcttcactcttgatccatcgcttggggaattcatattaacccatcctgacatcaagattccaaagaaaggaaagatttattcagtaaatgaaggaaatgccaaaaactgggatgaaccaactgctaaatacgtggaaaattgcaaatttccaaaagatggttcatcgtcgaagtcccttaggtacattggaagcatggttgctgatgttcaccggacgttgctttatggtggtatctttttatatcctgctgataagaagagcccaaatggcaagctacgtgttctgtatgaagtcttcccaatgtcatacttgatggagcaagcaggaggtcaagcttttactggcaagcaaagggcactggacctggttccacagaagatacatgaacgttcacctgtattccttggtagctatgatgatgtcgaggaaattaaggcactctatgctgctgctgccgagaccaaagccgcatgaacttgtggatctcaaaataaccataaatgttcattaatgcattgtttgattagtgattccttcaaattggctatagtttcctgtatttgatcaatacagtcaccggagaaaacttctggtctatcctcaaaagcaaaccagaagaaaactaccaatggtttaggtgtattaactctggataattaaataatac

SEQ ID NO: 2932 - DNA, 1401 bp, Citrullus lanatus
tcctaacccatattctccattttccccattttcaattcatttgtgctttctctatgcatatatatatatataaatatatgttggagtttcatcacagccctcgaatttagcacccctttaagaatctcatcctaatttctacttcttcttctgattctgcaaaaggggtttttgagcgccatggatcacgcggcggatgctcagaggacggacttgatgaccattacacgcttcgtcttgaatgagcaatccaagtatccagaatcgcgaggagatttcacgattttgcttagtcatattgttcttggctgcaagttcgtctgctctgctgttaataaggcaggtttagctaaacttattggacttgctggagagaccaatgttcagggtgaagagcaaaagaaactggatgtgctctcaaatgaagtctttatcaaggctttggtcagcagtggcagaacttgtatccttgtttccgaagaagatgaagagccaacatatgtcgagccatctcgccgtggaaggtattctgtggtgtttgatccgctggatggatcgtccaacattgactgtggtgtttccattggaacgatttttggaatttatcacttgaatgacagccacgaacctaacctagaagacgtcttgcaacctggaaagaatatggttgcagcaggctattgcttgtatggcagctcttgcacgcttgttttaagtactggaactggtgttaatggattcactcttgatccttctcttggggagttcattttaactcacccagaccttaagattccaaagaaaggaaagatctattcagtgaatgaaggaaatgcaaagaactgggatggtccaactgcaaagtatgttgagaagtgcaagtttcctacagatggttcgtctcccaagtctttgagatatgttggaagcatggtagctgatgtccatcgtacattgctttatggtggtatatttttgtaccctggtgacaagaagagccctaatgggaaattgcgtgtgttgtatgaagtttttccaatggcattcttgatagaggaggcaggaggtcaagcgttcaccggaaaaataagggcacttgacttggttccaaagaagatacatgagagatctcccatatttcttggtagctatgatgatgttgaagagatcaaagctttgtatgctgctgctgagaaggaatgaatggaggacttcaaaacttagaaccaagtttacttgtgattgatgttggcttcattgcttttgccccttcttatagtgttttctaattgtaattgcatttgttgccatagaatttgaatgtctttttgattgttcttagttctctaatgataatgaatgcataaaatgtggccacgagaaagtatctgcatgttgtcc

SEQ ID NO: 2933 - DNA, 1285 bp, Cucumis sativus
acagccctcgaatttagcaccccttttaacaatatcatcttaatttcttcttcttcttctaattcttttgattgagcaaaaggggtttttcacagcgccatggatcacgccgcggatgctcagaggacggacttgatgaccattactcgcttcgtcttgaatgagcaatccaagtaccctgaatcccgtggtgatttcaccattttgcttagtcatattgttcttggctgcaagttcgtctgctctgctgttaataaggcaggtttagctaaacttattggacttgctggagagaccaatgttcagggtgaagagcaaaagaaactggatgtgctctcaaatgaagtctttatcaaggctttggtcagcagtggcagaacttgtattcttgtttctgaggaagatgaagagccaacatatgtcgagccatctcggcgtggaaggtattctgtggtgttcgatccactggatggttcctccaacattgattgtggtgtttccattggaacgatttttggaatttatctcttgaaagacagccatgaacctaacctagaagacgtcttgcaacctggaaagaatatggtggcagctggctattgcttgtatggaagctcttgcacacttgttttaagtactggaactggtgttaatggattcactctcgatccttctcttggggagttcattttaactcacccagatcttaagattccaagtaaaggaaagatttattcagtgaatgaaggaaatgcaaagaactgggatggtccgactgcaaagtatgtagagaagtgcaagtttcctacagatggttcgcctcccaagtctttgagatatgttggaagcatggtagctgatgtccatcgtacattgctttatggtggtatatttttgtaccctggtgacaagaagagccccaatgggaaattgcgtgtgttgtatgaagttttcccaatggcgttcttgatagaggaggcaggaggtcaagcattcactggaaaaataagggcacttgacttggttccaaagaagatacatgagagatctgccatatttcttggtagttatgatgatgttgaagagatcaaagctttgtatgctgctgttgaggagtgaatggacttcaaaagttagaaccaagttactcgtgatccatgtcggcttcattgcttttgttgtcccttctttcagtgtttctaattgtaattgcatttgttcccatagaatttcaatgccttattgattgttcttagttctttcatgataatgaatgcataaagtg

SEQ ID NO: 2934 - DNA, 1275 bp, Cucurbita pepo
tcgtcgcaaccctcgaaatcagcacccctttttcaacaatctcatccttatttcatcatcttcttcttttttcttctgattctgcaacagaaacaggggttttcagcgccatggatcacgcggcggatgctcagagaacggacttgatgaccatcactcgatttgtgttgaatgagcaatccaagtacccggaatcgcgaggggatttcaccattttgcttagtcatatcgttctcggctgcaagttcgtctgctctgctgttaacaaggcaggtttagctaaacttattggacttgctggtgagaccaatgttcagggcgaagagcaaaagaaactggatgtgctctcaaatgaagtttttatcaaggctttggtcagcagtggcagaacttgtatccttgtttctgaagaagatgaagagccaacttatgtcgagccatctcggcgtggaaggtattctgttgtgtttgatccgcttgatggatcctccaacattgactgtggcgtttcgattggaacgattttcggaatctatcacttgaacgatagccacgaacctaacctggaagacgtccttcaaccaggaaagaatatggttgcagcaggctattgcttgtatggcagctcttgcacactcgttttaagtactggaactggtgttaatggattcactcttgacccttctcttggggagttcattttaacccacccagaccttaaggttccaaagaaaggaaagatatattcagtgaatgaaggaaatgctaagaactgggatggtccgactgcaaagtatgtagagaattgcaagtttcctacagatggatcacccccaaagtctctgagatacgttggaagcatggttgctgatgtgcatcgtacattgctttatggtggtatctttttgtaccctggtgacaagaagagccccaacggaaaattgcgtgtgttgtatgaagtttttccaatggcgttcttgatggaggaagcaggaggtcaagcattcactggcaaaataagggcacttgagttagttccaaagacgatacatgagagatctcccatatttcttggtagctatgatgatgttgaagagatcaaagctctttatgctgctgctgctgagaataaatgaatgaatgaatgaatgaatgaatgagttcaaagtttccttctgattttgcatctgtggccataggattctaatgtcctattgattattattattcttacttctataatgttaatcaatgcataaatgtggccatctaaac

SEQ ID NO: 2935 - DNA, 1286 bp, Eutrema halophilum
cggtcgcgtctttatctcatcatcttcctcgaaacgtgcaacacataaaatagggtttaaaaagattgcacattcagtctcttctctctctaaattaaaagtcatttggttagcgtagaagcttaggaagagagagagagaagaacaaagatggatcacgaagcagatgcttaccgtacggatttgatgaccataacgagattcgtgctgaatgaacaatcaaagtatccagaatctcgtggggatttcacgattttgctcagcaacatcgttttgggatgcaaattcgtctgcagtgctgtcaataaggctggtctggctaagctaattggacttgcaggggagacaaatatccagggtgaagagcaaaagaaacttgatgtgctatctaatgacgtttttgtcaaagctttggttagcagtggcagaacttctgttcttgtctcggaagaagatgaggaagctacgtttgtggagtcatccaagcgtggaaagtactgtgttgtttttgatccacttgatggatcgtcaaacattgactgtggtgtctccattggaacaatttttggaatttatacaatgaaccacagtgatgagccaaccactgaagatgtcctgaaacctgggagtgaaatggtcgcggcgggttattgtatgtacggaagctcctgcatgcttgtgttgagcactggaactggtgtccatggatttaccctggacccatctctaggagagttcatattaactcacccggacattaagattccaaagaatggaaacatctattcagtaaatgaaggcaatgcgcagaactgggatggtccaactacaaagtatgtagagaaatgcaagtttcctaaagatggttctccagcgaaatctctgagatatgttggaagtatggtagccgatgttcatcgcacactactttatggaggaatattcttgtacccggctgacaagaaaagccccaatgggaaattgcgtgtcctgtatgaagtcttcccgatgtcgttcttgatggagcaagctggaggtcaggccttcacgggcaagaaaagggcgctggaccttgtcccggagaagatccatgagcgttctccgatatttcttggtagctacgacgatgtagaggagattaaggctctgtatgctatggaggagacgaaaaattaagcttctttctatttttcgtattctctcacttgtctcttgtattctctcacttgtcactccttccaatgagacgaactaaataactcatttatacaaataagactttttct

SEQ ID NO: 2936 - DNA, 1124 bp, Brassica napus
atggatcacgaagcagatgcataccgtacggatctgatgaccatcacgaggttcgtgctgaatgagcaatcaaagtacccagagtctcgtggggatttcaccattttgctaagcaacatcgttttgggatgcaagttcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggcatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcaccctgctttatggaggaatcttcttgtacccggctgacaagaaaagccccaatgggaaactgcgtgttctgtatgaagtcttcccgatgtcgttcttgatggagcaagccggaggacaggccttcactggcaagaaaagggcgctagaccttgtgccggagaagatccatgagcgttctcctatatttcttggtagctacgaagatgtagaggagattaaggctctgtatgctgcagacgaatagaagaaataagattctcactcttcttatttcatcactcttctctcttatatctatgtcttcttctgttgagacaaacaaatgactcatttatacaagggagacttttt

SEQ ID NO: 2937 - DNA, 1193 bp, Brassica juncea
cagtgcatcatcgttaaccagatcgatggatcatcatcaggcgaaggatcaaagcctgtgaagcggcggaggaagaggaggatcaaagatggatcacgaagcagatgcataccgtacggatctgatgaccatcacgaggttcgtgctgaatgagcaatcaaagtacccagagtctcgtggggatttcaccattttgctaagcaacatcgttttgggatgcaagttcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatctacacaatgagccacaatgatgagccaactactgaagatgtcttgaaacctgggaatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttcccctgcaaaatctctgagatatgtgggaagtatggtagcagacgttcatcgcacattgctttatggaggaatcttcttgtacccggctgacaagaaaagccccaatgggaaactgcgtgttctgtatgaagtcttcccgatgtcgttcttgatggagcaagctggaggtcaggccttcactggcaagaaaagggcgctagaccttgtgcccgagaagatccatgagcgttctccaatatttcttggtagctacgaagatgtagaggagattaaggctctgtatgctgcagaggaatagaagaactaagattctcactcttcttatttcatcatttgtctttcttatatctacatcttcttccattgagacaaacatatgactcatt

SEQ ID NO: 2938 - DNA, 2207 bp, Brassica oleracea
attacaaatcgcgtttgattttagggttttccgtgaaaatccgatggatcactaggtggatgggttgagatgggtttgaccctagtttgccttgtaattatcgttacttgcgaaggtttcttaatactttactcatttctcgatttaaaaataattgtaaatgaaaatagagttataactgggatatgctggctttaaattttacatctagggggcattggagaaagatttctcgacgatgaggcgattgcatcagaagatacgaggacaaggttccttctttatcgttatccccacgaaaagacggccaaacctgtcacagccacgtgtcaatccgatctagtaagtctctccttggattggcacgttcgttggatttatcaccgatcgcgtctttatctaatcatcttcctcgaaacctgcaacacacaaaaaagaataaggcaatctctaaaacatctgatttaaaaaggcatttggtggcgtagacgagagagagagagagagagagaggatcaaagatggatcacgaagcagatgcataccgtacggatctgatgaccatcacgaggttcgtgctgaatgagcaatcaaagtacccagagtctcgtggggatttcaccattttgctaagcaacatcgttttgggatgcaaattcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggcatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcaccctgctttatggaggaatcttcttgtacccggctgacaagaaaagccccaatgggaaactgcgtgttctgtatgaagtcttcccgatgtcgttcttgatggagcaagccggaggacaggccttcactggcaagaaaagggcgctagaccttgtgccggagaagatccatgagcgttctcctatatttcttggtagctacgaagatgtagaggagattaaggctctgtatgctgcagaggaatagaagaaataagattctcattcttcttatttcatcactcttctctcttatatctatgtcttcttctgttgagacaaacaaatgactcatttatacaaaagagactttttctcattttttcaatgcacctaagatatttttttttcattttctattctaatctgtctccagctcgcagcacttattggtggattagtccaaacctatccttcagagtgatgccaccacgtatatctctcatctttagagcctggttcaaacttctcattttattccatgaattatttggggtatcgaccacacatgaaagagaagctaatacatggatatatgagaactaaagcagactaagacaattttaaatattttttcctgcaattgtcaattgcattaatctttaaaaggtaatttcgtaaagcaaattaatattatctacttataaatcatttttagatttattttagataaatttatcggtttactgtgaaatacgtttgtaataatatttcagaaatatatttcagtctagtgcttgtagagtttggttcgatgggtaacagtgctttccggtaatctacaaaatagttacaatgtctgatgaaagctctcaagtagtcctgtgagtgtctggtacaatcagtctgctctatagattttttagactatacattt

SEQ ID NO: 2939 - DNA, 1190 bp, Brassica oleracea
ggagagagagagaaagggagaggatcaaagatggatcacgaagcagatgcataccgtacggatttgatgaccatcacgaggttcgtgctgaatgagcaatcaaagtacccagagtctcgtggggatttcaccattttgctaagcaacatcgttttgggatgcaaattcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggaatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcacactgctttatggaggaatcttcttgtacccggctgacaagaaaagccccaatgggaaactgcgtgttctgtatgaagtcttcccgatgtcgttcttgatggagcaagccggaggacaggccttcactggcaagaaaagggcgctagaccttgtgccggagaagatccatgagcgttctccaatatttcttggtagctacgaagatgtagaggagattaaggctctgtatgctgcagaggactagaagaaataagattctcattcttcttatttcatcactcttctctcttatatctatgtcttcttctgttgagacaaacaaatgactcatttatacaaaagagactttttctcattttttcaatgcacctaagatatttttttttc

SEQ ID NO: 2940 - DNA, 1817 bp, Brassica rapa
agattaaacatttatctatccaccaaaaccattttagaaagagaaaaaaaaaagaaggaaagaggccgaaactttataataatgttaatcgtgggagggcgagagacgatgaggggattgcatcagaagatacgaggacaaggttccttctttatcgttatccccacgaaaagacggccaaacctgtcacagccacgtgtcaatccgatctagtaagtctctccttggattggctcgttcgttggatttatcaccgatcgcgtctttatctaatcatcttcctcgaaacctgcaacacacaaaaaagaataaggcaatctctaaaacataaaaaggcatttggtggcgtagacgagagagagagagagaggatcaaagatggatcacgaagcagatgcataccgtacggatctgatgaccatcacgaggttcgtgctgaatgagcaatcaaagtacccagagtctcgtggggatttcaccattttgctaagcaacatcgttttgggatgcaagttcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggcatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcaccctgctttatggaggaatcttcttgtacccggctgacaagaaaagccccaatgggaaactgcgtgttctgtatgaagtcttcccgatgtcgttcttgatggagcaagccggaggacaggccttcactggcaagaaaagggcgctagaccttgtgccggagaagatccatgagcgttctcctatatttcttggtagctacgaagatgtagaggagattaaggctctgtatgctgcagacgaatagaagaaataagattctcactcttcttatttcatcactcttctctcttatatctatgtcttcttctgttgagacaaacaaatgactcatttatacaagggagactttttctcattttttcaatgcacctaagatatttttttttcattttctattctaatctgtctcccgctcgcaacacttattggtggattagtccaaacctatccttcagagtgataccaccacgtatatctctcatctttagagcctggttcaaacttctcattttattccatgaattatttggggtatcgaccacacatgaaagagaagatacatggatatatgagaagtaaagcagactaagacaattttaaatatttttttcctacaattgtcaattgcattaatctttaaaaggtaatttcgtaaagcaaattaat

SEQ ID NO: 2941 - DNA, 1224 bp, Brassica napus
ctaaaacatctgatttaaaaaggcatttggtggcgtagacgagagagagagagaaagggagaggatcaaagatggatcacgaagcagatgcataccgtacggatttgatgaccatcacgaggttcgtgctgaatgagcaatcaaagtacccagagtctcgtggggatttcaccattttgctaagcaacatcgttttgggatgcaaattcgtctgcagtgctgtcaacaaggctggtttggccaagcttattggacttgctggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggaatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttctcccgctaagtccctgagatatgtgggaagtatggtagccgatgttcatcgcacactgctttatggaggaatcttcttgtacccggctgacaagaaaagccccaatgggaaattgcgtgttctgtatgaagtcttcccgatgtcgttcttgatggagcaagccggaggccaggccttcactggcaagaaaagggcgctcgaccttgtgccggagaagatccatgagcgttctcctatatttcttggtagctacgaagatgtagaggagattaaggctctgtatgctgcagaggaatagaagaaataagattctcattctccttatttcatcactcttctctcttatatctatgtcttcttctgttgagacaaacaaatgactcatttatacaagagagactttttctcattttttcaatgcacctaagatattt

SEQ ID NO: 2942 - DNA, 1063 bp, Brassica juncea
gaggatcaaagatggatcacgaagcagatgcataccgtacggatttgatgaccatcacgaggttcgtgctgaatgagcaatcaaagtacccagagtctcgtggggatttcaccattttgctaagcaacatcgttttgggatgcaaattcgtctgcagtgctgtcaacaaggctggtttggccaagcttattggacttgctggggaaacaaatatccagggtgaagagcaaaagaaactcgatgtcctctctaatgatgtctttgtcaaagctttggttagcagtggcagaacttctgttcttgtgtcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggaatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctactcagtgaatgaaggcaatgctcagaactgggatggtccaaccacaaagtatgtagagaaatgcaagtttcctaaagatggttctcccgctaagtctctgagatatgtgggaagtatggtagccgatgttcatcgcaccctgctttatggaggaatcttcttgtacccggctgacaagaaaagcccgaatgggaaattgcgtgttctgtatgaagtcttcccaatggcgttcttgatggagcaagctggaggtcaggccttcactggcaagaaaagggcactggaccttgtcccgaaaaagatccatgagcgttctcccatatttcttggtagctatgacgatgtagaggagattaaggctctgtatgctgcggaggagaataactaagctttccattgtaatattttatttctata

SEQ ID NO: 2943 - DNA, 1050 bp, Ananas comosus
actcctctccagctggctggcttgtagtaaagagattttgattgagaagagatcgtagccgttgagagatggatcacgaggcagatgcttaccggacggatttgatgacgatcacgcggttcgtgttgaacgagcagtcaaagttccccgagtcacgcggggacttcaccatattgatgagccacattgtcctcggatgcaagttcgttcacgccgccgtcaacaaggccggtcttgctaagcttcttggacttgcgggtgaaaccaacatccagggcgaggagcaaaagaaactggatgtgctttcaaatgaagttttcgtcaaggccttggtcagcagtgggcgaacaagtatccttgtatcggaagaagatgaggaggcgacatttgttgatccatctattcgtggaaggtactgtgtcgtctttgatccactggatggatcctccaacattgattgcggagtttcgattggaacaatcttcgggatttatatgatcaaagatagcggagaaccaagtttagatgacgtgctgcaaccagggaaaaatatgattgccgcaggatattgcatgtacggaagctcttgcacgcttgttttaagcgcgggaagtggggttaatggatttaccctggatccgtctcttggggaatttatactgactcacgcagatattaagattccgaagaaaggaaagatatattctgtaaacgaaggaaatgccaagaactgggacgagccaactgcaaagtatgtgcaaaaatgcaagttccctgaagatggatctccggccaagtccttaagatacatcggaagcatggtggctgatgtccaccggactttactttatggtggcatctttttgtaccctggtgacaagaaaagccccagtgggaaactgagggttctttatgaagtctttccaatgtcgttcctcatggaacaagctggaggtcaagcatttacggggaaagaacgggcactcgacatgattccaaagaagatccatgaaaggtctcctatatttttgggaagttacgatgacgtcg

SEQ ID NO: 2944 - DNA, 1096 bp, Brassica napus
tagaagcttcataacgaaacaaagatggatcacgaagcagatgctttccgtacggatttgatgaccatcacgagattcgtgctgaatgagcaatcaaagtatccagagtctcgtggggatttcacgattttgctcagcaacatcgttttgggatgcaaattcgtctgcagtgccgtcaacaaggctggtttggccaagcttattggacttgcaggggacacaaatatccagggtgaagagcaaaagaaactggatgtgctctctaacgatgtttttgtcaaagctttggttagcagcggcagaacttctgttcttgtctcggaagaagatgaggaagctacgtttgtggagtcatccaagcgtggaaagtactgtgttgtttttgatccacttgatggatcctcaaacattgactgtggtgtctccattggaacaatctttggaatttacacaatggaacacagtgatgagccgactactaaagatgttctgaaacctgggaatgaaatggttgcagcgggttactgtatgtacggaagctcctgcatgcttgtgttgagcacaggaacaggtgtccacggatttaccctggacccatctctaggagagttcatattaactcacccagacattaagattccaaagaagggaaacatatactcagtgaatgaaggaaatgctcagaactgggatggtccaaccacaaaatatgtagagagatgcaagtatcccaaagatggttctcccgcaaagtcactgagatatgtcggaagtatggtagccgatgttcatcgcactctgctttatggaggaatcttcctgtacccggctgacaagaaaagccccaatgggaaattgcgtgtcctgtatgaagtcttcccaatggcattcttgatggagcaagctggaggtcaggccttcactggcaagaaaagggcactggaccttgtcccgaaaaagatccatgagcgttctcccatatttcttggtagctatgacgatgtagaggagattaaggctctgtatgctgcggaggagaataactaagctttccattgtaatattttatttctatatatctcctggacaaaccaaa

SEQ ID NO: 2945 - DNA, 1301 bp, Brassica juncea
ccaaagtagacggaggtataatgatggaaatgagtttgtgcagttgaatctttagaggcagagcttaattcacatgaaagacattggaggggagacataacattatgcaatacgtaaccaaaagcttcataacgaaacaaagatggatcacgaagcagatgcataccgtacggatttgatgaccatcacgaggtttgtgctgaatgagcaatcaaagtacccggagtctcgtggcgatttcacgattttgctcagcaacatcgttttgggatgcaaattcgtctgcagtgccgtcaacaaggctggtttggccaagctaattggacttgcaggggaaacaaatatccagggtgaagagcaaaagaaactcgatgtgctctccaacgatgtctttgtcaaagctttggttagcagtggcagaacctctgttcttgtctcagaagaagatgaggaagctacgttagtggagtcatccaagcgtggaaagtactgtgttgtttttgatccacttgatggatcctcaaacatcgactgtggtgtctccattggaaccatctttgggatttacacaatgagccacaatgatgagccaactactgaagatgtcttgaaacctgggcatgaaatggttgcagcgggttactgtatgtacggaagctcctgcatgcttgtgttgagcactggaaccggtgtcaatggatttaccctggacccatctctaggagagttcatattaactcacccggacattaagattccgaaaaagggaaacatctattcagtgaatgaaggcaatgctcagaactgggatggtccaaccacaaagtatgtagagaaatgcaagtttcctaaagatggttcccccgcaaagtccctgagatatgtgggaagtatggtagccgatgttcatcgcacactgctttatggaggaatcttcttgtacccggctgacaagaaaagccccaatgggaaattgcgtgtcctgtatgaagtcttcccaatggcgttcttgatggagcaagctggaggtcaggccttcactggcaagaaaagggcgctagaccttgtgcccgagaagatccatgagcgttctccaatatttcttggtagctacgaagatgtagaggagattaaggctctgtatgctggggaggaggagaactaagctgtccattgtaacatcttatttctatatatctgctgttgagacaaaccaaatgactcatgtataccaagaagactggtaaaagaaaaaatatcatctttcaataaatattatttgtctcaacagcagatatata

SEQ ID NO: 2946 - DNA, 1180 bp, Brassica rapa
atctgattaaaaaggtctcctgccttagaagcttcataacgaaacaaagatggatcacgaagcagatgctttccgtacggatttgatgaccatcacgagattcgtgctgaatgagcaatcaaagtatccagagtctcgtggggatttcacgattttgctcagcaacatcgttttgggatgcaaattcgtctgcagtgccgtcaacaaggctggtttggccaagcttattggacttgcaggggacacaaatatccagggtgaagagcaaaagaaactggatgtgctctctaacgatgtttttgtcaaagctttggttagcagcggcagaacttctgttcttgtctcggaagaagatgaggaagctacgtttgtggagtcatccaagcgtggaaagtactgtgttgtttttgatccacttgatggatcctcaaacattgactgtggtgtctccattggaacaatctttggaatttacacaatggaacacagtgatgagccgactactaaagatgttctgaaacctgggaatgaaatggttgcagcgggttactgtatgtacggaagctcctgcatgcttgtgttgagcacaggaacaggtgtccacggatttaccctggacccatctctaggagagttcatattaactcacccagacattaagattccaaagaagggaaacatatactcagtgaatgaaggaaatgctcagaactgggatggtccaaccacaaaatatgtagagagatgcaagtatcccaaagatggttctcccgcaaagtcactgagatatgtcggaagtatggtagccgatgttcatcgcactctgctttatggaggaatcttcctgtacccggctgacaagaaaagccccaatgggaaattgcgtgtcctgtatgaagtcttcccaatggcattcttgatggagcaagctggaggtcaggccttcactggcaagaaaagggcactggaccttgtcccgaaaaagatccatgagcgttctcccatatttcttggtagctatgacgatgtagaggagattaaggctctgtatgctgcggaggagaataactaagctttccattgtaatattttatttctatatatctcctggacaaaccaaatgaatcatgaataccaataagactggttaaaaaaaataaaacaactcattcactggtca

SEQ ID NO: 2947 - DNA, 1378 bp, Ceratodon purpureus
cctccctctcccgctctctgccaattgttcccccgtctggcgtccccgtctttcgttgcgcttcaattcagcggaggaggttgatctgagtgagggaagttttgaaagctcgcagccatggatcacgctgcggatgccatgaggacggacttgatgaccattacccgctacgtgctcaatgaacagagcaggtttcccgaggctcgtggtgatcttacaattcttctgaacaacattgtgctcggctgcaagtttgtctgctcatccgtcagcaaggctggattggccaaattgattggactggcaggagagacaaatgtccagggagaggagcaaaagaagctcgatgtcttatcaaacgacgtcttcgtcaacgcacttgtgagcagtggacgcacaaatgtcctcgtatctgaagagatcgaagatgcgattttcgtagagaaagccaagaggggaaggtactgcgttgtgtttgatccacttgatggatcctcgaacatcgattgcggtgtctccatcggcacgatttttggaatttacatgctcaaggatggaattgaaggcacggttgaagatgtgttgcagcccggtactgcaatgcttgctgctggctattgtatgtatggaagctcttgcacgttggtattgagcacaggtgctggagtcaatggttttaccctcgacccttccctcggagagtttatcttgacgcacccagacatcaagattcccaagaaggggaagatttactctgtgaacgaaggaaatgccatgaactgggatgcacccaccacgaagtatgttcagaacgctaagtttcccaaggacggggcatcaccgaagtccctgcgatacatcggaagtatggtagctgacgttcataggactctattgtatggcggtatctttatgtaccctggtgacaagaagagccccaagggcaagctcagggttctgtatgaggttttccctatgtctttcttgatggagcaagctggtggccaagctttcaccgggaaggaacgggctcttgaactggtgccaacgcacatccatgacaggtcacccattttcttgggaagctatgacgatgttgaggagatcaaggctttgtatgcagaagcggcttaaatatatacgtaagccgatgagaattgtcatagctatgtgtcacccagctgagaaatagctctttacttttgaagatcgtgtagaaaattggctcaaaggtaggtggaatgtcattggttagggacctgtcaatctaggtgatttttgtaatcgttttgtttatgagcggtttctttgtctatcatgaatatgggcgtgtaaactctcccactattgacatttgtttcaaacttgaactgtgaat

SEQ ID NO: 2948 - DNA, 1257 bp, Cucurbita pepo
aggcggcttcatcacatccctcgaatttagcacctcatccatattccttcttcttgttctttcgattgccatggatcatgcggcagatgctcagaggacggacttgatgaccattactaggttcgtcttgaatgagcaatccaagtactctgaatcgcgtggggatttcacgattttgcttagtcatattgttcttggctgcaagttcgtctgctctgctgttaataaggcaggtttagccaaacttattggacttgctggagagaccaatgttcagggtgaagaacaaaagaattggatgtgctctcaaatgaagtctttatcaaggctttggtcagcagtggtagaacttgtatccttgtttctgaagaagatgaagagccgacatacgtcgagccatctcgccgtggaaggtattctgtggtgtttgatccattggatggatcctccaacattgattgtggggtttctattggaacgatttttggaatctatcagttgaacgacagccatgaacctaacctagaagatgtcttgcaacctggaaagaatatggttgcagcaggctattgcttatatggcagctcttgcacgcttgttttaagtactgggactggtgttaatggattcactcttgacccttctcttggagagttcatcttaacacacccagaccttaagattccagagaaaggaaaaatctattcagtgaatgaaggaaacgcaaagaattgggacggtccaaccgcaaagtatgtagagaagtgcaagtttcctacagacggatcatcccccaagtctttgagatatgttggaagcatggtagctgatgtccatcgtacattgctttatggtggtatatttttgtaccctggtgacaagaagagccccaatggcaaattgcgtgtgttgtacgaggtttttccgatggcattcttgatagaggaggcaggaggtcaagcgttcaccggaaaaataagggcacttgatttggttccaaagaagatacatgagagatctcccatatttcttggtagctatgatgatgttgaagagatcaaagctttgtatgctgctgctgagaatggaggaatgaatgcataaatgaatgaatagcttcaaaatttaccacttctagttgatgttggcttcattgcatttgtggccatacaattctaatgtcttgttcattcttcttacttctttaatgttaatgaatgcataaaatgtggacatgagaacgatttcgttcgcttc

SEQ ID NO: 2949 - DNA, 1402 bp, Lupinus angustifolius
actgtacatagtagaacttttcatccttaaattgtggagtgaggcctcatcttcttctttcatctttcatcctatatacccttcataactttctttcctctttacaataaaaactatatctttccaagaatttgcatatattggtgttgatccaagaagaagaacaagtgattaatcatttttttggggagagaaatggatcatgcaattgatacaaacaggacagatttgatgaccataactaggtttgttcttaatgaacaatcaaaatatccagaatcacgtggagatttcactatcctaatcagcaacattgttcttggttgcaaatttgtttgctctgctgttaacaaggcaggactggcaaaacttataggacttgctggagagaccaatgttcaaggtgaggagcaaaagaaattagatgtgctttctaatgaagtatttgtgaaggccttagtcagcagtggccgcacatgccttcttgtatctgaagagcttgaagaggctatatttgtgccaccatcacagcatggaaaatacattgttgtgtttgatcctttggatggatcctcaaacattgattgtggtgtctctataggaactatctttggtatttacatggtaaaggataaagataatgttactcttgatgatgtgttgcaacctgggaacaaaatgttagctgctggttactgcatgtatggaagctcatgcacgtttgtgattagcacaggaaatggagtgaatggttttacacttgatccttcccttggagagttcatattgactcacccagacatcaaggtaccaaggaaaggaaagatttattcagtgaatgagggaaatgccaaaaactgggatgaaccaacaactaaatatgtagaaaattgcaagtttcctcaagatggttcaccaccaaagtctcttaggtacattggaagcatggttgctgatatccatagaacattgctttatggtggtatgttcatgtaccccgctgatatcaaaagtccaaatggaaagttaaggcttctctatgaagtttttccaatgtcatatttgatggagcaagcaggaggccaagcttttacaggaaaagaacgggcacttgacttggttccaagccatatacatgaacgatcgcctgtattcctcggcagctacgaagaaatcgagcacattaaagatctttatgcttcatgccaagcaaataatggtgcatgaatattaattattgtctttgaatttaaggttgtatttcatgtgtaagagagatatcaactattggaatttaattgtgtagagaataatttgtttagttttttttgtactaataagggtatctctagaatatgataataaacgcaaagttgcataaaatgaagagaagctttcaata

SEQ ID NO: 2950 - DNA, 1476 bp, Zostera marina
tttatcaaatccaacagaaaaggaagaagaagaaaatatagatagcagagcagcaagaagtggcagaaccacgataactacagattctcgccacgtgtcatacgaaatctgaatacctgccattgtcacagcctgcgaactgagccaataagctgtctgccaccagttaacgctatctcttccaatcatatctgctcctcacgaatcacgattctcctccaactataaataaacactcaacgatcacaatcccccaaatcggttgttgcagttgaaattgccaacactagacgtttcactggtttcagatagagaaaaattacgccatggatcacgaagcggatgcgatgagaacggacctcatgactctgactaggtacgtgctgaatgagcaatccaaacacccggagtcaacaggagactacaccatcttgttagcacacatcgttctcggatgcaaattcgtctgctcagccgtaaacaaggcgggacttgcaagtctggtaggattggctggggacacaaatatccagggggaagagcagaagaaaatggatgttctctccaatgaggtttttgtaaaggctttggtcagcagccacagaacatgcatcctggtttctgaagaagacgaagaggctacatttgtggatcctgctcttcgtggaaggtactgtgttgttttcgaccctttggatggatcttccaacatcgattgtggggtctccataggaacgatctttggaatttacatggtagacgatccgaataatatctccctcaatgatgtactgcaaccaggaaaaaatatggtagcagctgggtattgtatgtatggaagttcctgcacgctagtgttaagcagcggaaatggggttaatggttttacacttgatccatctcttggggagttcatactcacacatccagacatcaagattcctcccaaaggcaaaatatattcagttaatgaagggaatgctaaaaattgggacaacccaacagcaaagtacgttgaaaaatgcaagtacccaacagatggacccccaaagtccctgagatacattggaagcatggttgctgatatccatcgcacactactctatggaggtattttttgaccctgctgaccagaagaacccaaacggaaaactaagggtcctgtatgaagtattccctatgtcatttttgatagagaaagctgggggacaagcctttacaggcaaaataagggcacttgatttgatacctgaacatatccatgcgaggtcgcctgtcttcctcggcagctgtgatgacgttgaagaactcaaagaactttatgctgcagaaaaggcaaatgcataagttcataatatgtaattatgtaagctaagaagcatcaagcttgctttgcatgaaaaataaacatgtaagctgactacttcccccattcttcttaatatatgaagacctcaaatctttacataaactttt

SEQ ID NO: 2951 - DNA, 1097 bp, Brassica oleracea
tagagagagaaacaaagatggatcatgaagcagatgcttaccgtacggatttgatgaccatcacgagattcgtgctgaacgagcaatcaaagtatccagagtctcgtggggatttcaccattttgctcagcaacatcgttttgggatgcaaattcgtctgcagtgccgtcaacaaggctggtttggccaagcttattggacttgcaggggacacaaatatccagggtgaagagcaaaagaaactggatgtcctctctaacgatgtttttatcaaagctttggttagcagcggcagaacttctgttcttgtctcggaagaagatgaggaagctacgtttgtggagtcatccaagcgtggaaagtactgtgttgtttttgatccacttgatggatcctcaaacattgactgtggtgtctccattggaacaatctttggaatttacacaatggagcacagtgatgagccgactactaaagatgttctgaaacctgggaatgaaatggttgcagcgggttactgtatgtacggaagctcctgcatgcttgtgttgagcactggaacaggtgtccacggatttaccctggacccatctctaggagagttcatattaactcacccagacattaagattccaaagaagggaaacatatactcagtgaatgaaggaaatgctcagaactgggatggtccaaccacaaaatatgtagagagatgcaagtatcccaaagatggttctcccgcaaagtcactgagatatgtcggaagtatggtagccgatgttcatcgcactctgctttatggaggaatcttcctgtacccggctgacaagaaaagccccaatgggaaattgcgtgtcctgtatgaagtcttcccaatggcgttcttgatggagcaagctggaggtcaggccttcactggcaagaaaagggcactggaccttgtcccgaaaaagatccatgagcgttctcccatatttcttggtagctatgacgatgtagaggagattaaggctctgtatgctgcggaggagaataactaagctttccattgtaatattttatttctatatatctcctggacaaaccaaatgaatcat

SEQ ID NO: 2952 - DNA, 1193 bp, Raphanus sativus
agataacatagagagtgagtgagtgtcagagagagagagaaacagagatggatcacgaagcagatgcgtaccgtacggatttgatgacgatcacgagattcgtgctgaatgagcaatcaaagtacccagagtctcgcggggatttcacgattttgctcagcaacatcgttttgggttgcaaattcgtctgcagtgccgtcaacaaggctggtttggccaagcttattggacttgccggggagacaaatatccagggcgaagagcaaaagaaactggatgtgctctctaacgatgtttttatcaaagctttggttagcagtggtagaacttctgttcttgtctcggaagaagatgaggaagctacgtttgtggaatcatccaagcgtggaaagtactgtgttgtttttgatccacttgatggatcctcaaacattgactgtggtgtctccattggaacaatctttggaatctacacgatgaaccacagtgatgagccaagtaccgaggatgttctgaaacctgggaatgaaatggttgcagcgggttactgtatgtacggaagctcctgcatgcttgtgttgagcactggaacaggtgtccacggatttaccctggacccatctctaggagagttcatattaactcacccagacattaagattccaaataagggaaacatctactcagtgaatgaaggcaatgctcagaactgggatggtccaaccacaaagtatgtagagagatgcaagtatcccaaagatggttctccagcaaaatctcttagatatgtcggaagtatggtagccgatgttcatcgcacgctgctttatggaggaatcttcttgtacccggctgacaagaaaagccccaatgggaaattgcgtgtcctgtatgaagtcttcccaatggcgttcttgatggagcaagctggaggtcaggccttcactggcaagaaaagggcactggaccttgtcccggagaagatccatgagcgttctccgatatttcttgggagctacgatgatgtagaggagattaaggctctgtatgctacggaggagaagaactaagctttccattgtaatatcgtatttctacatcttcttctgttgagacgaaccatttgactcgactcatgtatgccaaggagactggtttaaaaaaaaagataataataatatataacttttttc

SEQ ID NO: 2953 - DNA, 1346 bp, Tripterygium wilfordii
cccctccccttccccaccacaatccaacttggcatcaatatttatattccttctgcgtatacttttgcgtatgatatagagaacaagaagaagaagaaaaaaatcaaagcttttcgaagaaagatttttgggtttcgtggtagtattcaaaaatggatcacgaaagcgaggctcaccggactgatctcatgacaatcacgcgtttcgtcctcaacgagcagtctaagtttcccgagtcacgcggtgacttaaccatcttgctcaataacattgttctcggctgcaaattcgtctgcaatgctgttagcaaggcaggtcttgctaaactgattgggctagccggagagactaatattcagggtgaagagcagaagaaattagatgtgctttcaaatgaagttttcatcaaggctttggtcagcagtggacgcacctgcatccttgtatctgaggaagatgaagaagctacttttgtggaggtatcgatgcgaggaagatatattgttgtttttgacccattggatggatcctcaaacattgactgtggcgtttccattggaactatattcgggatttacatggtggaaaacactgacaatccaactttagaggatgtgttgaaacctgggagccatatgacagctgctgggtattgcatgtatggaagttcttgcacgctggtttttagcactggaagtggtgtcaatggcttcactttagatccatcgattggggaattcatattaacccatcctgatatcaagattccaaagaaaggaaagatttattcagtaaatgaaggaaatgccaaaaactgggatgaacctactgctaaatatgtagaaaattgcaagttcccaacagatggttcatcctcaaagtcacttaggtacattggaagcatggttgctgatgtccaccgaacattgctttacggtggtatctttttgtatcctgctgataagaagagcccaaatggaaagctacgtgttttgtatgaagtcttcccaatgtcatacttgatggagcaagcaggaggccaagcttttactggcaagcaaagggcactggatttggttccaaagaagatacatgaacgctcacctgtattccttggtagctatgacgatgtcgaggaaattaaggcactctatgctgctgccgagagaaaaggcgcatgaacctgtcgatctcacaataatcataaatgttctttatgtaatgtttgcgattccttcaaattagcaaccaatacagtcaccggagaaaacttctgtcttctggtctgtcaagaaattattgctcattcttgttgtgctctttctgttctgaatgttcttttattt

SEQ ID NO: 2954 - DNA, 1090 bp, Ambrosia trifida
atataaaaggaaccataattatcttctattattattcaaaaatagcaagttctgtagtgttttgtgcgaaagatggatcatgctgcggatacatttcggacggatttgatgacgattacgcggttcgtgttgaatgagcaatcgaagtacccggaatcgcgtggtgattttagtattttgctcagtaacattgttcttggttgcaagtttgtctgtgctgctgttaataaggcaggtttagcaaaactcattggacttgctggggagaccaatgtgcagggagaagaacaaaagaagctagatgttttatcaaatgaagtttttgtaaaggccttggtcagcagtggcagaacatgcatacttgtttctgaagaggacgaggaagcgatctttgtagaaccatcaaaacgcggaaagtattgtgttgttttcgaccctttggatggatcttctaacattgactgtggtgtgtccataggaactatttttgggatctatatgttaaaagacggtgctgagtcgcgtttagaagatgtacttcagcccggaaagaatatgctggctgctggatactgcatgtatggtagctcttgcacgcttgtgttaagcactggatctggtgtgaatggatttactcttgatccatctctaggagagtttatactcacccaccctgacattaagatcccaaagaaaggaaagatttattctgttaatgaaggaaatgctaagaactgggatggtcccactacaaagtttgtggaaaaatgcaagttcccaaaggatggttcaccagctaaatctctaagatacattggaagtatggttgctgatgttcatcgtaccttactctatgggggtgtgtttttgtaccctgctgataagaaaagcccaagtggaaaactaagggttctttatgaagtgtttcctatgtcattcttgatggaacaagctggagggcagtcatttactggaaaagaacgggctcttgatctagttcccaaaaagatacatgaacgatctccaatattttgggaagctatgatgacgtggaagaatcaaggccctgtatgcagctgaagagaaggca

SEQ ID NO: 2955 - DNA, 1751 bp, Pinus pinaster
atttggggttactagcagagtgtggaggcacacgggcacagatcagatcagctcattccatctcaataatcgcaactgagaagaatggatcacgcggcggaagcccatcgaacagacttgatgactattacccgctttgtgctaaatgaacagtccaagcacccggaagctcgcggggatttcacaattctgctgagccacatagtccttggctgcaaattcgtatgctcttctgtcagtaaggcaggacttgctaagctcattggtcttgcgggagaggtcaacgtgcagggagagcaacaaaaaagttagatgtactatcgaatgaagtattcatcaaggctctcataagcagtggacgtacgagcattcttgtttctgaggaggatgagcaggcaacctttgttgagccatcaaaacgagggaggtactgtgtagtttttgatccgcttgatgggtcctccaacattgattgtggagtatccattggaacaatctttggaatatacatgcttaaggatggtagtgaagggaccttgaatgatgtgcttcagccggggaaaaaaatggttgcagcaggatactgtatgtatggaagctcttgcacgcttgtcttgagtactggtacaggagtaaatggttttacacttgatccatctcttggggaattcattttgactcatccagacataaaggttccgaagaaaggtaaaatctattctgtgaatgaaggcaatacaaaaaactgggatgagcctaccaagaagtatgttgagagatgcaagtttcctgaagatggatcatctccaaagtctcttagatatattggaagcatggtagctgatgttcacaggacacttctgtatggtggcatattcatgtaccctgcagataagaagagtcccaacggaaagttacgtactctctatgaagtgtttcctatgtctttcttaatggagcaagcaggaggtcaagcctttacaggcacaggacgagcactggatatagttccaaccaccattcatcagcgttctcctatcttccttgggagctttgaggatgttgaagagattaaatctttatatgctgcttatgaagcaaaaaccttctaggttcgttttccaggtacattgtacttttttcatgaactgatttaagagtacagtcatgaggtattgaagacttccagaacatagagttcctcaagtacgagttctgttaaaagcttgtagaagatgcagcttgtagaagatgccagctttagacggtttggtaagctgtggagagtctccagtcttgctaaacattactcaaattataaaatagccctttggctgtcggttgcaatgaaatagagctgtaaaggattgtgtctgacaatattgttggagactgaatttttgtccatgacaatggcttcgttataaatctcacgtaccttctcccgagtaggcatttgcttatgttgaagttgatacaaaggtaattttggggacatgggataactaacatgttattgttgttaatggtgtctgtgtatttacacacacacggattttagctgtattgagtatgatgtaatgacaataatttattatgtccacaggtaattatggggacataggataactaacattttaaggtatattatatataatggcaataatttattatgtctatcatgttataatgtatatttgacagattaatagtgcttttgtttaaaaataataaagactcttttaaagtac

SEQ ID NO: 2956 - DNA, 953 bp, Avena sativa
gaagatggatcacgcggcggacacgttccggacggacctgatgaccatcacgcggcacgtgctgaacgagcagagccggcacccggagtcgcgcggcgacctcaccatcctcctctcccacatcgtcctcggctgcaagttcgtcgcctccgccgtcaacaaggccggcctcgccaagctcaccggtctcgccggcgagaccaacgtccagggggaggagcagaagaagctggacgtgctgtccaacgaggtgttcgtcaatgccctcgtcagcagcggccgcacctgcgttcttgtgtccgaggaggacgagaaggcgacgttcgtcgaccctaagctccgtggaaagtactgtgtctgctttgaccccctggatggatcctccaacatcgactgcggcgtctccatcggaacgatctttgggatctacatgatcaagaaccaagacaccgtgactctggaggaagtactgcagcctgggaaggacatgattgctgctggatactgcatgtatgggagttcctgcacgcttgtcctgagcactggaaatggtgtcaacggcttcacgcttgacccttctcttggggagttcataatgactcatccagatatcaagataccgccgaaaggaaagatctattcggttaatgaagggaacgccaagaactgggacacgcctactgcaaagtacgtggagaagtgcaagtaccccacggatggttcatcacctaaatcccttagatacatcggcagcatggttgctgatgtgcaccgcaccttgctatacggcggcatatttctgtaccccgcggacaagaagagcccaagcggaaagctccgtgtgatgtatgaggtgttccccatgtcattcctgatggaggaggctggaggccagtctttcacgaggacaaaggacggtcgctcgacctgactccccaccgacatccacgaga

SEQ ID NO: 2957 - DNA, 1270 bp, Euonymus alatus
ttccatattacttcttcgatatagaggaggaaaaaatcaaagcttttcgaagaaagtttttgggtttcgtagtagtagtaatcaagatggatcatgaaagcgaggctcaccggactgatctcatgacaatcacgcgtttcgtcctcaacgagcagtcgaagtttcccgagtcacgcggtgacttaaccatcttgctcagtcacattgttctcggctgcaaattcgtctgcaatgctgttggcaaggcaggtcttgctaaactgcttgggctagccggagacactaatattcagggtgaagagcagaagaaactggatgtgctttcaaatgaagttttcatcaaggctttggtcagcagtggacgcacgtgcatccttgtctctgaggaagatgaagaagctacttttgtggaagtatccatgcgaggaaaatatattgttgtttttgacccattggatggatcctcaaacattgactgtggcgtttccattggaactatattcgggatttacacggtgacaaacactgacaatccaactttggaggatgtgttgaaacctgggagccatatgacagctgctgggtattgcatgtatggaagttcttgcacgctggttcttagcaccggagggggtgtcaatggcttcactcttgatccgtcgattggggaattcatattaacccatcctgacatcaagattccaaagaaaggaaagatttattcagtaaatgagggaaatgccaaaaactgggatgaaccaaccgctaaatatgtagaaaattgcaaattcccaaaagatggttcgtcctcgaagtcacttaggtatattggaagcatggttgctgatgtccaccgaacattgctttatggtggcatctttttgtatcccgcggataagaagagcccaaatggcaagctacgtgttttgtatgaagtcttcccaatgtcatacttgatggagcaagcaggaggccaagcttttactggcaagcaaagggcactggacctggttccagagacaatacatgaacgctcacctgtattccttggtagctatgacgatgtcgaggaaattaaggcactctatgctgctgctgagagaaaaggcgcatgaacctgtcgatctcacgataatcataaatgttctttatgtaatgttttattggcgattccttcgaattctcgatagtttcatttatttgagcaatacaatcacctgagaaaacttctggtctttcgtcaaaagcaaatcagaagaactgtttaggt

SEQ ID NO: 2958 - DNA, 1445 bp, Pteridium aquilinum
acccggggacggcgaaagctgtctccacttgtcacgcacccaacacactctctccagcttttgtgacaacctggacaagtgacgcacggcattgctttacggatagcaaaaaccccgaggaggaatcagacgcttattcccaaacagaagagggagccagagagagagtgagacagacagagagagcgccatggatcacgcggcggatgcgcagcgaactgacctgatgaccatcactcgctttgtgttaaacgagcagagcaagttcccagaggcccgcggtgatctcaccatcctcctcaatcagatagtcctcggctgcaagttcgtctgctcttgtgtcagcaaggctgggttggcgaagcttataggattggccggagagaccaatgtgcagggcgaagagcagaagaagctagacgtgctttccaacgatgttttcatcaaggctctagttagcagtgggaggacgaatgttcttgtctcagaagagcttgaagaggcagtttttgtggaagagaaacttcgtggcaggtattgtgttgtttttgatccactagatggttcctccaacattgactgtggtgtgtccattggcaccattttcgggatctatatgctcaaggaaggcagtgcaggaaccttaaatgatgttcttcaaccaggaaagaatatgatagcagcaggctattgcatgtatgggagttcttgtacgcttgttctgagtactggtagtggtgtaaatgggttcacacttgacccatcacttggagaatttattttgactcatccagatataaagatcccccagaaagggaaaatttattcggtgaatgaggggaatgcaaaaaactgggatgaaccaacaacgaagtttgttgaggattgcaaatttccaaaagatggttcctctcctaaatctcttagatacattggaagtatggtggctgatgttcatcgaactcttctttatggtggcattttcatgtacccagctgacaagaagagcccaagtggaaaattgcgtgtactttatgaggtttttcccatgtcttttttggtggagcaagctggaggtgcggcttttactggcaaggaaagggcacttgacattattcctgccaagattcatcagcgttcgccaatctttcttggtagtcccaacgatgtggagaagataaaggcattatatgctgctgcataaggatgtagctgagaggtagcctatatagcaagctgtatatatttctacagcagctacataaaatgaggggaggcaaattatgtgctatgtatttatttataataagaggaaaatgctggggtggaaagctgaacagtctgcttgcagctttcctctctctagttttgtttataaagatgggatgaaaaggagcttgcagaattaaacaaatttgtgtaaaaaggtgcagttttaagggctt

SEQ ID NO: 2959 - DNA, 1242 bp, Trigonella foenum-graecum
tagttgattaggttcagttacgattcactctttcgttaggattggaagattgtgaagaagaagaaaaaaaataggaccacagcgcagatgcacatcgcacagacttgatgaccataacaagatttgtgttgaatgaacagtctaagcatcctgaatcacgtggagatttcaccatcttgcttaataacattgttcttggctgcaaatttgtttgttctgctgttaacaaggctggtcttgctaagctcattggacttgctggagagaccaatgttcagggtgaagaacagaagaagctggatgttctttccaatgaggttttctgcaaggctttgataagcagtggcagaacatgcatcttggtttctgaagaagatgaggatgcaatatttgtggagcctacgcagcgtggaaagtactgtgttgtttttgatccattggatggctcctccaacattgattgcggtgtttccattggaactatttttgggatatatatgatgaaagataaccatgaaccgatcatagaagatgttctgcaaccagggaagaacatgttggcagctggttattgcatgtatggaagctcttgcacgtttgtgataaccactggaagtggtgttaatggtttcaccctcgacccttctcttggcgagtttatcctaactcaccctgacattaagatccctaagaaaggcaagatttattcagtgaatgaaggaaatgccaagaactgggatggccctactgccgcttatgtggagaaatgcaagtttccaacagatggttcatcagcaaagtctctaagatatattggaagcatggtagctgatgttcatcgtacattgctatatggaggtacatttttgtaccctgcagacaaaaagagtccaaatggaaaacttcgtgtgttgtatgaagtcttcccaatgtccttcttgatggaacaggcaggagggcaggctttcaccggcaaggaaagggcacttgatttggttccaacaaagttgcatgaaagatctcccatatttcttggtagctatgatgatatcgaggaaatcaaagctctttatgctgcagaagctaaataagagaggatcatgaaaagtttccttttgtttttcactacttgcaagcatttatccaattgttaggctaacaagtgcctgtaagaattaaaacttgtttaccttatcttgtatatgctataagaaaacttgtcaatgtgattgccatagttat

SEQ ID NO: 2960 - DNA, 1372 bp, Physcomitrella patens
aatggcaggtcgctgtctgacgcggcgctgaacttcctttctcgcgttcacaattgcctccgagaggtgttcgtcgtgaagctagatctgcgaagtgaactgggaagatctcgcagccatggaccacgctgcggatgcaatgaggactgacttgatgacaattactcggcacgtgctcaatgagcagagcaaatttccagaagctcgtggtgatctcacgattctccttaacaatatcgtgcttggctgcaagtttgtttgctcgtccgttagcaaggctggattggcgaaactcatcggattggcaggagagacgaatgtacagggagaagagcagaaaaaactggatgttttgtcgaatgatgtcttcatcaacgctcttgtgagcagtggacgcaccaatgtcctcgtatctgaagagaacgaagacgcaatttttgtagagccgtccaaaagaggaagatactgcgtcgtgtttgatccacttgatggatcttccaacattgattgtggtgtatctattggaacgatttttggaatctacatgcttaaggaaggagcctcagggacggttgaggacgttttgcagcctggcactgctatgcttgctgcaggctactgtatgtatggaagctcatgcacattggtactgagcacaggtgctggggttaatggcttcaccctcgatccttcacttggggagttcatcttgacgcaccctgacatcaagattcctaagaagggaaaaatttactctgttaacgaaggaaatgccaaacactgggacggtcctacaaccaagtatgtggagaacgcaaagttccccaaggacgggtcatcgccgaagtcgttgagatacattggaagtatggtagcggacgttcacagaactcttctatacggaggtatctttatgtaccctggtgacaagaagagccccaagggaaagctcagggttctgtatgaagttttccccatgtctttcttggtagagcaagctggaggtcaatccttcactggcaagcagagatccctcgatctggtcccagctcacatccacgacagatcacccattttcttgggaagctacgatgatgttgaggagattaaggctctatatgcagctgaatctgcttaggtcaatgccgctcacctgtcagatctacagttataagaattatgtggaaaatttgctcaaaggaaaggaaattttcttcattggaagagctgaaaatctcagttatcttttttaataactgtgattatttatgagcagtgtttactgcaattgcaagagagtaaaagtctctcataatgtagtatctgttctcaaatctgaactgtgaataaattgtccacgtcttttgtccaa

SEQ ID NO: 2961 - DNA, 1628 bp, Picea glauca
agaataaataccgtgacgtggtgctccacgccagcatcatacttccccttacgcaatgtcgaagttgaataaaactacaatcagctcggctttctaaatttacagaggcacacgggctcagaccagatcagctcggctcattccatctcaataatcaaaactgggaagaatggatcacgcggcggaagcccatcgaacagacttgatgactattactcgctttgtgctgaatgaacagtccaagcatccggaagctcgcggggatttcactattctgctgagcaacatagtccttggctgcaaattcgtatgctctgctgtcagcaaggcaggacttgctaaactcattggccttgcaggagagatcaacgtgcagggagaggaacaaaaaaaattagatgtactatcaaatgaagtattcatcaaggctctcataagcagtggacgtacgagcattcttgtttctgaggagaatgagcaggcaacctttgttgagccatcaaaacgaggaaggtactgtgtagtttttgatcctcttgatgggtcctccaacattgattgtggagtatcaattggaacaatatttggaatatacctgcgcaaggatgatagtgaagggacattgaatgatgtgcttcaaccaggaaaaaacatggttgcagcaggatactgtatgtatggaagctcttgcacgcttgtcttgagtactggaactggagtaaatggttttacacttgacccctctcttggggaattcattttgactcatccagacataaaggttccaaagaaaggtaaaatctattctgtgaatgaaggcaatgcaaaaaactgggatgagcctaccaagaagtatgttgagagatgcaagtttcctgaagatggatcatctccaaagtctcttagatatattggaagcatggtagctgatgttcacagaacacttctgtatggtggcatattcatgtaccctgcagataagaagagtcccaatggaaagttacgtactctctatgaagtgtttcccatgtctttcttaatggaacaagcaggaggtcaagcctttacaggcacaggacgagcacttgatatagttccaaccactattcatcagcgttctcctatcttcctcgggagctttgaggaagttgaagagattaaatctttatatgctgctcatgaatcaaagaccttataggttcgttttccacatgtattatacctttttcatgaactggtttaagagtgaagtcgtggggtattgaacactaactattataaactcaagttcctcaagtacaagttctgttaaaagcttgtagaatatgccagctttagacagttaggtaagccattgagagtctccagtctctctaaacattgttcaaattatataatagccctttggttgttggttgcaatgaaaagcatatagagttgtaaaggattgtgtctgacaatattaatggacggtgaattttcatccatgataatagctctgttataaatctctggttctttctcccgagtaggcacttgcttgtgttaaagttggtacaaaggtaattttgaagatgtgggataactaaccttttattgttggtcatggtattagagatatatatgga

SEQ ID NO: 2962 - DNA, 1031 bp, Chrysanthemum coronarium
agcatccggaatcacgtggtgattttagtatcttgctcagtcacattgttcttggttgcaagtttgtttgtgctgctgttaataaggcgggtttggctaagctcattggacttgctggagagaccaatgtgcagggagaagagcagaagaaactggatgttctttcaaatcaagttttcgtgaaagctttggtcagcagtggcagaacatgcatacttgtttcagaagaggatgaagaggcaataattgtggaaccgtctaagcgtggaaagtattgtgttgtgttcgatccgctggatggatcctccaacattgactgcggtgtttccattggaactatctttgggatctacatgatacaaagacggtgacgatccatctctagaagatgtactccagcctggaaagaatatgttggctgctggatactgcatgtatggtagctcttgcacgtttgttttgagcactggatctggtgtgaatggttttactcttgatccatctttaggagagtttatactcacccatcccgacatcaagatcccaaagaaaggaaagatctattcggtcaatgaaggaaatgctaagaactgggatggtcccactgcaaagtttgtggaaaaatgcaagtatcccacggatggttcatcagccaaatctttaagatatattggaagtatggttgctgatgtccatcgcacattactttatgggggtgtgtttttgtaccctgctgataagaagagcccgagtggaaaactaagggttctgtatgaagtgttcccgatgtcgttcttgatggaacaagctggaggacagtcctttactggaaaggaacgggcacttgacctggttccaaagaagattcacgagcgatcccccatcttccttggaagctatgacgacgtggaagaaatcaaggcattgtatgcggctgaagagaaggcatagagagaaagagagttaagggtaattgatctcgtctccgtgttcttgtgcagtttctattcgccatttctttgtttataaaa

SEQ ID NO: 2963 - DNA, 958 bp, Silene vulgaris
ggaggcatacaagacggacctcatgaccatcacacgtcacgtgctgaacgagcagtccaagcaccctgagtcacgtggggatttcactattttgcttagtcacattgttctcggctgtaagttcgtctgctccgccgttaacaaggctggtcttgctaagctcataggacttgcaggggagactaatgttcagggcgaggagcaaaagaagctggatgttctttcaaatgaagttttgtcaaggcccttgtaagcagtggccgaacttgtatccttgtgtctgaggaggacgaggaggcaacatttgttgagccagctctacgcggaaagtattgtgtttgttttgacccattggatggatcttccaacattgattgtggtgtttctattggaactatctttgggatctactctgtcaaagatgttgacaatccaacccttgaagatgtcctgcaacctggaacggaaatggtagctgctggttactgcatgtatgggagctcttgcacgtttgtattgagctctggatctggcgtcaatggtttcactctcgatccatctcttggagaatttattttaactcacccagatatcaagattccaaagaagggaaaaatctattctgtaaatgaagaaatgcaaagaactgggacaccccaacagcaaagtatgtcgagaaatgcaagtttccaacagatggctcttcaccaaagtctcttagatacattggaagcatggttgcagatgtgcatcgaactttgctgtatggcggtatcttcatgtaccctggtgataagaagagtcctaatgggaaattaagagttctgtatgaagtttttccaatgtcattcttgatggaacaagcaggcggacaagcattcaccgggaaagatcgggcccttgacctgatcccaacgaagatacatgagcgctctccagtattccttggaagttacga

SEQ ID NO: 2964 - DNA, 1669 bp, Physcomitrella patens
ggtttctaatcaggagctcctcgcttttgtaaaagttgagcgtcgtcttttgcgtcaagcattcctctcgaggttctagtcgtgaagctagttttgtggaaggaactgtgcagatctcgtagccatggatcacgctgcggatgctatgaggacggatctaatgaccattactcggcacgtcctgaatgagcagagtagatttccagaggctcgtggcgatctcacaatcctccttaacaacatcgtgctgggctgcaagttcgtgtgctcctccgtgagcaaggctggattagctaaacttattggattggcaggagaaaccaatgtgcagggcgaggagcagaaaaagctcgatgtcttgtcgaatcatgtcttcatcaacgctctcgttagcagtggacgcacaaatgttcttgtgtctgaagaaaacgaagaagcgatttttgtagagtcctctaaaagagggagatactgcgttgtgttcgatccacttgatggatcttccaacatcgactgcggagtttctattggaacgatttttggaatctatatgctcaaggaaggagcatcaggcactgttgaggatgtgttgcagcctggcactgcaatgcttgctgctggctattgtatgtatggaagttcatgcaccttggtactgagcacaggtgcaggggttaatggattcacccttgatccctccctcggagaattcatcttgacgcaccctaatatcaagattcccaaaaagggcaagatttactctgtgaatgaaggaaatgccaaacactgggacgggcccacaacgaagtatgtggagaacgccaagtttcccaaggatgggtcatcacccaaatcattgcgatacattggaagtatggtagcagacgtccacagaactctactttacggaggtatctttatgtaccctggtgacaagaaaagccccaaaggaaagctcagagttctgtacgaggttttccccatgtctttcttggtggagcaagctgggggccaatcctttactggcaagcagcgtgctctcgaattggtcccagcacatatccatgatagatcacccattttcttgggaagctccgatgatgttgaggaaattaaggctctatatgcggctgaatctgcctagatgtatgccaaggcggcatgaaaaatgtcaccaacctgagagcgctttagttttcaaaaccgtatagaaagtatcggctcaaagccggtgaattgtaattcctttttggaggacctgacaattctcagattttttttaatttgtagttttaattacttacggaggtgtctcagtctacaatgattgtgggactgtaaagttctcacaatttgacatccgttttcgaatttaaaatgtgaaaaaactgtctaagagatctcatatagtcctaaatctatctttagttctcgacatattcatatctacagtgttgtaggaatgaatcaaaagctttctgagattacaggtgaaatctcgtcgattagaatcacaataagtttcagaagtggaattgcaccgttttgccgtttatgactcaattctatgaagattgtttcattccgtataagtagtagcatcgcaaaacgtcttatttaaatgatttgtatggagtgagcaacccagcgaacaatgaacagttgcagg

SEQ ID NO: 2965 - DNA, 1876 bp, Pinus taeda
gagccagcttacctcagaaacaactgaaaggccactgttcaaattccaagacacgtgtgttttccacttattccaagactaaataacgtgaggtggcgctccacgtcagcaccatactccactttacgcaatgtcgaagtcgaataaactacaatgcagggggctctctaaattctacagcagagtgtggaggcacacgggcacagatcagatcagctcatttcatctcaataatcgcaactgagaagaatggatcacgcggcggaagcccatcgaacagacttgatgactattacccgctttgtgctaaatgaacagtccaagcatccggaagctcgcggggatttcacaattctgctgagccacatagtccttggctgcaaattcgtatgctcttgtgtcagtaaggcaggacttgctaggctcattggtcttgcaggagaggtcaacgtgcagggagagcaacaaaaaaaattagatgtactatcgaatgaagtattcatcaaggctctcataagcagtggacgtacgagcattcttgtttctgaggaggatgagcaggcaacctttgttgagccatcaaaacgagggaggtactgtgtagtttttgatccgcttgatgggtcctccaacattgattgtggagtatccattggaacaatctttggaatatacatgcttaaggatgatagtgaagggaccttgaatgatgtgcttcagccggggaaaaaaatggttgcagcaggatactgtatgtatggaagctcttgcacgcttgtcttgagtactggtacaggagtaaatggttttacacttgacccctctcttggggaattcattttgactcatccaaacataaaggttccggagaaaggtaaaatctattctgtgaatgaaggcaatacaaaaaactgggatgagcctaccaagaagtatgttgagagatgcaagtttcctgaagatggatcatctccaaagtctcttagatatattggaagcatggtagctgatgttcacaggacgcttctgtatggtggcatattcatgtaccctgcagataagaagagtcccaacgggaaattacgtactctctatgaagtgtttcccatgtctttcttaatggagcaagcaggaggtcaagcctttacaggcacaggacgagcactggatatagttccaaccactattcatcagcgttctcctatcttccttgggagctttgaggatattgaagagattaaatctttatatgctgcttatgaagcaaagaccttctaggttcgttttccaggtacattgtacttttttcatgaactgatttaagagtacagtcatgaggtattgaagacttcaagaacatagagttcctcaagtacgagttctgttaaaagcttgtaaaagatgccagctttagacggtttggtaagctgtggagagtctccagtcttgctaaacattactcaaattataaaatagccctttggctgtcggctgcaatgaaatagagctgtaaaggattgtgtctgacaatattgttggagactgaatttttgcccatgacaatgccttcgttataaatctcacgtaccttctcccgagtaggcatttgcttatgttgaagttgatacaaaggtaattttgaggacatgggataactaacatgttactgttgttaatggtgtctgtgtatttacacacacggatttagctatattgagtatgatgtaatgacaataatttattacgtccacaggtaattctggggacataggataactaacattttaaggtatattatatataatggcaataatttattatgtctattatgttataatgtatatttgacagattaatagtgcttttgtttaaaaat

SEQ ID NO: 2966 - DNA, 950 bp, Heritiera littoralis
gagagatggattatgcagcggatgctcataggactgatttgatgacaataacacgtttcgtgttgaacgagcaatctaaacgtcccgagtctcgtggagatttcaccatcttgcttaatcacatcgttcttggttgcaagtttgtttgctctgctgttaacaaggctggccttgccaaactcatcggccttgctggggagactaatgtgcagggtgaggagcaaaagaaactggatgtgctttccaatgaagtgtttatcaaggctttagtaagcagtggcagaacatgcatccttgtctcggaagaagatgaggaggcaacatttgtggagccctccaagcgtggaaggtactgtgttgtttttgatccactggatggttcatccaacatcgactgtggagtttctattggaaccatttttgggatttacatgatcaaagatacccatgaaccaactctagatgatgtgctgcaacctgggaagcatatgttggcagctggctattgcatgtatgggagctcttgcacgcttgtgttgagcactggaggaggagttaatggattcacccttgatccatctcttggagagttcatactaactcacccagacatcaagattccaaagaaagggaagatctattcagttaatgaaggaaatgctaagaactgggatggtccgactgccaagtatgtggaaaaatgcaagttccctaaggatggttcctcttcaaagtctctgagatacattggaagcatggtggctgatgtccatcgcacactactctatgggggtatctttttgtaccctgcagataagaagagccccagtgggaagctacgtgttctctatgaggtctttccaatgtcgttcttgatggaacaagctggaggtcaggcattcactggcaagcaacgggcacttgacttggttccaacaaagattcatgag

SEQ ID NO: 2967 - DNA, 1397 bp, Podocarpus macrophillus
cgccacgtggagccgacggcttccactggacaccgataatactatcccttcaaatttgccgcttcccagctctggaatctccaatctggacacgtgtcatccacaatacttatatggcaagaagctagttgcagggttgtggtagtagccaaggaggtgtagtggaagagagaatggatcacacagcagatgcccatagaacagatttgatgaccataacaaggtttgtgctgaatgagcagtcaaagcaccctgcctcacaaggggacttcaccatcttgctcagccacattgtgctgggctgcaagtttgtttgctctgctgtcagcaaggctggtctggctaaactcattggccttgcgggagagaccaatgtgcagggcgaagagcaaaagaaattagatgttctctccaatgaggtctttgttaaggctcttgtaagcagtggacgaacttgcatacttgtttcagaggaggatgaactggccacatttgtggagccttcgttgaggggaaagtattgtgtagtttttgatccacttgatggctcttccaacattgactgtggagtatcgattggaacgatttttggaatataccagatgaaggatggaggtgaacctacattggcagatgttctgcaaccaggcaaaaacatggctgcagcaggctactgtatgtatggaagctcttgcacgcttgtcctgagcactgggactggagtaaatggctttacacttgacccctcccttggagaattcattttgactcatccagacataaagattccaaagaaagggaatatatattcagtgaatgaaggcaatgcaaagaactgggatgatcctacaaggaagtatgtcgagagatgtaaatttcccaaggatggatcatcctccaaatctctcagatatattggaaggaagtacgttgcccttattgtggaacttgtgcctatatcacctgttgtgcagtatggtagctgatgttcacagaacccttctttatggaggtgttttcatgtacccagcagataagaagagtcctaatggaaaattacgtgtactgtatgaagtatttccaatgtctttcttaatggagcaagcaggggggcaagccttcactggaaaaaacgagcactagacattgttccatccaagattcatgaacgttcatcaatcttccttgggagttatgatgatatggaggagataaaagctttatatgctgaagaggaacaaaaggactgatactggttggctgcttgtttagcagttatattgtatttgtaatctgtttatgctctactatcaatgattcataacaaacaaaattgcattaatagaagtcctatccatcttgcaaacaaaatgtttcattatattttattagtttaa

SEQ ID NO: 2968 - DNA, 1132 bp, Cedrus atlantica
gatcagatcagctcggctcagcgcatacaatctcaataatcacaactgggaagaatgaatcacgcggcggaagcccatcgaacagacttattgactattaccagctttgtgctgaatgaacagtccaagcatcccgaagctcgcggggatttcacaattctgctgagccacattgttctgggctgcaaattcgtctgctctgctgtcagcaaggcaggactcgctaagctcattggtcttgcaggagaggtcaacgtgcagggagaggaacaaaaaaattagatgtcctatcaaatgaagtattcatcaaggctctcataagcagtggacgtacgagcattcttgtttctgaggaggatgaacaggcaacatttgtcgagccatcaaaacgaggaaggtactgtgtagtttttgatccgcttgatgggtcttccaacattgattgtggagtatcaattggaacaatctttggaatatacatgctcaaggatgatagtgaagggaccttgaatgatgtgcttgagccaggaaaaacatggttgcagcaggatactgtatgtatggaagctcatgcacgcttgtcttgagtactggaaccggagtgaatggttttacactcgacccctctcttggggaattcattttgactcatccagacataaaggttccaaagaaaggtaaaatctattcagtgaatgaaggcaatgcaagaaactgggatgagcctaccaagaagtacgttgagaaatgcaagtttcctgaagatggatcatctccaaagtctcttagatatattggaagcatggtagctgacgttcacagaacacttctatatggtggcatattcatgtaccctgcagataagaagagtcccagtgggaagttacgtacactatatgaagtgtttcccatgtctttcttaatggagcaagcaggaggtcaagcctttacagggacaggacgagcacttgatatagttccaaccactattcatcaacgttctcctatcttccttgggagctttgacgaagtagaagagattaaatctttatatgctgttcatgaaacaaaaaccttatagattcttagttttccacttgtattctacctttttcatgaactggtttaagag

SEQ ID NO: 2969 - DNA, 1039 bp, Ananas comosus
cctcattttggttctctctccagctggctggcttagagtaagagattttgattgagaggagatcgtagccgttgagagatggatcacgaggcagatgcttaccggacggatttgatgacgatcacgcggttcgtgttgaacgagcagtcaaagttccccgagtcacgcggggacttcaccatattgatgagccacattgtcctcggatgcaagttcgttcacgccgccgtcaacaaggccggtcttgctaagcttcttggacttgcgggtgaaaccaacatccagggcgaggagcaaaagaaactggatgtgctttcaaatgaagttttcgtcaaggccttggtcagcagtgggcgaacaagtatccttgtatcggaagaagatgaggaggcgacatttgttgatccatctattcgtggaaggtactgtgtcgtctttgatccgctggatggatcctctaacattgattgtggagtttcgattggaacaatctttgggatttatatgatcaaagatagcagagaaccaacattggatgacgtgctgcagccagggaaaaatatgattgccgcaggatattgcatgtacggaagctcttgcacgcttgttttaagcgcgggaagtggggttaatggatttaccctcgatccatctctcggagaatttatactgactcatgcagatattaagattccgaataaaggaaagatatattctgtaaacgaaggaaatgccaagaactgggacgagccaactgcaaagtatgtgcaaaaatgcaagttccctgaagatggatctccggccaagtccttaagatacatcggaagcatggtggctgatgtccaccggactttactttatggtggcatctttttgtaccctggtgacaagaaaagccccagtgggaaactgagggttctttatgaagtctttccgatgtcgttcctgatggaacaagctggagggcaggcctttacggggaaagaaagggcacttgacatggttccgaagaagatccacgagaggtctcctatatttc

SEQ ID NO: 2970 - DNA, 1554 bp, Glycine max
attttcttttccttctcactcaaagctatgctatgagaataattcatccataacataacagcttggtacccatgtgtcattcctatcatttcgttgacaaaactttcatatccccgaaattctctctttttccactgttccctaggaaatatttattctcatcttcatcctctacacaacacctaagaaggacaagagggaactcataatttataaaaagaacattgagaaagagagaagggaagaagaatggaccaccaagctgacactaacagaactgatttgatgactatcacacgctttgttctgaatgaacagtcaaagtatcccgaatcacgtggcgatttcaccatccttctcagtcacattgttcttggctgcaaattcgtttgttctgctgttaacaaggcgggattggcgaaactcataggacttgctggagagaccaatgttcaaggtgaggagcaaaagaaattggatgtgctttcaaatgaagtatttgtgaaagccttaatcagcagtggacgcacatgccttcttgtttctgaagaggttgaagaggctatatttgtgccatcatcacatcgtggcaaatacattgttgtgtttgaccctctggatggatcctcaaacattgactgcggggtttctattggaactatctttggtatttacatggtgaagaatgaggctgaagtaagtcttgaagatgcattgcaacctgggaaccaaatgttagcagctggttactgcatgtatggaagctcttgcacgttcgtgcttagcacagaaaatggagtgaatggttttacacttgatcctagccttggggagttcatattgactcacccaaacatcaagataccaagtaaaggaaagatttattcggtgaatgaaggaaatgccagaaactgggatgaaccaaccactaaatatgtacaaatgtgcaagtttcctcaggatggttcaccaccaaagtctcttaggtacataggaagtatggttgctgatatccatcgaactttgctttatggtggtatcttcatgtacccagctgatgcaaagagtccaaacggaaagctacggcttctctatgaagtctttccaatgtcatacttgatggagcaagcaggaggtcaggctttcacaggaaaacaacgggctcttgatttgattccaaaaaaaatacatgaacgatcaccagtattccttggcagctacgatgacatcgagcaaatgaaagagctttatgctgcatccaaagaagatgatgcatgaatattgtctttgaatctcagtatatactatttcttgagctcttggctgttaattgggtaggacaacttttgtttaggtggaacattgtgtttatttgaaaatagttatacagaaaagaaaaaggtgaatgggattattttctttaatttacaacattattaagttgcaattataggtcgaaaatcattcaatgtgcaaaagaatagaaaaaatcttgcacgacgcagcacaacattaaaaatccttagccatagttatgacaatccctttatttag

SEQ ID NO: 2971 - DNA, 1067 bp, Flaveria ramosissima
gaacagtcgaagcatccggagtcgcgtggggagtttctagtattttgctcagtcatattgttcttggatgcaagtttgtttgtgctgctgttaataaggcaggtttggcaaaactcattggacttgctggagagactaatgtgcagggagaagaacagaagaaactggatgttttgtcaaatgaagtctttgtgaaggctttggtcagcagtggcagaacatgcatacttgtttctgaagaggatgaggaagcgataatcgtagaaccatccaagcgtggaaagtattgtgttgttttcgatccgttggatggatcttccaacattgactgtggtgtttccataggaactatttttgggatttacatgataaaagatagtgatgcggcccgtttggaagatgttcttcagcctggaaagaatatgctggctgctggatactgcatgtatggcagctcttgcacgcttgtgttaagcactggatctggtgtgaatggatttactcttgatccatctttaggggagtttatacttacccaccctgacattaagattccaaagaaaggaaagatttattctgtgaatgaaggaaatgctaagaactgggatggtcctactgcaaagtttgtggaaaaatgcaagtttcccaaggatggctcacctgcaaaatctctaagatatattggaagtatggttgctgatgttcaccgcaccttactttacgggggcgtgttcttgtaccccgctgataagaaaagcccaaatggaaaactaagggttctctatgaagtctttccaatgtcattcttgatggaacaagctggaggacaggcgtttaccggcaaagaacgggctcttgacttggtccccaagaagatccatgatcgatctccgatattcttgggaagctatgatgacgtggaagagatcaaggcattgtatgcagctgaagaaaaggcataaacaacggttgttcttgtgcagttgtatttcccttttattcagctcttatataagttaatttttattacaatttgatgaaaataatgtgtttaatatgtgtatatt
